United States Patent 9,328,346 (POLYCOMB-ASSOCIATED NON-CODING RNAS) - sequence listing, part 126

SEQ ID NO: 191455 - RNA, 301081 nt, Homo sapiens
gaggugcgcgcgcccgcgccgaugugugugagugcguguccugcucgcuccauguugccgccucucccgguaccugcugcugcucccggggcugcgggaaaugcgagaggcugagccggggaggaggaacccgagcagcagcggcggcggcggcggccgcggcggcgggagccccccaggaggaggaccgggauccaugugucuuuccuggugacuaggaugucgucggaggaggacaagagcguggagcagccgcagccgccgccaccaccccccgaggagccuggagccccggccccgagccccgcagccgcagacaaaagaccucggggccggccucgcaaagauggcgcuuccccuuuccagagagccagaaagaaguaaguugagugcgagggagccaggccgggagccagcggcggcgccgggccggagcugucaccgggcgcccgccccgcggccuccgcgccccggcgccccccggcggggugggggcggggcgggcccgcgggcgguggcggcucccggccccggccccgcgccccucgguagccgcccgcgcccggccucccccgcuccgcgccgcccgcccgggcucccgccggcgcccggcuccgcacacuuuacuuuucagucgggccuuuucacugggucuucuccgcgacucuucuuuuggagaaauuucucguagccgcgucuuggccuagcuggaucauugagaaaacaagcccggagcgcgcccagguaguccccggacggacuccgggcgaaccgccgagccgucggcgcucgggaaacucucggagcugucaaaacgcccgggccagguggucucggggcgcgggcugggggcgagaagaaagcggccgggcgagugcagcuuuuguuugucagcgacuugcuccuggaacuuuuccuggucccaaaccuguguuuucuucuuuugaugauauauuaggaagccauuugacuucuuccuccccccucccccaacacccagcaccgcacucccgggcuccgaaagcacaaguccugugggaucccccagcuucggggaacggccugccuaaguuuuggagacguagccagcguccccucguaaggcagaauaccaagagcacuuauucggagagagugcagauguaaaugucgcuucccucguaagucuuagcuguaaggggcuugggaauagggucgccugccuuugagcguacaguagggcuggaccccagcuuauuagaggaccagaaaugucuucuuacagaacgguuauuugacggcuuugcuuguaaauuaagacaccguuuuagugccagcgaacugcucggcuucuguggcucucgcgugugccguggaagaacugugaaugucucucgaaguuguagaauggcgugugugcuuacucauuucgugagaugauauucucauugaacugucgggaguggaagggugcgcugggacgugaaggaagccagcacguuuauggauaggcuguuucuuugguucgggugcauucacuuaguaauaguauuguuguuuggugauuuguaguaaaaauaguagcgugaacugaggcauagcagagcuggguugugggaacccauugagcucuugacuugaaugugcucuuuucuugccccgcuguccuuuuacuaugaaaaugauucagggccuucaacuugccuccauauuuuauugccagcuguuaccuagcuaugauaaucgugagggaagcaaguacaggauguguguacauuauuacauuagcuuguucgugauacaaaguuaggacuuauuuauuaugccacuugcguuguaauacaguggcaaguauaaaaugcccuuauucuguauuaacugaaauuuguagaaggaaguggagguuuaaguaauuuuuagacauguaagccacuuuuuuuugcauccuuuaaagcaacucaggacaagccauauugggguuuuaccuugauugccucccauuucacuauuugcaaagcauuucuucaucucuuacugaacauuaauuugcaaguauuguuuuaaauuugcauuugaauucuuacuccagaaagauuagaucuauguugucacaccccacaccccauacuccuguaagggcgugcuugugcacgcgcacacgcgcacacucacacgcacgcgcacacucgcacacacccuacuuuugaaaugagcucauuuguauuagugcagcuccugagugcacuggacgauuaggguauugccacuuuauuauuuuaauucugaaucucaugaagaaauaggcagccuuuggagaagauaaaaaauuucugcugaauaacaguauaaucuaacuaugaaaaaucaaaacuuuuggaaauauuuagaacaaauguaagucuguagagagcuuuuucuuuuagauuugaaaacuaguacugcuuucuuuauaggaaauuaaagucuacugguaaauuugacgggucuaaacuuuuuagagcguuuuuuuugaaauugugucuuuugaagggaauggaaucuccaguuguuuuuagcaacauguaaauggaaacuaacauaugaauuggaaagcaaagagguuuuugaauuguguaucucuauacuguauaagaauccaugcagaaaagacccuguaguuggacaguaaagacccugaaagugaaacuuauguguaaccaguguaaauuagguuuguaaccagugaaauuaugugaaauugcaaauaauucaccugagaaaugaaaauuaaucuucuuugcuaaaucucauagagauauuuuaaguugcuaauguuacuuagauguucauuaacuuagugaguuacauuaaguagagaagaugccuuuuuuuuuuuuuucuggacgaagucuugcucuguagcccaggcuguagugcagugguaugaucucggcucaccgcaaccucugccucguguauucaagcgauucuccuuccucagccuccagaguagcugggauuacaggugugcgccaucgcaccuagcuaauuuuuuguauuuuuaguagacacaggguuucaccauguuggccaggcuggucuugaacccccgaccucagguaauccacucuccucagccucccaaagugccaggauuacaggcgugagccaccgcaccccgcugagaagaugccuuuugacaaugaaguggauuuauguauuuaucuuuggcuuaaaaaaacaugcaccaccaauuacacuuuccucaaguuuaaauuuuuaauaauuagguaaauaaagcauuuucuugucuuauaguguuagcuagauuguuuuuguguauuuugucaugaauaaaaagcauagcuauauaguuacugcuuuuacauuaacuauaaauaucuuaaaauuuuacuaccuaaaaucaagaaacuugaacugaagcuauuaaucuuagaguuggaaaaguaaauacauagagguuuccuauuguacaaaugucaaguggcacagugaaauuuacauucauuugaaaguuuuccuuaacuguaaaaaguaucaaauuauuugauaauuuggaguaguucaucaucuuuaucagaggcacaggucuuaaccauuggcaggccucugucagaauaugcacauauuaaagaucucauuauuuuuguguuaauguuaaaaaauuuuucugaagcuuuuuucuuauuuuuuccauccuuacacuguaaauucacauuaccaaguugggaagccaaagaaacauucuacucuacuauguuucuuaccaguucaugaaaguugauguuagaaaugggugugggugugggggaugggggugguuguacagaagcagcaggugguagguauaggauuucugaagcacuauccuuggccuuuuuugaguaaacucuuuauacccugaaccacuuucuuuucagagggcaauugcuauuauuagagagccaccuuaagcauuauuguuguagaaaaauuaggcacaaccagugauugucauuacaaggaccagcaaaaauggcuagguugcuacucuguauuuguaacgcccuucccccaacaaaauuucuccuuuucauagcugugaauuugaaauaagugauagaaaacuguacugcauuacaauauauaccauuuaauaaaacaaguuuauaguugagagacagcacuauuauucaugcuuuuugagauaaugcaaauuuguaauuuuuaugacagcaauucuuaauaauuuauuguccaagagaucugauaaaauuuuugauauuauuggucucugggacucaauaggcacugaaauguuuuaauucaguugaaaaguugacucaggauugcuacccucucuuaccuguuaggagguuguuguuuaaccugaccugaaauucccaugaauaagaaccuguuuuuuuucuuuuuuuuuuuuuuugacagagucuugcucugccgcccaggcuggagugcaguggugcgaucuuggcucgcugcaacuuccgccucccagguucaagugauucuccugucucagccucccaaguagcuggaguagcugggacugcaggcacguacuaccaugccugacuaauuuuuguauuuuuaguagagacgggguuucacccuguuagccaggauggucucaaucucuugaccucaugaucugccugccugggccucccaaagugcugggauuacagacaugaaacaccgcaccuggcccagggaauuucuaauauuugagaagauguuauuuuuagucuauuauacaaauuuauauauuguuuacuaauauauaaauuuacauauuaguuacuaauauguaaacuuaccaauuuacauauugguuacuaauauguaaacuugauaaacauggauuuccauggaaauauaaaaguaucacaacaauuuguuuucccauucugacacuugugauuuauuacauuuucguacuauuucaguuaauuccauaaugccagaauuguuguuaaucugccaagugacaagccacacugcuucaucucauuccucuguuccgcaaaacugcaaaguuucccagaccacagucagguuucucuggguagauagugguuguccaacucuguaaacuuaagucacuuuaaguuuaugauggaggggcuucgugaaacuucauugaccuuccaaggugaaaauuggucaguuuccaguuauaaaggacauuaaggaugggugugguggcugauauauguaaucccagcacuuuugggagacugagucaggaggaucacuuaauccucauuuaaaaggaguuugagaccagccugggcaacaaagugaggccuugucucuacaaaaaaauuagcuggguguggugguaggcaccuguagucccaacuacucuggagacugagcugagagaagauugugugaggcuuggagguugaggcugcagugaacggacaucacaccacuacacucuagucaggugacagagcaagacucucuaaauaaauaggaacauuagauggucucucugcacucuugccugguggggacguguuagauacccucguuagguugugauuuaguuuuuaaucugugagauguuugggccaaacaacuuuuagcugccauggaauaaacuuuacagucagcgugugaguuuguguuugccuuuacuuuuuuuuuucuauauuguuuugguccauuuuuaucuuuuaauuucagaaagcugauuaaucucuuccuuuucucuuuaaaaauuuucuuuaucauguuugugcuacagugguuauuuugagaacuuguuggcaggauaaguggcaaaaguuacgaaguagaauagagaugauuucuguuuuuuuuuuuuuuucuuuuuuuugagacagucucacucucuugccuaggcuggagugcaguggcgugauccuggcucacuguggcugccgcccuccggauucaagcgauucgccugacucagccucccaaaaagcugggauuacaggcgcaugccaccacacccagcuaauuuuuguguuuuuaguagagauggguguucaccauguuggccaggcuggucucagacuccugaccucaggugaucugccugccucggcacucccaaagugcugggauuacagacgugagccaccacgcccggcugagauuauuucuuuuuuuauuauagcuauugcuuguagauauaugcuggugguuaucugugaaaauguaauagaaaggcugggcacgguggcucacaccuguaaucccagcacuuugggaggcugaggugggcggaucacaaggucaggagugggagaccagccuggccaauauggugaaaccccgucucuaccaaaaauacaaaaauuagcugggcgugguggcaggcaccuauagucccagugacucgggaggcugaggcaggagaaucgcuugaacccaggaggcagagguugcagugagcugagaucaugcuauugcacaccagccugggcgacagagugagacucugucucaaaaagaaaaaaaaaaaaguaauagaccaaucuuggauuuauaauuggaaguguugaucccuuuauuugcagaauuugaaggacuuaagagcacaaguugagagaaacaaaugacacagcucuuuuugcacuuuguaauauucuagaaaaagccucagguaaaaggaaaauuguuucacuuuguuucugcuguuaauuuugugauggcaguaacuacauaugaucuacaaguguaaaauuguuuaacaagucuuaaguuuucuauacuucuauguaacuuuuuagaucuuucauuugguacauguuauuuaaagagcuacaaagugcuaaauauguccugggaugaacagucaacccuggaagauuuauuguggccuagaggggugcucaaagauuuggaggaaguaguauuugaauuagaccuugaaggauuggugggauuuagccaaguagaaugacaagaaaaugagugugugagggagcaaugugaaugaaauuauugagggaaggagguguaaaaggugggguggcuucugacugugugacuagaacagaggcuguguguaguggugaggccaagcugugauaguucuugaaugccagacucaugaguuugggcuuuauccuguaguccaggaguuauaaacuguuuacagggagcagguaagcaauuuaaaugaacaguaggcugcuucuaagaaucugaaugacaacugacacuuuagaccuuggguuggggagaaaaugggaaauaauaacagccuuggggaagucuaggaguccuuaugcccugcuuaaggugaaacugauacagaauucuggcugaugguugcuauuugagaugcuguuucuagauuuuucaagagggcggaaauuuggauuuuuaugauuuuuuuuuuucuuuuuugagauggaguuuuacucuuguugcccaggcuagagugcaauggugugaucucggcucacugcaaccucugccucccggguacaagugauucuccuuccuuagccuccugaguagccaggauuacaggcacccaccaccaugcccggcuaguuuuuuuuuuuuuuuuuuuuuuuguauuuuuaguagagacgggguuucaccauguuggccaggcuggucucgaacuccugaccucaggugauccaccugccucagccucccaaaaugaugggauuacaggcaugagccaccgcacccagcccuuuuuaugauuuuuaaacuuggauuuuaaguguuuuucauuaauuagaaucuaaaacgguauuugcgccuauacuuuguaggcuagguuuaaucugcggaccaccaggggacuacaggucucaaucucugcuuuaugcccaguuauuuuauuuuuuaaaugaaaguuuucaaagcagguauuuacaguauucuugaggauaggaaccuuacuaaauuacuuuguauucuguuuagcauuuaugcauuugaauguaggcacucaaauacuuggugauuuaaugaugccuauuauuaaaaaaacacugugguaauaauauggagacaggaguuaccuggaggcagagauaauaggcuguuacaauaguuguagugugagagaucaagccaaagcauagaauguugguagugcgaauggggaggaagauuccagucacugcaaaggaggaauucggcaguuucuggcauagauguuguagcaggcauccaaauagauuggaugccugcuaagcauucggggaaguaggacuggaguugaggaaucgauuaggauaaguauuuaaagaugugacuuaacauguaaucacugagaauauggcguaugggaauuaguaaaggauuaggaugcuuuguugcccuuaggagauaggggaccaguuauacccggaaaaacaagaaaggaaaucagaauauauucucaugacaaauggacaacauauacauacaagaugcucauggcagcaguauuaguaguagagaaaaguuggcaacaacaaaauaugcaucaauggacuaccaugcaguuuuaaaucaagacauagagauagaucugugggcccugaagugggagaaugucuaugauacauuguugaacuagagaaaaaccuuuccaaaaguuguaaagcaguaaguuuagcaguaacuuuauuuugugaaaagcacauaaacccaaacuguguguauauuuugugcauauaaaaagauugggaagaauacauaauaaauauuaauacucugggggccgggcgcaguggcuaacgccuguaaucccagcacuuugggaggccaggagggugagucacgaggucaggaguucaagaccagccuggccaagauggugaaaccccgucucuacuaaaacuacaaaaauuagccagucaugguggcaggcgccuguaaucccagcuacucgggaggcugaggcaggagaauugcuugaaccuggguggcagaguuugcagugagcugaaaucgugccauugcacuccagccugggcgacagagugagacucugucucaaaaacaaaacaaaacaaaacaaaaaaaaacucuggggaguauauucuuucaguauacauuuaugcauuuaaaaaaagaaaaaagcuuaauacuucagaaaugguaaaucauuugacaaaugagaaaaccaaauucugggggcaucacugauuauagagccuagaccuucuggauucaagucuagguuguacuacauauuagcuguuugaccuugggcaaguuacuuaaauuuuuugugcuaugguugccucaccuguagagaggacguaauaauacaccuaauuuaggauuguuaugaauuuauauauauguguagaauuuagaacaguuucuggcauagacuaaguccuauuaagaggugcuguuguaaggauuuaacuacuguuguuacugucauugccacuaaucaucaauuaucaaucaguugccuguuauaaacuauuuagagacagaagugauuagaaaccaaacucacuccaaaaaugccaugauauaaggcuggguauguuggcucacaccuguaaucccagugcuuugggaagcaaaggugggaggauugcuuaagucuaggcguuagagaccagccugggcaacauagugagauccccaucucuacaaaaaauuaaaaauagcuggaugcggugguaugcacuuguagcuccaguuacuugggaggcugagaugggaggauugcuugagcccaggaguuggaggcuacagugagcugugaucaugccacugcacuccagccugggugacagagcgagacccuaucucccaaaaaaaaaaaaaaaaaaaaaaacuaugacauaaaauaaugcaguuguuauuggaggcggggauagugggguggcaaagauuuucuuuguacgcagauguccccaauauauagaagaaagauuuuuaaaaagcuaggucagcagaaaucucuaugaaauguuuuucauuaugagcaauacacgaaaaacagucaaagcaauucccuaggaguuguauauguaguaauauuauuccaaaguuuuuuauugcucaaacuuuuaaauguuguuagaguagauuuuuacauauuauaacucuacuggcuaggguuuuauuaguaggccucccucagugagacuuguuuuaggugguuuuaaaaugauuucuuacaucuuuuauccuuggucacuuuaaaucuuuacaccuuauuguaaucgauuuacauuagaagcagcauacuugauggucucagugaagucuguguggugguguucuuuuaguggagccuagcaaaaaaagaauuuccuugauuuccugaucuuugggauucuagucauauggaccacauuuggaauaagcacauaguugaauauaaaaugacaaaaugaaacauaaccauauucuuaaaguucucauugaauuguucuaccauaguugaaguguuuggucaguauggccaaguguuuguuuguuuuugagacggaguuucgcucuugucacccuggcuggagugcaguggcacgaucucggcuuacugcaaccuaugccucccugguuccagcgauucuccuuccucagaccccggaguagcugagaguacaggcgccccuccaccacgccuggcuaauuuuucuauuuuuaauggagaugggguuucaccauguuggccaggcuggucucgaacuucugaccucaggugauccacccaccuuggccuuccaaagugcagggauuacuggugugagccacugugccuggcccuaaguguuucuuauauuagacuuucauacuuauagaguuguagaauauuagaacuauuaauagaugagaauucaagaagauugagucuaaccccucauuuuauagauaacugagccccagagagauuauggaauacuagaagucauauauuaagguguuacuuuuacaguaaauaaaggagaugguagucuacuguauugguguagacccauaguaaaucaugccuauggguauucaugcuauuguauagucaucucucuuuguaucucgccuagcccugugacucacuuuaaccaguagaacauagcaaaaaugacacuuugcuauuuuuggguacaagccuugagcaugucaggcagcuucuacuuuuguacucuugggagcucugaguugcugccgugcaagaagcugucauaccuugcuggagagaugauguggagaggaagagauuccaggacuauauggaaagagggaggcuuaacuaucucaguguccuagcugccuucagcccuuaguugacuugccuguugaauacagacacaaaagugauuaguaagauuagcgaaggggccggcgugggggcuuaugacugugcagucccagcacucugggaggccaaggcauguggaacacuugagcccaggaguucaagaccagcccgggcaauauagcaagacacugucucuacaaaaaaauacagaaauuagcugagugugguggcaugucucuguaguccuagcuacuuaggaggcugaggugggaggauuggucaagcccaggagggugaggcugcagugaaccauuaucuugccauugcacucaagccugggcgacagagugaaaccuuguuucucucucucacacacaaaaaaaagauuaacagaggaaccaccuagcuaagcucaguccagguuacgaaaucauaaauaaguaaaaugcugguuguuuuaaucuguuuugcuggaagcagauaguuuucugaauuaagggacgcuaagaacaaagaguauuuggagcugggugugguaguacaugccuuuagucccagcuacuuaggagguugaggugggaggaucacuugagcagaggaguuggaggcugcagugagcuaugauccugcaacugcaccccacccagccugggugacagaacaauacccggucucagaaaaaaaaaaugcauuugggauacgagugauaaaaaucauuauuuuccauccucuuuuacugaaauaguuaaaugaaguuucuccuuaaccuuacccuuuauuuuucuaaaguauuuugaaauacagauuuuuauuauugaggacuuuaaauaguauuuaaaaauggaauugucacaguguagauugggcuauaguuaggucauacagaauagaaagauaaaacaauuaugaauaucaacccuaaaaaggauauaguuuauuuauuuauuuauuuuuguugacuuguacagagaucuuuauauauuugagcauccuggacucuugacagaagaacugauuucuauuucugggccaauucuuaacagccggguauaucaguaaggacuagguuugucuuuaugugauugaaaaccccguaauaauaaugacuugaacaggaguguuuauuucuguuucacuucaaaaucuggaggguagguacugaggcugguauugucccucuacacugcaaagucaucaggagugucucccuuuaucuaacuucucagacauuucuagguuguggccuuugcccuaagauuccuugauggcuacuaaagucccaauuacauuacaugcaugucccaugaagcaaaauacagaaaggaguccaagggcacacagccuccuccuuugaagaaauauuguauguuuucucuuacauauaauuggcuagaacuaucacagaguucacauggcuaccuguagcugcaagggaggcugggaauguaguuuguuuguuuucugagacagagucucgcucugucaugcaggcuggagugcaaugacaugauuuuggcucacugcaaccuccgccucccgaguucaagcgauucuccugccuuagccucccaaguagcugggauuacaggcaugcaccaccaagccuggcuaauuuuuguauuuuuaguagagacaggguuucaccauguuggucagguugguacgaacuccugaccucuggugauccaccugcuuuggccucccaaaguuuuggaauuacaggcgugagccaccgcacccggcugggaauguaguuuuuuuuucuuuuuuucuuuuuuuuuuuuugagaugagagucucgcucuguugcccaggcuggagugcauuggugugaucuuggcucacuguaagcuccgccucccggguucaugccauucuccugccuccaccuccugaguagcugggacuacaggccaccaugccuggcuaauuuuuuguauuuuuauuagagacgggguuucaccguguuagccagguugaucuugaucuccugaccucgugaucugccugccuuggccuuccaaagugcugagauuacaggcgugagccacugcgccugguugggaauguaguuuuuuuagaugaguaccuugcuacuuagaauagguucaaagucugguuacugauggugggaauaaauauuacagaaauagcuaguaaauagucuuuaccacuuugagcaauugguuuaucaccauaggccuaauuuucucaugugugagaauuaugauacugaaguucuugcgauggcagauaauuucauguugaggcccgguugauugguagugacugcuuucaacaaugcuuuguugaauccugagcccccaggguuuucuuuuuuuuucuuuuugagacagagucuugcucugucgcguggcuggagugcagugaugcgaucuuggcucacugcaaccuccgccuccuggguucaagcgauucucgugccucagccucccuaguagcugugauuacaggcaucugccaccacgccuggcuaauuuuuuuuuuuuuuuuuuuuuaguagagacuggguuuugccguguuggccaggcuggucucgaaauacugaccucaggugauccacuugccuuguccucccaaagugcugggauuacaggugugagccacugcgcccagcccuaagccuccaguuuuugaccucagcauggugaggaaguaguagaaguauguauuuugggugaagaggagaguaaaagcaugcucccauuuauaugcuaacgcugugcuuuuuaaaaaugugguuacuucaacuuuuguaaucuuuucauugaaaacauuugguuauucugcuaaccuuugacuauucucuuuaaaaauguccuacauucauuccauauuuuaaaguuuucuaauaaaccugaguucccacuuguuuuuuuuccuuccagcuuuuauuuuagguucagggguuacaugcacagauuuguuaacaugggcacauugcgugucgcugaggcuuagagcacaaaucauuuugucacucagauagugagcauaguacccaguagguaguuuuuggauccucaacuuccucccagccuccacccucgaguaagccuuggugucucuugguccccucuguguccacauguacuuaguguuuagcucccacuuggaaguuagaacacacaguauuuggcuuucuguuaauuaauucgcuuacgaauaauggccuccaacugcauccaugcuguugcaaaggaucauuucauucuuuuuuuauggcugcacaguauucugucucguauauguaccauguuuucuuuauccaguccgcuguugaugggcaguuagguugauuccaugucuuugcuguugugcaaaguccugugaugaacauauguguaugugugucuuuaugguagaacgauuucuauuaauuuggguauauauccaguaaugggauaccuggauugaaugguaguucucaguucuuugagaaauccccaaagugcuuuugacaguggcugaacuaauuaacauucccacuagcaguguauaagccuucccuuuucucuacaaccuugccaacauguuuuuuuugugugugacuuuuuaaucauagccauucugacuugugugagaugguaucucauugugguuuugauuugcauuucucuaaugauaagugauguugagcauuuuuucauaugcuuguuggccacauaugucuucuuuugagaagugucuguucaugcccuuugcccauuuuuaaaugggguuguuuuuugcuuguuuuuuuuuuauuauaaacuauuuuuuuauuauacuuuaaauucuaggguacaugugcacaacuugcagguuuguuacauauguauacaaggugccauguuggugugcugcacccauuaacuugucauuuacauuaaguauaucuccuaaugcuaguuuuuugcuuguugauuuaaguuccuuacagauucuguauauuaggccuuuuuuuuuuugagauggagucucuuucuguuacagucuggagugcaguggugcgaucucagcucacugcaaccugugccucccggguucaagcaauucuccugccucagcuucccgaguagcugggacuacaggcgugcaccaccgcacccagcuaauuuuuguauuuuuaguagagaugggguuucaccauguuggccagaauggucucgaucuccugaccuugugauccacccaccucggccucccaaaguucugggauuacaggugugagccacugagccaggccaggccuuuguugaaugcauaguuugcagauauuuucucccguucuguagguugucuguuuacucuguugauaaucucuuuugcugugcagaaguucccgcuuugugcagaacauuccaaacacuggagauagggaugaugcagauaaauacuaaacuccuuuaauguguauaucagaauauacagaauauguuacggugacaaaggaucccaauucuuaguggcaucagucacaaagguucauuucuugcucaugcuauguguucaucacagaucgguguggguguuagauuauaggugacuuaaaaucucuuccuuucaaaguacauuucugaagcaugguuuauucuuagucagauuugcuuuuccuauuuguucucuguuaaucacccaaggaggauguuaggcaaaaucaaauacugagaaucugcuguguauuauacaguggagagaccaaaauaaggcaagaucccuaccuucaauuucugguaacucagugcaaaguauaaugcaaaugacacauuuuacaauagauuucagaaagugcugaggaagcuuagagaaggaagaacuuaucucagaggaacugaagaaagaagacaucuuuguugaguguuuaaaaaugaaaacagacuuuaccgaagagaaaaaggggagugagaaacuaguaccuggcuauuauguguuaggcacuacuagugcuuaccagaaguuaccuuuuugauaauuacugaucacaugggguugaaucauuaguacguuuuacaaaugaaagaugaauuuuuauauagcuuguaagugauugagucaggauuugaauccaggugugucugacccugaccuuugcuuuuuaagagacuacaguccaauaugggaggaaaugaggaagggaaaguaaauugggcauuuugaauauuaacuguaaacaauagggagccauugaagauguuaaacagagguaugacauuguaucuguguuagaaaaauaaccggcaacaacuguaaaacuggaacuaaugauuuuuugcaugugauuaaguaucaaaugaaguauaauuucugaucuccuuuaauuuguuuguaguauuuuauaauuuucaaugcacaggucuuguacuuuuuuuguuaaauugauuccuaaguauuucauuguuuuugauguuguuauaaauguaaauguuuucuuucccccacuuuuuuuuuuggagacagagucucgcucuguugcccaggcuggagcccaguggcaugaucucggcucacugcaaucuccgccucccgaguucaagugauucuccugccucagccuccugaguagcugggauuacaggcgucugccaccaugcccggcuaauuuuuuguauuuuuaguagagaugggcuuccaccauguuggccaggcuggucucaaacuccugaccuugugauccaccugccuuggccucccaaaaugcugggauuacagacaugagccaccaugcccagucuauuuuuuuucuuuuaaaugaaaaacaaaucuuuuuauguagggacagucgucucacuaugucacccaggcuggucucaaacuccuaggcucaagugauccucccaccuuggccuuucaaagugccgaaauuauagacaucagcuaccacacccagccugaccuauucucuuucaaacuuuuuucauauacacaguuuuuuuuuuuuugugauacuacuuauguacauuuagaguuuuguaaccuacuuucccuuguaacauguaaaagaaaauuuccguauuguuaaucuuuuauaacauuuuugaagggugcuuaauuuuccauugaguaaaacugagggcugagugcugucgcucacgacuguaaucccagcccuuugggaggcugaggcaggcauaucacaaggucaggaguucgagaccagccuggccaacauagugaaacccccucuguacuaaaaauacaaaaauuagccaggugugguggcaugcgccuguagucuucagcugcucaggaggcugaggcaggagaaucgcuggaauccgggagguggagguugcagugagccaagaccacaccauugcacuccagccugggcgacagagcgagacucugucucaaaacaacaacaaaaaacugaguaaccacacuauaauuuauguaaccauacagcugucuccccuuuuccucuucucacccuacugccuuuuguuacuauguguaaugcucuggcugaccuuuuuguagauaaagccuuuuucauauuuugguuauuuuuauaggacagauuaccauaggcaggauaauuagguuaaaaaauaagcauuuggccgggcaugguggcucacgccuguaaucccagcacuuugggaggcugagguggguggaucaucugaggucaggaguuugacaccagccuggccaacauggugaauccccaucucuacuaagauacaaaaauuagcugggcgugguggcgcacaccuguagucccagcuacuugggaagcuaaggaaggaguaucgaggcaaagguugcagugagccgagauugugccacuucacuccagccuaggugacagagugagacuccaucuuuuuuuuuuuuuuuuuuuuuaaaagaaagagggugggcgcgguggcucaugccuguaaucccagcacuuugggaggccgagguggguggaugacgaggugaagagauugagaccauccuggcuaacguggugaaaccccgucucuacuaaaagauacaaaaaauuagcugggugugguggcaggcgccucuagucccagcuacucaggagguugaagcaggaggauggcgugaacccaggaggcggagcuugcagugagccgagaucaugccacuacacuccagccugggcgacagagcaagacuccgucucaacaacaacaacaacaaaaaagcauuuuuugauucuucauagauauucagaagcauauaggcucuaaugucuauuugcuuauugucaaauucuggucuuaucacuuucuaguuguuggacuuuguauaagcuguucaaucuguaucuguuuguuaccuauaaaauagggaugauaauaacaucuuugucacaggauuauuaaaagauuuaaagaggguauauguguuaagaaagccgcuagaggccaggugcaguggcucaugccuguaauucuagcacuuugggaggccgagguggauggaucaccugaggucaggaguucgagaccagccugaccaacauggugaaacccaucucuaguaaaaauacaaaaauuagccagacaugguggugggcaccuguaaucccagcuacuugggaggcuguggcaggagagucgcuugaaccugggaggaagugguugcagugagcugugccuauuacuuaguaaguucuuaguaaauacgaacuuuuuaaaauuuuuuccuucuuauauuugaugccuuagcaagcaauaaauauaaacucuuuuuuugagauaaauauaaacucuuuuuuuuuuuuuuuuuuuugagaugaugucucacugugucacccaggcuagagugcaguggugccaucucggcucuccacaaccucugccucccagguucaagggauucucaugugucagcgcccugaauagcugggauuacaggcgugugccaccaugccuggcuaauuuuuugauuuuaguagagacaagguuuaccauguuggccaggcuagucuugaacuccugucucaagugaccugccugcuuuagccucccaaaguccugggauuacaggugugagccaccgugcccggcuugaucucuuauuuuuuuaaauuacauugaauuuuuuuuuuuuuuuugauacagagucuuguucugucacccaggcuggagugcaguggcaugaucuccgcuuacugcaaccuccgccuccugagaucaagcgguucuccugucuuagccucccaaguagcugggauuacaggcgcgcuaccaugccuggcuaauuuuuuguuguuguuguuuguuuuuuuuugagaugagucuugcucugucgcccaggcuggaguguaauggcgugaucucggcucacugcaaacuccgccuccuggguucacgccauucuccugccucagccucccucccgaguagcugggacuacaggugccugccaccaugcccggcuaauuuuuuguaguuuuaauagagaugggguuucaccguguuagcuaggauggucucgaucuccuaaccucgugaucugcccgccucggccucccaaagugcugggauuacaggugugagccaucgcgccuggccuacgccugacuaauuuuuguauuuuuaguagaauacuaaaaauacaggguuucgccauguuggccaggcuggucuugaacuccugaccucaagugaucuccccugccuuggccucccagaaugcuuggauuacaggcauaagccaccaugcccagcccugaucucuuauuuuuauuaaaguuuugaaaugccacucccuaaaaagguugcaucaauuuguaaugucauuagcaaugugugauaggucuaguuuuaucaaaccuuugucauguaugauauauuaaaaucuuuaucuuaacaacagaaaaaaaguaguucuaagcuuuuacuuacuugauuaguaggacuaaugaauauuuugaauuucuuuuucuuuuuucuuugagaccugagucuuacacuguugcccaggcuggagugccguggcacgaucuuggcuuacugcaaccuucgcgucccagguucaagcaguucuccugccucagccucccaaguagcugggauuacaggcauccaccaccacgcccagcuauuuuuuuguauuuuuaguagaaauggguuuucacuauguuggccaggcuggucucgagcaccugaucucaugauccacccgccucggccucccaaagcguugggauuacaggcaugagccaccgcgucagccuuuuuuugaauuuuauuacuuguauuucuugcgaauugcccagucguguuuuguccaugguuuauuggggugggggcauucuaacuguuucguaucauuaauuuaagcuuguuguaugacauauuugcucuaagaauuucaccucauuucauuguauagguaauuaucuuuuguguagugaaaagucccauuauuucuuuuaguucauuuaagauuuuauucaauuauuuauagaaguaguaagauaaauauuuguagauagguaaacaaagcauuagaauuuuugacuuuuagaaaguaaaaucauuugauuuaaugucuauuuuuguucauuccuauuuccuaucuaauuaauagaacacaguacugggaggaggaacaaaauuuuaaucaugauauugcuguuuuucauaauaaucuaggacuaguaauaaguccucucuuucauccagaaaauauugaaggccggaugccaucaccuguaaucccagcacuugaggcugaggcaggcugauagcuugagcucaggauuucaaaaucagucugggcaaaauggugagauccugucucuacaaaaaaauaaaaaauuagcugcaugugguaugcaccuguugccucagcuguuugggagacugaggagggaggaucgcuugagccuuggagauugaggcuguagugagcugugaucaugccacugcacucuagccugguagcagagcaagacccugucucaaaaagaaaaaaaaaaagaaagaaaguauugagaaguuaacuuauuucauuaccuuaaugaaaaauaguuaaggccaggugcaguggcucacgccuguaaucccagcacuuugggaugcugagguggguggaucaccugaggucuagaauuugagaucggccugaccaacauggugaaaccucuucccuacuaaaaauacaaaaaugagccaggcaugaugccgggcgccuguaaucccagcuaaaaaaaaaaaaagauuuuuuccaaauacaguauuuuuauuaaaucuuauugaguaguuuucacauuggcaacucuguguguuucuuucuuuuuuugagacagaguuucgugcuuguugcccaggcuggagugugauggcacaaucucggcucauggcaaccuucgccucccagguucaaacgauacuccugccucagccuccugaguagcugggauuacaugcaugcgccaccaugcccggcuaauuuguauuuuuaguagagaugggguuucuccauguuggucaggcuggucucgaacuccugaccucaggugauccgcacccccuuggccucccaaaaugcugggauuacaggugugagccagccaccacacccagcuuuuuguguuucauaugcauuuuuuuuuuuuuuugaaacagagucucacuaugucgcccaggcuggagugcaguggcacaguauuagcucacugcaaccucugccuccuggguucaagcaauucuccugccucagucuccugaguagcugggaucacaggcgugcgacaccacgcccagcuaaauuuuguauuuuuaguagagacaggguuucaccauguuggucaggcuggucucgaauuucugaccuagugguccgcccgccuuggccucccagagaguugggauuacaggcaugagccaucgcgucuggccucauacauuuucuaaaugacuuuuguaaauuuuuuuuuuuuuuugagacggaguuuugcucuugucacccggacuggagugcaguggugcgaucucggcucacugcaaccuccgccuccuggguucaagcgauuuuccugccucagccucccaaguagcugggauuacaggcgcccgccaccacaccuggcuaauuuuuguauuuuuaguauagaugggguuuugcuauguuggcuaggcuggucucgaacuccugaccucaggugauccaccugccucggccucccaaagugcugggauuacaggcgugagccaccaugcccggccaguuuuuguaauuuuaaagagaacaaaaauccugagauggaaacuuauguagaauuuuauucauaguugaaguuaguuacaguggaaauaaaaacuagaaaguugcauuguaucuucuaaacauauguauuuaacauaauuucacauuucauuauagaugguucuuuggaaugauauuuaaaaauuuuguggcugggcgcaguggcuuacaccuguaaucuuagcacuuuaggaggcugaggcaggcggauugcuucagcucaggagcucaacuagucugggcagcauaacaaaacccugucucuacaaaaaauacguaaauuauccagcuaugguggcccgcguuaguagucccagcuacucgggaggcugaggugggaagaugacgugaacccaggaggucgaggcugcagugagguaaaaucgcaccacugcacuccagccuggacaaagugagacccugucuccgaaaaaagaaauuguuauaaugaaugaauagauuuacauuguuaguuuaguuuuguuuuuuuucucagaaguguagaguuuguucuuagucuguccaucuguauacaagcaugaacuguacagucaacugccuuguagaggggcugguuuuugguuaugucuuaaaucuuaacuccuuuuaauuauucugaauuuuagugggauuccuauaucauuguagauuuggaaaguauugaguaggagaugauaaucuauaaucaggauucugaguugguaagauuuuauagaucugaaaaaaguaauuucuugaccuuggccucaauaagaaagucagaacuugacccuuauuuaccagcaccaucccccccaccacaauauuuaaaguguuuaaaucauuuauuuugaaauucuuaugugauccaagaccacugugcauuuaagcuaguuuauuuguuuauuaaaacaaaagaaguagacugcaguuacguuguuucuuuuucuguuguuuggugucaggaguagaauacauuuggccagcuucaugagaggauuagaaaguuggagaaggaaaaauagaauuguuuacggagccaggagaauaauugucuauaauuauagaugcuuguuuugagguuuggaaaaggugguuuaaaaaacuuuuaagaaaaaacaugauaaacaucuauaaauaugaggaagaaaaauugguugcaacauuaaaaaaauuuuuuuuugagagggagucuugcucugucgcccaggcuggagugcaguggcaggaucucagcucacugcaaccuccgccucccggguucaagccauucuccugccucagccuccugaguagcugggauuacagguuccugccacgaugcccggcuaauuuuuggauuuuuaguagagaucggguuucaccauguuggccagacuggucucaaacucuugccucaagugaucagccugccuuggccuccuaaacugcugggauuacaggcaugagccaccgcucuuggccagguugcaacaucuucauuagacuuguuuaaaugagaauuuuccuuuguuaaauggaagaaaauaggcucuguuugggagagugaggcccaaguaggacauccuugauacacauugaagaucuauuuauuuauuuauuuaaauuuuuugcucugcaaaauugaccaaagaaugaagaucauuuuaguugguuaauauuucaguuuugacuuccuggccagagauaguagauuggaaaggauuuagagauuuacugagggaguuaacccaagauuuuaacauugugaugcaaaaugauguuaaaacgcguucguuucccuuuuauuauuuaaagaaauccuagauuucuuuaaauaauacaaaguaauuaaauggaccuguuggguuauuugaaauuaagcaguagacaggggaaguucuuguaagugguuacuaaagcguuaacauuagaggcauucuccacuggcuggcuguagcagagucccugaucugggcuuuggagaaauccaucccaccuuuuuuuaggugccugcuuuacgucggaucuacuuucucuacucgugccuuuucuuccaccuucuucccccuccucuuucucauagaugguguggaggugggagagagggagggagagggagaucaacugauuauuguguguugaggggguggggggucagagauucucugggccauaaaaguugcacgaaauaaaaugcucuuuuuuuucuugugugggcccugccaugagaucagguugucggacuugauugggagccacggaucccgcccuacugaaaacauuguugcaggaugggaugggaugaagcugaaagucuuaucaagugguauuauaucuggcacaacaaaaggccagaaccccaaaauauccuaaggauaaaaaguuuuuguuucuuuucauaggauauuuuuguaucugguuuggaaggaugacuugacuuggauuguacuguuaaagacaaaaugaacuauuguauuuauuauguauuuaaccuuauuaaagcauuaaguaugacagcacuaguuauagagaauuguguguguaugcacacauauacacacauauacauauauacacacaccauauauauauuuuuuuugagacuuggucucgcucugucauccaggcugaagugcaggagugagaucuuggcucacugcagccucgaccuuccaaccccagugauccuuccaccucagccucccaaguagcuggggccguggggaugugccaucaccaccagcuaauuuuuuuaucuuuuauuuuuuguagagacggcgucucucgauguugcccaggcugaccucgagcuccuggguucaagugauccaccuaccucaaccucccaaaaugcugggauuauaggcgugagucacugggcccggcugagauguauauauuauauauacaucucauauacauauacauauauacauaaucucauauauaaaaauuauacauuauauauaauauuuauaauauaauauauauaaauuaaaacuuaaaaaaaauuuuauuuuauuugagauggagucuugcucugucgcccaggcuggagugcaguggcgcugucucggcucacugcagccuccaccucccagguucaagcgauucugcugccucagccuccugaguagcugggauuacaggggugugcuuccacaccuggcuaauuuuuuuuuuuuuuuuugagacagggucuuccuccgucgcccaagcuggagugcgagggcgcgaucuugacucagugcaagcuccgccuccuggguucacgccauucuucugccucagccucccgaguagcugggauuacaggugccagccacuaugcccagcuaauuuuuuuguguuuuuaguagagacgggguuucaccauguuggucaggcuggucuugaauugcugaccucgugaucugucuaccuuggccucccaaagugcuaggauuaccggcaugagccaccgugcccggccuauauuuuuaauaaugaaaucagaacuagguuuguaaacagggaaagaacaaauaaucauaaaaguuuuauauucuggauuuggaaguugguugauuuaagaguaaugagaauaaauaauauccccucccccuuuaguucucaagguuuuccacuuaguuuaaguaguuuuauuagcuauaguagaguaacucagcauuuugaaauauuuguauaauuugaaaagucucugaaagaacacugugauucggguauagcauugcaaguuugagggguuucaacagauuucuucauguguguuuaauuccaugaugauuuaaaaaaaaacccaagaaauaaaaccucuggucacuuaaccagcauuuuauuuuauuuauuuuuauuuuauuuuauuuuuuuugagacggagucuugcucugucacccaggcuggagugcaguggcgugaucucagcucacugcaagcuccgccuccuggguucaagcgauucuccugccucagccucccaagaagcugggacuacaggcgcccgccaccacaccuggcuaauuuuuuuuuuuuuuuuuuguauuuuuagcagacaugggguuucacugugugguagccaggauggucucgaucuccugaccuccugaugcaccugccucggccucccaaaaugcugggauuacaggcgugagccacugcaccuggcccacuuaaccagcauuuuaacauauuucuucugaaaaucugauuaccagaauuuaauuacauuagaagaaauuuuuuaaaaagcucauaacuauuacguagcaaauauguuuucaaagaacuuguuuuaaggugggucuugguggcucacaccucuaaucccagcacuuugggaggcugaggcagguggaucacucgagguaaggcguucaagaccagccuggacaacauagugagacccugacccuaaaaaaaauacaaaaauuagccaggugugauggcacauucuugugugaucccagcuaaucgggaggcugagguggaaggaucagguugagcuccggaggucaagacugcagugaguugagauggcgccacugcacuuaagccuggguaacacuaagccuggguaacagagggaaacucugucucaaaaaaaaaagagagagaaacccacccaguuugaugaauuagaugcauguuaagugaaacaguuuuuuagauaguguagaauuaacuucauuauguucacaguuaaauucauauuagacuguuaccuauucuaagauauuugauauuaacccucaagggacauuggcuacauuuuuuuuuuuuuuuuuuuuaacaaaaccuuguaguuuauguuaguggucuccaaacuuuuuggcaccagggacuaguuuuguggaagagaguuuuuuccacagaccccagggggagcacggaguggaugguuuucgggugaaacucuuccaccuuagaucaucaggcauuaguuagguuaguuagauucucauaagaagcaugcagccuaggucccuugcuugugcaguucacaauaggguuugugcuucuaugagaaucuaaugccgcugcugaucuagaggaggccgagcucagguuaaugcuggcuugccugccgcucaccugcuguguggccugguucccaacaggcuaccgagugguauuggucugcagcuauagguggggggaacccugaguacgauaaacuaucuucuagaauaauuuuuuuaauauauugaagcaguagugccuaguuuauaaguagacauauguauaguauaaacuauauaguuuauauucagaguacaaaauccaccuuggccacuauuuuuuuuuuucuuuuuuugagauggagucucacucugucacccaggcuggagugcaguggcacgauuuuggcucacugcaaccucuaccucccuggauucagcgauucucaugccucagccucccagguggcugggauuacaggcacacgucaccacacccaccuaauuuuuguauuuuuaguagaaacgggguuucgccauauuggccaggcuggucucgaacuccugaccuugugaucugcccaccucggccucccagagugcugggauuacaggcgugagccaccccacccggccaccuuggccacuauuacaaaaguaaagcuaaauaauacugaaguauauguuccauauuuuguaaggacuguugauuuggaaacaguguauucuaacaagauaaauuuuaaauguaacuaauaguauauguuucugaauaaauaguugcugcuucuaauauaaagugucauauuuguuuuaaaaucauugcucaaguuguauaguuguuuugggcacguauuuucaacuucuagaccaauacaaaauguaaaauaaguaaaagacgugauauaguuguauccuuucuaaacacugaccuauuuuuuuuuuuuccuuugcuaccuuuuuuuuuuuuuugagacagagucucgcugugucgcccaggcuagagugcaguggugcgauguuggcuuacugcagccuucgccccucggguucaagugagucuccggccucagccucccaaguagcugggauuacaggcgugugccaccaugccugguuaaguuuuuguauuuuuaguagagaccgguuuuaucauguuggccaggcugguuucgaacuccugaccucaagugaucugccugucuuggccucccaaagugauaggauuacaggcgugagccuccgugcccggccccuuugcuacauuuuaaugauaaugaaaauguaauccaagugucagauuauucaguagcuuccugucuuuugguuugugggaaguuugauacguuauuuuuuaauguuucuuaguccuuuguuauauuucauggauaguggggaagugagucugugacuugauugaaauauauuguacaaugcauucaucugcaucauaggcacuuggcuuuuaaugguaaaguggaaacuaaacuucuccuuaggaacaauuugcacuaauuuauuuaacugauauugaugaugcuccauaaagauaaaaaugucauugcauggaggcuuacuugugauguaauuuguacuuuggagaaguaaaucauaguaugauuuuagauguuuuauuaacaucuaaaauguuucaguuucuguaguagaauauuguuaaauaaaaugguaaacacuguaaaccuuaauacuccuucccaagaagaaaccauuaccaccacuaccucuucucccuccaaaacagaaaccauuaccaccuccaccucuaacaacagaaaaaaaaaaccaaaaaauaaaaaaacccuuuuuuggccccacaccuuuuuuggcucacaccuguaaucccagcacuuuggaaggccaaggcgggauccucuugagaccaggaguucgagcccagccugggcaacaucaggagaccucaucucuacuaagaaaaaaaaauggcugugugucgugauacaccuauagucccaguuauuugggaggcugaggcaggaggaucacuugagccuaggaguucaaggcugcagugagccaugauuguacuacugcacuccagcuugggcagcccaggaagacugugucucaaaaaacaaacaagaacaccuuuuuaaucuguuaacucaugguuuguuuaagauuuucuuuuagccauuuuugaugccuuuuuuuuuuuugagacagguucucacucugucucucaggcgggaguacaguggugugaucauggcucauugcacccuggacuucccagaaucagaugauucuccuaccucagccucccaaguagcugggacuacaggcacacaccaccauguccagcuaauuuuuguauuuuuuguagagacuggguuuugccauguugcccagaguggucuugaacuccugggcucaagugauccacccaccuuggccugccagagugcugggauuauaggcauacgccagcugcacccagcccauuuuugauaucucaaaucuuucaucauaguuuagucagccauauuuuuccuagaauuuuuuuaaaaacuauuuugucuugcuaucaagcuauuacucuguaguuuuacauacauucuuuauuuuaacuaaacuguuaugagcaauaauuugugauaacuuuuuuuuuuuucugagacagaguuuugcuuuuguugcccagguuggagugcaauggcgcacaugaucuugacucacugcaaccucugccucccagguucaagcgauucuccucccucggccucccgaguagcuggaauuacagccaugcaccaccaugccuagcuaauuuuuuauuuuuaguagagacuggguuuuuccaaguuggucaggcuggucucaaacucccaaccuugggugaucugcccacuucggccucccaaagugcugggauuacaggcgugagccaccgcacccugccaauuugcgauaacuuuuuaaucuuuuuguaucguguauuuaaacuuuuaaguucuuuucccugucaauuucugacagauugaaaaauaauaaucuuuauauuauuuaaaagcuucuucuaaaagguacaaaggaaaaaauagaaugcaaagugaacuaggcagcguguaguggcuccugccuguaaucccagcacuuugggaggccaaggugggcagaucacaugagaccaggaguuugagaccagucuggcuaacauggcgaaaccccaucucuacuaaaaauacaaaaauuagccaagugugguggugcaugucuauaaucccagcuacuugggaggcugaggcaugagaaucacuugacccuagaagguggagguugcagugagcagagaucgagccacuacuccagccugggcagaaaaaaaaaaaaaaaaaaaaaagugaaguuaaacuaaauuuagaucuguugaguuugaaaugaugguuguauauaccucuaagaucaguaaaaccuaaaucaaucuagagaacagguguuaaagauacauuuuuggugggguguggugccucaugccuguaauccugccauuuugggaggccaaggcggguggcuugcuugagcucaggaguuugagaccagcugggcaauaugaagaaaccccaucucuacagaaaauacaaaaauuagccaggcacagugcuacacgcuuguggucccagcuccucagaaggcugaggugggaggauugcuugagcgugggaggcagagguugcagugagcugagauugugccacuguacuccaaacugggcaacagagggagacccuaucucaaaaaacaaaacaaaacaaaacaaaaaaacaaaaaagauuuucaugcucugguaaaauaaguauuaaaauuaggaaacuauggaugaauugaauguuuuggucuggucgaaguacugugcauuaaauuuuugguuacauuuuacuuugauaagcagugacgguucaguaauuuugaugauagucuauacaucauguaacuugacuuauuuaguugucaacaaauaucuuuuuuuuuugagaccugagucuugcucuguugcccaggcuggagugcagugcugcgauccuggcucacugcaaccucugccucccggauucagauuuuccugccuccgccuucugaguagcuggauuacagaugugcaccaccacgccuggcuaauuuuuguauuuuuaguagagacaggguuucagcauguugaccaggcuggucuugaacucuugaccucagaagaucugcccaccucggccucccaaagugcugugauuacaggcgucagccaccgcgcccggccuagagauaccuuuuaaggugguucuaaagccucagaaauuauuuauccugaagagaaagauuaaaguuuuauucauugcauuaugagggaaaguuuaggcagaguaucuuaugguuuuguuuuucauuaaaagaucaauguucuuucagauuuuaaguccauuuaaaaacuuugcauaguaauauauguacaugguugaaaaaagucuaauagcccagaaugcuuauaauaaggaucaagaauucuguuucacuccuuauugccacucuccaaacaacuuuuuuguaucaauuuaaggguuacaggugcaguuuuguuacaugaauacauugcauagugcugcaguuugggcuuuuagugcauccaucauccaaauaauguacguguacccauucaguaauuucuuguuacucacccuccucccagccucccaaccuucugagucuccagugucguuauuccacacugugcccacauguacacauuauuuugcuucaacuuauaagugagaacauggccuccagguccuuccauccuuccacguugcuacaaaagacaugauuucauucuuccuuuauggcugaauaguauucguguguguguguguguguguguguguguguguguguguguguguaugugucccaguuuuucuuuauccagucgucuguugauggauauggagauugauucccuaucuuugcuauugugaguguugcugugauaaagguacgagugcaguuaucuuuuugauauaaugauuuauuuuccuuuggguggauacccaauagugggauugcuggauugaauagcaguuuuauuuuuuaucauuuuuacuuuuuugagauggaguuucgcucuuguugcccagguuggagugcaaugacaugauaucggcucagugcaaccucugcccaccagguucaagugauucuccugccucagccucccgaguagcugggauuacaggugcacaccaccacgcccagcaaauuuuuguauuuuuaguagagacaggguuuuaccauguuggccaggcuggucuugaacuccugaccucaggugaugcaccugccuuggccucccaaagugcugggcuuacaggcgugagccaccgugccuggccagcaguuuuauuuuuuagucauuugagaacucuuuauaugguuuuccauacaggugguacuaauuuacauucccgcccacaguguguuaaguguuccccauugucugcaucuuccccaacaucuguuauuauuauuguuucuuuaauaguggccauucugauugguguaagaugauaugucauugugguuuuuauuugcauuuccucgaugauuagugaugagcauuuuuuucacauaccuguugacuguuuguaugucuucuuuugagaaaugucuauuaauguccuuugcuaacuuuaaaauucuuaaaaauuuuuuauuaaaauuuuuucuuaagaccaguuaagugcaguagugaaaggggaguaaagaguauagaacaaggaauuugaucgguaacugacagugaaccaucaauugggauaacucacuaccaguuaucaguagugagguauucagaacagcccuuugcuuacuuuuugaugggauuauuuguguuccuuguaaauucuggauguuaguacccugugagauacauaguuugaaacuuuuuucuccuauucuguaggccauuuguucagucugcugauucuuuugcuaugcagaagcuuuuuagcuuaagucucauuugucuauuuuuguuuuuuuuuuuuuugcuugugcuuuugaggucuuagucaugaauucuuuaaauucaugaauucuuagucaugaauuguauagaucaguguccaggagaguuuuuccuagguuuucuucuaaugguuuuuauaguuucaggucuuuggaugaagucuuuaauccuucuugaguugauuuuuguauauggugaaagauagggguccaauuuccaaaggaaacuuucaaauuauuucuuccugugguauugucgugacuauauaauauacauauguuaugauuuaugauugauuucugcucugauaaaggaggauuuggcuucuuuacaucugcuuccccaauagauuuuuuaaaaaucacuuuuaauuucucugcuaguuaucucugcaguuuauaucagaacuuuccuucauguuauauagacuguugaucuugauguaccaagcaguaacuuuuguuuguuuguuuguuuuuuugagacggaguuucacucuuguugcccaggcuggagugcaauggcgcgaucucggcuugcugcaaccucugccgcccggguucaagcgauucuccugucucagccucccgaguagcuaggauuacaggcaggcgccaccaugccuggcuaauuuuguauuuuuaguagagaugagguuucaccguguuggucaggcuggucuugaacucccaaccucaggugauccaccugccucagccucccagagugcugggauuauaggugugagccaccacgcccggcugcaacucuucuuuuuaccuuuccuuuucccuuuaugugcuuacaucugucauuucugacauugacauugucaagguugagaacaguuaugcgcuguauuguacuccuuacuacuuuguuuguuuauuuauuuauuuuuuugagacagucuugcucuguugcccaggcuugagugcaguggugcgaucuugguucacugcaaccuccgcuuccuagguucaagcuauucuccuaccucagccuuccaaguagcugggacuacaggugcguaccaccgugcuuggcaaauuuuuguauuuuuaguagagacggggcuucuccauguuggccaggcuggucuuuaacuccugaccucaacugauccacuugccucggccucucaaagugcugggauuacaggugugagccacugcaccuggccgguaugacuuuaauacuugaaaguuaaugggcuggacgugguggcucacaccuguaaucccagcacuucgggaggcugaggcgggcugaucaccugagggcgggaggccgagaccagucuggccaacauggugaaaccccgucucuacuaaaaauacaaaaauucgugguggcguaugccuguuaucccggcuacuugggaggcugaggcagggagaauugcuugaaccccggaggcggagguugcagugagccgagauggugccauugcacuccagccugggugacagagugaaaaaaaaaaaaaaaaaguuaaugaauaguuucuacauuauuaugaucauguaauauuuuucacagcagaggcaaguaguauguaauuacauuucuuuguauuguuucuugguuuuugaaucuguaacugcauuuuucuugucauauuuucacgauucauuuuaucaaucuuuuucugugguuugucauuauuacuuauuuuaugcauaucaagucccucccacccuccccugcuuucccuuaguccuauuuccuucaguuugggcuagaaguauuuagaccuguugccuuguuuuugugcugaacuuuuccuuacucuuuuugcacagugcuacuacuguuauuagagcuuuaucauuucuugaguuacuaacuuguuuuaaugcaguacacccacauaaauagcuaagaaagaauaugugagaaauaaaguuuugaauccuugcuuaucuguaaaaguccucauuagcccuuacaguugacugguauuauuuuauucaagugcaauuaagcugaaaauuguuuucccucagaguuuugaagggauugcuccagugucuucuauguccauuguuguuggugaggaaaagucggauacugugugauucuucuuccuuugugggugauguguuucauauuuucauccaucccuuuagagccuucuuuuauccucauuaaacugaaauuucucaaagauguccagauguguuuucuucuccauuacaauaagcaaaauacuuuaugugcuucacuucuugaaaguuuucauguuacggcuuuagugaucuuucuuuuuuuuauuuuuuugagacggagucuugcucuguugcccaggcuggagugcagugguaccaucuuggcacauugcaaccucugccuccuggguucaagcuauucuucuucagccucccagguaacugggacuacaggcaccugcuaccacaccuggcuaaguuuuuguauuuuuaguagagaggggguuucaccguguuuguuagccaggaugguuuugaucuccugaccucgugauccgcccaucucggccucccaaagugcugggauuacaggcgugaacccccacgcccggccucuagugaucuuuucuuuguuuucucuauagcugcuuuuaguuggauuauuagacuuacugaauuaauccuccccaauauuuuugucuguuuguuuguuuguuuuuuuuuggucuggccaucucuucuacuuuauuuauucuuggaccuuuuaauuuuauauuggaaguuauauuuuaaauguuugagauuucuccuucauuuccucccccgccaauaucuuuucucauuuuauggauuaauaaucuucuugagucucugaaaauguuaauaagguuuauuuuuuuuuuaaauuuuguugcccucccucuuaccugucaacucuauuguaauuuuuguuguuaucuuagucucauuuauauuguaggcuuuuaaccaaauaucugcugaccuuggauaucacucagcuuuaagauuuaguagaaggguucacaaugagcucuuggugggaauuaaugguuggcaggcaggcuuuacuuuaggguuaagcuguuaauuagucuuuuguauucugacauucaagaguccauuguuuuaccccaaagugccaacucccaugcuagguucacuaguuuccucucucccagacuccaguuucuuuacuuuagaagagaucucuuuccauuaauuuuacuuuguuuuuuaauaauaauuuggcuuuaaauuuuuuuaaacuacuguuuaaaauggucuuuugcugaagagagauaaauguauauguuugaucugcuauuugagccagagaaucucuuucaguucucaaacuggacuagaccaaaaacuaauaauuauuuagauauuuauuuauccaguguuucagaauguguuagguuguagaaauauaauagcagcuuuaagugguguaggagguguuuugcguguuuauaaaagcgaguacuggcugggugcgguggugagcgccugaaaucccagcacuuugagaagccaagguggguggaucgcuugagcucaggaguuggagaccagccugggcaacauggugaaacccuaccccuaaaaaaaucccacaaaaauuagcugggcuugguggugcgaaccuguaguccuaccuacucagaggcugaggugggaggaucccuugagcccaggagguggagguugcauugagucaagauugugcuguugcacuccagccugggugacagagcugaaacccugucuccaaaacaaaacugaguacucauuauguguguuaagccuuuuacaguauguggaagauuagaagaugucacauaaaaaguuaugaauguaauacauucugguaaaaauaaagagcacaggagggcauaacuuaaaaaguaaaaggggcugggugcagggggcucacgcuuauaaucucaauacuugggaaggccgagguaggaggaucacuugaggccaggaguuugaggccagccugggcaacauguguuucacugggugacagagugagccucuuaucuaaaauaaaaaacaaaaaaugugaaagacccucuuuucccuguuuugccccacauuucagagacaauuacuguauccuugacuuuuguuauggguauaccuuugcuauuucuauguauguguauguacuuauauccauuuuuaugauaaugggaucauuuaauuuauaucgugauuugauuuugucacuuugugguugaucuuaggcaucuuuccauuuuagcuuauacacaucuaucucauucuuuucaaaauuuauccaaagauaugaaucacgugcuuaauuugccaaggaguguuuuagguguaaggauucaguggugaaccagagagaccaagcuccugcccuuauggaacaauauuucaacggugagaaacacaaaauaaaugcauuucucguaauuagucucaaauacugagaagugcuaugaagaaaauaaaaugugguacuguacugagugugucuguuaaugguaugagagagaacgcauguggcuaagguggucaggaaggucuguaugaagugauggcauugaaacacacgugaaugauguggaggcauuuuaggaagagcaggauuuauugugaagacucaaaacaagaaugaguguuguauuagugcguuuacugcugauaaagacauacccaaggcuggguaauuuuuaaagaaaaagaaguuuaauagacucauaguuccauguguuuggggaggccucacacucacagcagaaggcaugucuuacgugguggcaggcaagagagagugaguaccaagugaaagguguuuccucuuacaaaacuaucauaucucgugagauuuauucacuaccaggagaacaguauggggaaaccaccccuaugauucaauucuuucccacuguguccauuccacaacacgugggaauuaugggagcuuuaauucaagaugagauuuggguggggacacugccaaaccauaucaaguguguuauacucaagggauccucccaucucccaaaauaaacgauugguguuacugugcaaugaggggaacuuaggagaccauauuugagaggcaagcaggagcccaagcagugcccuucacaccgugguaagaagcugggauuuuauccuuagugcagcaaaagcccuuagaagguuauaaaccagggcacccauaaggcugugaaaguaaccuugacagauauggcuuagaguagagugauggcagaggagaaaggcaaucagaaguguuuggaaagcucaggaggcugaggcaggagagaauugcuuguaccugggagguggagguugcagugagcugacaucaagccccugcacuccaaccugggcaacagagugagacuccaucuaaaaaaaaaaaaagcuuggaaaguuacagcgguaagaucugcuaaaggauuugaugagauggauaugagauaaagaagaauuaaaauugucuucuagauuuguggcuucaguaguugaguggacagaaaugucauuuacuuagauuagagauugaucuuaguggagaaacagguuuuaaacuagauugaaggcccucugauuaguuaaaccauuccccuacugauggucauuuaguugauuuccaguuuuauuaucuuuguaaggaauauccuuguacuuguguauuuguacguguggacauauucuggaagauaaauuccuagauguaaaguucucucaucgaagaggacaguacauauguuucaaguuuugauggauauucauuaguugcccuccaaaagugagguguuggcuuggauucccccaacagaguaugccuuuuuccuggcauccucacuaacaacauaccuggugggagagaaaguaggcagggccuacauuucugaaaaugggagugggaguucuaauagcauuuuuucuuuacuaaaucacuuuggcacuuuguuccuagaaugaaaaucagcaauugucguuuucuuuuugguaucccuaaagucauaacaugucucuggccauaguuuuuuccaguuacuaaucauauagcuguuggucaguccuucuaggcuuagugguauuuauggagccuuucauaauaauuaugagaauuacaaugaaaaugaaaacuauuaauugguuuaauguaugccaagcacuauccuaagugcuuuacacguacuauauuaauuuauuuaauccucacaacaaccuaaaaaguaauuacuguuauuaucucgauuucuugaagugagacagaggauguccaccaaucuuugucuuuucauuuauguauuuuuuaauuaauuuuuuucugucaaaauaucuuuugggaaguuuggcgcuguuacuugaauaccuuuugucaguaguugugggucagaauccaaacacagaauaaauggcaggaaaaggcacauucaguuuaggagaaugcucugcuuaugggugauaguguuuguaaugcuuuggguuuugguuuucagaacugccuauguucaaaucccagccucacacuuaguagcuguuugauuuggggcugaucauugaucuauuuuuguagcucagucuucugagcuuuaaaaugggaaaacaagguuuuguagguuguaggauuguugcgggcaguaaguuacacauguaaaaguggccagcacaagaggaagcacuuuaucagcaucaacuaauauuuuuauauaauuggcuaagagugggcaguccuaucuagcacucaaaguguggggaaaauacuggugauaggauaucacacucuuacugaguuauauauauuaauauuuagguauaaaacuuagaaaguggggugguucacgccugaggcugaggcaggcagaucacuugaggucaggaguuugagaccagccuggccaacauggugaaacccugucucuacuaaaaauacaaaaauuagccuggcauggugguaggcaccuguaaucccagcuacucaggaggcugaagcaggagaaucacuugaacccaggaggcggagguugcagugagccaagauggcgccacugcacuccagccugagugacagagggagacugucucaaaaacaaaacaaaacaaaacaaaacaaaacuuaaaaaugguuaggcacuguggcucaugccuauaauucuaguacuuugggaggcuaagacaggaggaucacuuaagcacaggaguucgagaccagucugcugggcaacauagugagacacugucucuaacugggggggggaaagaaaagccaggugugcggccacgugccuguagucccagcuacucaggagucgagaugggaggauuacuugagcccaaaaggucgagaaugcagugagucaugguugcgccacugcacuccagccggugcaacagagcaagacccugucucaacaaacaaaaaacccuuaaaauuuuuuuaaugcuacuauuguuguaaugagucauauuaagugggauuauacauguaccaaacuuuuauuuuuucuugagugagauuauuucaugguuauuuuaauuggcaugccuuacgauugaguuaaauugauuauauuugucacuuuuuuuugcaaacugccuaccaguacccuauuucggguacuuugcagcuucaaauaagaaaaauuuuaauuaaaaaugcauuaaaccauaaauaaaauuuaccucacaugacuggaaguccagguguaauucaguggcucaauuaaauuaucacggaccuagaugguuuucauuuuccugcuguuuuauacucagcuuguugucgauaguugcuaaauuaauucacuuaaauaaucauuuaccaccuaaaauguauuaggcaguaguccauaagcacgggaaauacagcagugagcaaaacaaaguucauugccuuccuucacgggcuuauauuuuaguggggauaagggagaagacagucaaacaaauagguagaauuuauagauugucagaagauguuaaguuuuauggaaaaaaauaaagccauggaagggacgggaagggcuggguuggauuguuuuaaguggggccaucagagaaggccucagugagcugauguuugaauagaaucuuaaaagaaauaagaaugcaaaggcagauauuuggggaaagagcauugcugaugcggggaacagugagugcaaaagccccagaggcaggaaugugcuuagcauguucauagaacugaaagggccaguguggcaggagcugaguuauggagaaaacaucauaagagaaguagcguggggagucagauugugcagggccuuguagaccauugugagaucuuuugacuuuuacucuggauuagaugagaguccuuugggggcuuuuaaguggaggacuggcuuuaucugaccaagacucuaaaacucucaugcuggcugcuguguugagacuagaaugaaggagaucaaggaagaagcaggcauguuagauaauauuagcaggguaacagaugauuugaagcaugauaggcaucagagaaauguugaaguaauucugcauauguugaggcagagccgaaaagauuuguugagggauguggcaugugagaaaaagaggauucguaguucacaccagguucaaugaccaguaaagaugaaguauauuuguucaugcacaucuauuuuauuuggaauuaaaaaccuuuccuggaagcccuuagcagauuuuuuuuuuuuuuuuuuuuuugagauggaguuuugcuucuuguugcccaggcuggagugcaauggcacgaucucggcucacugcacugcauccucugccuccuggguucaagcgauucuccugccucaaccuccccaguagcugggauuacaggcaugcaccaccaugcccggcuaauuuuguguuuuuaguagagacaggguuucucucuauuggucaggcaggugaucugccugcuucagccucccaaaguguugggauuacaggcaugagccaccgcgcucggccaacagauuuuuuucuuaaaucccaucagccgugauugguauccauccauguccuagauacaagugagggugagagagcaaggauguuccuugcagccaugauaaugggaaguggacucuguaaggaacagguugugaguggggaguggcuauugguuagguaacuaauagucuguuugucauugcccauuuuucuguuaagucgaucauccuuuuuaaaugauuuguaaauaauuuuugcaugcuaagaaaguaaguauuuguuauauaauucuagauucuaaauauuuuggagcuguaaaugagguuuuaaacucugagaucaguuuucuaauuuugaaauaaagugaaucuccauugaaauuuacaaguaggggcuggugaucgcagaguccaaugcauaauuuauaguuuuuccuauucugggugcaguugucauuuuaaccugaaugccagguaguuaucuuuauaaaacuaucaugugugaguuauagagguagcauuggggugguggaaaaaaacaaaacaccacuuuugagguaggaucucacucugucacccaggcuggagugcagugaugcagucauggcuccuugcagccucaaccucccuggcucaaguaauccucccucuacucagccuccagaguagcugggacuacaggugcauaccaccacacccggcuaauguuuaaauuuuuaguagagacaagauaucacuauguugcccuuucuuccuucaaaaaaagcugauaaacuggcuuauuauauaacaaggaauucucauuuuauuuuacuuauauuguauuauuguucuuuaauuucagugaugugaagcaguguuuuuuggagguuuugagugugagcuuucucaucagauacugaagaguuuuugagccuuaacuccauuacuuaauuagcugugugacccagaccacuucauuguacagcuccguucuuguugugcuggggagggcauucacacaaaauacaaugaaauugugcuuccuggugguucugaugugacuuuaggcaaguucauuaaacacugcgcuuucaauaagauaaugcauguggaaugcugagcacagugccuuuaagacacugaaggggauaugagaacaguuccauagcccuucauuuuuacuuuugauuaagaguuguuuacuaauaacuaacuaggugaguuauaaauggggaaguagggucauugugaaguggcuaugaaacagcauagaggauauauuuuaaaagcuguauuuuuacuaccuauuuucaaacugcauauuucauuuuaguuuggagaacuuuacugaaaaauaaagaaguaguaguaugugaguuuggaucauuucugugguuaggugguggcuacacuaaggccuuuccaauucuugguccugugagagguagguaggguugugggggguaggggagaacagauaaaugagauacauuuauauuuuuuugcaugguaacuuauaaggcauugccaagagagggaauucacugcaggcaaagaaaaauauaaaacauaguguauauagggcuuuguagcauccgugguuucaggcauuuaugggagccaggcagggguaggguaugggguugaaauguauuuccuauggauaagcacaggacuacuuuauaucacuuaauccaagacccuuuuacuggugaggaauccagcauuuaaauuuauguauguauaugauaaagcuagaauuuuuccagaucugagacucaaagcucuuuguguuuucguuuauacuccagcucuuuugaggagcuuuaaagucuaguuacaaagacaggaaaaacaagaacggccacaguggcucacgccuguaaucccagcacuuugggaggcugaggccgagaccagccuggugaauauagugaaaccccguaucuacuaaaaauacaaaaauuagcccggugugguggugugugccuguaaucccagcuacucaggaggcugagguaggagaauugcuugaaccugggaggcagagguugcagugagcugugccacugcacuccagccugugugccagagacucugugucaaaaaaaaaaaaaaaaaaaaaggccgggcaugcaguggcucaugucuguaaucccauugcuuugggaggccaaggcaggcagauuaccuaaggucaggaguucaagaccagccuguucaacauggcaaaacccugucucuacuaaaaauacaaaaacuagcuaggcgugguggcaggcaccauaaucucagcuacucgggaggcugaggcgggagaauggcuugcacccgggaggcggagguugcagugagcugagauggaaccagucagugcacuucagccuggguggcagagcaagacugucucaaaaacaaaaaaacaaacaaaaaacaaacaacgacaaaaaaccuaggaaaaacauacaugcaacagaauguuaaagaggagauuuuaaggcuuuuuuuuuuuuuuuuuuuuuuuuuggagacagucucacucugucgcccaggcuggagugcaguggugcaaucucggcucacugcagccuccgccucccugguucaagcaguucucugccucagccucccaaguagcugggauuacaggcgccugccaccaugacuggcuaauuuuuguaguuuuaguagagacgggguuucaccaucuuagccaggcuggucuugaacuccugaccucgugauccaucugccucggccucccaaagugcugggauuacaggcgugagccguugcuccuggcagagauucuaaguuuuuugagaauagugacuguauuucuugggucauggcucuaucuuauacaucuggcacaguguguguguguguagcaggugucuaauauuuguuaaacacacaugguccuuaauaucaaacggcaugggauuuaagacaugaacuuggguuugagucucagcacuuucauuucuuaguuguaugaccuugaccauuuaaucuguuugaucuugaauguccuuauccgaaaaauaggggacauacuaauuaacaucuauugugauggguuguaaugagaauuaaaugauaauguauacaaaauaccuaacuugauuggauuugugguacucaguagcuauaaugaccauuuuaaccccaauaugagaaggauucacucaucacacuguuguauacuucguagcuauuacuucuuuaauccccaaggacuuguuuaacaaaguguucuucaguuucuacuuccuaguuccuuuguggaacugguaaaaauuuaaaauaucuuaacauaauauuuuauuucaaaugauaaacaguaagguaaaaugugguuuuucuuggacaacuuaugguagaaugaugucuagaauauuuaguuaugucauuuaauacuuuuuuucuuuacaauuuaaaaaaaaauuuauuuuauuuuagauucaggggguacacgugcagguuuguuacauggcuagauuauguaaugccgagguuuggccugcuagcgcagccaucauccaaagugacccuaguacccaauagguaguuuucaaccugugugccuccucuucuaccuucucuuuuggaaucucuagucuauuacuuccaucuuuauguucacauguacucauuguuuagcucccacuuacaaaugagaccaugugguauuugauuuucugguucugaguuacuucuuuuaggauagaggaugaaaaagaguguagccuccagcuccauccauguugcugcgaaggacaugauuccauucuuuuuuauggcuguauauuuuuaccuuuuuuugcgagggggagaggauuuaaauauggaccagcauaaugaagaaaaugucuguaaucccacuauucacauaaccccugcuaguuuaaaaaaaguucguguaggccgagcaugguggcucacaccuguaaucccagcacuuugggaguccaaggcuggaggaucacuugagcuuaagaguuuaagaccagccugaguaacauagugaaaccucaugucuacaaaaaaauaaaacuuagccagguaugguggugcaugccuguagucccagcuacuugggaggauugcuugaggccaagaguucgaggcugcaguaagcugugauugugccacugcacuccaccagguauuuaaaaaaaaaaaaaguaaauaauuagaaaauuuaaauaguguaaacuagaggccucuccuaucaguuugcuagagcuaccauaacaaaauaccacaaacugagugacguaagugacaguauuuuuuuuuuuuuuuuuuuugagacggagucucacucugucaccaggcugcacgaucucugcucacugcagucucggccucccagguucaagugauucuccuaccucagccucccgaguagcugggacuuccagucuccagaauugagaaauuuaauuucuuuuaauuuaaaaaaauuaagagugacaguuggcugggcgcaguggcucaugccuguaaucccagcacuuugggaggcugaggcgggcagaucacgaggccaggaggucgagacuauccuugcuaacacggugaaaccccaucucuacuaaaaauacaaaaaguuggucgggcgcgguggcucaugccuauaaucccagcacuuugggaguccgagguaggcggauaaccugagguugggaguuugagaccaguaugaccaacacggagaaacccugucucuacuaaaaauacaaaauuagcugugcaugguggugcaugccuguaaucccagcuacuugggaggcugaggcaggagaaucgcuugaacccgggaggcagagauugcaguaacccaagaucacgccauugcacuccagccugagcaacaggagcaaaacuccaucccaggaaaaaaaaaaaagucuaaguaguccccaaaacauaaaauuugagccuaaaauaagaacuguuuuaaaauuuuaauauauuguguuuuuucgccauacaaucccagguauucuucagguuagaacucaguuucacaaaaaagggugugcuugaaaagcuuaccaaaaucuccugauuagauacuuuuuucguuuguuucuguuuuuuugagacagucucgcucugucgcccaggcuggagugcggugccacaaucucggcuuacgcaaccuccgccucccggguucaagcgauucuucugccucagccucccgaguagcugggacuacuggcacacaccaccaugcccggcuaauuuuuguauuuuuaguagagacgggguuucaccaugucgacaagucuggucuugaacuccugaccucaggagguccacccaccucggcauuccaaaguguugggauuacaggcgugauccaccacgccuggccagagcauacuuauuuauuuagcagguguggauauguguauuuaaacagacuuacuuguaaauagauguauaaauguauacccauaaugaaugaaauuaaugaaauuauauauauuuauauauucauuauaagagguuacaauuuuuuuauuuuauuuuuauuuauuuauuuuuuuuuuuugaagagguuacauuuuuuccccccagccuagaaagcuucacugcauaacaugauuaugugggaauuucagaguuggaucacuuugcauuacuguaaaugauagagcuuuaaaguauuuuuuauucuaaagguauaugugcuuuucauaaauucaaauucuaagaaaagguauacaucacaaguucaguuuuacuccccagagguuaucacuggaagcuuuuuuuguauauuuuucuagauguuuuugguuuguagauaagacguguauguauguagaaaaaaauacagacauaggcauauauauucuuugaaaacaaauggaauuaggccgggcgcgguggcucacgccuguaaucccagcacuuugggaggccgaggcgggcggaucacgaggucaggagaucgagaccauccuggcuaacacggugaaacccggucucuacuaaaaaauacaaaaaauuagccggguaugguggugggcgccuguagucccagcuacuugggaggcugaggcaggagaauggcgugaacccgggaggcagagcuugcagcgagccgagauggcaccacugcacuccagccugggccacagagcgagacuccgucucaaaaaaaaaaaaaaaaaaauggaauuauacuauaaauacuguuuugucacuuuuuuuuuuggcauacuaguauauguuauacaucuuuucauagguauauugugauuaauguaggugcaguucaguaaugauugaaaugaaguuuuuucauuauauucuauuuuugaaaaauuaccaauaacuacauauauaacugaaaucacaucauguaacugucaguauaaaggaauggcucagauaaaaccaaauagaaguuguauauuuaauauuuuuaauaauuuuaauauuuaauuaaaaaguuaaaacuuguacuacauggcuguuuauuaggguaaggaaguaugaucucuuuaauguacaugguauuuaaaaaauaucuuauucuggugugucuucuugauuguaaaaccccacuuaacauuuugggcuccuauuuauaucuuuuuacuuuaaaguaacacuauucugugguuauucuuauggcauauuaaagugauauuuuaaggaauacuuaacaaaauucuauauaaaauguaucuacucuaaguuagaaaucuuggugcccuuacuggucuugugaucuuggaagucacuuaagaucccgagcucuguauuaagacagugcugguucaaguucuggaucuaccauugaguaauugaccaugacuuucuuuauacuucaguuuccucaacuguugaauaggaauaaugguuguugugaugaguccauaaaaaauacagucuuacugacuuuaugguggccgaaauuucaagaguaacacaguaacaguuaagucauacugggacucaggcuaaucuuuucuccguugcccuaggcauugauguccaccuggcaaaugagggugagaagcggugagggauugcaugggagguuuggggacaaggccugggaguaguacagaggcaucuuucacuuuugcccacauuucauuguccagaccagucaugugaaagggaagcugggaaauguaguuuagccauaugccaggaggaaaaggaaacgcuuugguaaauagccaguuuuugccaccagugcuaagcacaguuccuggaagaugguuuucaagucauuaagcaagucacuuuucaccucuccagguccguguuucuuucuguaaagugggaagggggaugauaaugaaaacuucuaugaagcacuguuuugggagaacuauauguuauaaccaucuuaacucacuuaauucuuacaaaaguccucugaaguaaagacuacuauugucccuuuuuuuuuuuuuuucuuuuuuaacagcugaggaagcuaaggcucagagugagucauggacacaggauuugaacccaggcagucuuuucuguagggucugugcuuuuauuuauuuuuauuuuuauuaauuuuuuuuuuuugacggagucucauucugucacucgggcuggagugcagugguaugaucucagcucacugcaaccucgccucucagguucaagcacuucuccugccucagccucccaaguagcugguauuauaggugagugcuaccacgccaggcuaauuuuuguauuuuuaguagagucgggguuucacuguguuugccaggcuggucuugaacuccugaccucaggugauucacccgccucagccucccaaagugcugggauuacaggcaugagccacugcaccuggccucaggcauaaugugauaucguuuauaaauauuagagaauguaguucuaaaaagugaaggcuuaagaaaaaccuaauaccaccaucauacuuaaaaaaaaauugacaguuaaauccauaauaucaucauauucuauguucagguaaacacgucucaauuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaggagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccaacacgucucaauuuuuaaaaguauuugaauaaggcuuacuuauugcgauuaagugucuuaaucuguaggauaccaccuuccuuuuuauucucacaauuuauuuguuaaagaaauggguuauuugcccuguagaguuccuguagucaggauuuugcugauuccugagauucaauaccagguuuauccccgauguuucucuauuuucuguauuuccaaaugaguaguuagaaccagaggcuuggucagagucagguucagucuuauuuuauaagacugcuucuuauauuguggugcauucuuucaucaggaggcacaaaauaugguugucucuuuuugugacauuagcaacuguuggugacuaaugccuagaucuguugauucauuaagaguuguaaaaugauaauguucuaguuguguuacuccuucauuuuauuaucuggaauacuguuuuauaaaaagaaaaguuuccaucaccucuuacuugguugcccaguguaacuguucauaugggaaaggcagaauaaauguuugcuuguuuaccuuucuuuaccaguuuccaguguaaucaguagguucacuguauuuuccagcugugauuaauaaauuuuuaaaauuauuauuuuuaauguaucuguuacuguauaggacaguaucuggaaauacccaaagacaagaucucuaaaggagucaucggcuagugguggaucagugcagcgugguggugguggugguggugguggugguggugguggugguggugguggugguggugguggugguguuaugcacaugggggauaauauagcagaggcauuuagcuugaaaucaggaaagagcucuggaguuauccuugagcugcauuuugaagguugaguagcaguuugcuauuggaggagguagagguuacuuuucaggcagagggagcagcaugugcaaaggcucugagaugugagaguuuguuacugaagaaauucaguagggcuggaagcucagugagcuuggugcgagagagucaagagaugaggcuuuagagguaguauggguuuuaagucauuccaaggaauaguuuugauuuaacucugaaggccauggagagacauugaaagguuuuauccaagugaaugauguaaggaacaaacuguggaacucuuggggcagcacugaggagagugacucaugaugccccuuuucugaacugcuuauacagauuucucauucuuggcauuacuccugauuccuccuucaucuacaugcacacgcgccuacacacacgcacacacacacagacacacaugucugccucucggaucuccuucuagagucuuaguucuuguuuuuuuuuucagaauuugggcaacuaacaaggcuagaaaggaggccaucuaaaaaagugauugguguugaaaaguugcugcuccuguccuagcagcacaacucuucacgucauaguaauaggaguaaugacgaugaugaguguggacaacuaaugagcacuuaacuguaguaccaggcacuauucucagaauucauuagugugacaacccucuaagguagggucuguuauccccauuauacagauggggcagaaacggcagggagaaguuaagugacuugcuuaagguaauaaauguaguaagaagcagaggugggauugaaccuaaacagucugcaucuagaguucaugcucauaacauucuauuuauugccuuucugguuuuaugacccccuucuuaucuaaguguaugcucugugccccgcauauacaaacuaguucccauaacauguguaauauaaucccuccuuucccaggguuucccggcuuccuguccuuccccuuagcuuucuaucaucaguuuuuccuaggauuucugguucagccuaugucaaagugagagucaccaacauaguugaugauaaauacuguuugauuacaggaauguaggaagaugugcaagcauucuacuaaaaaugcuuuucccacagauaauguaaacuaagguugcuuagguuuuguaagacugccauucaacuauaaauaggccuuauguauguuuacuaaaucagaaaaaauuuaauguagcuaaauuuuaaauaaucaacaacagaaaauaaaaauauuuugccccaccaucuuaagguuacaagacuuagagguauauuuuauuuacaugcaugcauacacacacacacacacaaauuauauauagauguguggaaaauauagaaaaguagaaaaauguauacaaauauuugaaauacauuauguggaaucauguuuguauuuuucuuagcuuaggaaagaaagccauuaaaagaguuacaugucaauaaccaugauacuauaggauuuuaguaguugcagaguauuacauuacuuaaauaaaugauucauggaauagucuuuuuuuauuggacaaggaauuuuccccuccaccucaaucuuugagaguuagaaacaaugcagagaugagugucuuuauaguuaaaccuuuguacauuuuauaauuuacucaugauaaauuuucaaguugaauuccuaggccaaagaguauacagauuuuaaagacuuucaauguuggcagauaucacuuuaggauaauuauaccaauuuauacucuuaccaguaauauaugaguguauauauuuaccuauuccuugccaguucuggaaauugugaauuuaacagaaucuuccaaaaagcauugaaaauuggccugggaauguaaauauccuuuucuuccccauucagcuuacuaaugaaucuaucauaaucucagcugucugaaucuaaaagagaaccaguaaaauugagaugacaaguuuauugcaaaauaaaugaccugaaagccacaggcauuggguggggugggggaagggcagguaauggugacugaggugacucuguguuuggguuuuugaaaagaugguagauuugaaggauaaggaguucagagaaguagaaaggcaaauaggggccguuauaaauaaggacaguggcaugagccaacaggguuaucucucauguuuauagaacauggcuagaucugguuucccuauaaguugauuucuuacuguuauucugaguugaaugcguaucuuuugucucaaugaagccugaauggcuuuugaugucucugaucuggaaagguuguuuauguaucucagaauaagucauuuugcuaaaaaaggcuacuccugagggagagcaguggaaaaaagaguuggaaaaguggauuguagcuaguugaaaaaaggauuugaaugucaagcuuuaggaauuagguucuuauuugguauguuacgggcaaccauauggacuuuugagcaggugaaaaauacaguauuaauggguagggauagcuugggagggaaggagacauggacauugagcuucagaaaaaccaguuaguaaaauauuucagaugauacauugguaauagaaaaggauccguugaaaugugaggcauucacuuggaaagaacuggcagaaugugguaauuaacugcuauaaggaccccaaaauaaaaggaauaaucaaacaucacucaaagcuuuuagcacaguuuuugauaacagucagugucagaaggagaagacaacuuuguuccuaaaaguuauauuguaaaauaaauguagcuuauacauuuuugaaagugaaaucucaggauucaugguaucuuuacuucuacuugccaaauuauuaaaaugguguuauauuucuuaagauauuuuaaagccucuauuguagaacagaaauaguagaaaauggaacuaauguuuauuaacaauuacuauggaagagggaauagaaauguguugcucuugaacagauuuauucagcuuuggcacuguugacauuuuggacuagcuaauuccuugucaugggcaguaucuccuguguguaggauguuaagcagcauuccuggccuccacccgcuagauauaguagcacacccgcaccccucccccccucccugcccccgugacaaccaaaaaugucuuuagacauugccagaugucccuuggggagcaaaaauuacucccucuccccaguuaagaaccauuguucuagaguacagaaucaaucccacuaaauaaauguuauuggcguguuuagaacagugccuagcacauagcuggcacucaaauauuuguugaauaaaugaguagucagauuuucauugugaauuaaaaacagaacaaaacuugaugacugaccacucaaguugcuuuuacaaaagaaaugggauguccauugaacaucuguuuuagaucugauuucccaaucuggauuauuaaaaugaggaggcuauuuuuucccaguauauaaaugauucuaauacuuuuugcuguaaaacuuuuggagucucucugcuaaauuauguuccaguuucguagcuugggauucaagucauaaauauacuaggucugucuuaccuuucggugcuuuuauuuguucccuuuugaacauggcugaauuuuacuuuucuguccaccugcccgccauucgugcuaccccuccuuccuuuuuccacucucaucuuuuucccauuuuccagucuguaaauccuaccuauccuuuuauuuuuuaaauuacaagaucucauucuguuacuuaggcaggagugcgguggcacaaucauaguugacugcagcuucgaauuucugggcccaaaugacccucccaucucagccucccaaguagcugggaauacaggugcgcaauacugugcccggcuaguuuuuuuuuuuuuuucuuuugagacagaguuucgcucuuguugcccaggcuggagugcaauggugcgaucucggcucacugcaaccucugccucccggguucaagcgacucuccugucuccgccucucgaguagcugugacuauagucgcaugcccccaugcucagcuaauuuuuguguuuuuaguagaggugggguuucaucauaguggucagguuggccuugaacuccugaccucaggugaucugccugccucggccucccaaagugcugggauuauaggugugagccacugugcccagccuaguuuuuuuuguuuuguuuuuuguuuuguuuuguuuuuuuuuuuggagauggagucucgcucuguugcccauccuggagugaaguaguguaguggugugaucucagcucacugcaacuucugccuccuggguucaagugauucuccugccucagccucccaaguagcugggacuacaggcacaugcugccaccccuggcuaaguuuuuauauuuuaguagagaugggguuucaccauguuacccagcuggucucgaauuccugagcucaggcaauccgccugccucggccucccaaaguguuaggauuacaggugugagccaccaugcccagccauucccggcuaguuuuuguagauacuggggucucgcuguguugccuaggcuggucucgaacccaugggcucaagugauccucccauuacagccuccuaaagugcugggauuacaggcaugggccacugugcccugcccuguccuccuuuuugaagucucucucucucugucuuuuauacuuauuuuuucucucuugucaugucuuuguccuugucuuuuuugauggagucuuacucugucacacaggcuggauugcaguggcacaguucuagcucacugcagccuugaacuccuggggucaagugauccucuagcucaagugauccuccuacuucagccucugaguagcuggggcucuaugugugcaccaccacgccuggcuccuuuguccauuuuuguuuguuuguuuuuuggagacagagucuuacucugucgccuaggcuggagugcaguggcaugaucucggcucacugcaaccuccaccuucuggguucaggcgauucuccugccucagccuccugaguagcugggauuacaggugcccaccaccacgccuggcuuauuuuuguauauuuaguagagaugggguuucaccauguugaccaggcuggucuugaacuccagaccuguguucugccugccuuggacucccgaagugcugggaauacaggcaugagccacugcacccuggccuuaacuacguauuuuuuauaucugcacaguguuuuggaaaaagugguucaacugaaagaaugaaaagaugggggcagaauuugcuuuuuaaaaaaauaauaauaauuuaaaaaaagggcauugaaaaaaguuucagugguguugggagggccuuggaacaaggaaugaauggaagaugagggaguggagggaggccauguauggacucuuucuacagaccaggcuguugaaggagagagggcuaacaggaaaugaagugcgggggaaguuuuuugaagaugggagaaagaggacaacuuuuauauauuucauuucauuugauuccuuauaaauuuguaaggaagauagagcuuguauuauuucagugaaguugaaaauagaguacagaaaaauuaagauacagcacccccaaaacugagaacuucugacauaauacacuguuggaaauacuuacuucagagugaagaaaauauuggaaguuaggcuuguuaauugcucugcaugguucauaauuacucuuucuuauuaacuauuuaaggaacaugagaccaggaaguuaaauaccuggguauaugcagauauauaucuagaauugguaccaaaguaaauacaggcauaccuuggagauacuguagguuccauuauagacuaccacaauaaagugaguaucaccauaaagcaaggcacacaaauauuuugguuuaccagugcauguaaauauuauguuuauauucuacugcagucuauuaaauguucaguagcguuauauuuaaaaaaccaaugugcauacuuuaauuuaaaaauacuuuauugcuaaaaaaugcuacugaucaucugagcuuucaguaaauuguaagauuuuuugcugauagaggauguugguggcugcugacugaucccagcagugauugcugaagguuggggugccucugguaguuucuuacaauaagacaacaaugaaguuugcuacauugauugccuguuucuuucaugaaagauuucucuguagcacgugaugcuguuugauagcauuuuuuacccaaaaguagaacuuuuuucaaaauuggagucagcucaaacacugcuuuaacaacuaagguuauauaguauucugaauccuuuguuguuauucaacaauuucacagccucuucaccaggaguagauuccaucuuuaagaaaccacuuucuuggcucaucuguaaggaacaacuccuaaucuguucaaguuuuaucaugagauugcagcaauccagucacaucuucaggcuccacuucuaauucucuugcuguuuccacuacaucugcaaugacuuccuccacuugagucuugaaccccucaaaguuauccaugagaguuggaaucaacuucuuccagacaccuguucauguugauauuuugacuuccucucaugaauuaugaauguucuuaaugacaucuacgguggugaauccuuuccagaagguuuucaguuuacuuugcccaaaucuacuacaggaaucacuuuuuuuuuuuuuuuuuuuugagacggagucucgcuuugucgcccuggcuggagugcaguggugcgaucuugguuuagugcaaccucugccuccugguucaagcgauucuccugacucagcucccccgaguaucugggacuacaggugugugccaccacgcccggcuuauuuuuguauuuuuaguagaaauaggguuuugccauguuggccagggucuucuugaacuccuggcuucaagugauccgccugccuuggcaucccagagugcugggauuacaggcaugagccaccguaccuggccgaaauguauuucuuaaacaguaagacuuaaaaauugaaauuacucauugauacgugggcugcaggauagauguaucguacuggcaggcaugaaaguaacauucuucuuucugaacauauccaucaaagcccucgaaugaccugguccauuguuagugagugcuaauauuuugaaaggaauguuuuuuccuuagcaguaggucuugacaguggacugaaaauauucaguaagccaaccucuaaacagaugugcugucauccaggagacuguuguuccauauguagacagcaagcagauuagauauagcauaauucuuaagagcucuaggacuuuuugaguggcaaaugagcauuagcuucaacgucaaguuaccagcugcauuagccccuaacaagagagucaguuuuuauuuauuuauuuauuauuuuuaaaagagacaagagucucgccuuguugcccaggcuggccuugaacuccugggcucaagcgauucuccuaccuuggccucucaaagugcugggauaacagguguggccccagccugaccuuugaagcaaggcauugauuuucccucucuagcugugaaaguccuagauggcaucuucuucuaauggaaggcucuuuugucuacauaaaacaccuuguuuaguauagccaccuccagcaaugaucuuaguuagauauucuagauaacuugcuacagcuuccaugucagcacuugcugcuucacuuuccacuuuuauguuaugacgagagcauuuuuccucaugaaccaaucucuacuugcuuccaguuuuucuucugcaguuuucucaccucucucagccuucauagaauugaagaagguuagagccuugcuguggauuaggcuuuuugcuuaagggaauguuauggcugguuuaaucuuccauauggaccacuaaaacuuucuucauauuagcaacaagauuguuucauguucacugacauagugcuuuuaauuuuauucaagaauuuuucauuuacauucacaauuggcugagugguacaagaggucuagccuuaggccuuucucacuuuuugauaugccuuccccacuaagauuaaucauuuguagcuuuucaguuaaagugagaggcacaugacuuuuccuuucccugaauuguuugaggccauuguaggauuaggguuaacuaauuggccuaauuucaauaugguuguguguuggggaaacgggaggucugaaaagagggagaaagagagauagggaauggcuaauugguggagcagucagaacacacauuauauguuagccaucuuaugugggcgugguucaugguguuccaaaacaauuacaauaguaacaucaaagauagcaugguagcucacuccuggaaucccagcacuuugggaggccaaggcaggaggaucgcuugaguuugagacuagccugagcaacauggugacaccccaucucuauaaaaaauaaaucagccagguguggugguacaugccuguugucccaccuaccgaugaggcugagcacuugaguccggaagguugaggcugcagugagcugugauugugccacugcacuccagccugggugacagaacaagacccuuucucaaccaaaggaaaaaauauauauauaucacugaucguagaucacuaucacagauauaauaauaaugaaaaaguucaaaauacuuugaggauuacuaaaacguaacacagagacacaaagugagugcaugcugcuggaaaauggugucaguagauuuguucaggcuggguacuauggcucacaccuguaaucccagcacuugggaggcugaggcggguggaucaccugaggucaggaguuugagaccagccuggccagcauggugaaacccugucucuacuaaaaauacaaaaauuagcugggcgugguugugggcgccuguaaucccagcuacuugggagacugaggcagaagaauugcuugaaccugggagauagagguuucauugagccaagaucaucccacugcaccccagccugggcgacagagcaagacuccgucucaaaaaaaaaaagacuuguucagugcaagguugacaaaagccuuugcuauuuuaaaaaaaacucgcugggugugguggcuuacgccuguaaucccagcacuuugggaggccgaggugggcagaucaccugaggucaggaguuugagaccagccuggccagcauggugaaacccugucucuacuaaaaauaaaaaaucagcugggugugguggcacgugccuguagucucagcuacucaugaggcugaggcaggagaaccacuugaaccugggaggcggagguugcaguaagccgagauugugccacugcaguccaguuugggcagcagagugagacuguguccccaaacaaacaaacaacuuauuaucugugacgugaaauaaaaugagguaugucuguaagcaaaauggauauuccucuuaauguuugacauuauuuuuuaaucgaggaguucugaaaaauugauuuugcauggauuuuuuuccuuguguuuuucucuucaauuuuuuuuuuuuuuuuugagagacagagucucccugugucacuaaggcuagaguacaaugcugcgaucucggcucacugcaagcuccgccucucggguucaagccaccccaaguagcugggauuacaggagugugccaccaugccuggcuaauuuuuguauuuuuaguagggacagaguuucaccauauuggccaggcuggucuggaacuccugaccuuaagugauccacccaccuuggcuucccaaagugcugggauuacaggcaugagccagcacacccggccugauuguucaguuuacacuccuacuagugucgauuuucccauaaccugacuagcagaguguguuaucacucuuugcuaauuugguaucugaaaugauacuccuugcuuucauuuccauuucuaaaauuguuuaguugaauaucucauguguucagagacuuucacucuuucaguuguuggacuguauuuguuauuuuucuauugagaauuuguuuuucucauucacucauuuuaaaaauuauuauuuuuaaaauuucuuuucaauuuuuauuaauuauuauuauuauuauuacuauuuuuugagacagagucuugcucucuugcccagucuggagugcaauggugcaaucucgggucacugcaaccuccaccugccagguucaagugauucuugugccucagccuccugaguagcugguacuacaggcaugugccaccaugccuggcuaauuuuuguauuuuuaguagagaucucgggguuucaccauauuggucaggcuggucuugaacuccuggccucaagugaucugcccgcuuuggccucccaaagugcugggauuauaggcuugagcuaccaggccugaccaguaguuuucauuuuucauaucauuguucgauuucccugauuacuugguaaaguugagcacuuuaucauauucuauagguugauuaauugugucugaauuucuuauucaaaaaugaauuuguuguucauauccuuugucccuuuuuaaaaaaaauuagguuugugucucaggauacuuuauucuuccuuuauguucauaaguagaguuuuauauuacuuauuaaaguuauuccuaguaacuuuguuguugauaucucuuucuauuacaguagaauaauuauuucuacuguaugcuguauagaaaaguuauugauguuuauauguuacuguguugaucugacaaucuuaaagaacucuuuuaacauuucaguugauaaacuuguauuuucuaaguagacauuagugauauuuucugcuaauuaugacacuuuagccuguuccuuuaugguauuaaagugucuuauuucuuaucacuuagcuuaaugacacaacauccaguauuaaguggcuuuguuuuaaaguuugauucccugugaaauuuuauuauuuuguucagugggagacagaacuguaacuugcuuuucagaauuguuaggcuguuaucucaauauuuguuauugaauccauauuuuuguccugaguuauagaaccaucuacucuuucaacaaaacauauauugagugcuuauguuucaucuggugcuguuagguguugggggugcagcagugaauagaacaaauuucuagucuucauggaguauacagcuaaagagacaguaauaaacaaauaauauuuuuuugauccauagucauuuggauuuacagaugcggaacccguggacauagaagucuuacugcauuuauaucuguuuuuuuucugcauuuguugagaugaucauuuuuccuugauuuguaaauaugacaaccauauuaacagauuuucccuuuugauuucuuuaugaauuuucuagcuuucuuccuaugucauugauuucuaguuucauacaauuguuguuagaaagauacuugaaaugauuucauucuucuugaauuuguuaaaacuuguuuuguggccuaacauaugaucuauccuggagaauauucugugucugcuuaagaagaauguauauucagcugcuguuggcuagaauguucuguaugugucuguuagguccauuuagucuguaauguucaagucuguguuuccuuauuaauuuuugucuggauuauuuauccguugucgaaagugggguauuuaaguuccccacuauuacgguauugcuauuucccccuuuaguucuauugauagugcuuuauauauuuaggugcuccaaauuggggcauguauauauauuuauaaauguuacauucuccugaugaauugaccucugaucucuuuuaacacuuuuugacucaaagucuauuuuauuuuauguaaggauccucugcucucuuugguuaacauguguguggaauaucuuuuuccaucucuucacuuucagccucaguccuuuaaagcuaaagagagucucuuguaggcagcauauagguggaucuuguuuuuaaaaauccgcuuggcugggugcaguggcucacgcuuguauuccuagcacuuugggaggcugagguggguagaucaccugaggucaggaguuugagaccagccugaccaacauggugaaaccccaucuuuacuaaaaauacaaaaauuagcugggugugguggugggcgccuguaaucccaguuacucaggaggcugaggcaggugaaucgcuugaacccaggagguggagguugcggugagcugagaucacaccaucgcaguccagucugggcgacagagugagacuccgucuuaaacaaucaaaaauccauucaaucugugucuuauuggagagcuuaauucuuuucauuuaaaauaauuauugauagguaaggaguuacuacugccauuuugucaguuuuucugacucuuguaguuucuuuguuccagucuuccucucuagccgucuuccuuugugauuugacgauuuuuugguagugauaugcuuuugauuuucuguuucauguaucuuguaggcagcauaucauuggaucuuguuuuuaaaaauccacucggccaggcacgguggcucacaccuguaauaccagcacuuagggaggccaaggcagguggaucaccugaggucaggaauucgagaccagcauggccaauauggugaaauuccaugucuacuaaaaauacaaaaauuagccaggugugguggcaugugucuguaauccuagcuacucagguggcugaggugggagaacugcuugaaccugggaggugggguuuccagugagcugagaucaugccacugcacuccagccugggugacagagcgagacuccaucucaaaaaaaauaaaaugaaaugaaaaaauuaaaaaaaaaaucacucagccaaucugugucuucuggaguauuaaauuuauuuccauuuaaaauaauuauugauaggcaaggagaugcuaucgccauuuugucaauuuuucugacucuuguaaguuuguuuguuucagucuuccucucuugcugucuuccuuugugauuugaugauuuuuuugauagugauaugcguugguucuuuucugguuuauguaucuacuacagccuuuuuuuugugguuaccaugaagcuuacauaaaacaucuuauaguguuaauagucuauuuuaagcugacaaccucaacaguauaccacaacuuuacauuuaacgucuccuuucacauuuuguauuauugauuucauaauguauaucuuuuauauaucauguauccauuaccaaauuguuguauguauaguuaauauuuaauacuuuugucucuuuacauuuauacuagacuuaaaucugauuuagguaccaccauuacaguauuggaguauucugaauuugaauauauuguuaucuuuauagugaguuuuauucuuuaauauguuuuuauguuuuuagaguucuuuuguuucaauuugaagaacuuucuuuagcauuucuuguaaggcaggucuaaugguggugaccucccacauuuuuuucuguaaggggucacauaguaaauauuuuaggcuuugcuggcaauaugcugucuguuguaacugcugauaucugcuauuguagcaugaaagcagauguagacuguauguaaacaaauauacauggcuauguuccgauaaaauuauuacaaagaccaaguacaggacuggauuuggccucuggaccguaguuugcugaccagugauuuagacuucuaacaugguagauuacauugauugauuuuuugaauauugaacaaguguagcauuccugggauaaacccuacauggugugguauauuacucuucuuauguuccugaguuugauuugcuaauauauucuugaugauuuuuguguuuauguucacuuaggaaauuggucuuuaguuuugcuucuuuguacugucuuugccugauuuuggcuuuaggauaaugcugaccucauuaaaugaguggagaaauguuguucccuccuuuuucuggaagggauucuguagaguugguguuacaucaucuuaaaguguugguuagaaauuaguuagugaaagcaccugggccuggagauuguuauuucagaaaauuucauacuauaaauucaauuucuuuaauaguuacagagcuguucagguuacauauuucaucuugggugaguuuugguaguuugucauuuccuaugaauugguccauuucauuuaaagauaucaaacuuauguguguggaguuguucauacugcucuuuuauugucuucuuuuuuuuuuuuugagacggagucucccuccguuguccaggcuggagugcaguugugugaucucggcucacugcaagcucugccuccaggguucacgccauucuccugccucagccuccugaguagcugagacuacaggugcccacuaccacgcccagcuaauuuuuuuguauuuuuaguagagacgggguuucaccguguuagccaggauggucucgaucuccugaccucaugaucugcccgcugggauuacaggcaugagccaccgcacccaaccuuauugucauuuuaaugucuguggagucuauagugaaauccccuuucauuccuguuuuaguucauuuucuauugcuauagcaaaauacccgagaguugguaguuuauaaaggaaaaagauuuauuugguuuaugguucuggaggcugagaaaucuaagauggguugccgcauguggugagggcuuugugcugugucauaacauggcagagaagugcaaggggaagcacauguuugcaaagagaggccaaacaugagaggcauccucacuuuauaacaaccuacucuuguggguucacuucuccaagagugagaacuccuuucagaacgacauuaaucccucuuaacaaccuaaucaccucuuaaagguaccaccucucaacacugcuacauugcagaccaagcuucaacaugagauuuggugaggacaaaugauauucaaaccauaguagucauuuuuuuguguguguuaguuuugcuggaaucuugucaauuuuauugaucuuuacaaacagucagauuuugauuugaguuuuuaaaaaguugugguagaauauacacaaaauauaauuugccaucuuguuuuuuuuuuuguuuuuguuuuuuuuugagacagggccucacucuguugcccaggcuggagugugguggcgugaucuugguucacugcagucucugcuucccagguucaagugauucuccugccucagccucccaaguaacugggauuacaggcacgugccaccaugcccggccaacuuuuguauuuuuaguggagacaggauuuugccauguuggccaggcuggucucgaacuccugaccucaagugaucugccugccuuggccuuccaaagugcugggauuacaggugugagccacugcuccuggcccuuaacuauuuuuuuuuuuuaaccuuccacaguccuuuuauuuuggaauaggcuguaaacaaucaaaccacgagaacaugauuguacaacaguaaaauguucuccuguauuaaacugaagauaucuguuuaauaaaaaaaagaaaaagaaaauguaggaaagguacuuagagcuguuacuuucuaaguacacaacacccuagacaauucaaggcaucuuaaucuccaucaagaaaaacaagaaaaaauaauuuuugucacgcuguuaaauccaucauuauggaugaaacuggugcauauuggucaaacggauccaacaaacacugauguccaagcuggcauauuggcaacuaauacguaacugguggucaauagagaguuuaaaagaucuucccuuucuucuuguucuuuuccaagguucucgaagaguucuguucuaaaauauguuguugagcuucccaguuugccuucucauccucaaacugacgacguuuuuccucuaauucuuugugcugugcuuccaaauucuuuuucauuagcucacggcgccacuggagcucagcuucagaguccuuuaguuuuugaacuuuuuauuugaccuucaucucuaacaccugcuccaucuccaucucuaucuucuucauuuuagcugcauacucccuucuuucuucuuccauuugugccagagggcucuuagucagcugcccuuuauucuuguuguuaucaacuccauuauaagucacagcugccaguuuucugcuucuguaguucucauaguggacauuauuaguaacaucuuucaaguccugaguguguguuuuuaucagcauauuucuuagaauuguaaaaucacaauguucaccauuuucaacuucagcagcaccccaaggauacugccuuccuuugacccuuuugccauuaacuucaaugauaguauuacuagcuuaccacagcaagagguaaacaguccuuuaccuuuuuagcaaguuuauuuucuucuucaucaucuauuucuggaaaaucauauaucuuaauuuuauguucuuggauuucuuucauuaucuguuuuuuaaacuguuggcauuccucugguauaagugugucugcuuuggcaauaaguuggaugauaaucacuuuuucaugcgaacgcuucauaaacucaauauccaaugguuuaaguucauguccugaaggagcaaugaaguauaaacaacacugcacccugcuauuaggcaucugacgucuguucacucgugauucugcauuuagguaguccucagauuuacuaucaauguaaucgauaagaggcugccagcaauuacuauuauccacuacaucuccaaauccuggggugucagcuauugugagcagcaacugaacaccaccuucuuugauuaaaacuuuggauuguccaccuguauagucuuuuuaauucuaugagaaggaccuggauacucuggagcauacaaaucuguaaggaauaaugaguugauuaaugucgacuuucccaauccagguucgccucucuggguaagguggcucacaccuguaaucccagaacuuugggaggccgagguggguagauuguuugagcucaggaguuccagaccagccugcgaaauaaggcgagacccugucucacuuuguaugcuggugccagccgggggugccccugguaggugcucccuggggugucugcuucagggcuucugcgaaggugcaggucagggcuccuccagcugggaaacuuggaauaguuggcagcugcuuugaauguugguuccuucuucucugaugaccgugcugucaacaucaaaacacacugcaucugcugaguagaaaagcuuccucagcucugagugggagaccauccuuggaagaauuuuccucguuucuccagugcuagauuucuaggagaccacacucuucucuuccuguuccuucucuggauaaaaaugcagcacagaguucugacuacagauuucuucaagaaagaccuguggauuccgcaagagcaagagcccaggcucaggugaggcaagggugcggccggggcugcaacuggcgcuggccauugaggagcuucugcgcgaccuugcgaucgugcccgccaggcgccggcccguuggcucgcagcgccagcucgcgccgcgucuggcccuugcugcgcccggcucugcaggccgggaaguuguaaagcuccuccauagcugaugggcggcggcggccgggccgaagccugcggacacggaagggcugcagcucagcggcugguuacaucccgcccggccgucuguggccacccaaccccuuaacuauuuuuaaguguacauuuuagugaugugagauacauucauaauguagacacuauccauuuucauagcuuuuuaaaaaaucuuguuaaacucauacuuuauagccauuaaacaauaacucccaguuucucccuucucucagccucuggcaaccaccguuccacuuuccgucucugauuuuagcuacucuuaguaccuuauauaaguggaaucauccacuauuuuuuuuucuuugugacugguuuaauucacuuaggagauuguugucaagguucauuuauguuguaguaucgcauaugucagaaauuccuuccuuuuuaaggcugcauaguauuccaccauagacauacugccaaugugguaugucuguaccacauuuuacuuaacuguuaauuauguuuuauuuauugugaauaaugcugcugugaacauggguguauaaauaucucuuuggagacucugcuucugauucuuuuugguguauacccagagguggaauuuguggaucauauggcaauucuauuuuuaacugcuugagaaacugccguacuguuuuccagggcccauaucauuuuauguucccuacaccugugcacuaguguuucaguuucuccacguccuugccaacauuuguuauucuuuuuuuuauuuuucacaguagccauccuaaugggugugaggugguauaucuuaguuuugauuuuucauuuuucuaauagucaucgugagcaucuuuucauguuuuuuuggucauuuguauaacuucuuuggaaaaugucuguggaaguucuuugcucauuuuugaguuggguuguuuuugucagguguucgucccaccucauccuccugaguacccaggacuacaggcacaugccacuaugccccacuaauagaaucuauuuuagaccuaauuauauucugucuaccugaaagacaauugaaauaaaaugacauaaagagaaagauaaaacaugccaacacuaaucaaauuaagcuggaguggcuauguuaauaucagacaaagcacacuucaaaacaaaacacugggccgggaggcuaaugccuguaaucccagcccuaugggaagccaaggugggaggaucgcuugagaccaggaauucaagaccugccugagcaauauagcgagacuccaucucaaaagaagaaaagaaaaaaggaggaaguuuuuaguuaacuguuuguuuguuuguuuguuuguuugagacagggucucacucugccgcccaggcuggagugcagcggugcgauuucugcucacugcaaccuccaccucccuaguuggagcaauucugccucagccuccagaguagcugggauuacaggcgccugcuaccauuccuggcugauuuuuguauuuuuagcagagacaggguuucaccaucuuggccaggcuggucucgaacucgaccucaggugauccgccugccucggcuucccaaagugcugggauuauaggcgugagccacugcacccagccuacuguugcuuuugaaggauacuuuuuuuugcugcauguuuuguucaguguuuagaaggguuuuuccuuuaauuuucuccuuaguacuuuaaauauguuuuuuacugucuucuggcuuacauaguuucagacaagaagccugcagucauuuuuacuuuauucccccuuuaagcaauguguauuuucuuuugcugcuuuuaauauuuucucuuuauuaaucuuuuucagcaauuugacuauaaaguaccuuacugguacgugugugugugugugugugugugugugugugugugucugucuguuucagauuuuguugugcuuggaucugugggcuuauaauaauacagcuuuuaaaauuuacagcuaauuauuucacuaaacaauuuuuuugucccuaucccuuuaaccccaaccucacacauauuaguuagguagguugcuauuauuccacagggcacuguagcuguguugucauuuuucauacuguucuuuauuuugaauagauuuuuuuuuguuaugucuuuagggauaaugaucuucuuuugucauuucuaaucacauguuaacuuuucaaugugaaauuugcauuuuuuucuuuuuuucuuuucuuuuuuuuuuuggagacggagucucgcucugucacccaggcuggagugcagugguguaaucucggcucacugcagucuccaccuccuggguucacaccauucuccugccucagccucccaaauagcuaggacuacaggcaccugccaccacgcgcccggcuaauuuuuuguauuuuuaguagagaugggguuucaccauguuagccaggauggucucgaucuccugaccuugugaucugcccgccucagccucccaaagugcugggauuagaggcgugagccaccacacccggccugaaauuuacauuugauguuaucuuuugauguuaccuuugaguuccauguuauuuuuaauaucuucuguuucucucauauucauguuuucuuuacauucuugcgcauaugaggcauacuuauaauagcuggauuauuggauuaugcccaguaguuaaguugggaaucauuauuguucaguugagacuuauuuauuuuuuucauacagagucacucucaggauaaguugagacuuauuugucagcucuuuuagggauggucuagaauagcauuuguucuguggcucauuuagcccugcuccuaaaggugugucucacucuggucucugcugaauguguuacauagucauugaggucuugccacucuggcuaaagacaauacaguuggcuagagacaauacaguugauucgcagcuuucugugagcucugggaauuguucuucuguaauugcucucucccuggaaguuguucuuguucagucuucugggauuucacaucacacaugugcagauugguauucaguugaaacucaaggguaucccucugcagauuucuggagcucuuucucugaauaccucucuucucuuggguagucugucccacaaauucuagucuucuugagccaccugaaccuaugauuucugucuucucauuucagcucucauuuuggguuccuaucucugugugguaguuucuaaauuaaugccaagcagaaagccugugccaugguaggggucacccuguuucuuucccuuuguucccuucgccauaccuguugcccagugucuuauaauaagguuguuucuuauauuugucugguuuccuaguuguuugggcuggaggguaauuuugaccugucuuacucccauguggcuuuauguagaagucuccuauguuacuuuaggaacucaaguugguuucagauucugagauuaauauggaacauaaaguuuugguagaaaauuuucucaaauaaaguuaguuguauucuuuuacuucacauuucuugguaauaaagugaagugaagaacacugaaaugaaaggguuaagagacaggaaaaagaggggaacgaagaaaacccaaagaaggguuaaaauaaauaaucuucauguugucauuuguaauuagacuucaaacuuuccuuaaaaacugaaacuggaaauaucugacucaauauggaaauauaaaacauguaucuauuuugcuguuuaaauaugaaaguuggcaacugauaggguuuugaagaguaugaccauuaucuuugcauucagaauauaguguuugauuagucagaaaagucacauggcagaagccaaugagcagcaauaaggacaccgaugaaauaaaagaauucgaaaaugacaugaugucaauaaguugguccauugcccagaaggaaaggaauucugaugaauugaucaacguaaaaagcaugucuuccuagugccaaaaccaagaauagaaaucagaagaaaaauuugaaaagcaaaaauuaaaaucaaaauuauuuuuuaaggaguaaguagggcaaugcagauaacugauauguugauagagauuauaaacuagacagaacgagcuugaaauaaagccaguugugccaaaacaaacaacagcauagacagugauggucaagauaguggagaaaaaacucaaaguagagcaaaacaugggucugagagauuaaguuaaaaagucagcuaaaccauacgguuuccaauuucuuuaaaaguggauguuuaugauuaugaaaaaucacaaaagaaagaugaaaaguaaacucuaccuccauaauggcaugugaauuauuuugucauucucuauuuucuuugaagcagccauguugggauuguuucgaggauuucuagucucccaguccccaguucuuguauuggucuacagguuucuaaacaaaaagugauccuauuaaaaaaaaauucuuagaccucaugccuucuuacccccuaccgcugacucugccccagccaccguauauccuucuugucccucuaaccccccucacuugcucucaucucaagaauuuugcauuugcuguuacuucuacugcaaugcuuuucucccagauaucuguaugguuugcuucaucuucaguucugugcuaaaguggcuccuuacaaaauuuuauuuuaaaacauuuauuuuauaaaucuguuauuuaaaauagcuagucccuuuuucuuugcuuucuuuuguuggauguuguauguguaauacuuguuuacuguugucucuucucacuagaauguaguuuugugacaggagggauuuuguuuuauuuauuucuguauccacuguguuugaacagagucagacacaaaggaagauugauagaguaaucuaguaaugcuugcucaauguguuguccaaauacuuguuuaaaaugcuucaaacuauaauguuucaucuaucaguuuccgacagugggauguuaauaucucucuaaugauuaguuaccaauuucucuuuguucuguaaauguuugcuuuauguaaucugaaguucucuuauguuauccaaguaaauuaauuuuuuuaucauuaugacaguuuaagccauuuauguuuacugugaaaauucauauuuauauuuaucuuuuuauguuauuuucuauguaccauuuguuuucauuccuuuucugccugcuguuggauugaucaaauuuucuuaucccuucuuuccacuuuauuuuaauguuuucuaucaaauuuaaaaacaacuacuuaauaaauucuuuuuuuuugagacggaguuucucucuuguugcccaggcuggagugcaauggugugaucucagcucaccgcaaccucugccucccggguucacgccauucuccugccucagccucccgaguagcugggacuacaggcgcccacuaccacgcccggcuaauuuuuuuguauauuuuuaguagagacgggguuucaccguguuagccaggauggucucgaucuccugaccucgugauccacccaccucagccucccaaagugcugggauuacaggcgugagccaccgugcccagccuaaaaacaacuacuuaauaaauucuaaagauguucuuucuuuuuguccaugaacaauaagauccaccuuagaguguuuucucccuaauucacccuuuuucaucuuucagguuuuguagucuuuuuauuuaguucugccuucuuuccccuuucccccugugaaguuugaagugaugcuauuuugacugcuugacuuguuauguaacauuaacaaauuucuaauguugaaucauccuggcauucugauuauauucaauaggauuguucucaguuuuuauuuucauucauaguuuuugacaauguuuguuggaauucugagucagguacuuccuuuuuuuuauuuuugguuaagaccgacuuuuugauaguuuuuaguaguuuaauuauaaaaccauuuaggcuuugauuacuucaauuuuuuuuucuuuuugagauagaauuucgcccuuguugcccaggcuggagugcaguggugcaaucucggcucaccgcaacuucugccucccagguucaagcaauucuccugccuuagccucucgaguagcugggauuacaggcaugugccaccaugcccagcuaauuuuucuuuuuguuuuuguauuuuuuuuaguagugacgggguuucuccauguuggucaggcuggucucgaacucccuaccucaggugaucugccugccucggccucucagagugcugggauuacaggugugagccacuacgcccggcuggucaccuuaauuuuuaauauauuauuauguuauagcuccuucaugguuuagguugguuaacuuuuuuuuuuugagacagaguuucacucuuguugcccaggcuggagugcaauggugugaucucggcucacugcaccuccugcccacuggguucaagcgauucuccugccucagccuccugaguagcugggauuacagaugugcaucaacacguccagcuaauuuuuguauuuuuaguagagacgagguuucgccacguaggccaggcuggucuugaacuccugaccucaggugauccacccaccucggccucccaaaguacuaggauuacaggcgugaguuacugugccuggccuagguugguuaacuuuuuuaugagaacaagacuuaaauggauuucuuauuguuuaaaacauaguucuuuguuuuauucuuuuuucauauuauucuuuuauuucauauuguccccccccccccaccccccuuuuuuuuguuuguguguuugagacagucucacucugucgcccaggcuggagugcaguggcaugauaucagcucacugcaaccuccaucugucagguucaagcgauucuugugccucagccucccaaguagcugggauuacaggcacacgccacaacaccuggcuaauuuuuguauuuuuaguagagacggaguuucaccauguuggccaggcuguucgugaccuccugaccucaggugauauaucugccucagccucccaaagugcugggauuacagaugugagccaccacagccagcuguuuuucacuuuuuaaauguuuuauguuuuucaauuaaauacugaguugauuuguauuuuuucuuucuauuuccucccucccucccuucuuuguuuuuuuucuuuagcuggaauuacuggcacgccaccauguuugccuaauuuuugaauuuuuuuuuugguagagaugggguuucgccaugauggccaggcuggucuugaacucuugcacucaaaugauccaucuaacucgacccuccaaagugcugggguuacaggugugagccaccuuacccagccuuuuucuuuuaaagaguuuaaaauacugcgaaauaauuuaaaacacugacauuaucugaguacugcuuugucaguuuccaaguuuuuauguguaauaucuuguugcucuuauguguuauuaauuuuucuuuuacucauuucuauaccguauuuaguacaauucaaagaauuuaaaggcauuaguuuuuuuuuuuuuuuucaauugcuuucugucaggaauuucaccuugcugugacucuuaccuuuauuuuacuuuccugaaguguuuauaaauuaaauuuuauuaugcuuguaagguggacaugauuauaaucgugcuuaauuuuuaaaauuuuguuuuuuagucaucugcaucacagucaccaaaagcaccuuuuacaaagcuuuuaaaaauacauauaucuggucauuucacaucaacuuuauuaaauauagaaguuaaaccugguaugugaacuuugugaagaacccauuauguaguuaaaagccacuacuguagacagagggagacuucagaagguuaccuaaaaaaggggcaaaaccagagugaggaauacuuaagugaauuaugaggacacaauuauauucaugugggucuguccucacauuuagaguauaaggaagugcuggauuuaagggagaaaaugacuguaaacucugauauuuucuacuugauaugguaaaaugcuggaaaaaugcccuaauuacuuauuuuguauaccuucaaauugugccuuauguugaauauaagucuaagccuuaaaauuuaacauuuaacucuauguacuuauuauuuuuuuuuuuuucuguagaccucgaaguagggggaaaacugcaguggaagaugaggacagcauggaugggcuggagacaacagaaacagaaacgauuguggaaacagguaucagaacucaagaauuuauaagaauguauaaugaugcuuugcauauguuuguacacugcauguagcauuuguauaacaauauucuguguuaagcauuuguuuuuauacugaacucuaaguuucccaucugccuuguuuugauaacuaaugacaaagugaaaaaacugagcccucuaucucucuuuuuucccuaagcccugguuuaguauaauuauuuuauaucugaagauaaauguuuuaucaaggaaauaaagacugggagaaacaguaauccaggcuguuaguauaaucgcucauaguauauucuggccuaugaaccaucuaguguuuguuuaaagcuuauuuuguuaauauguguucugaaaaaaguaguauguuucguuauggaauuaauauugugaaaggcuaggccaaacuagaccaaauaguuucuggucuguuggacuuuuaggugcccuuaaauaagcugcuguauguugugcaucugcaaaagguagcuagaguugguugcccaaagcaguuuccaaaauuuucaggucagugguaaguuaucaaagggacuaggauucauauuguauugagaggauaccuguaggagauagucucucauugguaaaguuuucaauaguuguuagauaaaguuuagacacagugauaggcuuuuucucugaaguugaauaucaucuugaugcuuacagaauaucaugcaguuaagagaugagaaaaauuaaaaauuguuauagauuuuaaaauacauuuuuccagaaauccuuacaguugucagauguguugcuauuauauagguauaauucuuggaaagccuucaaauaaucuauaguuucuuuccaauaaggucuaguuagaguauuacucuuggaagcucagaauacuaaauuucacccuuuugugcacauucaugaauuacuguauuacuuuaaacuguuaauucuuuuucauaugguuuuuuuuucuguacuauauauuguuacuuuuacuacugaaaagucuuuuugaagcuuuaguguuuuuguuuguuuguuuguuuguuuuuaagacaagagucuugcucuguugccugggcuggagugcaguggcgugaucucagcucacugcaagcucugccuccuggauucacagguucaugccauucuccugcgucagccuccuuaauagcugagacuacaggcgcccgccaccacacccagcuaauuuuuuguaucuuuaguagagacgggguuucaccguguuagccaggauggucucaaucuccugaccucauaauccgcucaccucagccucccaaagugcugggauuacaggcgugagccacugugccuggccuauuguuguuauuuuugagacagagucuugcucucucucccaggcuggacuacaguggugugaucucggcucacugcaaccuccacccgccgggcucaugcaguucucccugccucagccucccaaguagcugggauuauagacaugcgccaccaugccuggauaacucguauuuuuaguagagacaggguuuugccauguugacgaggcuggucucgaacuccugaccucaggugauccacccaccucccaaagugcugggauuacaggugugagccaccgugucuggcucuaauuauuauuauugcuauuauuauuauuauuauuauuauuauuauuauuauucuuuuugaguuggagucucacucuugucucccaggcuggagugcaguggugcgaucucagcucacugcaaucucugucucccggguuccagugauucuccugccucagucucccuccuggucugggacuauagguggaugccaccacgccucgcuaauuuuuguauuuuuuaguagagaugggguuucaccauauuggccaggcuggucuugaacuccugaccucgugauccaccugccuugcccucccaaagugcugagauuacaggcgugagucaccgcgccgugccugauuauuauuuuuuuuaauuuuguuuuuuugagacagaguuucguccuuuguuccccaggcuggagugcaguggcgugaucuuggcucacugcaaccuccgccucccagguucaagugauucuccugucucagccuucugaguagcugggauuacagccacccgccaccacgcccggcuaauuuuuguauuuuuaguagacacaggguucucccaguguuugccaggcuggccucgaacuccugaucucacgugauccgcccaccuuggccucccaaaaugcuaggauuacaggcgugagccacuaugcccggcccuuugauuauugaagaugauuauuucaccaccuuuucuuuucuccugaaacuuccaacaccccuucucauuuuugauucuuuagugaugaucuugcuuauuucagugaaaaaauaaaaaauagagaacaauuagaaaagaaguuccauauucaucuaccaucaaaucuauuuucuugcuugcaucccuacccguauguuguuucuguccugguaaaaugggauaaagacugcggauaaagccagcuccucugcuugugucuuccauuguguccccucucauguauuacggacuuugguucugcaguuguccuugcuuuucugcaucaauaacuuuuccaucucauugauuucauuagcauaaggggggugcugcagaaucacccccuuucaacacaaauagccucucuugauccaacauccccuuuuagguacuauacagcuucuuugcuccaucauagcaaaaauccuugaguuauuuauaccuaugauuacuacuuauuuuucaccauuuucucaugaacccacucuaaugaagcuuucuuccucccauucuacuaaaauuauucuugucaauguaaugaucucauauugcccagaccagcuuuuagucuucauccuccuuaaccuuucaggaucauuucacacagcuaaccacucucaggagugaaacuuuuuuuuaaaacuugacuuucaggucacugcauugucuugguuuuuuuuuguuuguuuguuuguuuuuuuguuuuuuccuacuccuucacugguuuuuucucauucucuucgcucaucuucuuauguauuagguggucuuauucaguuuaauggcuuauuaucuauuuuugugcuauuauuauguuaucuaaaugcuaaugacucuaaaauuacgucaccagcucuuucuugcuuugaacacaaccuguaucuuucagcuuguuucuuaacaucucuucuuagaugucugaagaggaucucauauuuaguguguccucucuggaaauuuuuguuguuauccugaaacccucucuuccaguguuaccaccucugguauauugccacuguauauuguucaggcuuaaaaagauggagucuuucuugauuucacauuuucacauuuuacauuuuauacauucacauuuuagacauucacauuucacauuuucacauuuuagacauccagcccacuggagggcuuuaccuacccaguauauccuggauucaauuacuuugaccccuccacugcuauuauuccagaacuucacacuaccauuccacuggacugcugcaauagcuuccuaacuggucuuuuuccuuuucauuccauucuacucuugucccacacauaguagccagagugauccuuccaaauucaaagugagagccuuuuacuucccucugucaaccauccaaagacuccagugauauuuagaauaaaauucaaaguucaugcaguaccauuguuuucaggcuccauugaucugacuuuggcuacuuguauaaccguaucuuauguucccuuguucacugggcuccauccuuacuggccuccuggcuuuuccaggagcccaccaaacauacuccuuucucaggcauuugcacuuuuugucuucuuugcuuggaaaaauuuuuucucagauauucauacagcuuauucccuuacuucagucaagucucuacucaguuacaguuuucccagagaccuuuccugacaaacuugucuaaaaaguaacacuugucacuuugucuucuccugcuuuauuuuucuccuaguacguaacagauaggacauuuaauuucauauuggcuuauuguaugcuuuccacacuagaauguaagcuuuaugaagucaggggauuugucuuguuaccuuauuuauccccagugccaagaauacuucuagggauauaggaggaauuggauucacuaagugaagcaguauuguguucuugaauuuucuuuauguuuucuaagcuaccuaccauucuuggaacauuacaacauuacaacaaaacuaaauuccuggcauuuuuuuuuccuuacuggagaguaguaagccccacgaauggacugucuucucaugcugucuccuaugagaggucaaggcaaauacaguuuagauaaauguuuuaauaggagcagaaaacuauuuuuuuuaaccuggcuuuacuaaaguuaauaaagccaaguguauauuagucuuuguuuugucuuuguccuuggaaaguccauuguccacuucuuuuagggaacauagugaacauagggcaaggagaacagugaaagaaagaauaacuguuauaaccacuaaaccugcaaauccagacagaguuuguuccauaaauuucuaguucauuuaaaagcacauucaaguuugcugcaagguuuuaacauauguaugucucaagaccccaggguuuauuugaagguucucuuguuccuguaaauccugugccuugacaugcuuacuuaauguuuuguaguaauauaaggguauuacgcugggcgugguggcucacaccuauaacccuagaccuuugggaggccuagguggguggauugcuugagcucaggaguuggagaccagccugggcaacauggcaaaaacccgucucuacaaaaaaauacaaaaauuaguugggugugauggugugcaccuguaguccuagcuacucaggaggcugaggugggaggaucgcuugagcccgggagacaccaguugcagugaccuguaaucagucgcaccacuguucaccagucuggguaacagagugagauccugucucagaaaaaagaaaagaaugcuaaugagucuccuaccaugguggguggaugggaaugaguaaucuaggaguagccauugggaaaguaauaagaaaccucauuugguaauauuuuauguuaagaaaauuucaucuuuaucucagcucacugcaaccucugccucccggguucaagcaauucucugccucagccucccgaguagcugggauuauaggugccugccaccaugccuggcuaauuuuuuuguauuuuuagugcagacuggguuucaccaucuuugccaggcuggucuugaacuccugaccucgugauccaccugccuuggcaucccaaaguggugggauuacgggcaugagccaccacacccagcugagaaaauuugaucuuuuguuggugguggcuguuaccagucucugcgcauuuuuuuuauaugaauaaaaucaacuugagugaagugcuaguuacuugaagagaagagaaacuuuuuuuuucuugagaaucacauaaucaggucuuugcaaacuuguuuucauuaacuauaauuagcuaauuauaauucaguuaguuauaauuaaacauuuuucuccuaguguucaaguugucauaguuuggcucaugggagccccuugucagcuggcuucugaguccuuuuaaauaacaucucaaaaccuuucagagcucugugcucuuuggcaaaaguuuuauuuuucaggcccauuuaaaauucucccugccacaagguaugaaaucagcuauucucuaaggacuucuaguuuuuuaguggagaauaguauuagggacaaaaauuuaggcucaagggauaucgggggaaauucagccagauauugggcaaaauucacccccgauaauucacguagguucuuuucuauuuucccuaagcuucggcugguuugagaaauagagggacagaguacaaaggagagaaauuuuaaagcugggcauccgggggagacaucacauguugguagguuccgugaugccccacaggccgcaaaaccagcaaguuuuuauuagugauuuucaaaggggagggaguauaugaauagggugugggucacagagaucacgugcuucacaagguaauagaauaucacaaggcaaaugaaggcagggcgagaucacaggaccacaggaccagggcgaaauuaaaauugguaaugaaguuucgggcacgcauuguaauugauaacaucuuaucaggagacaguuugagagcagacaacuggucugaccaaaaauuuauuaggcggggauauccucuuccuaauaagccugggagcgcuacgggagacugggacuuauuucaucccuacagcucgaccauaaaagacagccgcacccaagggggccauuuuagaggcccacccucagggaugcauuugcuuucuuagggauguuccuugcugagaaaaagaauucagcgauauuucuuccauuugcuuuugaaagaagagaaauguggcucuguucugcccggcucaccagcggucagaguucaagguugucucucuuguucccugaacauugcuguuauccuguucuuuuuucaaggugcucagauuucauauaguucaaacacacaugcucugcaaacaauuugugcaguuaaugcaaucaucacaggguccugaggcgacauacauccuccucagcuuaugaaaaugacgggauuaagagauuaaaguaaagacaggcauaggaaaucacaaggguauugauuggggaagugauaagugcccaugaaaucuucacaauuuauguucagagauuacaguaaagacaggcguaagaaauuauaaaaguauuauuuuggggcucuaauaaaugucugugaaaucuucacaauuuauuucuuccaccauggcuucagccggucccucaguuuggggucccugacuucccacaacaaagggaugcauauuacaauuguuacuguugagaauuaguuaugugaguccacuuuagucauauacuaguacagucaugcacugcauaaugacagcagaucacauauaugacaguagucccauaaaauuauaauggagcggagaaauuucugucaccucaauaugucauagcugucaugaugucauagcugucgugaugucauagcacagcgcaacauagugcauuacucacauguuuguggugaugcugguguaaacaaacccaguguacucccaauuacauguacuauacaaaaguacacuacauacacucuugcacaguacauaacucuugauaauaagugacuguguuacugguuuauauauuuacuauacuauacuuuuuaucauuauuuuggaguguaccccuuuucuuaagcaaaaaagcuguaaaacagccucaggcagaaccuucaggagcuauaucagaagaaggcauuguuaucauacgaaaugacagcuccuuguguguuauugucgcugaagaccuuccagcagggcaaaauguggagguggaaagacagugauagugacgaucccgacuucguguaggccugggcuaaguuuaaaacaaaaacagagaaacaaaaaagaaaaacccuaaaaccaaaaaacuuacagaauaaggguagaaaggaagauuuuuuuuguauagcuguacaguguguguuuuaagcuguguuauuacaaaagugucaaaaaguuuaaaaaaaguuuauaaaguaaaaauguuacaguaagcuaagguuaauuuauuacugagcaaagaaaaauaauauuuuaaaaauuugguguagccuaaguguacaguguuuauaaagccuacuuuagugcauaguaauguuugaggccuuuacauucacucagugauucacccagagcaacuucuagucccacaagcaccauucaugguaagugcucuauguagguguaccauuuuuuguguuuuuacacuguauucuuaccauuguuucuauguuuacauauauuuagauacacaaauacuugacuguuguguuauaguugcguacaguaacaugcuguacagguuuguagccuagaguacuaggcuguaccaaauagccuagguuuuuaguaggcuauaccaucuagguuuguguaacagugacaaaauugccuaaugaugaauauuucagaacauaucccuguucugagaggacuguaauuacauagaucuauacacacacuuacaaaugugaguucacaucgauacauucaguuacuucuagcauaaguuuuuaaaaauagacuuuauuuuauuuauuuauuuuuuuugagacagaguuucacucuucuugcccaagcuggagugcaauggugcaaucucggcucacugcaacuucugccuccuggguucaagcgauucuccugccucagccucccgaguagcugggacuacaggcaugugccaccacgcccagcugauuuuguauuuuuaguagagacaggguuuuccauguuggucaggcuggucuugaacuccugaccucaggugauccgcccaccucagcuucccaaaguguugcgauuauaggcaugaaccacugcaccuggccaaaaauagccuuuauuuuucagagcaauuuuagguuuguagcaaaauugugaggaagguacugaaaucucccauaaauccccuuccccgacacgugcauagccuuuuucaguaucaacauccuauacuagagugguacauuugucacaauuuuuuaagccuacauugacacauuauccacaguuuauaguucacauaaggguucacucuugguuuacauucuauggguuuggacaaagguauaaugacagguaucugucauuauaguaucauagucacugcccuaaaaauuaauagguguuccaccuauuaaucccucccuccuugcucccucccuccuugcuaaccuauggcaaccacuauucuuuuuacugucuccauaguuuugccuuuuccagagugucaaauaguuugaaucauauaggauauguagucuuuucagacuggcuucuuucacuuaauaauaugcauuuauguuuccuccacauccuuuucuguuuuuuucuuuucucuuuucuuuucuuucuuuauggagucuugcucuguauucccaggcuggagugcaauggugugaucuuggcccacugcagucuccgccucccgguuucaagugauucucccgucucagccucccgaguagcugguauuacaggcaugcaccaccacaccuggcuauuuuguauuuuuaguagagacgggguuucuccauguugaucaggcuggucucgaacuccugaucucaggugauccacccgccucagccucccaaaaugcugggauuacaggcgugagucaccgcgcccagcccuccuccgugucuuuucaugucuugauagugcauuucuucuuagugcugaauaauauuguauuguuuggauggaccagaguuuauccauuugccuacugauggaauuucuauuugcacccugguuuuggcaguuaagaaagcuucugucaacaucuaugugcaauuuuuguuguggauguaaguuuucaacucauuuggauaaauaccaagcagcaugauuucuggauuguauggcaagaguauguuuaguuuuguaaggaaccaccaagcugucuuccaaaguggcugugccauuuugcauucucacuagaaaugaauaaaaguuucuguugcucuguguacuuacugacauuuggugguguugguguuccagauuuugaccauucuaauagguguguagugaugcccuguuguuuuaauuuucauuucccugauaacauauaauguggaacaucuguucauaugcuuaucugcccaucuguuuauguuuauuggugaggugucuguauucccuaugcuuuuuuucuuucuuucuuucuuuuuuuuuuuuuuuuuuuuuuuuuaagacagaguuuugcuuuuguugcccaggcuggaguacaauggcacaaucucggcucacugcagccuccaccucccggguucaggcgauucucuuaccucagccuccucaguagcugggauuacaggcaccugccaccaugccuggcuacuuuuuuuguauuuuuagaagauacgggguuucaccauguuggucagacugaucucgaacuccugaccucaggugauccaccugccucggccucccaaagugcuaggauuacagaugugagccaccaugccuggccuucccuaugcuuuaucuccugaaagagaguauagagaaaugguauaauuucuuccuuaaauguuugguagaauucagcaaugaaccaaacuggguguguucaauauucgaaguuuauuaauuuuugauucaauuuguuuuaauagguauagacguauucagauuauuucuucuuguguaagcuugagcauauugugucuuuuaaguaauugguccauuucaucuagguuaucaaauuugugggcauacaguuguuaauaguauuucuugaauauuuaagauuccaugggaucuguagugaugucccauuuuucauuuuugauauuacugaguguagauuuucccuccuuucugaaacaguuggcccuuuaauagcuugggguugaaccaugugcaugcacugauaaauggauuuuuuucaguaaauauauuggaaauuuuucguggagauucgugacaauuugaaaaaaugcguagauggacuguguagccuagaaauauuuaaaaaauuaagaaaaagguaugcaugaaugcauaaaguauauguagauacuugucuguuuuauuguuuacuaccauaaaauauacacaaaucuauuacugaaaguuaaaauuuaucaaaacuuaagcacacacuuaaagacuguaugugguaccauuggcaauugagagaaauguaaacaaauguaaagauguaguauuaaauaauaacugaauaaaauuuacuguaguacauacuguacaacuguaauaauuauguggccaccuccuguuguuauugcagugaacucaaguguugcaaauaucugauuaaaacaccaugggauaccaaucaucuuugagcaguucaucucuccaguaaauuggguaucuugguaaaaagugaucuggcgcuucucauguaucuuucaccauguucagugcagugcuauaaauugugcauaacaccacgggacccauaugaagugccacuaaugaugcuuaaagugcucccuacaagaagcaaagucaugacauacaagaaaaaguugaacugcuugauguguaccauagauggaagucuguagcugagguugcccacuauuucagguagacagucuuguaaacaggugacauaaacuuaugguaucaguaaauacaguauggucuuguaaauguauuuucucuuccuuaugauuuucuuuucuuuucuuuccuuuuccuuuuccuugucucccuggcuggagugcaguggcacgaucuuggcucacugcagccucugccuuccggguucaagcgauucuccugccucagccuccugagcugggauuauaggcacaugccaccacgcccagcuaaguuuuuguaucuuuaguagagacgggguuucaccguguuagccaggauggucucuuaucuccugaccuccugauccgcccgccucggccucccagagugcugggauuacaggugugagccacugugccuggccaugauuuucuuaauaacauuuucuuuucucuagcuuacuuuauuguaagaauacgguauauaauacaacacagaaauauuuguuaaucuacuguuuauguuauugguaaggcuuccugucaacaguaggcuauuaguaguuaaguuuucaaggagucaaaaguuacacagauuuuugacugugugguggggggguuggagccccuaacccucucauuguucaagggucaacuguauauguguuaaaugccauaacuuuuccucuaagcacugcuuucacugcaucucacaaauuuucuuuuuauuuucauuuaguuuaaaauauuuuucaauuucucuugagauuucuucuuugaccuauguguuauuuagaaguguauuguuuaaugucucaguauuuugggauuuuaagcuaucuuucuguuaccgaauucuaguugaauucugacgugaucugagagcagacauuguaugauuucuauuuuuaaaaaucuguuaagguauguuuuauggcucagaauguggucuaccuuguaagugucccauguggaugagaagcauguguauucugcuauuguugaugaaguagucuuuagaugucaguuauuuccaguugauuaacggugucagauucaacuaugucuuuguugauuuucugcacgccagaucuauuucugagagggguguuaaacuuuccaacgauaauaguggguucaucucuuacuccuugagauuguaucauuuuuuugcuucacauauuuugauguucuguuuagacacacugaugucuugggaauuaaccccuuuaucauuauaaaaugccuuucuuuauuccugauaacuuugacaucugagcugucugaaauuaauauagcuacuccugcuuucuuuugauuauuuuuagccuggaauaucuuucuccauccauuuauuucuuauccguauguaucuuuauauuauaguuaaagugggguuuuuuuguagacaauauguacuuggguuuucuuuuuaaaaaaucuauucuaggccaugugcgguggcucauaccuggaaucacagcacuuuaggaggcugaggcagguggaucgccugaggucaggaguuugaguccagccugaccaacguggugaaaccccaccucuauuaaaaauacaaaaauuaaccgagcaugguggcggguacugucccagcuacucaggaggcugaggcacaaaaaucacuugaauccaggagguggagguugcagugagcugagaucgugccauugcacuccagccugggcgacagagcaagacucugucucaaaacaaacaaacaaacaaacacaaccuauuauaacaauuucugucuuuuaauugguauauuuagaccauuguuacucaaagugauucuucuuuauuuuuagagacagaaucucacuguaucacccagguuggagugcaguggugccaucauauuucacuguaaccuugaacucuugggcucaagccauccucgcaccucagcuucgcaaguagcugggacuaccugugcucagccucccaaguagcugggacuacuggugcacaccaccacuccuggcuaauuaaaaaaaaaauaguuuuuuuggagggacggguucucgcuguguugcccaggcuggucuugaaaugcuggccucagccuccuaaaguggugggauuacugggaugagccaccaugcccagcuuuagagugauuguugauauaauggaauggauaucuaccauaucuguuaacuguuuucuauuuauuguccuuguucuuuguucauauuuuugucuuccacucuuuuugugcuuuuugugguuucauuuuauuuuauuguauuauaauuuuuugagacagagucucacucuguugcccaggcuggagugcaguggcaucaucuuggcucauugcaagcuccgccuccuggguucacgccauucuccugccucagccucccgaguagcugggacuacaggcgcaugcuuuccugcccagcuaauuuuuaauauuuuuaguagagacgguguuucacuguguuagccaggauggucucgaucuccugaccuugugaucugcccgccucggccucccaaagugcugggauuacaggcgugagccaccaugcccagccugccuuuugugguuuuaauugagcaauuuguaugauucuguuuucucuucuuucuuagcacaguucucucuuuuuuuuuuugaguuguugccuuagaguuuguaauauauguuuacaacaaacccaagucuacuuucuaauaacacugugcaguagugucccacuuuaacugugguuuugcuuuucacaguuuugguuaccuccaguuaaccguggucugaaaauacuaaaugggaaauuccagaaauaaacaauucauaaauuuuaaguuguacgcuguuuucaguagcauaaugaaaucuugugcuuuucagccugagaugugaaucaucucuugguccagcacauccauacuguauaugcuaccugccuguuagucacuuaguagccaucuuaguaugauugaaaaagcauacuggauauauuggguuugcuguuauuugguuucaggcauccgcuggggucuuggaauauauuccccauggauaagauggcaccacuguaauuuucacuuguaaugugaguacuuuauaagaacaaaauaauccuaauuccuuccucgcaucccuuguauuguugcugucagucauuucaguuauacauaagcauauguauuuauacauaagcaaucauaauugaauacauuguugcagauauuauuuugaacaaacuuaucuauuagaucaguuaauaagaaaaaaguuuuuuuuuaaaauuuuaucuucacuugccccuucugagaugcucuuccuuucuugauauaggucuaaguuuuugaccuguaccguucuuguucucucugaaggacuuuuaacauuucuugcaagguaggucaucugacaacaaauucuuaaauuuuuguuugccugagaaagccuucacuuuugaaggauaauuuugcaggguacagaauucuagguugauguuuucuuucucucaacauguuacauauuucauucccucuuuucuugcuugcaugguuucugaguugauguaauuguuaccuuagguauuuuuuucccucugaccucuuuuagguuuuuucaguauucugugguuuuuaauaugaugugaccagguguaguuuguuugggcauuuauccuuuuugauguucuuugucauuugguuucugagauuaauuugaggaauauuucuucuucuuccucucuuuugucucuuuuugguauuuccauuacauguuaccuuuuuguaguuuucuguauuaaacauucuguucuuuuuuuuuuuuuuuuucccagucuuuuucucuuugcuuuucagguuuggaaguuucuuuugaaauaucuucaagcaaugagauuguuuccucagcugugugaggucuacuaauagacccacuaaaagcauucaucauuucuguuaguuuuaaaaaaaucucuaucauuuuaaucucuagaauuucgaguucucugcuuacauugcccacgucuucuugcaugcugucuacuuuauccauuagaaccguuagcauauuaaucauaguugcuuucaauuccucaucugaucauuucaaauuccuuccugcauccaagucuaguucugauguugcucuauacuguguuuuuugcuuuuuaguauaccuuguaauuuuuuuucucgauagccagguguaguacacuggguaaagacaacagcuguaaauaggccuguaguaauguggugggccuuguaggaggagggggaagucugaauuuuuuacucuuccuccccacccugcccuuucacugcuuuuagguggggcagaauggccuagaaugggcuaaaguuagauaguucucuuaggcuagaacuggcuggaguuuauuucucuucucguagguuaggcucuaguuaaauaguuucuccugaaggcaggccuuguuaagagaaaugguuccuuuuccccuccugcuguugaaagcaagaagauauuuuucugugaaguucacugugagaaacugguagagcuccuagagguaaaacacaaaaccguggggccccacgaugacugggucccucuguaguuuguaucuuccagacucguccacacugaaccuccaacguuuugucaauuaugguucagguuuuuguacccauggagcuuuuuacccauggguuucugcucagguaaguugugauucaugucuauuccuccaguucugaggguaccuguuugcccugugacuuuauugaccuuaugguucuagcaagaguuguugauuuuucaguuuagcuuuuuacauguauuaacuauaguuauaucccuuuucuaauuugguaagccaguucuaacuauaguggaauggauuauaauuguuaacaauaacuaaguuaauaccuauccauuauuauaaauaugucucauaaauaauaauucuuauuaaaauaguaaaacuaucggauuuaauaucaagauuaccauuugugacuaaccuuugagggauuuccacuaaugaugucuaucauacugccuugaguuauguaucaaaaucuuagauuaucuucuggucuaauuauuuguuaauuuuuagcuguugcuuauguaaugacuauugguucuuauuuaguggugguuuucagauguuaguauuuaauugacauagacaagauaggggucuuuugcuuugucaguacacuugaugagacagguggaauuggaguuccaaagccauacacguguuacuuuacuucagcgccuuuugguuauuugcauaugguuuaaguauacagcuuuguauaaacccuacauaugccuuuauuuacaagaauagaaacuuuagugauauuauuauuuuaaaaaguggacaccccaaauuauuguuuguacauuuugagucuagcugcuaauucacaacagauuauggugacauuuggcacaaagaaaaagccuggauucuuauuacauuaauuggccuaacaauuuaacuuuaccuguccuuucuuaucuuuuuuugauaugaaaguuuguaauugacacuucucuuuuugaaguaucagguuuuucuuuggauaaaauuuucccuaacuuuaguauauuauuuaaaauuauauacuguggugguagauauugguguugucugucaaauaguucuggcacucucccuucuggauaugugguggaauuacacagcuccaagccugcuugacaggcccaugugacuguguccagugaauuguggguggaaaucauaugggucacuucuggacuggagcaaaacccucugagcuuuuuucuuuuguaguuacugucaguguuugaaauacugacugcuucgaugguuuaguugaagagauggugaagcaaagacaccuauaugucuuugauaagccauacauaauuuucaaacugaaguuuaaaaugaaaaauucagcuucuuauugccacguaacaaaucauuucagaacacaguggcuuaaaaagcaaacauauuucaugaucuuguggguuaggaauuuaggucaggcuuggcugggcaguucugcucugcuggcauccaccagagucauuuauugcuauucaggugacaccugggcuggucuagaggguccaagacaguuucauugguucauuuuuguuuuuaaggccuaaauaaaguuaaauuucagaagaagaucaauauugguagaaauaauuguuauaaagauguauguuguaauuuguugguuuauuuuaguuucuuuuauuaauugcaaaaaauuccauuaacauuuaaaaguuauguaggaaaacuaaaggaaauacugauaacaacuaaauaaaacaccuagagaacaguugacuuccaacaguuacuauuuuuuuucauuuauuagcagucuauccugcuuaaacaauuacuauuuaaauuaaugcccgcauauuuuuuggcuuuugacaaguauuggacucuuaagcuuuuugaauuugcauuaaaaaaucacauuaaauauuauaacaguaauguauauuuguagaaauuuauggaacuguggguaauuauaaagagaguaagucaccuguaaaaguguuaacucucagagaaaauuagugcuuuuuuuguguauuuacuuuuaguugcuuacauuguucugugaaagcagcaacuauauucauauuauuaaucagugucaauauuuuaaguaguuuagugaauaaagauaguguuaauaaauaauuugcuuuuucuaauauagugcuaauguuuuagcuuuacaguacaauuuugaugacauuggauacacuagauucaaugagauauauccagaaaacauaacugucaggaggcagacuucuuucaaaagaagggagggacaugguuacacaauuucuuagcuauguuuucuucuguaguuuuaguaggaagcaagcaugaaaaguauugccauucucuggaguuaagggaagucaguuauucuauuuaauagcugauuaggcugggcauggugaugguggcucaugccuguaauucuagcacuuugggaggcugaggugggaggauaacuggagcccaggaguucgagaccagccugggcaacauaguuaaucccugucucuaccaaaaaaaaaaaaaaaaaaauccaggcgugaucgcaugugccuuguaguccuggcuaguggggaagcugaggugggaggauaccuucagcccaggaguuugagguucugaugagcuaugauugugccacuguacucuagccugggugacagagcaugagcccaucucuuaaaaaaaaaaguugauuaaagcauagagggagaaggcauauuuuuuggauaacuagucgauaaugaaugucaguguuuacuugcauaguuaguaaauaugaguucauuuuaaauauauuauuuuucucugugcuuuuuauaaaucuuuguaucuauauaugagauuuaucugcuugcuuuauauuauauaauauuaauuaagcaacuaucgaacaucauucagguuuugugguagcucugguuuauaaaaacagauacagugccuguuuucauagagcauauagucaaauuggggcuguggucuccugugaauggcacauacagaacagggguucuuaacuuuuucagugccauaguccccuuugguacuaugauguaauccauggacucuuuuucaaauaauguuuuuaaaugaauaaaauaaaaauacaccaaaauaggauuacaaagauaaacaauugcauugaaauaaaaauaagccaaacuuguaaucuuauaacaucuuuuuaauucacuuaaauuauaaaaucuagcagugaauuuaauaacuacuguaauuuugaaguagugaugagggugaaugauauuuugggauaucugcaacaacugcaugugauaagaaaauauccgugauuucuguuggugacaaacacuuagguauccaccaauaccacugugcuuguugcuuacauucuuaauauuuucuuagaauucuaaauuuuggaagugaauaaaaauuagagguuaguaaaaauaaagaaguaauuucucccucuaaaauccuauaacccuugagugaguaaacuuuaaaaauccauugaaaaaguaggacgcuuugaaagaauauacuaauguauugauaagggaguccaaaauugaccucuaaaauauuuuugacauagccuguuaugcuaucaguguugguaaguuuguucaguauauuuguaggcuacacacaguccuuucaaagaaguauuuaaccuuugagggaaauacuuuuguaauuguucaaaaucaaaaugcuuuauuucugugaacuuggcugugagauaaauguucuguccacuucauaauuuuauucagcagugcuuaaaaaagaguauuuuuaguuaucucauaguguuuauauucaguaagugaucccucaguaacaugguccuaguaagacuguuaacauuucucuuuaauauugauguauuuauaaaacuuacaugcuacacuuugaugcucugccaggcgguggaaguagugaaaagagcacaucaggcuuuagaguuacacaacccgauuuuguaucccagcuuuguuuccuauuagcuuugugaucuugagcuuguaauuaacuuucagauuuuaguuuccuuaucuuuugaaugaagaaaauauguuagauguuauucuuuuuuuaaaagagaaaacuugagagagaacuauuaggcacacuuugauuuauccuuuuaguuuuagcugggcuucuaauaccuuucugaagccuuucugagcuguauuccccaccucuuccccuuaacucccaucaugccaugugcuuaccagcaucaucauuauuguguccuauuuuuauuuucagucuuucaucuagauccauuaaacguagggaucuugacuaucuuuguaaugacuaccauuugaauagaaauuauaguauguacuuguuacucaaaauuuuguuugguaaauaaccauucuaaauuaaugauauauuaacucuggagcauagaucggagggggcuaaauaaaugucuucuuuauucucauuaauucucauaaugcaauuuaauaauucaugaugugacaucaagaguuagaaauugaguaggugagggcugggcacgguggcucaugccuguaaucccagcacuuugggaggcugaggcaagcggaucacgaggucaggagaucgugaccauccuggcuaacacagugaaaccccgucucuacuaaaaaaauacaaaaaauuagccagguguggugccgggcgccuguagucccagcuacuugggaggcugaggcaggagaauggcgugaaccugggaggcagagcuuucagugagcugagaucgcgccacugcacuccagccugggcggcagagcgagacucugucuuuaaaaaaaaaaaaaaaaaucaaguuguauaagugagguggacaagugaauccauagacuauagugugugaauguagauagaggucaucagaauagcagcuacaucacuacacuuaagacguugagcuaagugcuuuucaugcguucuuuuuuuuuuauuuuuggaucauaaagacaguuuuauacuaggugguauugucugucuuaaaugacgagcaaaguaaaauugagaugaaguuaaguaacuugccaaaggucacauugcuagcagauggcagagcuagaaugcagacucggaaccauuggauuccaagccuuugguuuuaacuaacacagcagacaccuuuugcuauuaaacuuucucaugucuuagaaccaauuuguguaggauaaauuagagucauuggagguggaaaaguaaagguuuaaaagaggguauguuaugaacuuauuuaagggaaaggguuagaucuaauuuaucuuugcauccccagagauaaugccuggcacauagcugaugcuauuuaaugaagugcacauugucuucaaguucucuuaggaaucuacuuacaugugauuagguucucuuuuuuauuguuguuguugagacagggacuugcucugucacccaggauggagugcaguggugugaucuuggugcagcugcaaccucugccucccaggcucaagugauucuuccaccucagccuccugaauagcugggucuacuggugugugccaccaaggccggcugaauuuuuuuugcuuuugccauguugcccaggcuggucuugaacuucugggcuuaagugauccuccugcuucccaaagugcugggauuacaggcuugagccaccacgccaggucaaugauuagguuccuuaguauaguuuaccacuguacaugugccaccuaguggauggagauuauccguagauaguggcuacagaugaaaucgccuugccuguccuuaucccaggguugcaguuguccccaccuuucugacuuuggugcauuuugugaccaagugucauugccuguauuuuaggucagguucaaaguaagggaaaagauauauuagggauuuuauauucaagaaaaauaccacacugaauuuuuaaaaaugcaauguaauuuuuuaaaugucugcuccaauuuccacaguuuggcuugcaggcaguuugagcuaauuggaccucaugaaaggcaaaaacucugcaaagugguggagucgccaaaccuggacuguuuuauugguugaauggcuagcuucuuucuuuaggcaaagcauaggauaguauucaagaguacauuuuuaauaauaaacuggagauaauuaaguacuggcaucaggcauauuuccucagauaucacuggguuuguagccauuucauccagagcaucucuggaugacaucucugguuggaucccugguugacaucauuuuuauccagagcagucuguuucacauucugcugccaaacucugacaauuguuugaagacuaggauuaggagaagagagagagacauaaacacucaguuguccugccuugacuuugacagauacuaagaucuaacauagucuaccaaaugaagagugacaguuaaagacagcuucuguuauuaccugaaguaucaaauauuuagugauaccuuuuuuguuguuuguuccuauuuuguggcaggaauuacugcuaucuaggaagcagucauagaguccucuuuauuuguuaaagaacacaagacugaaacaacaaaaucuaaaccaaaaguaaaaccaaaacuaucgcucccuacuguuucuuuagcagauccaaguuagaaucaugggcagagccaguaauaauaauagcuagaggagaaaagagaacaggaugaacucugaaagccugucuucuuaccugcuuuaugggaucagaucuggugccgauccuauuucuuaaaaaacaaaaaaaaaacaaaaaaacccuauagucugaaucuguuuuuuucucuuugaaaugcaggaaacauaauuucaaaagguuguauaccugcaaaccuacuggccaaccaguaacauuaacguuuaacuuuucuauuuccuucuggcucuuauuugagggagagauagacauuguccugcuucuuuucccuuagcuguaagcaauaaaacuccccuaaaaauaauaaaagugcuauguauuuucuuuuuuggggauaaaaauaaggaaaaagcugaaacuguuauauacuucgcuaggagaaggaaauuuuugacuggaggucauauaugguagauagcagcauaguaaaaggaagcagacaagucauacuggauuggagagagcacagcuugggaguggagacaaauggaucuggcuccaggaaaaaauguguuuucaggguaauguaaugauuugcgacccugggccauuuggcucauuguugguaaguuucugaaggcacuauucuuauuccuccuuaaguuugucacuuauuuuucucuuccccuuucuuguuacccaguaguaagaaugguauaaaauggguauaucccaaaauguauucugggacucucugaguagaaaugaaaugcuuucauacagguauuuauauaugugauaauuuuauaguacuuugaauauaauaggcaggcagagagagucucucuagcagaacuguauucuuuucuaucuuuggcuguaaaaauacuagagagaggcaacacagaauacccuuugggucauuccagaugcuuugccuagagcuacaggcucuguagguacagucuacauuccaaauuguuguaggucauagcuauauuaaauauuuuaauauagccuaaaaagggucaguugauuuucagacuccauuaucaguguuucacggccugaucaagccacuugaagauuuuguuacggcaauucuucacucuuuaauaccaguuuucuguguuaauuagggcauggguuaaacugcuguaacagagaccccaaaauauagcaguggcuuaaauaaaacaaauugaucuucucucauguaauauuucugaggauggagagguauaggcugaugaguugucuuuugcuccauauuauuguuuguugacccagguuucuucugucuugucucucugccaucaccuggagcauugcgccucauuggcagcauugcgacuggguugcugucauguccauuccagucuguaggaaaggggacuauaauuuagugaagagcagcucacuuccuuuuagaugaugagguugcgcaguugcuucuggucauauucucucggugagaacuugccaugguuugcugcaaagaggguuggggaauaaagucucuagcugagcaguuauguguccuacuaaaacuuggaaagcauagaagaugaagaguauggauuuuguccuuugucuacuuucuuucuuucuuuuuuugagacggaguuuugcucuuguugcccaggcuugagugcaauggcaugaucucggcucaccgcaaccuccgccucccaaguucaagcaauucuccugccucagccuucugaauagcugggauuacaggcacgcaccaccucgcccggcuaauucuguauuuuuaguagagaugggguuucuccauguugaggcuggucucgaacuccugaccucaggugaucugccugccuuggccucccaaagugcugggauuacaggcgugagccaccgcacccggccccuuugucuacguucuacagguuuaugugccuuguucaucuuuggaguuauuuagcuauucuugaucugaauaccuuuuuuuuuggggggggauucaaauuguauuuauuuucucucaucugugacacauucauuuuguucaugaggucauuugucacauagaaauguaaauuuucauuuuauuauuccuuuugaauacaagcuuacguauuuguagauuugauucuagauacuuuaucaauuuugucucgggauagacaggacaccuugauugauagacuguauaaacacuuaauuuaaggucagcuuuucuauuucaauuuuuuaaaaaagaaaagaaacauguuauuuuaaguaugaaaaccaaaaccaucuguuugaugcuucauguuaucauuaguuuuaugauuugauaggauuuacaauuauuuguaguuuuuucuaacuacccaagaauaguuauacaaauuguuuuucaaaauacuuuucuaaaauucauuuugaauguagaagauaguuuucuuuuuuuaaagagggaagucagauugaagugcuaaucugagcgauaagagauaaaguuuugugugaaauuuaguguucaagcugcuaaguaugucuaguguauaguuaaaauaugguguggaacucaggagaggaguuagugcuagagauguugacuuacaaaucauaaaguccagaggaaauuguugaaauguggauaauaaguucuucaaagaggagcuuauaggcugggaguagugacucaugccuguauucuuggcacuuugggaggccaaggcaggaggaugauuugaggccaggaguuugagacuagccugggcaacauagugagacccccaucucuacaaaaaaaugaaaaagaauguggugacaugugccuguggucccagcugcuugggaggcugaggugggaggauucuugagcccaagaaugcgaaugaucauacuacugcacuccagcaugggcgacagagugaguccuuuucucaaaaacaaaaacaaccacccaaccccaggaguauauaaaggauguauagagggcuguaccuauauuuagaggucuaaaggaaaucagcugaagagauagauauuagacuauuauaucucugugcuuauaaaagauagaagaucauuucacuaaggaggaagugauccuggugugaagugaacuuuuaggauguuugaagaaagcuugugggugcuaacuggauuguuaauucuuuugccguuggucuauuggugguguugacgagaauaauuuguguguguguguguguguguguguguguguguguguguguuuugagacgcaguuucauuccuguugcccaggcuggagugcaauggcaugaucucggcucacugcaacuuccaucucccagguuuaagcaauucuccugccucagccucccgaguagcugggauuacaggcaugugccaccaagcccggcuaauuuuauauuuuuaguagagacaggguuucaccauguuguuggucaggcuggucucgaacucuggaccucagguuauccgcccaccuuggccucccaaagugcugggauuacaggugugcaucaccauacccagcugagaauaauuguuauaauaggaggcuggauacaauuagaaagguauaguugaaggggaagguaguagaguucagucaugccaucucaugaauuuggugguaaaaggaaagacagagaagaggcgcuugaaaggacuuuaagauguuuuuguuuguuugggguuagugaugcagaaaggucuaaauaaauuucaaauuagaaaagaaggagccagccaagagcauggaacugcaucaugagcacugguggggagguguaaugucccuucauuguaguaauagagcaugacagacagaguggacauauaauuuuuauuaaacaagaagaaugauguuagggguagugguguguggaaauccucucagcuguuaggcugccuccugagaaagaacauuuaagguguuugggguuggauucaaggagaauggaaaaaggcaauaaagugaagguuuguccuuuucaaauauuaagcuuuuagaauggguaauaauuaagauacaugaugagucuuuuaaugaugauuuuauaaagugugaagcaauuuuuaaugagucacuuugaaauacauuuguucuguagaccaauugcuauaauccugaaauaagauuuuuuuuuggccgggcacaguggcucaugccuguaauuccagcauuuugggaggccgaggcagguggaucaccugaggucaggaguucaagaccggccuggccaacguggugaaacccagucucuacuaaaaauacaaaaauuagccaggcaugguggugggcgccugucaucccagcuauucaggaggcugaggcaggagaauugcuugaacccgggaggcagagguggcagugagucgagaucgcgccauugcauuccagccuggguggacagagcgagacuccaucaaaaaaaaaaaaaaaaaaaaaaaaaucuuuuuguuguuguuguuguuguuguuguuguugagguaggaucuagauguguugcuuaggcuggaguccaguggugccaucacagcucacuguagccuccgcugccggggcuugauugauucucccaccucagccaccagagucgcuaggacuacaggugugugccacuaugcuuagcuaauuuuuuguagagaugggguguuaccauguuucccaggcugucuugaacuacugggcucaagcaauaugccugccucagccucccaaggugcugggauuacaugugugagccacuacaccuggccaaaaauaagauucuuuuuuuuuuuuugagacagggucuggcuuugucaccuaggccugaguacaguggcacgaucccagcucacugcagccucuggcucccagguucaaggcauauccuuccaucucagccuccugaguagcugacauuauaagcacucaccaccuugccuggcuaauuuuuacauuuuuuguugagaugagguuucaccaucuugcccaggccagucugaaacuccugagcucaagggauuugcuugccuuggccucucaaagugcagggauuacaggcaugagccaccaugccuggccaagauucuuaacauuuauuacuaggaugaaacuucucugagucagcuauaauuugggcacaaggaaaaguauaccaugcuucacauuauuuugauaaucauuuugcgguagagaauaaagaugcacaauaccacuaauuacgugcaugaacuuuucuuguguuagugaaauauuguuauuuguuguuucuuuuuacauuaugaccuaugcuuuauagauacauucaccagugauuaaaauaaacacaaaaaugacucuuuguuuucucuuguuuacuguuaagcagaaaucaaagaacaaucugcagaagaggaugcugaagcagaaguggauaacagcaaacagcuaauuccaacucuucagcgaucugugucugaggaaucggcaaacucccuggucucuguugguguagaagccaaaaucagguuagagaaugaaugcagcuggauuggauauuagugacaggaauaaagcagugaaaugacuauagagaaaauucaaggaguaugaguuuaggaugaaaaucugggugggauuuuaugauuuaguagcuaaauuugaagcugauaccucuguguuuaguugggaugaguuacaucugugggcuuaggcaauuguagagcagggcagcacacuacgguuuuacucuagucaccucaggccaguacagaauauuaccaaugugcuguuccuggcagaagacauaaaugugagcauuuagcaugaggauuaauuuuugauacuuaccuguaaacuuaaguugauaguuuuguuccuuaccuucuccccauucauuaaaaaaggaaacacaggacauuauaaccuauuuuuuuucuuucuuuuucuccccccccccaccaccccucccccccucccuuuuuuugagauggcgucuugcucugucaccaagcuggagugcaguggugccaucucagcucacugcaaccuccaauucccugguucaagagagucuucugccucaggcuccugaguagcuaggauuauaggcaugcaccaccaugcccagcuaauuuuuguguuuuuaguagagacaggguuucaccauguuggccaggauggucucgaucuccugaucucaugauccaccugccucggcuucccaaagugcugggauuacaggcaugagccacuacacugggccuguaauauaucauuguauaauucagcuuugaaguuuuaagaguuuuuagaccuuauuugaaagacaugaauaaaauaaugaaauuauccaucaguuugguacucccaucuccuuccuucccucccuccuuaccugucucccucccuucuuucccuccuuccuucccgcccuccuucccucccuuucucccuccuuccccuccaucccuucucccuccuuccucccuucguuucccuucuacuuccuuuuccucuucccuuuucuuccuuuccuuucuuuuuuuuuuuauuuuuugaggcaaggucuuacucuguugcccaggguagagugcaguagugugaucacagcucacugcaggcucaaccucccaggcucaggugauccucccaccuuagccucccagguggcugggacuacaggugugugccaccauacuuggcuaauuuuuaagcuuuuuuuuugguagagacugggucucuuuauguuauccagguuggucuggaacuccugggcuaaagcaauccuccugucucagccucccuaagugguggaagugcaagcaugaaccacugcaccugaccucucucaucuucuugaaccauuuucuuucuuuugcuuuugggacaucucacuccucauuuuaucuuuugcuaguugcuguggagacucuacauguuuauaauuuuggaguucuuaaggauaaguccucagauaucuugucuacuuuuugucucuguucacucccugggaaagaaagcucauucauucuaauggcuguaaccucugugugugcccuuaagagucucacguguucauuuccguuacucuucuuuaccugaacuccagacuuuuauguccaacugucugcuugacgucucuauuuggaaguguauuagacaccucacccuuaacauguccaguaccaugcuugauucugccuccaccucugccccaaaucugcuucucccuacgauuuccucauuucaauaaauaaugccaguauucacucaguuguuuaguccagaaacuuugaaaguuaauccuugauuucuaucuuuucucauaccuuguagcucaacucgauaacccaaacaacuuguuagugucuuaacuugccuaacauuuuaguugaagucacuguuauccuuuggaaguuguaguagccuuuuaaccagucuuucugcuucucuuuaccuuuccauaguccaauuuguuuauagcacaguugcaaaaauuauucuaauaaugauaaucagguccccacucuccacucucuuucaugacuauuauauuuaaauuauauucauaauuucaaguacuuaccaugucuacaaggugugaucuguuccugacugccucucucaugucauuugucacucacugugcucucaccacauuggccucacucuuuuaaaugugcugaugggguuucugucugagagcuuuggugcuugcucugcuugucuccuggcuuaccucccagagaggcuaccuugcugauaauacuagccuccucugaagggccacauccagcuuagucucagucagcuuaggaaaaagaacauacaaugugaaucaacgaaagaacacacugguguuuguuauacuguaguccucuccuccuccuccaauauuuuuugggagguuugaacauuuucaaaauaaaggaguaggauggaaaagaaaacagcagcucccaccauauuuuacauaguaaccugcuuuauuuuucuuuguggcacuuauuauuuuccaacaguucauuugacugucaugugaacucugaagacacgcacuuuguuggugggcuuuguucaccacacuguguccugcacuuaauaguuccugacggagauuaggugcuguauaaauuuuuuuuucuuuuuucuuuuuuuuuuuuuuuuuugaggcggagucucgcucuguugcccaggcuggaaugcaguggcgcgaucuuggcucacugcaagcuccaccuccuggguucacgccauucuucugccucagccuccugaguagcugggacuacaggugcccgccaccacgcccggcuaauuuuuuguauuuuuaguagagacgggguuucaauguguuagccaggauggccuugaucuccugaccucgugauccacccgccuuggccucccaaaguguugggaguacaggcgugagucaccgcgcccggcccaauauauuuuuaaugaauaaugaauucuaguugauugaaaagcauuuaaaguucugcuuaaauuuuuguaguuugauacuaccaugaacuuuacuuuuugcuauguguuauauagagauuagaaaugguguaaugcauaugugguauugagagguacagaaugcagaauauuugcuaguuuagagcaggugccugagagccuucugaaaguauucugugccucuguauccucuaggccuacuucgggaacccauuguaguucuuaaccuucuugcuugguucuucugcagaucuuaaggacacaguaugccugacugacuuaucuuuuugucaccugugaguagcacacugucacuguuaguccucaucuaauacuuguacagagaaugaaaguuaaaagcuacucaugaauauaugauaauuucauuuauaauaaucauggccuaucaguggaaaagaauaggucacucaauaauuggcuauccauguaaaaaauauagguagauugaugcucaugccacauggaaaaauaaccuugagguagauuaauaagcaaugccauuguuauuuauuuauccugggcuauacuaccacuaccacuguuauuuucauuagacaggacagagugaauguacacugagaaagccagcauacuguaaauacagacuugguguuuauuccaagcuccgacuuuuugaccuuuauuuauucauuuuuaucucucugucccacaguuuccuuaaaauaggaugaacagauugaauuuaaugaauuuuauuuuauuuuauuuuuuuugagacagagucuugcucugucgcccaggcuggagugcaguggcacgaucucagcucacugcaggcuccgccucccggguucgcgcgauucuccugccucagccucccaaguagcugggaccacaggcgccugccaccacacccggcuaauuuuuuuguauuuuuaguagagacaggguuucaccauguuagccaggauggucucgaucuccugaccucgugaucugcacaucucggccucccaaagugcugggauuacaggcgugagccaccguccccggccugaauuuaaugaauuuuaauggugcaguauauaaaauguucuaaaugaauauguauaauuaauaggauuuuagcaagauuacuagauaacaaaaucaaaaugcaaaaaucacauguauuuuuauauauuaggaacagaguuaaaugguauuuuuuagaauauuuuccaauaauauaaaauaauaugugacuaggauuaugugcaaaaauguaagacuuuuauagagaaaauuauaaaacuuuuuggaaagauuaaggaucacagacauaauagcaguauaauacucacauuuuaggggauucaguauuuuaaagauauucuuucccaauugauguguagguucaagaaaauucuaauaaaaauuucuacaguaaauuuuacaagcugaucuuaauuuauaugaauaugcaaaagacaggauaagccaaaggacccaugaagaagaggaaggauugcuuuacuugauacuaagacuuuuuguaacacacuaauaaauuaagucagugcuguauuaccacagaaacagacaaauagaccaauggaucagaauagggaacccagauacagauacaugauuaauauggacagguuauuuauaacaaaggggcaucacaaauuagugaggaaggaagucucuuucaacaauugugcuagaacaauuagacauacuuuaaaaaaaaaaaaaaagaaagaccuaauuuauucaugucuacuccaguuaauuuauagacuuaacacgugagaagcaaauuaauaaaagaaguuaauguagaggaauuucuucauugcuuugggguaaggaaagacuuuuaaaaaacaaauggaaagcccuaauuauagaaaaggguugauuggccaggcacaguggcucaugccuauaauccuagcacuuugggagguugaggcaggaggauugcuugagcccaggaguucgagaccagccugacuugaacaugacaaagcccugucucuacaaaaaauacaaaaauuaguaggacuugguggugcuacucaggaggcugaggugggaggaucgcuugagcccaggaggucgaggcuguagugagcugugauccugccacugcacuccagccugggugacauagugagacccugucucaaaaaaaaaaaacacacauaaaaagaaaaggggccgggugcgguggcucaugccuguaaucccagcccuuugggaggcuaagguggguggaucccugaggucaggaguuugggaccagccuggccaacauggugaaaccccaucucuacuaaaaauacaaaaauuagcugggcgugguggugggcaccuguagucccagcuacuugggaggcugaggcaaaauugcuugaaccugggagguggacguugcagugagccaagaucgcaccauugcacuccagccugggcgacaagagagaaacugcaucucaaaaaaagaaaagaaaaggauugauuaauaccacuauacuuaaauuuacaacuuuucaugaaaaauaccaagaguaaaaagauaaaugacagaaaagggaaaaauauuucuaaagcauauaacuaacaaagaacuuauguucauauguauuuaaaaaugaagcaaaacaaugcaauaagaagaagcuucuguagaaggcaguaagcauuacuugauuacuugcaauaaacauuacucgauuacuuucaauaaacauuacuugauuaugacauuuuuuaaacaugcuguuggguuuuaguuagcuaauauuuuguuuauguucauaagcaauaugaauuuuuguaauauuguaauguccuaguuuuggagacaaaauuacacuagccucgugugugaggcaucuuucaguuuucuuauuuucuggaacagcuaguuuaagacaggaauugacuccauguaggucugaaguaacugucauaaaauuacaugggucugugggguuucuucuagaaaaugaagucauuaccaguucaauucaaagauuuuuuuucuuggaauauguauuccauaaauuugcuccccacuuccaaauuuuuuucuauucagcugucuguuucaucuuguaccaauuuucucauguuauauuuuucucagaacauauacauuuuaucuaaaaugauucaugauacauuuauuauuuuugaauguuauuuuugauuggcaaauccuaauuguacauuuaugaguacagugugauguuucaauucaugaaugcaaaguggaaugauugaaucaaguaaauuaacauccauuaccuugauuaacucucauuuguuacuugaaauuuacucuuaaguuggugcaaaagugauugcgguuuuugccauuacuuuuaauggcagaaccacaaucacuuuugcaccaaacuaauaguuauuuuaaaauauaggucacccugcuaugcacuguaucucaaaaccuauuccuccugucucaaccuucguauccuuugcaccaaauuguuauuuuaaaauauaggucacccuacuauguaguauaucucaaaaccuauuccuccuaucucaaucuucauauccuuugaccaacaacuuacuauuuccuucuuccugccuuaccuucuccgagugucugguuaccaucacucuacuacugguucuuuuaguucaacuuuuuuagauucuacauauaagugagaucaugccguauuugucuuucugugccuggauuauuucacuuagcaugauauccucuagauucaucugaguuguugcagaugacaggucccucccgcuucucucucucucucucuccccacucuuccuuaauccccuuccccuccccucccugccucccuucccuuccccucccccucuuuuucuaccuccccuucccucccucuuuuuuccuuccuucucucccuucgucccucccuccuucccuuccuuccuuccuucuuuccuuuuuuucuuuccuuccuuucuuucucuuucucucucuuuuuuuuuuucuuugaaagggugucacucuguugcccaggcuggaguacagugccaugcucacaacucacugcagucucaacuuccugggcucaggcaauccucccaccacagccuccaaguggcugggacuacaguugugugcucaccacaccaggcuaauuuuuaaaauuuuauguagagauggagucuuacuguguugcccaggcugguuuugaauaucugggcucaagcaguccuccagccuuggccucccgaagugcugggauuauaggcaugagccaccacuccccauccucccgcuuuucaaggcugaauaguauuccauuguuuauauauaccauguuuucuuuauccauucaucuauugauggauacuuagguugauuccauaucuggcuauuguaaguaaugcuguaguaagcaugggcaugcagauauccuuuugacauugauuucaguuccuuuggauauauacccagaagugugauuacuagauuauaugguaauucuauuuuuaguuuuuugaggaaccucuuuaccauuuuccauaauggcuauacuaauugacacccccacagcaauguacaggacucccauuuuuucuguauccuuggcaauacuuaucuuucaucuuuuuaauaguagccauuuguuagguguuagccaauagccagguguuacgugauauauacuuguuuuaauuuucauuucccuaaugaguagugaugcugaacauuuucucauguaccuguuggccauuuguauguguucuuuugagaaaugucuguucagguccuuugcccauuuuuuaaucagguuguuuucuugcuguuuauuuggguuccauauauauuuuggauauuaaauauuuucucccauucuguggguugucucuuuacuuuguuaauauuuucauuugccguaaggagcuuggugguuuagccaucccauuugucuauuacugcuuuuguugccuaugcuuucagggucauauccaaaaaguuauugcccacauggaacuuucucccuauguuuuauucuaguaguuuuauaguuugacauccgaaacauaagacuuucaucuauuuugaauugauuuuuuguguuaugugagacaaggguaugauuuuauucuugugcauauggauauacaguuuuuucagugccauuuauugaggagacaguucuuuacccauuguguuuucuuggcaucuuuguuauaaaucaacuuaguguaaaugcgugaguucauuccuguuccauuggucgaugugucuucuuguuuuuugagccagggugguauuuguagcccaggcuggagugcgguggugugaucuuggcuuucugcaaccucugucuucugagcuggagccguccacccaccucagccucuugaguaccugggacuacagguguucacuaccaccccuggcuuauuuucguauuuuuaguagagacgggguuucaccauguugcccaggcugguuucagacucugggcucaagcagucugccugccucagccuacccaagugcuggcauuacaagugugaaccaccaugccuguccagauguaugguuuuuuuuuuuuuggugccaguaccauacuauuuugauuacaaucauuuuguaauguuuugaaaucagacagggugaugcauccagcauuguucuuuuugcucaagguuguuucggcuguuugaugucuucugugcuuccauauaaauuuaaggauaauuuauuucugugaaaauugacauuggaauuucgauagauauugcauugaaucuguagaucacuuuggguaguauggacaguuaguuucacaguauuaauucuuccaguccaugaacauaggauaucuucccauuucuugauguuuucuuaaauuucuuuugugaguuuuaugguuuucaguauacaggucuuuuaccucccugguugaaauuacaccuaaguauuuaauuuuuuuguugcuauuguaaaugggauuauuacauuaauuuucuuuuaggaucguuugcuguuaguauauagaaaugcuacugauuuuuguauauuuacuuuguauccugcuacuuuaucaaauuuguuuauuaguucuaacaguuuuuugguggagucuuuaggguuuuccauauauaagaucaugccaucagcaaauaaagacaguuucacuucuuccuuuccuacugggaucccuuaugucuuucucuugaccauauugcucugccuaggacuuccaguaauauauugaaauuuuuauauucaguauuuuauauuuuauaucaauuuuauauucaguauuuucauuaugauuuuauuucacauauugggauuuccauuuuaagugaaagauucuuaaacaauaucuuuucuaguuuccaaauuuauuuauuuauuuauuuauuuauuuucuugaaagggagucuugcucuguugcccaggcuaugcaauggugcgaucuuggcucacuggaaccaccaccuccuagguucaagcgauucuccugccucagccuccugaguagcugggacuacaggcgugugccaccauacccagcuaacuuuuguauuuuuaguagagacgggguuucgccauguuggucaggcuggucucaaacugcugaccucaggugauccaccugccucagccuccuaaaguguuggaauuauaggcaugagccacugcaccuggccagaagauuuuaaguuauccauuuauuauacauuuuuaguuuuacugcauuauugucagagaauguugccugcaugauguuggucacuugcuauguaucauguauucuuuuauggccuacuauguaauccacucuugaaauauuuuaauauacuugaaaagaaugugaaccguuaguuguagauagagcugaauauaguaucucaaacuaauuuauuaugcucagguaauuaauaaauaaugaacaauaaagauguucaauacuuaauuuuuauugguuugacauaguauuuucugagaaaaauaauuaaaaucuuccacuguuguugauuuaauuuuuuuagucuuccaguuuuguucugagaaacucagguugaguuucuccuauccaaaaugcuugggacaggccagguguggugguucaugccuguaauuccaucacuuuagguggccaaggcagguggaucaccugaggccaggaguuugagaccagccuggccaccauggcaaaacuccgucucuacuaaaaauacaaaaauuagcuagauguuguggcgugugccuguagucccagcuacucgggaggcugaggcaggagaauugcuugaacccaggagguggagguuacagugagccaagaccguaccauugcacuccagccuggacaacggagugagacuccaucucaaaaaaaacaaaaacaaaauguuugggaccagauguguuuuggauuuuggauuuuuuuuggauuuuggaauauuugcacauacauaauaagauauuuuggggaugggagacauguauaaacaugaaauuuguaggguccagccccacagguucgguggguuuucuccccgugugcggagacgagaguauagaaauaaagacacaagacagagauaaaagaaaagacagcugggcccgggggaccacuaccaccaagacgcggagaccgguaguggcccugaaugccaggcugcgcagauauguauuggauacaagacaaaggggcaggguaaggagugugagccaucuccagugauagguaaggucacgugggucacauguccaguggacagggagcccuucccugccuggcagcugaggcagagagagggaaagggagagggagagggagagcuuaugccauuauuucugcuuaucagagacuuuuaguacuuucacuaauuuucuacugcuaucuaaaaggcagagccagcuguacaggaugaaacaugaaggcggacuaggagcgugaccacugcagcacggcaucacaggcagacgguuaggccucuggauaacugcgggcgggccugacugaugucaggcccuccacaagagguggaggaguagagucuucucuaaacucuaaaagaguuuagagacucccuuucccggucugcuaaguaguggguguuuuuccuugacacugacgcuaccgcuagaccacgguccacuuggcaacaggugucuucccagacgcugggaccaaggacuccucugguggcccugucugggcauaacagaaggcucgcacucuugucuucuggucacuucucacuauguccccucagcuccuauugcuguauggccugguuuuuccuagguuaugauuguagagugaggauuauuauaauauuggaauaaagaguaauugcuacaaacuaaugauuaaugauauucauguauaaucauaucuaugaucuauauaacuauucuuauuuuauauauuuuguuauacuggaacagcucgugcccuuggucucuugccucggcaccuggguggcuugcugcccacagaaauucauuuauguuucguauauaccuuauacacauagccugaagguaauuuuauagaauauuuaaguaauuuuaugcuugaaacaaaguuuauauuaaguacuuaggugugaaauuuucuacuugugauaucauguuggugcuuaaaaaguuuugaauuucggagcauuucagauuuuggauuuucagauuggagaugcuuaaccaucucuuucagauucgagauucauuuugagaccagauucauguuggucugaguauaugguuaugaucgauaucuauuauacuauucaucauuuuguuaguguguaacaucuuuuucaucucuaaugucauguuuucuuuuugacauaacuuucauuuugucugauaaaauuauugccacucaaacuuccuuuugguuuauguuugccugguaucuuuuuaccucuuuucccaucaacauuuuuguccuuguuuuauaugucauuuguguuuauacuuccaacauuuuuugcaccuauuuuuuuuuuuuuuuuuuuuuugagauggagucuugcucuguugcccagguuggagggcaguggugcgaucucggcucacugcaaccucuaccucccugguucaaacaauuccccugccucagccucccgaguagcugggauuacaggcgcacaccaucaaugccuggcuaauuuuuuuguauuuuuaguagagauggggaggggguggguggguggugugugcuucaccauguuggccagagugauuucgaacugaccucaggugaucugcccaacuaggccucccaaagugcugggauuacaggugugugccaccacacccagcugcacccaauuguuagaucuaauuuuaaucuaaucucaaaaauggucuuuuaauuggugauuuuugccuuuuaauuggugguuuugguuuacauuauuguaauggcuaguaagauuucguaugcuauuuuagaaaauguuuuuuagucacuguauauauguuuuuucuuucuuuuauuuguuuuugagguggagucuugcucugucgccuaggcuggagugcaguggcacgaucucaguucauugcaaccuccgccuccuggguuuaagugauucuccugccucagccucccgaguagcuuggauuacgggcgccugccaccaugccuggcuaauuuuuguauuuuuaguagagacgggguuucaccauguuggcugggcuggucucgaacuccagaccugugaucugcccgucucggccucccaaagugcugggauuacaggugugagccaccaugcccauccucuuuuucuuuuuaaaauacaggcagggucucacuauguugcccaggcuggucucaaaauccugggguuaagcaauccuccugccuugaccucccaaagcacugggguugcagugugagccacuguuccuggcugaguugcuguagugcgugacaucuaaugagguacaugaagaggagccuuuguguggguuagaauuccccugucuuuggucacagguguuaacauagucucacuguguuucacacuuggcuucuagcaauuucuuaaaaauuuuuacugaguucuuaucacccugcugguaugauaucaguggccucuuccucagaggugcuauugucacauuucuuuauggaagugucuuucauuugguggugaguugguugccuugugauuucugcccucugauggguuucagaaaagugaauuugcagauucucugguuggguuauguugugugguugggcacaauguuguuugcagcuuucuacagccagaccaaaagcuagaaauuucccuugaccucguauuaaaaaaaagucaacaauaaauuacucugagguguuugaccucccuuacuucauacaaccuuuucuaauucuuuaauaauuuaaguacuucucuaaaaguauuuucauuuuugaucuguugucuggcaaaauuucugaggucuucuaagccagagaguaauuuuauuauaccuucacauuuaagcgauaguuuugaauauaaaauugaaugcuaagguauuuuucugcaauagcuuuaaaauauugcuccauuuucuaaucagugcuguuacaaucaauguugauaagacuaaugucaaucugauuguugcuucucauggguaguguuucuaggggaagaaacaaaccagaaaugggauauggugaaauaaauguaagcuuaauagcucagagaacauuacaaauaaggggauaguaagauacuggcaaagcauaaggugguggucucuuuuuggaaagaagaaauuuucuuuuucaacuugacuugauuuuuuuuuuugaaauuacacuacauuuaauuuguguaugucucgguaccagcagacaacauaguuucucaugaacuugaaauagguaauuuauuacaaaaacaaagcuaauuuugauaaaaguaauuaguugagaguccaauaugauuuaaaccuaaguuuuaaaaagucaccucaaaaggcuauagguuaguucuaucaccugguaaugcaagauauguaagaucaugggguaaauacuguagagguaacuuuaaugcccaagaaggaggauuuggguauagcagcaguaaauaucuugugaaguguaaauauaaucaagaggaagcaguccuuuuaauuucauucuuucuaagaucucuuaguaaguguauauucuauauauguauauugauuguugucucuuaauuuuuuaauguuuucuccuuuuuuauuaauagacuuagagcauuuuuagguuuacacaaaaauugagcucauucucccaccucuacccccagcaguuucccucaugauuaguauugugugcuguguuacaguugguaaaccaauauggauacauuauuuuuaacuacaguccauaguuuacauuagggcucaguaucuaccauuauaguaucauauaaaaugguuucacuggccuaaaaaauccccuuugcuccuaaucaucccuuuccuucuuccaguucagcucuucugcuucccuaaaaaucuacuaccacucaacccaggaacuauuuaaguuuauauuuuuauaucuccccguguguaugcaugugugugguauauauauaucaugcauaaugaacguucuaucaagugguuaaauaaaacugucaccauauguuuuacagaacugucauacaguuggguggcuacuaaacucuaccuucuuucccauuuuuaacuugcauuuuuuuuguuuccugagacagagucuugcucugucacccaggcuggagugcagugguucaaucucagcuuacuacaaccucuaccucccggauacaagcgaggugccucagccacccgaguagcugggauuacaggggugugccaccacacccagcuaauuuuuguauuuuuaguagagaugggguuucaccacguuggacaggcuggucucgaacuuccaccucccagaguacugggauuacaggcaugagccaccgugcuuggcccccaccuuuagcuuucuuacuuggauuuuuuucuagucaaauauaaaagaaaauaacuuuucuaacugcuaacuagaauuuuuuggauuugauauguguacuacuuuuuaaaaugcuauggaaaaguagaauuccaaauguauaauuauuaaacuuaauuguucuuauggguaaucacugaauagacuguagaaaauagauugaaaagcuuagcuugugcuuuagacauaauuuaaaagcacaaguaucuauaguuaucgcuuaaagcaguugaauaaagcuacuuuucuccuucucugacuuacauuucauuuuuacuagugaacagcucugcgcuuuuuguuacuguggggaaaaaaguuccuuaggacaaggagacuuaaaacaauucagaauaacgccuggauuuaucuugccauggagaaaccaaccuucuaacaagaaggacauugaugacaacagcaauggaaccuaugagaaaaugcaaaacucagcaccacgaaaacaaagaggacagagaaaguaagcaguuucgacuuuaaauguuggaauagauuaagacugcauauaauuuauuuccauuauaauguuuauaaauuuucaaaugggauuguucuuguugaacaguuucuccuguucuccacauuuaugggauacucugacucaccauuaacccaauuaauccaacaaacuauccuuuucacaaauuuuucuuguuauuuuuuaaaaaguuuauauuaauuguauaugaaagcggugugaucacaaaacuaaacuuuuggaagaaaacuucaaagaacauaacacaagcugagagggagggaguucauggaauuuauaaauggaaauaauguaauaauaaaacagaucaauaaaguccuucuuuuguuucucuaaauaagcuuuuaauuuuaagaauauaacauaauacaauagcaaauccagaauugguuuucacuacucaugucuuuugugucauucauucaucaauccauucagucauuuauuuaauuuauauauaaguuugugugcuucagaaaauguugcacuguccuauacauucuucccucccucccuccccugccuucccucccagaagaugcuuuuuucuuuuuuaaggaauuuuuuuuuuguaaugauguguguaugucuguauucacgggcacauuguaauuaccuaaaggucuugucugauauaguuuaaaauauuuuguacaguuguguuuaaagaccauauuaauauggagacuuggcugugcugguuaagggaguagaaguuucuguaguugaugagaauguguaaaaauuaauuuagcuugcaaagcuaacacugccucuugaggguuaugauguaaucacucaagugcuuaucuggcuuauauccaaauuuaaguacuaaaucauuguuguguuguacuuauuugauuggcucauuguuuugaacugcugccaaugccuugaagaccugaaguaggaaaugaaacaauaaaaagagggagaaucuuuuaaaagaauuuaagguggaacaguuuaaggaaacuuagaaguacuauauuuggagaguugugauguuuuggaggcuauagcuuuuucuuuaguugucaguugaguacacacaucuuaauaaaauaaucaaaaggccagcaaacuuaaaaugucuauuagcaaauuuaauggagugaaucaggcuguaucuuauauccucauguucugccuuaaauaauggcaauuauauaaaauccucuccugagaaauggaauugguuucauuuccuuguuuuaaaagugaaauuaauuuuuagugaaaauucuuaugagcucagauaauuauauaaaaauagccuuuguuaaacgaaagucuuuauauauacuuagugcuuaccaacuuaauaaguaaugauaauauggcaguuaaugaaguacacuuaaaaauuuggcaucauugaaggguaggcaauuaauuuagcuugguaaugauuucaaauauuuacaaaauguauguugcuaaugaaguuuaaauagcuaguuaauuuaaaaaacaauuuuacaaagguuuugaaaaugucuuugcucauuuucacuaaauaaaaaaaucaagaauuuuuuuccuuuuuuuguuuuauaacuaagaauuuuguggguaugcauuucagcugauuccucuugauaucucuuucuaagcugggcugcugucauccuuaguguugacauugauaucuuacugauaugguauauacauacaaaccagucucaaaacuugaagguugaauuugauuaagcugcugguuaggaccugauuaguaauaaauuagucauucucuugguuuuuuuacaccccuuucccucaucaaauacuagugcaaaacaguaugcuaaaacaacauuuaguaguuauagaugaacuguuggucuuuuuuuuuucucccaauaaaauaacaaugauuuguaauggagcauauauuuguaggaauagagauuauacuuauaggaaagaauuuguucucauuuuacugugggcauuuauuaaaaugagaauuuaaaguuagcauagcaugcuauaccuuuuaaaaaaagucuaugcauuucuaaugcugaacauaaaaacauuacugguuauuuuuauaugguuugauauuuaaauguacuuauugaaauauguuaauacuuuuuuucuuucaaugauuccagguauaaaaauguuuaguacccuggucauugugcugauuuucucuuaauaggaaucaugauaaauauccagcauacagaagugcagugaguuaugaucuauauucaauagugauuuaauccagaauuaugaucagguuaaauacuaugauauuaggagaagauuuaaguuuuagugguagucaucugauuucccauauuuaauaauuaaguacaauagccauuuuuauuuauuuaauggucuuaaauaauaccuaaaguguuagaccuugaaagccugaaaucucccauauguuguuuacuuuauucaauguucuuuuuuuagacuauaguuuuugcuguuauacuaucuuccuuauucuacaugccuuugguagcuauuuugcuuuugcuuuuuacuuccaauuugugacauacagucuugauugagaguacuugcaacgucaugccacagaccagcuguugagauuuguugacgggaccauaagaaagcuacagcugauacauuccauuccuccugccucuguuuucacacucuguaguggguuuucauuuucccuggaaaauauccuuucuuuacacaguuaacugccaccucuguuguggcaguccucagucaagauacagcagacuaaacauuucugauuugaucaaguuuuguuuuguaagcguuuaaguaaagccaaaggaaauacucaguuuauguguuaaauacaauuccugacuaggauaugagaguugguuuuaaaaacauuauauuauggaauggaaaaacaaauuuacaauuuaauacuucccuguggguuuggagacucuuuuucuuacuuguuacuuauacgauauaauauggcaacccaguuuaauauuauaccauggauaauacuaacagaugaauucuaaaaguuguuuuaugacaguuaauggcugauaaauuaaaauugauuuggcaguacauugcauuuaaacaguuaaaaaugaaacaauuuucugcuuguuuucacuuucacaguuauuuuauuuuauuuucagagaacgaucuccucagcagaauauaguaucuuguguaaguguaagcacccagacagcuucagaugaucaagcugguaaacugugggaugaacucagucugguugggcuuccagaugccauugauauccaagccuuauuugauucuacagguaugggcauguuuucaauaaugacugccucuuaauucuggaagcauuuuaauuuuaauacauuauuaauguccucaauaauaaauaccuuucaucuagaaauaauuauaaucauacuauaaaaaaaucauuauuaaauaugccugguuagguaaaagaaaagguuuaucuauuuaaaaucuguacaguaccaccaccggacuggaugcuuuuuaaaauacuuguauuuuuucuuguguagauagcggugccauggagaucugacaauugagaaaagagaaaauuuuaaaggggaaaauuuuaaagugagaacuuggggaauguggcauucugagucuauuuuauuugggcaugaaugaaaauaggucuuagccggguagauuaucuuauuauaacaguauuguaacucagcacucaugauauggugcuacuggaauuuaaaguacaucucauucuguaguugaacugcagauugacugauagugguucaaguguuaugugauggauaauuuaaaggcugaaguguuaauaaucauugauacgugcucucacugugggaugagggaaguagagguguauguguaguuuauuuucuauacauuuccuuuguauaucaccucaacaaaguacuaaguaauacuuuguuugcuuuauauaaagauaccagaaacauaucaaauacauauauaauauuuaaauaaaaugacuaaaaacuaauuuuguuuguugaagaaauaaucacuaauucaguuauucuuaaacuugugugugcaucauaauaaccagacggcuuguuaaaucacagauugcuggcagggcacgguggcucacagcccguaaucccagcacuuuggcaggcugagguagguggaucgcuugaacucaggaguucaagaccagacugggcaacauggugaaacccugucucuacaaaaaaugaaaaaaauucccggagugugguggcaugugccuguagucccagcuauuuggcaaggcugagacaggaggauugcuugaacccuggagguugaggcugcagugagcuguguucaugccacugaacuucagccugggcaacaaaaaaagugagacccugucucaaaaccaaaacaaaacaacaacaacaaaaaaaaacagaaccaaacacagauugcugggccccacugcacgaguuuuugauucaguagaucucacuugugaucugcgcuucugcauuuuuuugguuuuuauuuugagacggagucuugcucuguugcauaggcuggagugcaguggugcgaucucagcucacugcaaccucuguccccuggguucaagcgauucucaugccucagccuccugaguagcuggaauuacaggcgugcaccaccacgcccagcuaauuuguagagacaggguuuugccauguuagccaggcuggucucaaguucccagccucaaaagauccaccagcguuggccucccaaagugcugagauuacaggagugagccacugcacccagacagauucuguauuucuaagaauuucucaguuugauauugauacuggcacucagugguugguccacauuuuuagaagggccacuuuacugcuaucacaaauacaggaugccauuguauauuuacauauuagaguugauuuugaaguuuuaugucuuuauuuauuagcuuuaauuuuuuuaauguuugcucauuugcuccuuuucauuuuucccauuuuaggcacuuguugggcucaucaccguuguguggaguggucacuaggaguaugccagauggaagaaccauuguuagugaacguggacaaagcuguugucucagggagcacagaaguaaguagacaaagcaaauauuuaaaucauaguuuuauaacauucacuuuaaucagaaguucacuugaaaggauuauuaaaugauugcuguaguguaaaagcucucaaaauaggaaauuauuaauuuuuauuaagagaaauucuaggccagguaugguggcucacaccuguaaucccagcacuuugggaggccgagguggguggaucacuugaugucaggaguuugagacuagccuggccaacaugguaaaaccccuucucuaccaaaaauacaaaaauuagcugggcaugguggcagucgccuguaaucccagcuacuugggacacugaggcaggagaauuugcuugaaucugggagguggagguugcccguagccaagauugcgccauugcacuccaaccugggugacagagagagacuccguuuaauuaaaaaaaaaaaaaaaaaaaaaaaaaaaguuauuuuaugcaaaaauuagccgggcaugcuggugcacauguguagacccagcaacuuggggugcugaggugggaagauugcuugaguccaguagauugagguugcagugagccaugauugcaccacugcacuccauacuccagccugggcguuggagugagacccugccucaaaaaaaaaaaaaaaaaaaaauuaauuuguguaagccauuggaauguaguauguuacucagugaacuugaaucuuuuaaaauaaguaguuuacauuuaaauuagaaauuaaaauuuuagaaaugaaaauuuugcacuaugcuuauacauucaugugguaacuuuuuaagacaaaacuauuugauaaugauuuaaaaugaaagaaaauauuugaaaagauuugaaggucauuaguccauaauguggacuaccucuguuugauauuuuaaaaagugauuaaaaaaauuuuuuuaguucggucagcaguucaguucaucuuuauugcauuguaucaaaguaauaugugcauagucugccauuuuucagagcuuuuccugugauuuucauguaauuuugaaacaaaugcaaaugaaacggcuuccucccaucuauaaagacagcaaacucugugaagugauacugcuuugcugucuacaaauugcuuuucuuuuucuuuuuucuuaaaauguagagauggggucucaccauguugcccaggcuggucucaaacuccuggacccaagggauccucucuucucuucuuggccucucaaagugcugggaguuuaguugugagcuacugugccuggccuuccuuuuuuuuuuuuuuuuuuuuuuuuuuugagaggaguuuugcuguguugugcaggcuggagugugguggcaugaucucagcucacugcaaccucugcuuccuggguucaagugauucugccgccucagccuccugaguagauuggauuauaggcucgugccaccacaccggcuaauuuuuguauauuuaguagagaugugguuucacuacguuggccagccugaucuugaacuccugaccucaggugaucugccugccuuggccuccugacgugcugggauuacagguguaagccacugugccuggccccuuugguuuuuaacaaguauauuugggagaagugagacagcccuuccaauggaauauuaaaacuggaaauuuugaccuuagaaacuauaugggcuuuaauagauagaacauaggcaaagcuuucaaaaguauaguugagacaaggacuuagauucaaguaaaaauucaaucauuagaacauuagcuuuacuuggauuaucaaaaugaacugauuuacauagaugaguaagcaucaccucaagaguagugaagucagagugcuuguuuuggaaauuuuacauuaaaguguauaugucaucaaauuuugaacaguuuaaugcauaauaguauuuuccccagccugaacauucuuagagacuggauuaagacaaugauauuucagugaaaaccaucuguuuuaugaauuacuucauaaaaguaauuuuuauuuugggcuauuuugugacagugaaaaguauuacagggaagguaacaaaggcuaaaugagcuuuuuggugguggauuagaaccagaggaaucaauauaaacucguaguguuugauacuuaguacagaaauguagguguauguauuugcaugaguuuguauguguccauguauuuccuaccucuguuugcuaggaagguaguuaaaagaaaacuugccucacucugucccuuuuggacagaaguuaccauuuuuguucuuacugauuaauaauuaaaugguauuuagagaugaagacuguguccuaccacuggcagaggaaucacaagcccuuaggagacauugcaucccuuccgacuuuguuuaggcauuagaauuuggugggccuaagcaaguuaaaugcagauugaguacuuggaguugguagaccauguggggauuagaagggaucuagugguaacucugucaaaucuuuaccucuccacuagauugaaucacucaaaacucacaggagugucaguuuugugucgccauuuguacgguuguuuguuuuguccuucuuccuucuccccucccuuccucccuccuucccucccucucucccucucuccuucccucccucccucccucccucuuuccuuccucuucuguccuucgucuuccuuccuuccuuccuuccuuccuuccuuucuuucuuccuuccuuccuuccuaccguccuuccuuccuuccuuccuuccuuccuuccuuccuuccuuccuuccuuccuuccucccucuucuuuccuuccuuccucuucuuuccucccuuauuuccagggucucacccuguuguccaggcuggagagcaguggcaugaucacggcucauuggcacccuuggcuucccaggcucaaacaguucucccccgagccucccgaauauccgggaccacaggcaugcgccaccucgccuaacuaguuuuuaaauuuuuuguagaggcuagguucugcuguguuguccaggcuagucucuaucuccugagcuuaagcgauacucccaccucauccucccgaaguacugggauuauaggcaugugccaccacgccuggcuuuuguucauuauucuucauuaucaaauaggcacaagauggaccaguuagcuagaacuuugucucaagaaaggaagacuugucucacuggcaaaaauucaaacauaaaacaacacauuuguugacagggcuguggggaaacagguacucucauucuuugcugcugcagaugcaaauugguacacaucuuuuggagggaaauuuggugauaccuaacaaacuguaugcauuuaccucucaauuauucuaggaaucuaugcugaauaugccucuaacaauacaaauuauguauuacuuaauguuauuaauuauaguauuauuuaauuugcgaaauauuggaaacaaacuaaaugcccacacagaggagaagguuugaauaaacuguguuacauccauauagccauauaauggaguaccaugcagauaaaucagaaacuagagauugguuaccuguagggagugggagggagaagaagggaguggagaucuguguagcauggaugaaaugugaguggcacuucucagaguauauuugucaguauaacucugauucuuagaaccauaggaauguuuuaaaugcuucuaugcaauugccaccaaccaggaugugggagaccaaauaagcaauuaccaccuacccagaugcaggagaacccaaaaaggaauaguaaaauucacauaaaagaggauagggagggaaagaacucaccuaaguaacuguagaaaauagugucuugauuaaauaacauaaaacuagaggcaaaaagaacuguacagucaugcuguaguguugagaucagaaguaugaaaauaaacucauguuuuuuaauauuuacacagacauacagaaauauagaugugugcauauguaugaguuaauuugaauauguguauuuccuaccucuauccccugagagggcauagaaacaaugacaccccaguagcauugagaauaccuagugcuuagaucuuggucuccaaccauugcucuucaaugaaaggaaccagggcuccuugagaaguaguuccuuacgggacuggugcagagaaaauacaagguaagccuagaucaucuuguggugccagaaaguaaugaagugcuuaaaaagaugaaaaccuguucaaagcacgggaaccuaccugaaggagcuccuaagaacuggaccaauuuuagcaaccacaaaaauaaugauaauauugcauuuucauccauagaauaaguacacgaguccauacugauguaaauagauuguccagucaugucacugcucuacuuaacacucuucagugacuucccauuuuauucugagaaaaaaaaaaaaaagauuccuugcuaaccuguaaggcucuacaugaucuucaccacaccucacguauacuucucagacaucuuucacuauaaccguuuguucauuuacuuccuucagccaugcugaccucauuggucuuacucaaguacgcagacgcagauccaccucagggccuuucauaaugcauguguugcccccucauauccuuuauguauuuauucaagcgugacuuuacagugaggccuuugcuaggcuugcugucaaagauuucaaaugccuucccauaauaucugcuuuuuuguuuucuuuuucguacuuaucaccucugacagaguguauauucacguaauaaucuuacuuauuguucaucucccucucacuaguauacuagugccauucggaugggguuuuuuucuguuuugguuauuccucagugaauauuuguagacuaauuaauagcacugaagaucauucauggaaucauucauaggcagcaaauaaguucuaaguacccaaaaguguuacuggagguuaucaauauggcuaauuacaugaaaguuuauauacuuaaucucuaaauagagcaaaucuuuacaguucuacagaaaugauugggaaggaggagccaaggaaaauuucugcuaucacaaaaguuucccuaggggcgauauagcuauugaacuuagaagacguuuuuauuuugccaaaaggucgauuuugcugaccuuggcuaggugcagugccucccaccuguaauucuagcauguugggaggccaagaugggaggauuucuugagcccaggaguuugagaccagccugagcaacauagugagaucucgucucuauuaaaauaaaaaaugaaaaaugaaauuugcugaccuuuauuauguagcugaguauauucugauaccuagcucuauuuucaaagaaaacaaacacuuaaccugccccuucaagauaaagaugacauuucaacauugagaaugcagugacuuuucaaagaaacauguccuggggcguugaacauuuugaaaacagauguuuugaacuauuuauauugauauuuuauugucagaaauaaugaagguuguaaaaacaaaacaaaaaacucucauguuugucaccuuaaaagaaacuugaacauggaauuuucugauauguuuaaaauauucuaaagagcucugguuuaagcccauuuauuaaacauucaauauuuuuauuagagagggugaaauuuuauuugcuuaaauuuugauaauuucgguugagauuuaaaaaugguugcagaaaucauguacuacuucuaauuagaucauuuuacuuuuggggagaaccuguuuuuuuaaaccuaugagagccauagaaacuagguauuaaaauaaaccaaaguuagaauuaggcuuuuuaaucuaagaaaauggaagggaaugagauacuauaaagcucaggugagggguugcaguauuuuguaaauuuuuugauugugcacaucuuuuaauaagaaauguuugaguaugcagcuuuauuauacauucucaguggaauauguaugucuucucucucuuuuuuuuuguuuuuggagacauagucucucucugucuccuaggcugagauugcaguggcgcaaucucaguuuacugcaccuucugcuuccugggcccaagucauccucccaccucagucucccagguagcugagaucauaggcguggaccaccacgccuggcuaauuuuuguauuuuuaguagagacaggguuucgccauguuggccaggcuggucuugaacuccuggccucaggugauccgccugccuuggccuccccaagugcuaagauuacaggcaugagccaccaugcacagccaugcauaucuccuuuauguaacuuaacaucugcagcguuuguuugugugaguuuuuuauucugucugcauuuguguaugugagucuuuuucuauggauuuuucccaccauggcuguaagcaccaugagagugaggaaaauagcuguuuugcuuuaucauauuuucucuggugccuaacaaaguaucuggaacacaagagagucacuaaugggauaaauacaugcauuaaugggauuugucaaugaagggcaaaauuuagugcauuagcuugaaugaggagguagguccuacuggcuggccucuuggguagaggccaggacugccgcuaaacauucugcaauaugcaggacagccucccacaccaaaacuauacagcuuaaaaugccgauagugcugagguugagaaauccugguuugacauauuauuccuguguuaaaauuaauauauuuaaaguaauuuccucgguuguuaacauggcauuuuugucaagcaauuuuguuuucucugaaacauaccucagauuguuuuuaguuuuuccaggggaaacuuuauucauuuuuuacuagagaaaagaacauggcaaacagugaaucuguguuucaggaaggguaacgucguuuuucuuuuaauuucccuuuugaagcucucagggugcuaccaacaucuuggaaaucuggauaauuugaguauuacugagggaauauuuucauucuacaugcuacaaauguuuaaucauuuuauuuaucuaaaguuccuuucuuggccaggcgcggcgucucaugccuguaaucccagcacuuugggaggcugaggcggguggaucaccugaggucaggaguucgagaccagccuaaccaacauggcaaaacccugucucuacuaaaaaaauauaaaaauuaaccgugugugguggugugugccuguaaucucagcuacuugggaggcugaggcaggagaauuucuugaacccaggagguggagguuguagugagcugaguuuucgccacugcacuccauccugggcaacagagcaggacuucuucucaaaaugaaugaaugaaugaaagaaggaaagggaaaggaagcuccuuucucuucuauucccaguauugccccccaaaaagaaguaauccauaaacccccaauguauauuucuguuuucuuaacuauuucugaauaaaauguucaguguuggcugggcaugguggcucacgccuguaauccuagcacuuugggaggcugaggcugaggucaggaguuugaaaccagccuggccaaugugaugaaacccccucucuacuaaaaauacaaaaauuagcuuggcauggugacgugugccuguaaucccagcuacucgagaggcugaggcaggagaaucacuugaauccuggaggcagagauugcagugagccaagaucguucuauugcacuccugccuaaaacuccaucucaaaaaaaaccagguguuuuacucuuaaaauaagacauuaaaaaaauacuucuguugucuccccucauagaauugguaaucucuuccuucuccacccucauccccugcuguaauucuauauugaaauuucauuguauuuugugccagaugucuuuguguaaaaccaacuuaguucugugagaagaguuguacguuuuuaauauuuuuguucuuuuuguagacugcagaaacaaaaauagccuuccuauaguaagguggcaauucacauuaagaauguagauaggcaaauuuaaacuucuaaauguaauuugucuaaaaaaguugaaaaacaguguauaguaaaagucucuccuccaaccaauggaaaguacuuuuauguaagauccuuuaaguuacugacuugaaucuuuacguaagguaauuugcuaguaucuauuuuauaaauaauguuauuuaauacuguuuuauuuucuauagaauccuaguguuuuuccauguaaauuuuuagaaauucuuaaaguauguaucccucauuuuccccuauaguuguuugcuucuacuucuguuuuuaagagauagcaucucaguuguuuaagcuggaaugcaguggcacgaucauggcuuacugcaaccuugacuucuuaggcucaagcaguccucccgucucagccuuuagaguagcugggaucacaaaugcaugccaccacaccuggcuaacuuuucuuuucuuuucuuuuuuauuuuuuugagauggagucucacacugucagcgggcuggaaugcaguggcaugaucucggcucacugcaaccucugccucccggguucaagugauucuccugccucagccuuccaaguagcugggauuacaggugcccaccaccaugcccagcgaauauuuuguauuuuuuuuuuaguagagauggaguuucaccgugugggccaggcuggucucgaacuccugaccuugugauuugcccacuucggccucccaaaguguugggacuacaggugugauccaucacacccggccaacuuuucuuuuuuuuuuuuuuuuuaggagacagggucuugcucuguuuuccagguuggucucaauuccugggcccaagcaguucucccaccugggccugccaaggugcuaguauuauaggcgugagccacugcgcccagcccuuuauaguuuuuuucuuuuuuuugagaugaaguuucccucugucaccaggcuggagugcaguggcgcgaucucggcuuacugcaaccucugccucccugguucaagcgacucuccugccucagccucccgaguagcugggacuacagaugugugccagcaugcccagcuacuuuuuguaguuuuaguagagacgggguuucgccauguuggcuaggauggucucaaucucuugaccucgugauccacccgccucagccucccaaagugcuggcauuacaagcgugagccacugugcccggccagcucuuuauaguuuaagaggaaggauaaaccuuaagagaucacaaccauauauuugugucagggguccacaagacugccuccauguuuggagauuugcuagaaggacucaugggaucagcuuaggguuguaauggcuaagauuuauuacuguaacauaguauggauauauaguagaaagaccucaauggcaaaagacacugacagagucuggaaaaauccauguaccagcuuccuuaugugcugugccuuccaugaggaucacacagacuaccuucuuucccccuuaacgaaaauacaacaacauaugugacugcccaagaaacacaguuuuuaucuaggcuggucauguagguguacucucugccuagcaugugugaaauuuccagacucauaaaaagaauagcaggauaagccacauuauuuccauagucuagauauaguaaaccaugauuaccaguuagggaacccucuugaaauucaaguucucagaagccagccuaggaccaacugugcaaacagacagacccuccuucacaggauaauguaauagucucagaucugcuuuguuaauuuuuguuugcauagaguuuuauaauuggaaggugucucaaaugcuacauauuucugucuaauggacuauaguaagaguguuguauaguauauaacauugaauuauucuccauuauagacaggcugugauaaguguucuaauguuuauacaaaagaacuuuguaacuuugagcagaguaaagagacuguuaaugauacuuuugacugcaaguaguagaaaaauguuguguuuaacucugaaauaugcuuugccucauauuaguauuucuacucuagcuuucucuugacuagcguaagcaugguguauauuauuccauucuuuuauuuuaaccuguuugcaucuuuguauuuaacuuguguuucuugaaggcgauaguuuuauuucucugauaaaaacauauaagaagacaaucacauuaaauguauauggucuaaaaccucugcuuuuuaauuggggguauuuagaccauguacauuuaaugugauugucuucuuauauguuuucuauuuaucucuaucuguuccuugcaucauuuuucuugcaucccccaccugccaagauggggucuuacucugucacccaagcuagagugcaguggugugaucauaccuuacugcagccuugaccugcuaggcucaagugaucuaccucagccucccaauaguggagaccacaguugugcaccaccacaccuggcuacuuuguuuuauuuuuuuauauauggggucucacuauguuguccaggcuggucucauacuccugagcucaagugagucuccugccuuggccacccagagugcugggauuacaggugugagccauugcaccuggucuucuuggauucuuuuacuuuauuuauuuauuuauuuauuuauuuauuuauuuuuugagauagagucucgcucuguugccaggcuggagugcaguggcgcuaucucggcucacuguagucuccgccuccuggguucaagcgauucuccugccucagucuccugaguagcugggauuacagacgugcaccaccacacccagcuaauuuuuguauuuuuaguagagacgggguuucaccauguuggccaggauggucucgaucuccugaccuugugauccgcuuaccuuggccucccaaagugcugggauuacaggcgugagccaccgugcccagccuacauuauuuauuaugauuccaguuugccucuuuuuauuacuuuuaccuguuuuuaaaaauuauuuuuguaguugcuuuaagauuauaguguacauuuagagaggucuaccuucaaguaauauuguacacuucaucuauaauaaaagcauuccuucauuugcuuucuuuuccucccucgugcacuuugugcuauugcugccaugcauuugacuuuuauauauguuauaaacucuguaauauuuugcugucuuuuauuaaacauauaucucuuagagauuuaaauaauaaaaaauuuaaaagauguuugcucauauaguuaccacuguggugcucuuuauuccuucguauugauccagauuuucaucugacaucauuuuguuucuggagaauauccuuuaacauuucuugcagugaaagucuccuggugaugaauuauuucauuauuuauguuucuggugugccuuuauuucaccuucauuuuugaaagauauuuuugccaggcauggaauucuaguuggccuuuuuucuucuagaacuuuagagauguacugcugucuucucacuugcauuguuucucaaaagaaaucugauguuguucuuaucuuuguucuucuauagguaacaugucuuuuuauacagcugcuauuaauaauauaucccugauuuugaacaauuugauuauguuaucccuuaauguaauuuucuucauguuucuugugcuugggguuugcugaguuucuuggauccgugaguuaauaggucuuuuuauggcuagaacauuuucagcaguuguuucuucaaguauuuuuuuucucuuccucuuuuuucuccuuuggggacuccaguuaccugcauauuauuaggcuauuugaaguugccugacugcucacugaugcuuuuuaaaaaucacuuuuuaagauuuuuuuuuucuuuuuguacuuuagcuagugucuguucuuguaucuucaaguuugcuaaucuuuucuucugcaguuucuaaucugcuuuaguucauccaauguaauuuucaucucaaauguuuuugucuuugaaaguuugauuuuggcuuuucuuguuuaucucccaugucucuauuuaacuuuuugauuauaugggauacauguauaaaaacaguugaauguccuccucugcuaauuuuaacaucuauuuaaguucugggucaguuuugauugauuauuuucaguuugcaucaugauugucugcugcuuuuuaugccugguaaucuuuauuuaguuguaaaauuuaccuuggguucuggcuauuuucuuuauucuauaaaucuucuugagcuuuguuuugagauguaguugaguuacuuauaaaccguuucauucuuuuggguuuuguuuuuaugauuuauuagacagauaugaaggagugcuuaguccaggacuaauuauuccucaccacugaggcaagacuuucuguggacucuguugaauguuccaugaauuaauaguuuucccaguuuggcuagugggaacagauacuauuccuggcuuuguaugaguaucaggcccuguucccucccauuguuucugaugguucuuuuucuggauucucauaguuuccucauaugcauaugcugaucaguuaucuggugaaugcuugagagaagaucucuauagaccucugggguucuuuucuaugcaacugucuccucucagcauucugugcaguuauuccuugcugcuuuuuucucuccuggcucuuaacuuucucuuuccaacucaggagucagcugagauuugccucaguugccacucucuaugccauggccuggaaacucuuaucguugugugcuggggcauauguagggcucaccucuuuuguuucucauuucucaaagcucuacaguccuuuguugccugauguucacauagcauauauauguucacauauauucacgucuuucuuucuuucucucucucucucucucucucucucucucucucucucugucuuucuuucuuucuuucuuucuuucuuucuuucuuucuuucuuucuuucuuucuuuuucuuucuuucuuucuuuuuaguggugaugggauuucaccauguuugucaggcuggucucaaacuccugaccucaagugacgcaccugucuuagccucugaaagugcugggauuacaggugugagccaccaugcccugccaugucuucauuuuuuaugguuguuucaggaggagcguaaauccgauaauccggucucugugacuccaucuuggucagaauuagaaguauuaugcaaguaacuaagaaguuuauuauuucacaauagaaaauuaggaguuagggugauggguaguucaguagcuucaugauaacaaguugucagggucuuaacaucuuuucuuggugcauccagaacauauuggucucuuucuugauccaguuccucucaugagcaaaagauagugggcaggaccucuaagcauuguacucucaggauagcauucagaggcagaaaggaaaaaggaaccuuuuuauuauuauguuaauuaaggaaaaauccuugccagaugcuugucccauccuagcauauuucucucucucucucucucucuuuuuuuuuuuuuugagauggaguuucgccuuucgcccaggcuggauugaaguggcgcgaucucggcucacugcaaccucugucucccagguucaagugauucucuugccucagccucuggaguagcugggauuauaggcacccaccaccacgcccgguuaauuuuuguauuuuuaguagggaugggaugggguuucgccauguugcccaggcuagucuugaacuccugaccucaggugacccgcccgccucagccucccaaagugcuaggauuauaagcgugagccaccacgcccugccccuggcauauuccucuuaacauuuuauuagcuagaauuaccuugaguguucauaucuuuuuuuuuuuuuuuuuuuuuuugagacggagucucguucuguugcccaagcuggagugcaguggcgugaucucggcucacugccagcucugucuccuggguucacgccauucuccugccucagccucccgaguagcugggacuauaggcacccgccaccaugcccggcuaauuuuuuuuguauuuuuaguagagacgggguuucaccguguuagcuaggauggucucgaucuccugaccucgugaucugcccgccucggccucccaaagugcugggauuacaggcgugagccacugcgcccagccgagcguucauaucuuaaaccaauaacugauaaagaaguugagacagccaugauggcuuuccucugaggcuggggagaguauuuagccccucugaagcauguuucugcuuagagcagggugcguaucugaaaaaguggaaaucuguaggaaggaaaaagggggaauggauauuuuauaggcaauaaacagugucuauuauuggaaauauguuuuaacugagggaaucugaaaauauuuuuaaagaaggaaagauuuaagguggugcuuggaggauggguaaguuucaguagauuaacauagggauucuagacagagggucacccuuuacaggguuugaaacuaugaggguauauggauuuuggaaaaauggcacauacguaagaaugacuggagaauaaguaggguagagaauacuaggggacaggaauggaaaauuuccuuggcuuugcauaccaagaugaggaauuucaguaauguaccuuuuaaauaagaagagcaguauuaaaugaucuaaauucccccagcccuuuguaauugaauuggaaaagguuuacuugaagacaaacauauuuaggauuacugcuauaaauuaaaggccaaugaguguaaaaucuugaguuuagguauuauguguaaaacauaaagaugaaauauuguaauagaaugcauaguauuugauucuuuauaaauuagauggaggaacugcagaugucuuuuuuuucaagucuaaguauguuggaagaucacaaguuuuguuugguugugcugagccugaaaccgugugaaauggcuuugacacuaaaugucaggguaggaaucauagacaguuuuccuaacuagcagugguggcaaaucaaacugacuuuggagaacaagaagagaaaagaagauggaagauugauccuuuggucaaugcucugaggaagaaccagugaaaagguggauguuaacacagaauaaguuacaggaaguauaguagaaauuauaguaguuuggauuaauagauuuaaggagguauggucaauaaucucaaaugccucucaaguguguuuuuguauuauaagauuuucuaaauaaaaguuucuaaauaaaaccuaauaauauuuauuuuuuaagagauagagucuucuauuuugggaguggcggguccggcagagagggaucuugcuguguugcucaugcuggagugcaguggcuauucacacauguaaugauaguauacugcaacuaugaacucuagcaauguuuccagcucagccucccacauagcugggacuacagguacaugucaccauaccuggucauaauuauuauuuuuaaugggaagcaaucgggagucuucacuucuuaaucugucucugacauuguuagcuaaugucaagugacuucuuccccaggucauguuaccugucaguacucaaucaucauguacacaguaagaaauuguuuuaucuuuucacucugaaaugcagggauagaaggaaggcaucaaaaaauuaacaauggauuauuucaucacaauguuaagugcaaggugucgguacagcaagauaauccuagauauuuauuugaccuuggaaugccguuaggcauauaucuacuuaaaaauugauguggcugggcauaguggcucacaccuguaaucccagcacuuugggaggcugaggcaggcacauaacuugagcuacaaguucgagaccagccugggcaaugugacaagacccugucuuuucacuaaaaguaccaaaaaaaaaaaaaaaaaggcaggugugguggugcacaccuguagucucagcuacucaagagguugaggugggagggauggcuugagcccaggaugcagagguugcagucagcugagauugcaccacugcacuccagccugggcaacagagccagacuuugucucaaaaaugaaugaaugagggaaugaaugaauauguuuauuucccgucaccuugacaccuugacucuggagcuaagaggaagcugaaaaauuuguuuuagaaaauuaagaguuuuguaugccuauuuaaaaacaguuaaauuuugguaggcccauucaaugaagaugucucaauuuaauuuuaaucuuucuuuuuaguauuaaauaaguuuaaagaaaugaacuuaccuuugugaugaggugggugguauucuuugguauuguaaaggaccccuugaauguaaaguuuaggggagggguggagaauaauaugaacuuacaucugcauaaaauaucuugugaaggaugcauaggaaacugguaaaauucuuugccuguaggaaacuuauuuuauauaguuguauacaaagugauuuuauacugcauacccuuuaggaacuuuugaaccaugguaauguuuuuauuucaaaaauuaaaaaccuuuuaacaguuucuaacuuguuuugaaaauauacuucaaaaacuuauuucucuaguugugcacuauuguguguuuuaucuauuugaaauugauuuguguaucaugugauauaagggguccaguaucauuuuuucacacauggacagccaauuguuacuacaccauuuauugaaacaucuuuuuccuccacauuugaaauauaaccuauuauauagcaaacguucaauguauuuuagauuguugguagguucucuguuuuauucuuuguguauuugagaaucccagugauauaucaugaugucauuguuacuguagcuuuauacuaagucuuucuauucgguaguauaaguguuauuuccaccucuuccuauggcagagauacuugguuuagacuagccuuuccacugagaacaauuagaaaagcuguauaaaauguuguuucaaauaaauauuuaagggaucagaaaacuagaagaguggugaggaccugagggagugagaauucagaggguaagguugugcagaguuuggccugaccuuaaauuuucuuuuccccuugaguuaauuacucaguucaaaaaaauccagcugagagguugaaaagcugagaagcuucuggcagucugcagagcugggaagacaaaaagggaauuuaggggucauuaaaugcuauagaaguuuauuuaggacccugaaggcuacagagggguggauggaggugucagcaaaugacagccuguggggucacauucgguccuccagcuguguuuaugugggacaugagcuaaaaauguuuuuuaccuuuuaaaaugucugaaaaaaauuuaaaagggaauaauauuuuaugacacaggaaaucauaacgacauucagguaugaguguuuaaaacuaauguuuuaugggaacaaaaccacacccauuuauuugggcauuauauaugacuucuguugcacuacagugucagaguugguugcugcagagagcacauauauuucaaauugcugcucugcaugcuacgaaucacaaugacauaguuacaguuugucaguaugugugugugugugugcgcgccacacauauugcccuggcaucuuauuuauuucucucauuaccagugcauacccaccuaucauguuaaaacaagaaaaggagaaaaguggacuuuauauguaacacuuuagagguauaguggaauguauauuauuauuaacaaauuagauagcaaagcauuauauuuauuaugcuagaagacuauggcugugcuaaaagaauauaauauaugucagcauuaccagacuuggcacuucucacaauauucccagccaacaggaauaaaacuaaaaggucagaaaaaaaaauaguaaauuaaaacaaaauuuuaucacagcagaauuucuucucaaaaacaaaaaauggaaauuaggcuauaauuaaaguaaguuuuucaauggcuuauuuguuagccaagcaaggaaaaccauuaccaacaguaguuaauuaaauuauguuuuauuaagguaaacaaagauguguccauagaaaauaaacuuuaaaaaagacuauuagccuuucagcgagaguaauugcucuaaaaguuaaggacguugggaguaauaucaagucauuuuggaaagaagggugaaugauuuuucaugguuuucuuaggcuuuugauggaugaauagguguuaccaguacuguucaguuguuacauacuccagaaguuagugcugaguuugaagugauggaagaauuaguguuuaugcauagucuaugugaaacaacuacaagagaaaauauuuucagaaaaguugagcaaacacuaacuuaguacaaccugaaguggaauccgcuaagaugcguuacaguugauaguggcaaaaauaacuguggagcagaaagacuugaguuggacaaauuuacaaagcuuguuaaaugucagguguuuaaagccugauuauuuacuguauuauuuauuagcagguacuuugcagaaaauauuuaaaucugucauguuuuagugaacuauuauauaauagugucagcagugauuuugacuugcauuuguggacuucaucaucaaauccuaugaauuuuuguuagauauagaggcagaauauacugaauugccauucuacauagcaauuuagugacuuggcagugguaaaguuuuauugcaguuuuuugcgcugcggaaugagauugaaauuuuucugaauaauaaugcccucaacuauuaagucaaauacuuaauagcuuugaaaguuggcuuuuccuguagauuucauaauauuuuguaacaaauucaccuaaaauuacaaggcagaacagugauuauaagugaaccuuauacugugguaaggucacuucuacaagaauaaugaaucaugaaaaucaagagaaagaacaaauaguaggaaaaugucuuccaauuccuuuuagcccuucauauuucuaccugaacucauaagcuuuuaaaaagauaauuauuuuuauuuauauuuaaaaagauaauauaggauaauauuuuuguaaaagaguucuugagauacagcacugaauguaaaggaaaauauuggagcauucaacuacauuugagaaauaacuucuguuuauuaaaagauacuauaagaaugaaagcacaagcccuaaugaauauucuuguuugauacuaaaccaaagcuugagaagugguaguuucgcaaguuuuucaagugguuuggugcaaucugaagacugcaaucccaucaaugaacuuuauaucuuuacccuuuaaaauuauaauuuaugggccgggcgcagugguuuacgccuguaaucccagcacuucgggaggcugaagcggguggaucacgaggucaggagcucaagaccagcauggccaagauugugaaaccccgucucuacuaaaaauacaaaaaucagccgggcaugguagcaggcaccugcagucccaucuacgggggaggccgagacagagaaucgcuuaaacccaggugguggagguugcagugagccgagauugugccacugcacuccagcgugggugacagagugagacuccaucucagacaaaaaaaaaaaaaaaaaaaaaaaaaaaaaauauauauauauauauauauauauauauauauauauacacauacacacacacacacacacacacacacacacacauauauauauaaaauuuauuagacuaccuugcaauuucaggggaucuuuuacccauauaugauuuuauaagauuacuaaguggucuuuggaaaauauugguucacugagugauccagauauuccaacuauugauacgguuguuuuuguuuguuuguuuguuuguuuuguuuuguuuguuuugagacagaaucucacucuguugcccaggcuggaaugcaguggugcgaucucagcucacuucugucuccuggguucaagugaugcucaugccucagccuccugaguagcugggacuauaggcaugcaccgccaggcccagcuaauuuucauauuuuuaguagagaugggguuucacuauguuggcuaggcuggucuugaacuccuggccuccagugaucccaaagugcugggauuacaagugugagccaccuugccuaguccuacacauuuuuaauaaauaacaaaauucacauuuguuauaauccacugaucucaucagaaaagucuuuaaguauuggaauuaguuaagcuuacauuguuggauauaaguuuuucaaaucuucuuauuguccacucauguucuaaguuguuuuccuugaagugacaggcucacuuuauuccuuuuuucaagaaauauguuagauaaucaaguuuuaauaauugugguuuguuauuuguucuuacauguaaaaccgguguuccaugaaaaaagcauuuauuucaguuuauaaaucacaugaucacaaauucuuuccucaagaaaaacuaugguguaacaauuauuuuacucuuuauuucucguuuugucacauagauaauuaaaagauguguauucauggaucaagacuuaaaacauuaaugauuuuugcugcuucaucagugauauucucaaugauacucuacauuauuuuuacuguaguuguagugccaauugagaaugugacaacuucuaauacagcuuggugccaacugcuuucaguuuuggaaaugcaucaacaguuuuacccaccauagcuuuugcaucguguaacaauuuuugcuucaauuguuaaacauuauuuugaaaacucaaggaacaguaaagucuguuuuauugcccauauuuuuacuauuuguuuguucuuucuuccuucaggauguucugagaauccuucuuuuuaucauucuccuuucugguucaauaacuuuucucacuauucuuuugguguaguuuugucucaugacuaauuuuuaguucucauucaucucacaauuucuugauuucccuuucauuacuaauggauguuuuugcuggauauagaauucuuuguugucaguucuuuuaggacuugcaaaaauguuaugcugcuuuguucuggccuccaugguuucaggugagaaaucugcugucauuugaguuguuuuucaucuguggauaaggugucauuucucuuauuuaucucaggguuuuuuaguuuagucauuaguuuucagaaguuuaugauauauauuagcauugauuuauuuguguguauccucuuaggauuuauucaauuucuugaaucugugggucuucgaauaauuguucagcugcgucauguuccuuuucugagauuccagugacaggaauguugcaucacuuauuauagucccacaagugucuuuaaugucuuuuuuaaaaaaaaaauauuuauuuauuuauuuauuuauugucagaguuuugcucuuuugcccaggcuggagugaagugguacgaucucagcucacugcaaacuccgccccugggucuaagugauucuccugccucagccuccugagucgcuggaauuauaggugugugccaccaugcccagcuaauuuuuguauuuuuaguagagacaggguuuugccauguuggccaggcuggucuugaacuccucaccucaggugauccacccaucucggccucccaaaaugcuaggauuacaggccugagcgaccgcaccuggccacuuuuuuuuuuuuuuuuuuuuaaaucaguucauuuucuucucuuguuuagguuggguaaucucucccauuuuguuguucagcuuaguuuguauuuuauuuuuguuagcauauuuuuuaguuuucaacuugguauuuguuucuuucuugauuucuuugcaaaacuuuguauuguuuccuuuguuucaaaaguauguuuguaauugcuuuuuuuuuuuuuuuuuuuuuuugaggcagacucuugcucuguugcccagguuggaaugcaguaaaugaucucagcucacugcaaccucugcuuccuggguuuaagugauucucaugccucagccuccugaguagcuggaaucacaggcgugcaccaccaugccuggcuaauuuuuguauuuuuaguagagaugggguuucaugauguuggccaggcuggucucgaacuccugaccucaagugauccaaccaccucugccucccaaagugcugggauugcaggcgugagccacuguguccggcuguaauugcuuguugaagcaguguuauauaguuuaaaaucuuugauagauaauuaugacaucuaugaauucucauuguuugcaccuuuugacuauauuuucaaauuccuguucagauuuuccugguucuuaguaugguauaacauguuauauuugguugaauccuuugcauuuuaaguguuguguuaugaagcucugcauuuuauuuaaauacccccuuuuaguaggauuuaucugaaacuuugcuuuugggguggagguggggcacagccuuguuacuacucccagguguaugugaagauuccaguuccuuaguaggccuuuguugacucauugauggagacguacaccuaguaaaugcugaguaggagugaaaacucuggacuugcauuacaccuuugugaauaccacccuggcucaaaagguuccugcuuuucacuuggccuccacugaaugggauggaggggugguuaaguuaucacugggcagugcuuugaguuuggauucuccaauaggccucuccugucauaucucuguagagggagggauagggauauguccuuaucacuggguggguguugaacucaggcuccccacuuuuuuuccacccacacucuagagggaggaagccgcguuacugcucaguggguaugaauguccugugucccaguuggccugcugugguaucauguuguccgugggcaggaguggggaauggcugacuauguccuccuuuuaagucuuugcaaaagguauauggcuugggcuuuuauuuguaccauuuggcuuaaacugguuuguuguugucuaugaguuuuuugucuugguagccugccgcuucccugcuuuuuugacaaaagacagcagaauuuucuuggaguuuuacguaugugugugccuguugguguuucugaguugucugcuucucuagcaacuuuucuuguauauaugagucagaaaggaaaccuagggaauucauccucuuuuguuucuuggcuccugaagcccuaauuggucugcccucucucuacauuuuguugucuucuuuuguuugucuuauguaucacggcuaaggguuuuuaaagcuguauuuaguggaaagaacagggaaaaguacauuuucugcauuuugucuggaaguggaagucugcauucauuuuugcuguuuuucccugaauacagaguucugggaugauuauguuuuucuucuucaagcauuuaaaagauguugcauuguuuccugucuuccaugguuucuaaugagaagucagguguggugucaguaguaucauuauucccauguauauaauaauguuuugauauucucuggcugcuuucaggauuuucucuuuaucuuugguuuucagcagucugacuaugaugugccuaggugugguuuucuuuguauucauccugcuuggggguugcugagcuucuugaaacuguaaguugauauuuuucaccaaauuugugaaaagcuugacuuuuauuucuuauucuuuuucugucucauuucucucuccucuuccucuguaacucuaauuacaugaauguuaguauauuugauauuuuguagauuacugagggucuguucguuuucuucccaguguuuuuacuuuuaguuccucagaauagauacacuauucauguauuuucaaggagauggaccaauuuucuaccaaucucuuguuaagcccauccacuaaaauuuucauugaaauuaccauacuuauuaguuguagaauuuucuuuucuuuucuuuugagacagggucuuugucucccaggcuggagugcaauggcgcgaucucggcuuacagccaccuccaccucccagguucaagcgauucuugugccucagccucucaaguagcugggauuauaggugcccaccaccacacccagcuaauuuuuguauuuuuaguagagaugggguuucgccauguuggcuaggcugcucucaaaauccuggccuuaggugguccaccuuccuuggccuuccagagugcugggauuacaggcaggagccaucgcgcccagacugaaacucuauuuaaauauagauuuuagccaaugauauucugcuuuuuuuccaaggguauaauguccucccauuccagccaguuuuugguuauuuacagguaacuucaauuaguuagcuuuuacguuuucuucagauuugagacauuuuaggaaaguuacucugauauuagucccuaugcuguuacccaauaaauaaauaaauuuaugugugagagccauuguuuuguuaagguauauuuugcauacgcuauaauucacccuuucuaagguguguauugaaugugauuugguaaauaugaacagucauguaauuaccaucauagucaagauacagaauagacccuuuacccauaaauucacucaugaccuuuugaaguuacugccuaccucccacuccagcuccugccaaucaccgaucuguugcuuuccuauaguuuugccuuuucuagacuaauauaugaauggaaccauacaguauagaaucuuuucugucugccuuuuuuuacuuagcauaaugguuuugagauugguccauucacuagcuuacaguuaaguuucguucaauuuuuggccaguauauaaagcugcugugagcauuuauguaacaugcuucguuguggauguaucuuuucauguuucuuggguaaauaccuaggacuggaauuucugacuuguuggaaauauauucuuaacuuuggaaaacaguuucacaguuucuuaagugucuguauacuucuccguuucuagagaucugagaguuccauuugcuguacauuguugccagcacuggauauugccacuguuucuaaauuuuagccaucugguuggcauuuagugauaauuuauuguggguuugauuuugcauucccugaugauuaauuagauugagccucuuuuuaugucuuuuuuugccauuuguguaucuuuggugacaugucuguuauuuugucucuaccauuuuuuuccaauugauuuacuugucaucuucuugaguuguaagaguuuuuuuauauauuauucacagaagucaguuuuggagaugcauuuuauaaauauuuuugccuaaugugugacuuguuuucauuuauuuagcaauguuuauugaacagcagaggguuuaauuuugaugacauuggucauuuguuaauuuuuuggaaguugaaaaaauuaugcuguuuaugcuuuauuaaaaaaucuuugcuugccccaguguuaguuguagguuuaaaaaauccauuuaugguuaaauuacacauaugauaaaagaauuugagauaagauucauguuucuuuguuuuccauacggauuauuuagcaguuccagcaucauucuaaaagacuauuuauugcucucuuggauuaucuuggccccuuggucaaaaauuaauugaauauggaaaagugagucuauuucuguauuuucuguuuuucugacuuauuugucucuccuuuuaccaaaaccaaacauaaagauuuuuuuucaaaaucaugaguugauauuuauguuuucaguuuaauucaauagcacaauuacauaucuuuaaaacaguuuuauaccuguagcuaagcuauaguuguauauuuucuuuuaauaucaucuuuccuauaacugaaaaagucauuaaaagaagaaaagauuauuguuuuuguuucaauuucaaaguaaucaaaacuaaguguacuaguauuaaauaguuaaagcuaguagaucaauaaggaaauuuaauguuauugcuuuuuucuaucuuuuuuugaguuuacuagugauguaaaagauuugaguuauuugcugugauuauauaaauacucuuuugaugcauaauucagcaguuaacaucauguuaauuuguggcauuaguaauuuuacugauagcccuucugugauucugauuuuugguagugguuuuuaccugguaaguagcauuuuaucaguuggcagguacuggaaaucugcuuuaucacuucuuuuuuaagaaaaguggaaaacacaaacaguuuguucaccaaaguuauguuucaaggauuccauucaaccagaaucugguucaccuuauugacucaccuuggggguauauguacuagauuuuuacauacaucuguuuggagaaacucguuuuaucuguguaauguuuguaagaccagaaguucuuuuacuguucuugaaauaaaacuuuuaagaagcugaguauucuucuguuaguuucaaauuuggacuaaaauuacacccagguuuuggacuaaagagaaagcaaauaaucuguucucauguucuuaaaagacaugauuuaaguguauccaacuaacuugauucuuacugugucuguguuuacuccuacuaaaaugaaagcuuuuaaauuuuuucccacuuuuugaaguauuuaacucuucuguaauaggcaguguuuucuuauuaacuuuaaaguuguguuaagcaaacguguuuaaauuaauauuucaauuucaaaaacccuaauuugaaacaauaaauuuuaucauuguauacauuaugagcuuuuaagaauaaccaaaaaaauggggguggauguuuuauguggaaguuauguguaucccuuuucugcuuuuggcuaaggacagauaucuuagaauuagcuuuauggcgcauucaucuaucugauuauuucaguuaauaucaucuuaauauaauacagguuacuugagaagaaaacaaacucuuaacccacuauuggagagauaccagguaggauacuaaccuugauauagaauuucaugugagaaagaaaaaggaaaauauuuuccauuaaaaguugaguuuuuaucuaaaauucucuuaauuuucuagaaaaaacuuaauuuuucuaaaaauauguugaagaauuauauauaaaauucacuuugcuauauauauagcaagugaauaauagguacacauuucuaggaauaccccaaauauuagaacguauauacuaaaaucacaucaggaaacaaauaauagcgccccagaaauuccauucagccuccuguugguuacuauuccuaacuccccaaagacaugcacuaucaucuaguaacaacauaggugagucuugccuauguuuguacuuuguguaauuggcuuuguacuuuguauaauuggcuacuaaguacuguuuucugucaucuuucauguauauauuugugagauaaauccaaauuguuccuuccagucguuuauuuuucucauugauguauaguauucuguuguuaagaguacuauaauuuauuuauuuuaccguugggcauuuugaggacuuucaauuugaggucauuaugaauuguguucuaugaacauugcaguacauuucuuuugguugacacugagaguauuuuauggauucuaaccccaaaguggcuacuuucuuuucuuucuuucuuuuuuuuuuuuuugagacaagguccagcucugucacccaggcuggagugcaguggcgcaaucuuggcucacugcagccuccaccucuuggguucaagcgauucuccugccucagucucucgaguagcuaggauuacaggcgugcaccaccacgccuggcuaauuuuuguauuuuuuuuuugguagaaaugggguuucaccauguuggccagguuggucucgaacuccuggucucaagugauccgccugccuuggccucccaaagugcugggauuacaugcacgagccaccgugccuguccauauguuauuuucuuacaaccuaaauaaaaaccauuacguaaacaagacaaaguacuuaguacauuuccauagucgaugaauuugucuuuauuacuuguauauaacuaauuaugaacuccuugaguucaguuccuuucauuuccugacucauugggcuugaacaaggauauuuaaccucucugcuucauuuguaaaaugaaaaauaguaauaucuaccugaaaugguggugguuagaugggaauaaaguaauuucuuuuuuuuuuuguuuuuguuuuugagauggagucucacucuguugcccaggcuggagugcaguggcgcgaucuuggcucacugcaaccucuaccuccuggguucaacugauucuccugccucagccuuccaaguagcugggauuacaggcgccugccaccaggcccagcuaauuuuuguauuuuuaauagaaacggggucucaccauguuggccaggauggucucaaacuccugaccucaggugauccaccuaccucugccuuccaaaguguugggauuacaugcgugagccacugugccuggcguagaugggaauaaaguaauucuuauaaaguacuuggcuuagcugcuggcaaauaauaaugcuuacugauucuugcauauuacccauaguuuauuggcuaacuuaugucuuccuuaaauuaugaaauucuauaaacuauccuugucuauuuuaaaauuauacucauuuuuauaacuuacaugcuuuauuuguauauauccaggauacuagauauuuguaauucaaauuggagguuauuuuuugucacuugauuuuuuuucuguaauguguguucucaccacauagaaguuuuuacauuucuauguagucagauuuauucauguuuuuauuuaugguuauguuaaagauuauagcuauuagggaccuauuucuucaggguuuauaauuuauguauguuguuacaaauagagagauuacuuuuucuuugacccaauagguagagggcacuuuuguggacucagaaagcuugccucuccuauuuuuuuaggaaaauaucugagauucugccuccucauuuccaagccagaguuuaaaauauuuacauuuuuacuucauaguguuaagacauuguguaauguaaguauaauguuuaaaaaaaaaucuuaaaaauguaauagugauuuggcagagaccaaagcauggagggccuugaaaugcugcucuguuuguuaucuguuacaauaaagcaauuaccauaaacuuaauaucuuaaaacagcauccauuuacuuaggucagaacucaggguaggcucaccugugcucucuguuuaaggucucacaagauucaaaucaagguguuaccuggguggaagcucugggggugaauccucuucuaggugcauucaggugugggaggaauucaguucuaugcaguuguagggcugagcucgccauuuucuuucuuucuuucuugaucugccgcccaggcuggagugcaguggugcagucucggcucacugcaaccucugccucccggguucaagugauucucgugccucagccucccagguggccgggauuacaggcgugcgccaccacgccggcuaauuuuuuuuuuuuauuuuuauuuuuaguagagacgggguuuuaccguguuagccaggauggucuugaucucaugaccucgugauccgccugccuuggccuuccaaagugcugggauuacaggcaugagccaccgcacccugcugagcucaccauuuucuuacugccuauuggcuugggucacucucaguuccuagaggccacucuuugguuuuuccucguggcucuuuuuaucuucaaagauagcaacaguguauugaaauguucccuugcuaugaauuucccuuuugcuacuagcuggagaaaacuccgcuuucaaagagguuauuugauuagauuaggcaaaucucccuuuugauuaauucaaaggcaguugauugguggcuuuaaucacaucugcagaauuccuuugccauauaauauauuaauggcauuauccuugccaugauauuucaucauauuuacagccucuguauuaggguaggaaauuugguggggucggugguaugcgggcauuuuagaauacugccuaccacacauucuguauugagggguuugcgugugauucagaauauauuuguauuccuucagaaagauuacuguggcagcagggaggagaauguggcagaaaggaaagguacuggcaggagaaaaaucccacucuuagcagucuccauuuugauuuuguaaugucguuugauguuauuuuuuuuagcagauguuucaaucagaaauguguguuuaauaguaugccaacuagaaugauuagccuggaccagaacaagaguuaugagucagucaaugaacuguucauuacuucaggucaauucauauacagaauaauuucauagauuagguuuuauuucagucagcuuuauuucauuuucuaaagugaacaguuguuuaaaccucggaucucauuaacagcauuuuaauaaacacaguauuaggguggguuuacuucccuagauugugaaucucauggauuauauguugauucuuauuggcuuaauuuuugaauugggcauuauuuauuuuaauucuuuagucuuauaguuuugcauguuugaagcuauauguuuuccucugaagaccacauuugccacgucucagagauuuuuuugauguuucuuaaucauuuaaaaauaauacaugauuuuucuucuugauugaaacucugccguuauauagaaaggacuuuuaaauuuugccaguggauagauuugggacuuuauccuuauauugugaauuucuaauuuuuauuguauuaggucuagggacacaucugcuuuuacugaauauaaccuaggaaauaccugcuuuuuaaaauauguggacauuucuuuacgaccauacauguggauuuuuuuuugaaaauucuauguauauuugaauagaauguuuucucuauuuuuggaauacagagaucuguguguauuuuaugugucuguuugaaucaaacccgaucauuguuauuauuuauuucauaucuacuuaauauccugauuugagagcuauguuaaagucuaaucuaugcauguuauuucuacucagcuuuacuuuuuauaugugacauauauuuauuagguguauaaacuuuaaugacuauggcuucuuuuggaauuuacacuguaacauaaaacuuagguuauuaugaaauauuaucuuugacuuguucacugcuuuuuaguuuaaauucuauuucuuugcaauuauugcuauaccugcauuuuuugguuagcguuuguguuuuuuccccucaagucuguuuuugaauuguguaugucacugugcauugugcauauauauagcugcuccuguguugcuguaaagaaauaccuguugcuggguaauugauaacaaaaagagguuuaauuggcucacgauucugcagacaguacaggaaguguggugcuggcaucugcuucuggugagggcuucaagaaguuugaaaucauuuagccaggcgcgguggcaggugccuguaaucccagcuacuugggagacugaggcaggagaaucgcuugaaccugcggggcagagguugcagugagccgagaucaggccacugcacuccagccugggcaacagagugaaacucugucucaaaaaaauaaauauaaauuaaaaaaaaaaaguuugaaaucaugguugaaggagaagggggagcaggcaucucacauagccagaacaggagcaaaggagagggguggagaugccauacacuuuugaacagccagaucuugugagaacucacucguuaucgcaaggacagcaccaagccaugagggauuugcccccaugacccaaacaccucccauaaggccccaccuccaacauuggggauuacauuucaacaugaaauuuuggcggggacaaauauccaaaguauuucauuuauuucauauuauauauguguacacacacacacauacauaaaugaagucuguaguaauauguaaaauauguauauguguuauguaguauauuuugcauguuuugaaaguugcuaucuuuuacuagagaauuuaaccuauuuacauuuguuauccauggacuugaauguuagcuuaacagacauuaaaauuuugguuuuaaauaauuuuuuauaggccuagaaaaauaaugauuuuuuuuggguuucuuuuuaauucaguauugauaaugagaacugaugcccgauucuucuuuuuuuguaaugaucuguuuucuuuuuuauguggcuccaagaauuuuccuuuuauccuuguuauuucaaaguuucugggaaguuuuuaccugaagcugccauucagggaguuuaaggagacauuguuacagaucaagaguggguauuuuuguaaggauauagaaauaaguggaacagugauaaugacucuuucgguuuuagguuccucaucuguugaaugaggauuaugcuuaauuaaauguuagcuuuuauuauuagauauuuacauaacuuuuccuuuagaauuuuggugauuauaaucccucccauuuucucccauucugguacucauauaaaacagacauugcaccuucuggaucagauuuucaugucauucuaccucuuucucuuacuuuccaucuuuguucuuuauuacugcauccugggagaauccuaguugccuaauacuaaaaaaagacuggugaagauuaaaaacaaauuuggagcauggggagccuuauaauacuuauuuauuagagcacguagccuaaaaccauugcuauaguugguacagaauaaauacuggauaauuaauuaaaugaacuguggaauauuuaacuucuugguauuuuuuuaugauacaacuuuaaucucaaauuuuguucauucuguuuuguuuuauggauacauuuugacagauuauuucaaacuauuaaauaaaagucuugaaaauuccucagacucauucuuaaaauugguaauacgaguucucacugaguuuuuguuguuguuguuauuguguucuuggauuaauaugggaaaauauuauuauaacauguuacuuuuuuccuuuucuuacucccugucuuuuuaaugaugaauaaaaguaaaaagaaaaaaugcugucuaggaauuuucauuauugauucaaauaaaccauuuaguugauacaccauuuaagggccuuuuuuuuuuugaauuuuauagacugguucucacuuuuguuucccaggcuagagugcaguagcgugaucacagcucacugcagccucaaccuccugggcucaagcaguuuucccaccccaggcucgugaguagcugggacuauaggugcaugccaccaugcccaccuaauuauuguauuuuuuguagagauggaguuucaccauguugcccaggcugguuucuaacuccugagcucaaaugauccaccugccucagccucccaaagugcugggauuaaaagcaugagccaccaugcccggccaagagcuguuuacuuuaucccuccuccccaaauguuaauuagcuucguaauuguuacuuauguauuauauauuacuuauuguauuauuaauauuuuaacuugcuugauuucuuuuauguguaguguauaagaguguugacauuugagaaguucccuguggaaauccauucuuugauauugucuacgauuuuacaaguacuuuuuacuugguuuaggaagauacauuccagacuguguauauauaguaaacauuuucuuuuaaugccgagugcucuucauuagcuauuuaauuguaacagauggguuugaagcguucuccuaaauguaguguuuuauuuuccuucuuuuauucacugauaucuuuauaugauauuguaaauuaguauguuagauauauuccaguacuucucauaguaguuuagcuaauauaauauuuuucauugcagauaugauuaagagaacauauugguguuucuaaaaugagaaagacauugagaagcuggucaauuuaaauuacuuucuguuauuauauacuuaccucucauuauauuuuaucugccaagauuauuuuuaguguaaaaggcuucugcaaaacuugccauaugguaucaaaauaagcgauuuuagauuuuaacaauuuagcagaaauuaguuauguuaaugaguuguuauaaacauuuuucaacagauugauuguacuuuuccuuucgacauuuacguggucuuucuauucagacauuuagacuaccgagguguuguauuuguaguuaauucuggguucuguuaaugcacuaaacauauuuagauaccuugggaguuauaaaaaauuaccuguuuuguaaaagcugguuauuacacuuuaucaaugaagaaaaauauuuauuuucuguguuucuaaugcauuaauacccuugagugccaaaauagcacugaaauguuauucuguauacuuauaauauuauauaaaauuaaagugucacaacaguaauuacuguuuaugaguuauuuagaagcuucuccugcuucagccucccaaguagcugggacuacaggcgcccgccaccacgucuggcuaauuuuuuguauuuuuaguagagauggaguuucacuguguuagccaggauggucucgaucuccugaccucgugauccacccgccuuggccuuccaaagugccgggauuacaggugugagccacccggcccagccaaauuuuuguaucucuuucuuuucuucuuucugauucagcccucaggagucacuuagcuuuguuauguugauucagugcaguagacugaugacagugaggaagaguuugauaguaugugauauacagauuuacacauaaaacauugaaaacaauuauaauuuuaacuacuguagucccugguuaauuagcagaauauaaagucaguguaguaacaugugaagauauccacaguaauguuagcaggguccaacugucuguguuacaugaggcuccaguuaucucagcuaagcuguuuaugagccacacucacaaaaaagaucaccaaaaguuaagucuuuuugguauauguauaggaacaccuuucuauuagggccuguuucaagcagcauuuuuggugcuuuggauacaaagauaguauggugccucaauugaaggaucuuggacuaggaugaggaaaagauaaacugaucauguaauggcauaagcaaguaaguaccauguaaugguguaaacaaaaauuuauguuagauagucauuucccacagagagaugucauacuguauaguacagggcccaucaaacucucuucaaagaaaaugaugcucaaaguggacuugggagaaugaggaagaguuugugaaucauucuaagggaaaacugaauaaguaaaugcaacauuuuacauaauuucuucugacuucuuauguguucacuugcccuagacugccccucuuguuuggggcuuauuucugugcguuuuaccacuugcaagauaauggaggcagguugaaaugggaaagauaccagaugacuaauuuuuuuucgcccacauuuccaucuuuuguuaagaaauuugaaguugauugcuacauugaaguauguaguuuuguguuuuuuucugugagucuuuaaccauuugugucccuguuaacuuacaauugaugaguuuauuuuguauuuauuuuuaggcaggguaaaaaauaguaauaugucucauaaauaaaauauauguuccuauuacuaguuuuggugggauuuaaaaacuuuauaauaauccucaauauagaaaccugcccuuuuaaccauauuacuauuugcuuuaaaaaaaaaucuuuagguuuuguuucaaaaaugcuucaaaauuuauuuuugaaaauauaaggaaugaaauucuaacuuucuaauuugaauggaaggaugaguugguagcacacgaagcgcuaaauugaguaauguagauuuuauuauuuuuaacgaauccuuuguuuaauauuuugcagguucaauuuguuuuacuugugauauacagagaguuuuuuauaccuucccagcuuauauuugaauauuccuuuucaagguuuuauaaagagauuucucuccuuuaccccuuucagcgaugugcauuuuguaagcaccuuggagccacuaucaaaugcugugaagagaaauguacccagauguaucauuauccuugugcugcaggagccggcaccuuucaggauuucagucacaucuuccugcuuuguccagaacacauugaccaagcuccugaaagauguaaguuuacuacggauagacuuuuaaacuucaaccaauguauuuacugaaaauaacaaauguuguaaauucccugaguguuauucuacuuguauuaaaagguaauaauacauaaucuuuaaaaucugagggaucguugccagggaucgcuggggagggaaauguuaucagugguuucauugaaauuaaauccaaaaaguuauuuccucagaaaaaucaaauaaaguuugcaugguuuuuauucuuaaaacauuuuaaaaaccacuguagaaagauguaaauagggacuaugcaguauuucugauuuauacuauaaaauaauuuauuaaaaagucaaucaacacuaaaaagccauccaguugaagaauuagaagacaguucacucagguguuauuucaggauuuacguuaauaagaacaccaaagacuucugaaauucuuagaaauuguguuucccugauagguauaauagaaaucucugcuaguaccuuuucaugauucaucuaucuuagucuucuguaaucugcaguugugcuguuuuucuuuuccaaauaguauuuuauaauucaaugaaaauguuuaaaugcgugaaauuuacauuauacaggaaauuauaacucuuuacuauuguaucauuaaauagagaucucuccuuuuucuuacuauguguuuucccuaugagcauauauguuuugggaucuuuuuucuccuagucuauugaauuuccaaucucauuaugaaaccuccaugauauuuuauucaaucuuuuuuaugucaccucuuaguuaccuaauguuagcuuuuaucuguuccuuagcaauguuaauaaaagcuuuuuuccuaucuucuccaggucugugaaacguaaguauagcuaccccaggcuuaaacuaaucucaaauacaguuagucuacaugaucauuacccuuuucuuuguugaguaccauaauuucauuuuccauuaaaauuauuuuguguccacauauguaaucauaucaccauuaguaaccuaguguacaaauuauagguaaggcaaacuagaauuuuaaauuauauuuaggcuaauaagggauuuaaaguuuuaaaaugcguuagauuguacacucuucaaucuggaagagaagaacuucaugcacugcaacuguuacggcuacuauuuauguacugaguuacuucagcaagugcauaaacuggcaguuaucagaguggauuauauucuggguggcauaauaaauauacuuugucaucucaauaaaacaauuuuguguguauauaggaaucugaauuuuauucagccuuuuguaguuaaucaugcuuuagaccucagcaaacaacaugcaaacuuuuacaagaauguuguuguaguguuagaauauuuuauuacuuaauggcagugcuacuuucuacugaaaacuguguucuaacaguguauaccuucaguuacauguuagcaaucauaaaucaguuuguaaaauaauaaauacugaggugagauaauaugcuguuguugaucauguauauaaugaaagguuuauggcaacauaaagcuaaaagauacacuaaaauuaugaguacucugccuuuuuccaaaauagacuuauggagacucauaaaaauacaugagcaauaggauaaaacuaaaguaaggaaauuuggcaauggaaaauuuagauaggauaaauaugaagguaauagagagaccccccccaaaaauauauaacuccagacguaaccacaaauuuggccccauaccuuuucagcagucaauacaaagaaggaaauaugagcccuuaaucugauucuuacuauuuauaacaagacgucacuugauauaaugauauaauaauaacaagacaucacuugauacaaugcaaugaaaaauuaucuuaaaguagccaccuugcaguagaaaaauaucaguuucauagggcuguuucuuauagcagccuucaaacuaagucggugguguaaaaucaaggccuaaaugacuaaauuagauuucuuugggguuuuuuuuuuuuuuuuuuuuuugagauggagucucgcacugucacucuggcuggaaugcaguggcauggccuuggcucacugcaaacuccgccuuccagguucaugcgauuucuccugccucagccucccaaguagcugggauuacaggcgcauaccaucacacccggcuaauuuuuuguauuuuuaguagagacaggguuucacuguguuggcuagauucgucucgaacuccugaccucgugaucugcccgucucagccucccaaagugcugggauacagaggugugagccaucgugcccggccuccuuggggaucuuaagcagugcauucuaacuacacagcguucugacccaucuguuaagacgaucauaaucuuggauuaaguaccaaggauauaauuuaaagaauauugcagauaggauguuuugucaccuuuuuaacauguuuuauaaauauuuuuuccuauccuaauugugugucauggcagaaguuaauuuuuaugcuuuuaaaaugauacugucuuaaaucauaguguuauuaugaggguuaaaugaaaacaaugaauggaauucacauaacauugugccuuguauguauuaauugcuuuaaaaaggguaguuauuuuaccuccuaucuaaggauuaaguuaugagaaugauaauacauauugaguauauguauuuucuguugcuuccuaaggggcagagcaguagcugugauaguugacugaguuaggaguaagguugacaucuuuuuauaaaaguugagaaauuuaacaaaagcaugcaucucauuauaaagaaauucacuaaagagaguaucugugaagaaggccaagauuuucuucaggaaacacuuuuagggugcucugucauagguaaauggcuggucauuguugcaacauuauuuucaugaugauacaaggauacauuaaccuugucuggaaauuuuacccuaaaaauccaucuaguagauacaaccagauauacuuccugaauaggaaaacugaauggcacaaagccaaucaugcaagauaagaggaaagaacauuccagggagagggaacagaccacuacacagaccuugaggaauggauuuggcaugauucaugaacaggcagcaugucauuuuacuuggagcauaguagccuacuagguggguaguagagacaucaucaaggcgaacaaaggcuagaucauguaggccuuguaagcaagggaaggaguuuggguucuauucggucugcaaugagaagucuuugcaagguuuaaacauggaaaugcuacauauccuaauucacccccuguuccucaauguauuuacucaucauuuagcuuuaauuccuuuuacuucacuuaagcuuuaacuccagccucuuuucuuugguuaucuuuguauuucuugacauuaaguccuguugcuuuucuuuuacccuaaauucugucaguccucugaccuuucuuaucuaccugccaaugauacggucuagccucuuuggaugacauccaugauuuauuuuuucuucccagagauucucuuuuauagacaaaucacucagcacaguguccugccagugaugaaaauuggcagaugauagggugugauggaaauuagaaagcaaugcugauuugguccuucuuaaauucacacuguaugacagcuauuuugacuuuuguugcuguucaccaaugcuuuuauucuuauguguugucuggauuuucuuaaguaauaguuucaucagguuuaaggaucugugauaagcucuguucuaauuuaagcucaauguuuuugucuuuuuuauuuaucucuucucuuuuuacggcugucuuuuaggaaaugaccuucucuaaagaugaucauuuuguuuccucucacuuuucuccugccauaagaaccuugcucccuuuacuucauuuagcuucaucuuaugccacuguuggcauuucaugucuacuuuuguguauacucaaauacucaucacuuucauugaucaguaguaaaguuugcugaggagucaauuugauuaguagucaagagccugaucuuagaauccaaauagaccuggaauuuacuccucugcccuuuuaaauuaucuuuaguuauagccugucuuugcuuuuucaacuguuuaaagaaaaauuucuuaguugauuauugcuuuaaacuuagugucucuggcuuacagacaugugugucuaaauauucauauuuaauuucugucaugacaccaaagcuauccaguaguaucgauaaucuuguacaugaccuccaaaagguuguuucaguauucccacacaucuucucccugacugggaggguuggaaccaaccucauuucuuuguguagugcuuuuaaaaauuauuguguuucacauaaggcauauuaaguguuuuugcaccagauguauguauuacauggauguuuuucuuugacuaauuuauuaccaaugauccauaguaaucaaagaacacagcaagguuaucaguaaggaauugguggaaaucaucauagucuaaaaagugauuuuugugacaaugacaguugucuuguugcagagcgaacuuuguuguguauaacagugcugugcaguauaaauacaaugugagcaacauaaguaauuuuucuaguggguauguuaaaaauuugaguaaaaggaaacauugggaauaauuguaguaaauuuuauuuaauucaguaauccaaaauaguaauaucucaaauuuugagauacuuuuucuccuguuaagauuuuggaauccagugugcauuuuaugcuuacugcacaccucgauuugaacuaauuacauuucacuuguuuggaaaccacaugucgcuaguagcuaccauggcaacuugaagugucaggggagcaaacucuagaaaguuucacagaagcauuuuaguguuccuaggaaaguauaauagaaaaaugaauuguuuaucugauaauuaguuuauuauuucccccaauuuuuaaaaguuuuacggugagcaaaaagaucaauuuuuaaauguacauauuuugaaagauaaauacugguacugucuuaagaaacauaacaucccaguuauguccuuucuaucaaaaaugaacuaauuuaugaugcuuccauuguuagauuaaugauuuauuuuaaaugccuaucacuuaaagagccauuuaaaagugauuuuagcaguaaguccuucacuuaaaauauguucaauaagacuugauucauguuaggcaguuggggauacaaaguuaaaaaaguuaaggccccuguccuucaaggauucacagaguugugcuguaauuaauugauuauguaacagaaguuucuuguaagcauauggguaaaaguaauauucaacaacuaaagguauuugggugugguaauagguauucaggaaauaaugugcagaguuuuuuuuugagacagggucucacucugucccccaggcuggagugcaguggcgcaaacuccagucacagcagccuccaccucccgaguucaagcgauucuccugccucagccuccugaguagcugggacuacaggcaugugccaccacacccugcuaauuuuguauuuuuaguagagaugggguuucaccauguuggcccggcuggucucgagcuccugaccucaagugauccaucugcuuuggccucccagagugcugggauuacaggcgugagugucugugcccagccaugagcagaguuuugaaggcugggagcacagcagaaaaacaaaauuucaagcagagggaacagaauguguaaaagcacacagacaugaauagcauguuaugugaggugcauggcagacaacccaccaugaccacgagauagugagugguucugagauucaguuggaaagggagauaagggccuuuuugccucauacuugaaaauucugauuuucuuuuaggugaaaaaugagguauugguggaguuuuaauuuauacagagguuaacaauuagauuuacauuuuugaaagauuguucuggaugugcagaaaaugauuuagacaggaugucagaaccauaaguagagaugauuugaugcagaagauacugcaguuagcgagacagaguauuagguagguacaaagguaauugcagucuucgccauuaaaaguaaugucaaaaacugcaguuacuuuugcaccaaccuaauaugauagacuaaacuauaaacauacaaggaagaaugauguguaggaaguuuaauacauaagaauugggaucuggcuggauguguugggucagggcugaguucagagugaacagugauacuaagguuucugccuuuaucuauucuugagaaaaauggaugauguuucggguuuuuaaaaaaguuucacuuuagagcaguugagauugaguguuuuuagaacaucuggcuauugagauccaguaagacuugaagaauaaagguuugggguuuaugaaagaauucuagggccaauaauacagauuuaggaaucaugguggcauuuuauggcaugagaguugaugugaucacaaagggaaacuaugggggauuaggaaagaaggaaaaggaugaaauccuaagaaacuccagcauuuagaaagauuguauagguacaaaagccaacaaaggaggaugagaugaaaguaagggaaaacuaaggagaaauuaggagagaguugccaugauagaaacuaaggaaaggggcguuuuaaugugggaguggcuagcaaugcaaaugcuacaaagugcaaaaagccaaagacuaaaaaguaacaaucggguuuccuaugggcauuggcaaccucacuaauguagcuucagaugaguauuaggugcuaagccagccuucaugaaguacgucagagguccagccagcguccacauuuugaagccuguuuuuguacugcccucaagcgaggaauuauuuuuacauuuuuaaaagagugcaaauaaaaacaaaaagucugacuuuuugucagagacugcuauggcucacaaagccuaaaauauuuacuaucuggcccuuuucaggaaaaguuugcagacuccgguacaaauaaaagaaauauauuuuuacucuguuucaagaugcuugacuggaaaagaaagaacgugugagucagagagaaauugauaggauugaccaaaccuucaaaauggaaaaaaggcugagugugguagcucacaccuguaaucccagcacuuugggagguugaggcaggaggauugcuugagcucaggaguuugagaccagccugggcaauguggcgaaacaccgucucuacugaaaauauaaaaauuagaugggcaugguggcacacgccuguaagcccagcuacuggggaggcugaggcaugagaaucccuugaaccugggaggcggagguuacaguaagccgagaucgugccauugcacucuagccuaggugacagagugaaacucugucucaaaaaaaaaggaaaaaaaaaagguucauauacuuugugauacuuguuaaauacaggcauauuuauauauauuaucuaagguugguaugauaggcuugacuggaaaagaaagaacguaugagucagaauaguagauaggaaugaucaaaccuucaaaaaaugaaaagauucauauacuuugugauacuuguuauauacaggcauauuuuuuauacauuaucuaagauugguaugauuuuagaauacauuauuuuccuuauuuugcaguaugcauaaguuuaacuguauauuuggcagggcaguuuauccuuauauuuucuguuuuauaugguaaaagaacuguuaguacauuuucuuuuaauccacauuuagggauggaugauguccauaauuauguggauuuuaaugcuuuuacaacuagaaauuaauauagaugaauauauaauuaguauauuaaguaauguguuuguguaugaauauguagcuucugucuuuaauguucuuccacauaaggcauuuuccaguaauuaaaaaaaagcccuuauaugauuugaauagucuguuuaugcuuaagaagcaucuuagucuaauugauauuaauguuucuuaauuuugucucuuaucugauuuuguaauuucaaaauauauuuaacauucaaagaaaauguuuauguuacacugcaaagcauuucuuaauuuguauuuuccuuguuugguucuuuccaguaagcauauauugagcauuaauuagguauccagcauuaucauuggcauuaggaauagaaaauuaaagaagaccugcuuauggucucaaguagauauagccacaaauaauugcaaaacuauacgauuaaauuuaaugugguuacauuuagauuaaauacccuacaguguuuuuauugguaccucuuucugauuagaugacaauucaaugugaauaacuucaaaugucugaaagguucaugaugcaaauccuuucaaaugauuuuacuguauagucagaaaaaauuuaaauucuuauacaacaauuucauuguuucacuguuaauuauagcgaaggaagaugcaaacugugcagugugcgacagcccgggagaccucuuagaucaguucuuuuguacuacuuguggucagcacuaucauggaaugugccuggauauagcgguuacuccauuaaaacgugcagguuggcaauguccugagugcaaagugugccagaacugcaaguaaguuuucauuucaauucaaagcuguguauuggguuuaagagggacccuauuacuaggugcuaaagguuuguguaauauaauagagguuguucauauuuuagcuauauucauucagugacuucaucauacuuaaaaaaauuacuggauauuauaacauuuauccaguauauauccauaauauaauuuguuauuauauuauaauauaaauaacauuuauauaauuuugaaagaagucuaaacaaaacugauuuuaaucauuuaaauugcucuggucgucuaaagagcuaauuuaaauuugccaacaauuuaaaaaauaagcgauauuaacaauuuaaaacaaacagaagaauaaaguaguuuuucuuaagggguacuggggaggagauuuaauaggauuuaaacgucuaacuacagaaguagaagaauuagaguugagccaaaaaaucagucauguguuugaauuuccauuccaggaaggacaauuucuacuauuauuuuaauguacaucugcaucucucuaaaagccaccuugaguagauccuggucagcauaauuccaaaacgaaauauguggcauuuacaaauuuguaaggggguuauauuuuccuaugguauuucaucucuuggucauuucuccagucuuuucugugauuuccgcuugcacccccaugauucuaaugagcaugauaauuuggggauguuaccaguaucuucauuuacaggcugagaauuuuuguuguaaccagcaagaauuaugcccaacugccaugaucagucuguuuuuauuauuuaguuugauaagaaauaaacgucaguaucuuagaguuacgugacauaaauaggacuauguaccuccauauuuugguaaaaauuagauaaaauauucaguaaacauuuauucgauaccuuauaucugcgcucaguuucuugggaaggauuaaaagaacuugaaggaagaguacuuguccuccaagaucuuuccacguagcugaggagauaaaacgugacuuuuuauggagaggcugaacugaauaauaauuggaggcuaacugacccaucuuccuguugacaucuauuuaucccccagauuucauucagagauuccucucucagcucuucuugcuuucccuguuguuucuuuuccccuccucuugaauuuaaaaucauaguaucugaaagugauuauagucaaaaaucucaacagagauaaagcuguaggacaggggcccaaucuuugggggcagaagaguguuuagagaaagauuuuagguuuucaacuauaauucuuaauaauuaugacaagguucguauuuugaaauaauuauucagcauuuaauugcuuaauagacauucuaagcacuugaacccgcauuaccuuuaauucucgcaguaaucuuuauuauucccauuuuauaccuggaacucagagagcuuuagucuaaguuguuuagugacacagcuagaaaacagcagccugaauacaaauagagaucugaugccaaauuugauccucuuuacguuauacgacagugucuuuucaauucgcugugccaagauuuguuccuuuccacacaguagcaccuaucaguuauagcaccuuccucucaaaaauucuauuuuaaaaguaaagaucagaggcuauucaucuugccuuaacccuuccuccuuugcaggaauccuaaaauggcuagagcaaguuaaccauaggugagcauugaguaaagaucaccauuuaggagguaauccuuauggcaggguuaccucuguuacuaucugcagagacaaaacagauacugagguauuuaugaacugugcaguucccaggacugauuauuuucaugauuacuuauguuacaaaacauaaguuuaaagauaaggcaucauuaaugcuaucuuauuuuuuagacaaucgggagaagauagcaagaugcuagugugugauacgugugacaaaggguaucauacuuuuugucuucaaccaguuaugaaaucaguaccaaccaauggcuggaaaugcaaaguaaguuguuuauuuauuuauuuuuuuaaauccucucuauguuuuauauggagaccagacaaaucggauaccuauucaaaucuguacaucaucaccaucagcuuuuuaaaaacagcuuuauugacauauaacugacauauaauaaacuguacacucuucaagauaaugaacauagucaucacccucaaaaguuuccuggugccucuuggcuugcuuuguggcuguucaaacccaaacucugucuuccuagucugcuuuuucacuauagauuaguauucacuuccuagaauuuuuaauaaaagcuucauauacuauauacucguuuuuggucuggcuucuuuaacucaguguaauuauuuugaaauucauccauauugcugcacagaucaguagugauucuuuuuuauuacugagugcuggagauaccacaauuuguguauugaaucaccuguuggugaacauuuggguccuucaaaauuuugagcuauuacaaaaaaugccgaugagcucauuaacuaacuuccuaccucacuuggcuucugccccuucagggugaggcguucagagccggguugggggcagugggguaguggagauagcccuuggaauccaaggugcgguuuagcuuuuaagcuuagucuuccugggcugcugguguugcgagguugagggauggagaugacccucaggugcugcaugggccuggagcggguuuuuccuggagcuggagagggcaugauggcccgugugcgggaguggaaggcacagcauugucauugcucuucuuggaacugcuuuuucuagugaggagguggagggccugggaaaggagggugauguggccagaaccccagguccccagcugggggaggagguggagcagacgcagggagauucuguaccugcacccuguccucgccagugagguuuggcaccuagaacugcaagcaguauuaccagguucuuuuguggucuucagcaaguccuauuaggcaucugccugagugguggggguugaggggaggggcuuucucuccuggggggaaaaagagcugcuggguaacugugcucagcuguggcuaccugggaaguggggucugagggcugaaggauugugaugaacucuggccugcuuccucagguaguucagauuccuucucuugcugaaugacuuaucauuggaaaggaaaaacucugcuauuugacugauuuguauauuuacacucuuaucuucacucaguuccucuacuugccuuuuuauuuuuaauaugaaguugaauuuguaauucauuuucuuuccuuuccuaaggaaaaaggacauuuaagacuauaaguuuaccuucggcuguagcuuuggcugaagccaaauuuauuguauuuguaacuuuauguauguauauaccuuaccgaauaucuuuaucuuuuuuuuaaguugugcugaaguauguuaauuuaugcuuucauuucauuuaaucagauaauuuaacuaagguagguuuuuuaaaauaaauguguugauacuuguagugacuuuuuaaagguguagcauuuguguuuauuaauuucauuuaguuagaugaaguccuuuuaccuuauuuuuugacuuguugauucaacaaguuguuacaauugaccacuauuaauuguuccuaucaauuuaucauauuuuuaaacaaauaccuuguggcuguuauuuagcaaguaggucacgccaguguuaauauauugugcuuuuuaccaguaugaaauuguucuuuauucuauguaauguguuuuuuguugagggaucaggaagggcagguauuuugcuuugccugacacuauggccacguaggguguuaguuuaacaguugaaugguuaucuuuucacaucuuuuuauuuuggauucuuuuguguuauaaaaauguuaucuuuugaaaagcuuaauagagguaacuguuuggauugaugguuguaauugaaaugcuuggcuguuuugaggcaaaauuguucuuauaauuccuuucuacuuuucucuucuuuuacuuccugcaaugauuuauaauucagaaucucauuuugugaauguaaaugauuauaaauguuaaagauauaaaauuucucccauuccccacugaaaaugaaguuuuuauuccccuuuucucuguuugauuugauuaaccuagauuauaaaccuugucacaauuuucuuucaaaaauauauuuccucuguuaauuccaacuuuacccucaaucuuucggagucuugguuauguuccuuuaaaaauaauuauaaauuuucugaaacccuacaugucugaaagagacuguucccuuuaggcuauaagaacuuggcacaguauaauguuucauauuacaaauuuuucuuucuuauacucugaaaacauuuucuucaguuuuuucaguuuaugcugucacaagaaaaaucuuaacuuuaaaaaauuuaaucauaauccuuuuuuucuuccugaaagcuuugggagaugugugaguccccaucccccacgccaccccagcaccuuuuuaaaaaaauauauuuacuuaaaaaauuaccuucuuuacacucucuaauaauaucuaguaacuacuggauaauuuuuguucuugcucuugaucuucuuuauuaggguuuucauuaucuugagaacugguagagaauucugggugucuuucucagcuuguucugucuccccuuuggugugcuucuuucuaauuugcucuuuguaaucugcuauucucuuuugagagugacagaauuacauaauuucugggaauacuauuggauacuuaaucuuuuuauccuguucuaugaagggacuauaguguggugguucaaagcuuaugcuguggagucaaaaugcaguuuuuucaguuacuaaauugaugaucuuuggcuaccuguuuaacuucccuaagucaguguauagaagguuaacgguacuuaccucacagggauguuggauuuaaugaagugguaucuauaaagugcccagcacaaugccuaacacaaaguaaguacagaaauaguuaccagaguuuuucauggauugaaagguuuguccuuugaaccauuugaagagugaucaucuuucucugcuguuaaauucuucuguaguucucucuguagucuugagucauaauuugcucauuuguuugcauuuaacuuuugaguguuuacugugugugaaacuguagugaaggcuggagauguugggacaaaucagugugcccccacagggcugucagucuaguuuggggcugcucccuggugagcuggaguggggguaaucuuuucaggaucuuuauuguaaaccagucauugucagauagguuucuuuuuccuauuuuuaucucaagaaugucuguuuguugguauguuauguguuuuuagaaaguuuuuacuugaaaauaaguucaaacucuaaaaguuggagaaaauaaaaauaauacccaugucgcauuuacuuagauuuaucaguuguuagcauuucauugucacugggcaugcccucucuugcuuucucugugugugugugugugugugugugugugugugugugugugugugcgcgugugugugucuguguuuuugucucuauucccccuaacccccuacuauuugaggguuaauuacauacguugugccuuuuuaccaccauuucaguauguauuucuuaauaguaggaauauucuuaaaaaaucacaauccugcuaucaacuuccuaaacuuacaucaauguaguauguuuaucuaauguacuagccauauuccaguuaugucauuugaucuuauguccuucauaaccuaccccuuccuccaaguagguucuaggauuuaguuuuugucauugguauuuuugaagaauagaguucuucucgauauacuuguuuuuuucuuuuuuucaaacaaauuuccccauuuugucuuugauauccccuuauaauuagaugagaggcaugcauuauuggccagaauacugcaaaguacugauccauccucaggguaucacagcuggaagcacacauuauuccacuuucccucaugggaaucaccuggucaggcuguuguccaauuucuuuucccccuccuuuguaucuaauaaagcaguauguaaggacacuuuaagaccaugcaaauaucuugcuuuuccucagaauuuccuucuagauuugaaaaacuuacucccuaggcugggugugguggcucaugccuauaaucuuagcacuuugggaggcugaagcggguggaucaguugaggucaggaguucgagaucagccuggccaacauggugaaacccugucuguaauaaaaauacaaaaauuagccaggcaugauagugggugccauguaaucccagcuacucaggaugccgagacaggagaauugcuugaacccgggaggcagagguugcagugagccgaacucaugcuacuacacuccagccugggugacagagauagacucugucucaaaaacaacaacaacaacaacagcaacaacaacaacaacaacaaacuuacugccugaugaugccauuuuaaccugcuuuguuuugguugcaaaugaugcauuuccagcucuagcacucccaccgcauuuaccaguuagcccucugcuuucuuuuguaagcaagaacacuucuuucacauguuaaacuuacuuauuaauacugacucaugagcuccuauuaucuucaaucauuuacaacucauuaccuaauuauuuuuuggcugaaauagucccauacuugcugucaguugcuccuucaagcuggcgcugguguugugcccucaccacuuacuugaacacuucauacuuuuugguguaacaagauguuacaagcucaucuuauaccuccugugccccagcccuggaauaaguccauuguuaaauaaguaacccagauuccuuuaguggggaaugggugcugggugugcucauugcuacugaaggguguuugcuucuucauccuuucagcagguggugucaggaaauacaugcguguguauacacuuacagaaguuuguccaacccaugacccgcaggcuacaugugguccaggauggcuuugaauguggcccaacagaaauucauaaaauuucuuaaaacauuaugagguguuuuuuuugugugugugugugugugugcguguguguguagcucaucggcuaucguuaguguuaguguaucuuguguguggcccaagacaauucuucuucuuucagugugguccagggaagccaaaacauugaacaccccuacacuuaacguauauacacauaaauauucauauacauaugcauaacuuagaaauaaugaauuuacaccaguaccuccaguucuuguccuucuccacugaauucuuugccuucucauucuugcaugucuguucuucuacaauaaaaauucuggguuguagcaacaucagcacauuuauucaguugcucaaucuaaaaagcaagucugcuucaguuugcucucaguaauagauuuuauuccccuuucuuuucuuagugauuuaauuuuuuaaauauagaagauauuaguauacuuucaaaacucaauacuauaugaaguuuuacucagaauugucacugccucuuguuuauuauuuauacuccauuucucccaaccucuuggaaguaacuaacuucauuguuuucuguuuuaaaccuccuguuauuuuucgucuaagaauaagaagauauauugcucuuauuuucagugaagguagcauguuguguauguucuuuugcauguugcuuuuuucguguaauaaaaucuggaaaucacuuccaggcaaguuaggcaaguucaagagaucucauucuccuuuuaaacagcugcauagcacuccauuguguaucugugcuauggguuacucaaccaauggccugugcuuugguauuucaguaguuuacgauauuuugcauuauaaaugauuuuacacucccuagcuuugugcauguguguuuuugaauucucagggacaaaucuguaggguaaauuccuagaaguaggauuauugccucaggaguguacacauauguagcuuuguuagauacugucagauucccuuucuuggggcuuaugguacuuugcauugccaccagagaugugugagagaacuuuucuuacgucuuugcuaacaggaugacuuguucagcuuuugaauguuugucugucuucugggcgaaaagugguguaucaauguaguuuuaauuuuuguuuauccugagugaaguugaucguuuuuucauguguuuaagggucaguuuuaauuucuucucgugaauugucuguucauguguuuugccuguuauugaagauuuuggcauuuuccccuaaauuuaagaguucuuuauaaguuagggauguaagcuuuuaucuguguuacaugaugcagauacuuucugccagcuuauuuguucuuguuuuuuuugcuuauuugugugagacagugucucacuccaucaccccggccauaguacagugguauggucauaguucacuguagccuugaccugggcucaagcagucuuccugccucagccucccgaguuagcuaggaguuauguguaccaccaagcccagcuaauuuuuuacuuuuguagagacagggucucacuauguuguccaggcuguauuaugugucuuuugacuuuguuuuuauuauuuuuuuuuugccaugcaaaaguuucuuucuuauggaguuagauuuauuaaucuucuuuugcuucuggauuuuugagucauauucagaaagccuuucccuacacugaggguauagaggaguucauauuuucugcuaggauuugcaguuuuuauguuuauuuuauuuuugagauagaguuucacucugucgcucaggcuggagugcaguggcucaaucuugggucauugcaaccucccccucgcggguucaagugauucucaugucuuagcucccccaaguagcugggauuacaggcaugcgccaccacgcccagcuaauuuuuguauuuuuaguagagauaggguuuugccauguuggccaggcugguguugaacuccuggccucaauugaucugccugccucggccucccaaagugcugggauugcaguugugagccaccauguauggcuugcauuguuuuauuuuuuacauuuaaaucucugaucuauuuggaguugauguuuguguaugaugugaguaucuuuuuccaacuggcuauucaguuuucuaaaaaccauucauuaaaaagacugucuuugcccuagugacuugagauuccagacuacaauguuagauuugauugaacuuauaucuggaaccucuuuuccauuccaucgaucugucuauucauucaccaguacgacacuguuuuuguuauagagccuuuguaguaucugguaauguugggccccuucagaacuuauccauuucacagguuucuuaucugugcuuguguauuuguuuuucuguauaaacuuuaggaucaccauauguagccccaauaaaaaccucauuggaauuuuuauuggaaucacauuuaauuuauugagugucugggugcaguggcucacaccuguaaucccagcacuuugggaggccaaggcagggguguugcuugagcucaggaguuugagacaaaccugggcaauauggugaaacugccucucuacaaauacaaaaaaauuagccagguguaguggcacacgccuauagucccaguuacucagaaggcugaggugagaggaucacuugagcccaggaguucgaggcugcagugagccaugaucaugcuacuguauuccagccugggcuacagagcaagacccuguuuccaaaacacacacacacacacacacacauauauauauauguauauauauauauauauauauauauauauauauauaagugagaguugauugacaucuugauuuuaagacauccuaaccaagaacaagggaugucuuuacaaguuuguuaaagucuaguuuugugucuuuuaggaguguuuuauaauuuucuucauacugauuuucaacauuuaagcuuauucuugaauauuuauuuuucugcuguuauaaaugggguuuucuuaccauccuuuaacucguuauuugugugugugaauucuauugccuuuugcaugcuaauuuuauauccuaguacuuuguugaauucuuuuauugaauuuuugaacaauuuucuaggauguuccaacucuguuuacaaauuaagaguuuuguuucuucuuuuccuggucuuauguuucuguuuucauuuguuucaaugcuugcauuggcuccagaaccauguuaaaauaguaguggagauaauaggcacccuugcuuuuuccuguccuuagugggaaugccucucgggcucucccauaaaauaagauguugccuuuagaauugaaguauuuauguuggucacauuagagaaauacccauccauuuuuacuuucucaagaguuauuaguaauggguuuugauucuucccaaagacuucuuucuuuaaucaucuguugcauugaaauaauuuuuucuccucagaccuuuuaauuuguuaaacuuuauuaauggauuuuucuaauauuaaauaucuuugaauuucuuguauaaacuccaccugggcauaguuauuauuuucuuaaugugguauuagagucuguuugauaguauuuuauuuaggauuguuuuucuuuucuccuucucauuagauaaaggauaauacauucuuuuaaaaaauauauguguauguauuucaaaagauggggucucuguguguugcccaggcugaauucuaccuccuaggcucaagagauccuucugccucagccucucaaguagaugacaccacaguucugugccaccgugcccagcuauuuaggauuuuugcaucaguguuguuaagugcauucauuuuaaucuuuaagacuagcugaucuaugguuccugguaguuucucuuuuuaagugagcaucccuuucauaucaaccugguagcacagaaagauaaaguucccuuuuauugauauuuuagauucaaaauuugggguggguaaugagagccccacaauguauuaaccuuacacccagggauacccaggguuuuaaggcugacuagcucacaggcacagaaguaguuuuggcuggccucugguuggccuuuuacuucauaaacaauucuaauuugguaaggauaggacacucucucuauucuaaaaacaugaagggccaucauuggacuuuugauguggagcaauauauuuucacauuuucagacaccaagucacauggcguugaccgugcucuguguuuccccacccaccauggcagucucacauuguugcccaggcuugaguguaguggcgugagcucccugcagccucaaacuccuaggcucaagcaauucuccugccucagcuucccaaguagcagggacuacaggugugcaccaccauggcuaauuaaauuuuuuuuuuuuuuuuuuuuuuuuuuuuuguagagaaagagguguuuugccuucuugcccagauuggucucggaucccuggcuucaugcgauccucccaucuuggccucccaaagugcugggauuacuggcaucaaccaucacaccaggcuggccaugcuauuguuuuagaguugagcagacuuacuccacaaaaauuacuuccugcuccuagcauauguuucuuuuuuugaauuuugaguugcugucuuuuugguuuuaucucuuccaccuauauguuuuccuggauauccccauucccuuauuuaaauuuuccuggagauuuuagugcagauuuugugaggccacaucagacauugaaaacagcuuuuuaaaagguguauacccuaaggccaggcgcaguggcucacaccuguaaucccagcacuuugggaggcugaggcaggcagaucacuugaggucaggaguugaagaugagccuggccaacauggugaaacccugugucuuuaguaaacacaaaaauuagcugggugugguggcacacaccuguagucccagcuacucaggaggcugaggcaggagagaaucacuugaacccaggaggcagagguugcagugagccaagauugcgccacugcacuccagccugggcaacagaguaagaguccaucucaaaaaaaaaaagcauguacccuaaauuagugucaugaaaauaaaagcuuaauguauaauccacaaaugauucaugacuuuuuaaagguuuacaucagaacuacaauuacaaaugcauaacaaacuguuuuuguuuuuauuuuuccugguguuuagaauugcagaauauguauagaguguggcacacggucuaguucucaguggcaccacaauugccugauaugugacaauuguuaccaacagcaggauaacuuaugucccuucugugggaaguguuaucauccagaauugcagaaagacaugcuucauuguaauaugugcaaaagguaagaagauaguuauucuauucaguuguuuugucgauuguuuuauucauguggucauuugcucuaccaucuuacagcuucuaaguuuuuaucacucuagcaauuccaucaguacugauugcuguuauagauggaauuaaaugauguuuuugagucucaaaggcauaaggaaguaaaugggcaaaagauaagaccagaccacaucagaaaugagcacuaauagggaaaaguaaagagaaaauagcuuaaaaaugucaaguaaaaauacggcagcaucucuagugacaugcacaaaugugcuuuaaaaaaccuuugucaguuagcaacuccucuaaccucucuccucucauacuuaauuaacuguuuucauauccagcuuuucagcaaugccuucucuuuaccuagauaauaacucgauguuagaaauuuuuauuuaaguauacuuaucacugcagguggguucaccuagagugugacaaaccaacagaucaugaacuggauacucagcucaaagaagaguauaucugcauguauuguaaacaccugggagcugagauggaucguuuacagccaggugaggaaguggagauagcugagcucacuacagguaaauuugagaaugauuuuuuuuuaaauuuuuuguuuuuguaauguugugccauuguaucaccaauauauugcuuuaaucaggaagagaggauccuguauuccagauuccaucuuguucucaguuucucaaccuuuaaauguauuuguuaucuuggucaucucugaaucugauggcuaaaaucuaaucuaacuuaagauaguuuuuuuuaguauuugaauuccgggucuagugugcuuuccuucacuuguguucuucaggccgacaguggaaguuccccagucuuuggguuugcuuaguuuguucuuuauaauguggguuauuuuucucuaagcauguuguaguuuuguaauguccuucuuaaguuaauuaucaccuuuucagcccaagauuuuguucagguauggaauauuuuuaguaguauccuacuguuaaaaacaugagucuuagagaguaaaggaaauagaacugcucgccagauuguuuuucauuuucaucauuaugaguggcagcuuuuguaaaacuucucuuuaucaucuucaaggauaacuaaacaucuuaauuacuaaccuuucauuuccagaaugccaucaguauuuaguuuugaaauauccuuuuaaaauaaugugccaguuaccuuuuaaaaaaaauuguuuuagagauggguucucacuauguuggccugguuggucuugaacuccuggcuucaagcguuccuuccgucuuggccucccaaaguguuaggauuacaggcaugaacuaccacgguuggcccaccuuuugaugcauuauaauuuucauguuuuuuaaaaauguaaauauacaugugguucaacagagaaaaaucugaagaaaaacuuaaagcauuuuuggugaugauuugcccuuacucauacaaaaucauaauuguugacuuaaugaacaaagaaaaaaacucauucugagcuaaagaauuaauaauuuuuuguuaagauuauaacaaugaaauggaaguugaaggcccugaagaucaaaugguauucucagagcaggcagcuaauaaagaugucaacggucaggaguccacuccuggaauuguuccagaugguaagaauguuuaauggauauacucuguuuuugaagaaaauguguauauacaauaaauaugugaauauugacuaaaacuucaguaaaagccaagaugcagucacuuaggaagaguuuuuuaguaaaauaaucuuagacaaauuaauaggagaaaggacaugcguguauuuguaguucagcuaccaucuagacuuaaucauaaguacuuacuugguuaagggaccaagugauuuucuauuaaaaagcaauucguauuuuuauuucuuuaguuguaguugcuaaguagagcuguugcugaugaugagauguuucaugcugagauaaugaaaaauuuacuguauuggaucaucucagcaguccuauugaggguuauuucacuuauuuccaugauguuucaauuaagcuuuuuguaguaaauauugauaagagcuauuauuguacuugcagaucuggaauuaauaagagaccauguugggggaaaacuacuuguuacauuuaaucacaggcucaucugaaagucuuugguguuguaugugaaguuguauguucaauuauauaguauacauaaaaauuauaauguauacauaaaaagccacugagauguuuugaaauuuauuaaguuuacguauaauaacucucauuaaaauuauuuucuauaaucuuucuugugaggucuaguuguuaaagaaaaagagaaaaagacaauuaaaaaauuuuuaccauagugcaaagacuucuaauuuugucuucauaacuuacuaauaagugguacaauguuucaugcuuauauuggaaauugacauuuaguagaauaaaacucuuuacucaaauuacuguugagggaacaguguuacagaaauuuugacuccuuagagauuuuauaaauguguuacucacagcgguucaaguccacacugaagagcaacagaagagucaucccucagaaagucuugacacagauagucuucuuauugcugguaagcaguauguucauauugucuaauuugauugaguuacaagauaaugucuuuaucccaaagacauuuuugcgauugcuguauguauauacauuacgguaacuaaaucuuuuaguuaagagauucuggaaaagaauugacaauggaucuaaagaagguuaguuucucuugaaagguuuuuuuuuuuuuuuuuuuuuuuuuuggaggggggaggucaugauuaaaaauauuuuguacuuucagaucuguuacuugguaguuuucuuuuaucccuaccuguagucuuucaauaaagugggaaagaagaugagauuucaguuugauaucagaacauguauaggccugggcgauauagugagacccugucucuacaaaaauaaaaaaaguaucuggggauggugacacaugugugcagucccagcagcuugggaggcugaggugggaggaccacuugagcccaggagguugaggcugcagugagccauguuugugcuacucuacuccagcuugggucacagagugagacccuguuucaaaaaaaaaaaaaaaaaaaaaccagauaaauuuuagucacugauugguaaaugaggcuagcagugucuuuuuacuauaacuuaaaaauuaccuugaugagauugaguuaaagguuuaacauacugguauccugauuuaaaauuuaccagugacuauguuucugauaucuaaguuuauagauuuccugagauuagucuuuuaauuuauagacagugaugaagaacaaggauuauauccaaagaauauuuuggguagguuggcagguaugguuaagcaaaauaaauauuggugguuaguaaaucuuuucugucugugcuuuugagucuauaguaacuuuguuacaucuggguaucuacuauuagaaaaugccuacacauucuagaucacucuuuacuuuuuaacuuagguaccucacauaacaugauugauccucauuuucuuaacuaaaaaaugaguaugagaacuuuuccuguguaauuuucaauccauuuggaaauccuuaaguuguaaaacauaauguuuucauuagguuuucugguguguggcugauucuaauccauaaauccuuguguacuuuggcuuucauucacuuaauaauugucugcuuugaugaauaccuucugauuuaaguucuaguguagccaaauguuuuauauaucuauaguuagaaaauuuaaaauuuguuuguacauugccauaacaaauguucugaauuuuguaguaucaucccaacauacagugaauacugaauuggaaaaacagauuucuaaugaaguugauagugaagaccugaaaaugucuucugaagugaagcauauuuguggcgaagaucaaauugaagauaaaauggaagugacagaaaacauugaagucguuacacaccagaucacugugcagcaagaacaacugcaguuguuagaggaaccugaaacagugguauccagagaagaaucaaggccuccaaaauuagucauggaaucugucacucuuccacuagaaaccuuaguguccccacaugaggaaaguauuucauuauguccugaggaacaguugguuauagaaaggcuacaaggagaaaaggaacagaaagaaaauucugaacuuucuacuggauugauggacucugaaaugacuccuacaauugaggguugugugaaagauguuucauaccaaggaggcaaaucuauaaaguuaucaucugagacagagucaucauuuucaucaucagcagacauaagcaaggcagaugugucuuccuccccaacaccuucuucagacuugccuucgcaugacaugcugcauaauuacccuucagcucuuaguuccucugcuggaaacaucaugccaacaacuuacaucucagucacuccaaaaauuggcauggguaaaccagcuauuacuaagagaaaauuuucuccugguagaccucgguccaaacagguagggugauuuuaaugauauugacagaaaagauauuggaacaauucuauaaaaucagaagguauauguguagcuuugguguggauggcaacuuuuucugucuucagauagaacuucaguguaauguugauuauguguuucagccauuauuuuuuaaaugcuguuaaugaagaaugccauuuauuaaauuugaagugaucuuauuuggaauuucaacucaguugggccauaaagaugcaaccuauugauaauaguuucuaauagaaagaacuuuaaaaauucuuuuaguucugugcugcaguaaauauagagccuaaaauacaguauaguuuuggguauacaguaacuaacaucuauuauuuccuucuaauauauuuauuuauugauauuauucauuguauauauuuuuaacuggauaaacaucaacauuuaugacaggaauuuuccaugcuggggaauuucucauuuugauguuuuuauuaauugcuaacucuugugggauuucuuuuuucaaguaggacuuauuucaguaguuucauggaaaaaaaucuuagaauuguacuguugauuuucaguaaguaaagauaaaucuuccuuugucugcuuuacaucauguacauucuacccuuuaagaaugaguuccauuucuuuuuaagugagauuuaaguaaaacugcauggcaaaaugaagauacuguagguacgaauuauuuauuguuuuacaaaauugcugcuuucugaaguguuuuuuaaaauugcaagauaacaaauaguggagaaguguuaauucacaauaguaauuuggaguuuuaaguuucaugauugaaauugcuucaaguuaaguuuuaaguuucaugauuuaaauggauuaaaguuuggcuuuuuauaggaauaauauauugauuuuaaucguauaauuuuuaaacuguaaggccaagcuuuuaagaaaaucauuuuuuaaugugaaaauuagucuccucuauaucaaacccagauauauuuuauucucuaaagacaagguacacgaaagggaaaguaguugucagaugggauuuagcuguuucugcauggcaaaagacgugugcaguaaaacuaggccacucuuuauauaugccuuuuucuaaguauuuuccuugacaguuauuucugcucuaccaugaaaaguuuuucuucucaaaccaguugugcuccuuucuaguaaguuuuuuuuuguuuuguuuugaauaguuauauaauaauuauguuguucugacucugaaaagacuuuaccaauggaaauuugaaucucaaauuuacuuuugguugauauauuuacauucuuuaaagauacugcuucauauguauuccuguuaaauuuuacuuaucucuccuuccuuguagacuuuuguuucaauugagaaaccagguucaauacauuaggacucuuuuucuguagacuuuauguuccgaaauauuggggagggggguguauuuccaggcuuauuccaucuuauaugagccauguccuaguauuuugcugagcugucuuugauucccaaauccgaugauaaucuuucuauuuuucugccccucuuguuacuacuucaucauuugcugcuacucuuguaaguauuuuguaggcuguguuuucccucccuccagcuuuuuaguuuuccaaucuugguuuuaguuaucuagcaaacagccuucacuugaugaugaaccugcuaauauagugcuguuauuagggagaguaugaauugaauaguacaagauagaucuuccauuggugaggcacugggaccauaacuugcaggaaauauucuacaguuagcaggaauguguauauccguauauuagaaauacugaaguucaguauucuguuacaugaauuucuuugguauuaggcauuucuguauuauacuucuguuuuuauuuacuguuucuucuacauauucuucacguuggggauuggcuguaaaauaagcugcauuuuccuggcugugauugugauguaagcaagauucuuugguuuccagcuauuuuuuguuaacaucacuggcauuuucauauuuuguugaacauuaccaauucuuuggucuuuaccaguaaaguaaauacuaaccaaagaaauguagauuuaccuuaaguucuguuucauggugggcaaauuauuaaguugauuuuaaugauuuucuauaauaguauuauaugagcuuuucuaggaauucacuucaaaauuaaacgaacauuuuaauaggaaacaucugaaagaucuaguuugugauagcuagugauuggauuaucagauguuaucuggagguacaagcuagccaacuaguagaacgguaagccagugcugucuaauauaaauauaaugcagaccauauguguaauuuuaaauuuucaaguaguuacacuuuaaaaaaacaaaaacaggugaaauaaauuuuaaucuauuuuauuuaaccugguauauucaaaacaauauuucagcauuuaguauaaaaaugaacaagaugcuuuauacuuaaaacaucaguucuggcuagcugcauuagaagugcucaguggucacauaugaugguggcugccuuauuggacgaugcaagacaaaacauuuugagaaauauaaaaacagcaguuccggaauuauuggugaaauuaaaauaccaaaagaauucaagaucgacaaacuaagacuguggcugugcuuucacaauuuuuaaggacugaaguagaaauauucuuuuucuguuguucauggaacacauuuuaaugcagauaauugcuaaaccauuuguugcugcaacaaaucuuucacauuuucaaguauauucaguuuuaaauauauaauccaaauaacccaauauuggagauuuucugaaggugagauguuaggacacagaaaauggaauuuauaucucagguauuggacauccauuaucaaauaucaaaucauauagaauuauuuuccuuuaaggagguuaguaauuaaaguuuaguuuuuuguauuuuuccuuucauauggaauauuucaggugcuauuuagugagaaauaugaugcuuauuuucuuuaugacauguuucaaauauaucucaaauguaugauuuagaaccuaacugacuacaggaauaguaacacauuuuucugauggcugugaauagaauaagauuccuuuuguuuuuuguuuucuugccuauuguagacgcaggauuucacaaagaugaggaaaaauuagacaugauaagguaggagaaguaacagacagcaaauuggauauuguuucauacaaauuguccuaaugaccuaguuguauuuucucaucuuuuauugaaguuaucuauucauaaauaauuuaguauuucauuuuucagcauuuaaaaauauuuuuuauuuuuuuauagagaugggggucuugcuguguagaccaggcugguuacgaacuccuggccucaagcgauccuuccaucucgggucucccagagugcugggauuacaggugugagccccacagcgccuggcccauuuuucagcauuuuuauagguguauguacuuugcgaccuggguuuaagaaagugauuauugacacugccacauauuguaaucaacucgguagauuuuagaacaucaagcuaauggcccuacccuagaccaauuaaaaugcacuucuaggaucaucuuuaacuguaacccugaaagcggaguucugaacuagagaaaugugcuacuugucuuacugauuuuuaaaaaugcauuaaacugaauacuguaaggaaugcucuuuaaaaaugguggaaaauaaaguggaaauuuuaaauuugucauauuaaaucauaacauuuguuuuuauuucugucuucaguccauuucucucauugcacaguuguauucccauucuaauuaggaaauucugagauaauaaucuuaggucuucuuguauuauuuacccuguauguaucaucacgucuuauagaaagauauugaauguaaucacacuacuaugaucuaguucagacaccuucauguucuaauugcuuucaugaugguauugaaaguuuuuauuaagcauuuuaugaaacguauuauuugcaguagacauuucuuuauuuuauuuuuacuuauuuaucuguuuauuuugagauugagucuugcucuguugcccaggcuggaguuguggcacgaccucacucacugcagccucugccucccuggcucaagcaguucuccugucucagccuccugaguagcggggacuacgggcgcacgucaacacaccuggcuaauuuuuuaaauauuuuuaguagagacgguguuucgccauauugguuaggcuggucucgaauuccugaccucaggugauccacccgccuuguccucccaaagugcugggauuacaggggugagccaccacgcccagccuacaguaaauauuucaagaaaauuucauaaaugaaaacauagguacuguauuuugauaucucuuggacaaauuauaagaaguuuacuuuauauuauaagaagaguacuuucaguuuuaaaaguagccagagaaccauaguguuaaaccuaaaaaauaccuaccccuuuggaacaccaagcuaacaacacagccgauuagaaguaccagacuuuccuuuuaguucacuugugcuuguugugguauuuuuggagauauuacuguugcuagugccaccuaauuuguauugugaaauuauugaaggcuaaagcugauaauagcuguuucuguaguuaucaaaacaggauuaggucuaauuucuuguucuacuugauaucgaacucaauuuuauauaugagacuucuuuuaagaauucccuaaauagugaaguguuugcugcuguagcuccacuguauacaagugauuauauuuaccaaaaagacaaacuguaaacucuuuuguuucuuuuaccaguuaucuuccuuucggcucucucucuucauugcuuucacuuuuccuaaauuagacuuacuguuuauaagcaaccuugguuuuacauaguauguuggaagaguguggggcugggguugauuuaggauuuggagguguaaaguuugccagugagacaccaaaccuucucuggcugcuuuuaaaacugauaguacucuugggcuguaagagugacuuugaucauauuuaacaaccagcaauagaauuugacuuuuaauagaaaguugcuucuaaauagccuauccuccacgugucauuauuguucucauuuccccaucccacaguccuuguauaacuuacuagcuuggacaguuuaccugagaaauuggccucaaaacagaaagaaacuuaaugcuaauauuaaacuguuuuuggguuaaauuauuuuucuuggguucaaauucagucccugccagguaguguuuuuuuaguuucuguaguauuugauagcaaguugauucuauuuacaacuuaauaaugauuacauuaggaacuauuuugcuuuuaauucaguuuguagauuaaggaggcauuauauagauuuuuuaguaauuuuuaguaacuuuuuuuaagugaagaaauucaagauucuagguuauuacugguggaggcauuaguguguuucauaucauaguucauuguuuauugaugaauucauacacauaugcaaaaaaagauaauagaugcucagcagaaaaaaaguucaauaagugcugaacagggugcuuaacauagcagugaacagaaaggggcaugaucuuuaauuacaguguaaaaagugcugcaacuggauuguaggggaagagcccauacauuacaggggcagcuaaccuuuucugagugguuuguguaaguucuugaucaaagcuaagaucugaaggauaauuuaaacuuugguaauuauagcuauauuuuaguuuuaaggucuaaggaauauacuagauaauuugucagaauaucuaaguauaaugauaauuuuucuucagaacuauaaaauuacacaaagucugucuucuuuuugaagugagauaaaauuuuggcaucaaagcuaacuuuuaaauuaugaugaauaauacauaauuaccagaaaauucuuacuucugaaauaaaauuauucaacauuauuuuuaucuuagaguacgacuuucugucucauauuuuugagaacugucuacugccaacauaauauuaaacuaucgacuaaaaggaauuuaagauguauguuagccaaaucucagagaaaaaccaauggaaauauugagagaaguaauuuagguaucuuuugcccccacugccuaccacuaaauaaaauuacaaacaauaaaacguccuagguggugaugcaaugagaggcacuaauggugugguaagagagaugaugguucaccgggagcacuaaggaaaggucugcuguugagaaaauauguaaggccauaccugaaggguuagaaaacgccagacauggcuggccgugguggcucacgucuguaaucccagcacuuugggaugccaaggcugguggaucacaaggucagguguuugagaccagccugaccaacaugguaucgcuccuaaaauacaaaaauuagcugggccugguggcgcaugccuguaaucccagcuacucaggagacuugaggcaggagaaucgcuugaaccugggagguagagguugcugugagccgagaucgcaccaccgcacucuagccugggugacagagcgagacuccaucucaaaaagaaagaaagaaagaaaaugccagacauuuauugaggggcuggaaugauauagugaaguguucugagucagucgggcucugauugauaaagagcuuggcauguuugaaggacagcaaggaagccagaauagcuggagcguagcagcggggagacaaaugccacaagguuaguuggagaaaggcauugggaaagguuugucuuuuaagugcucugagaagcaauugaagguuugaaauagaauagugacuugcuugaucacauuuguacuuuugaaaaguuucucuggcugcuguggggaaaggcuucaguagaugcagggucggagaagcauaaccagcaguagacucuuguagcagguuaggugagagauggugguggccacgacugagcugcuagugguggaagugacaagaaguagaaggauuggagacaaaacuugaagauaaaaagucuugaauuugcugaugauuugcauugaugaaguguugggggagaggacugaaggagcaaaggagagugacaagggacuggaugccauuuauaaggauggggaagacugggaugaaaccgguuaagggagaaauuuuaaacauggcaaacuuaagagggguuuugugugagaaaauggaaaugcuaagaaggaaguugaaaauccugcuaauuuggagaucuuugauuaaaacuagaaauaagaauaugggaagcaucaacuuccaagaugcccucauuguagauaauaccauuuaggaucuaggcucaagcccugggaaacuccagggcuuuggaagucaaauagaggaagaacacguacaggagaugaagaaagauuagcgaggaaggcagugaaauauccacagguggacugcugccaaauccagcagaacaguaugccagaugucaggagcaugaguaaaaugagaaaagagaaauggcuuuugacaacacuuccuuacuaauaguagggaagaagacauagguacagauucaaguugauuggaaauuaugaaagugagguaauugaccugcagugguugcugcucagugaaaucagcauagugauuaccugagcuagguuagagauuugauggguaagaaagaacaccuaacgguaauccuggagggaaaaaaauaaaguguuugcuggagagaaugaguuggauugcuggacuucaauguguguggauucaguuugugacuuaaaaaugaaaccagucuauugcuuguguggcuuuucucaaaauacuguuauuccauuaccuaucucuuaccccaagaguagucacauucuuauuucugguuauuuuaauuccuggugguauuuuuaugugauuaaugagauaguacuuuuuaauuugaugauauucuagaaaccugguaaguacuauguaccuugucuuaaguuuugguuacuuaauugguaaaauuauagcaugcaccauugaauuaccuaauucaaaauauauucuuuuauuguuugacauuugucuuguuuuucuuuaaaauguuaucuuuguggaguaaacauuuuucuuuaugcuguuuagcaucuucaucagauuaguucaggguauugcugaaugugguuguuuggaaguaaaaugcuuuaguuuuaguuauauagauuuuaauaagauacuacuuucuauauaauuuaucagguacuuuaggcauuuuaauuugcaaauuuaggacaauuugcuuuaacguuucuucacuuuuguccauuggauguaauuuccauaaaguauucauuucccuaaguaaaaaccaaaaccaaaccgacaacuaauggucacugaagaaagagugauuaaaugcuuagauuauaaugguauuugcauuuuaauguuaccagcucucuacaguuuaacguguaugcauuuaucgauugcuuauguuucuccuugcauucuuuggccuacugguuuugguuguuuauagcuauagaauauagaauuccuuaugguuauccauuucuccuuuuaaguagagugauaguuguuagaagaaaaauaaccccccaauacuuucuucuaguguuaauucuuaaagugugauugacuuuuauuuacuuuuuggugcaguaauugcaguucaugagucaauguugauguccuauaaaccuuaauuuuuaauguuucauuguagugaugucucaggcagaauaaaauauuuaauguaaauuguagcagcaaacauuuaaguuauacuuaaauguuuaaaucacuguuagugauuaacuuauuuugccuuccuugaagcaauuuguccuaaauuuccauacguuugcauuuguuuuugcuguucuaaaauuccuuaguugcuggcuuugaccuuuuauguugcugaguuuuacacaucuauuuucucaacugccauauccuagggggcuuggaguacccauaauacagugagcccaccuuccugguccccagacauuucagaaggucgggaaauuuuuaaacccaggcagcuuccuggcagugccauuuggagcaucaaagugguaaauaaaauugcauuuacauucauauaucauuucugucugauuuguuuugcccuacuggauguuaagaauuaaaucuuucuuuucuagauugagcuuccaagaaacacuuuuuaaaucuaaaaauuuuaauguaaagaaauaauaugcuugcauuuaaaaaucaaguauacauuuuuaauaccucuuuuuaugguuaauuccuuuuguugugauuacuacuguuuuuaugagggagaaguccuugacauguagaccaaaagguaauuaaggaccuuuucauucaugauaucauaaaaccuuguugcuuagaaaaaagcaaaagaaaaagcuccauuaauuuauuauguucucauggagaagaaauaccaaaauuguggcauauuucauugucugguuaauaccuuaaaaugacaaggcuuuuucccccaugacauugguugauggcucugccaguccuugaagugaguuaaguagugugaugcauuuugaagagaaaaaaauuaauuugaaaaaguauuaacucaaaaguuaaaauacuucauugacuggagaugacaguuuuucuucauauucuauauuuaauauucuggaauauggcuguuuaauuuagacuaaucaaggauuuuaaggaauucuagauuauacuuuauuuucuuucaugacuggaagaacuauuguuuuuuaaccucccuaccucccccugauaucauccaagauauugagguauaaauauaccucauuugacaguuugauaauauagaccaccaauuuucacuuacuuuuuuucugggucagcauuucauguucgagaaaauaaauugagagauuacuguagucucgauuuuuaaucacuaacuuaauuuuucaaaaaucuuuuauaccaauuuaaaaacaaaacaaacucggccgggcgcaguggcucaugccuguaaucccagcacuuugggaggcugagggggcagaucacuugaggucaggaguucgaggccaaccuggccaacauggugaaacccugucucuacuaaaaauacaaagaaauuuagccgggugugguggcaugugccuguaaucccagcugcuagggaggcugaggcaggagaauugcuggaacccaggagacggagguugcagugagccaagaucgcaccauugcacuccagccugggcaaagaagcgagacuccaucucaaaaauaaacaaacaaaaaaaacccccaaaaaacuaaccugacgccauccaucuguugugcaaagaagcugaugcacuucucaaaagggaucucaaggagagcaggguaagagaagacaggaguggcaguuugaaacugggagcuggcuguauuuguuacauccaaagggaaaaaagccauuccucccguuccuuuuguucauguguaucuauuuuaugcuuacaguaucaccauaaauuuuugacuuggaaaccauucugcuaaauagggaauaaguucauuucaaacuaugauaagggacaucaguugaagauaugacauauuauuuaacuuaacugugagggaaacaucuaaguauuuuccugagcaucuggauaauuuuaaauauacauaauucaucuacuuagggaggugccagguuuuuucaaggaguaauuaauuaguacaaacaagggugagggggcagggaacaccauacucugguacuuaaugucugaaauuaucagggaauuuaacacauuuucccauagguuuauuucuuguguaagaagucagauaaauuauuuccauuucaaguauuuauuauucagauuauuuaaagcaaagcuuucacaaagccuuuugucagcuuuccuauaauccucaaauaauuuuuccuggcuggacgcuuuggcuuacuccuguaauccuggcacuuugggaggcagaagcaggaggaucacuugagcccaagaguucuaggcugcagugagcuaugaucacaccacugcacuccaaccugagugacggagcaaguucuugucucaaaaauaaaaguaauaacaauaaugauaaauuuuccucuaaauacaauggugaaugagguagaaauguugaguucauaagagaacuguugaauagugaaggaaacugacuuaauuuuaaugagaggaagaauacuguuacacaacacuagcaaaaaugaacuuucacgcugauguagcaguacagaauaugcuuccaaccccgggacgcugcagccagacuugcuagcuaagugaccuuggacaaguuacuuaaccuuuuuauuccucagcacacucaucucaaauggggauaauaaaaccuacuauaugggauuguugagaguaaaaaauacuuagauuaguacauaguaaguacucaauagauguuagcuauuauuguaaucaccgcgagaccaguuaaugagagaguucuuccuuauacuuacucuauauugaauacaauuuguugcacuucgaaauaucuggaucaggcuauaguuguugucgucaccaagaauguaggagugggaaagagaaaaaucaugcaaaggcuugcugauagcauucacagugacaggccuaagguaugauucuaagguuguaagcauuuuauauuuagauuuuuaaguuguggaguauacguuuaaagauaaaaauaauaagccaggucucuuaauacuuaucuaaggaaguguuuguguaacauuuaauaaaauguuuuaucucaguggcauuuggauuuaaaaauuauuuuggucugucacagaauguugacuuuucccaaucuguuacauagggccgugggucuggauuuccaggaaagcggagaccucgaggugcaggacugucggggcgagguggccgaggcaggucaaagcugaaaaguggaaucggagcuguuguauuaccuggggugaggcuugcuucauguauauuuucucuaaucuaaaugucaguuaaugaugaaaaucucauagcaaguuauuuugaucuuaagagucauauaaauaggucaaaauguuuauuuuacuguccuacuuugcuuuuuuuuuugagccucugguuauguuuucuuguauauuuacuuucucauccuuucucuuuucuuaccuuccucuuugacuccuuaucuuucuaugccaacccucucuaaaaagucaguauguaauauaguugcucuuuuauuuaaaaaauuuuaagauugauagauauuugcuuacuaucauguuaugaggcuuuauuuauauguguauugcaaauauauuugcuaacuagcaaauauuuuauguaauaacuucgcuauuuuauuaaaauucuguuuuuaaaauucugaaaugucauuuuaaguauaggagacaggugaaauuguucaaguuuacuacuaaaccaggaauaaggaagcuuagauucuuguccuuuuuucaaaaagaaaaauuuuaaaaccaggcuuauugagguacaguugauauaagcuauauuugacauguacaauuccauaagcuuugauauauauauauauauacacccuugaaaacgauaccacaaucaugauagugaauauauucaucucccaaagcuucuucaugccccucuguaauuuucugcauucccccugccauccguccuuguccccaagauuaguuugcauuuucuagaguuguauauaaguggaaucauacagaacuguacacuuuuuggacugauuuauuucagcacaauuauuuggagauucaucugugcuguugcauuuguuaacaguguacucccuuuucuugcugaguauuaauaaaacuguggaugcaccaugguuguagaccugugcacuuuuuuuucuucuuuuuuuuucugagacagguuaucauucuaauuccuggcuggagugcaguggugcgaucauagcuaacucuagcuucgaccucccaccuccgucucccaaguagcugggcccauaggugugugccaccacacccaacuccuuuuuuaaaauuuuugauagagacagcaucucacuauguuguccaggcuggucucaaacuucugagcucaagcaguuuucccaccuuggcuucccaaagugcugggauuacaggcgugagucaccaugccccagccuguagucuuacauucuuguaaugucuucgucugguuuugguaucagcauaacuacagcuucauagaaugaaucaggaaguauauucuccucuucaguuuucuggaaaaguuguguaguaguggaaauguaucuucuuauauuauacguuaauuuauuagugaaaccaucuuggccugaaauuuucuuugugggggguuuuuguuguguuuuccuuuuuuuuuucuucuuucuuuugagauagaguuucgcucuuguugccuaggcuggagugcaauggcacaaucucagcucaugcaaccacugccucccagguucaagugauuuccccugccucagcccccuggguagcugggauuacaggugccugccaccacgccuggcuaauuuuuuuuuguauuuuuaguagagacaguuuuucaccauguuggccaggcuggucucgaacuccugauccaccugccucggccucccaaaguguuggaauuacaggcgugagccaccaugcccaggcuggagugcaguggcgugaucucugcucacuacagccuccaccucccagguucaagcaauucuccugccucagccuucugaguagcugggauuacuggcgcgcaccaacaugccuggcuaauuuuuguguuuuggguacagaugggguuuugccauguuggccaggcuggucucgaacuccuggccucagaugauccgucucccaaagugcugggauuacgggaugagccaccagugcccagccugugggacaguuuuuaacaacaaauuuuauuucuuuaauagguaccuauuuagguuaucugucucuccuugcauaaauuugcaucuuucaagaaauuuguucauuuugucuaucuugacaaauuaaaggaauggaguugaucauaauguuucuuauuauuuuaauaccuguagaaucuguaaugauuucaccuuccucauucuugauacuaauaauuugcaucuugucuuauuuuuuuccugaucagucuggcuagagauuuaucaaucuuauugaccuucuugagucagccuuuguuuucauggacuuuugucuauuuucuuuccccuuucuguuuuauugauuuuuauuaucaucuuuauuuuuuccuaucuucucacuuugaguuuaauuugaucuucuuuuuuuguuuacucuuacgugucccugcuuggaagggacacuugugaaguuuaggucagaacuuucuauucuccuuggcucauaucuguggucuaggaaaaugaaauuucuaucaccuucuggauaaaucacacuauuaucuaugcaggcaacaauagcacguauuuucucaaagauuaccuuugcccucaagguagguuuuauuuuucuagcagucuaacggucaugaaauaaauuauaaaauaaaaacagugggucuucaagcuagaugauacuauuuucuuucuugcauggacaauuauuuuaaaauauuuugguuuuucugcacuuauuauuuaaauaugacaguaugacuccccacccccacuugaaucuagggacauuguaguuuucuacugcagacuuuguuucugguuuauacugggaauauauuguuuaucauuuucagugaaagcguucacugguuaaauuuccuuuuaaaaauaauaauggaucuuuacaauuucuuugagcugcucaguggguauaauguguugaauuuucuguuagugguugggagguagaaauagauacuuuaucucuauuuuagccauuuccauaauuauauaucucaauagucuugucaaugcaucauuaguucuaugacugaauuaaugauuacuuuuaguagucacuuaauuucuuacugaugaugaugauucuacuuuugugaaucaucuuggaugauucucuaaaaucuuagaaagcugauuuuguuaauacuaugcauguaacacaucaauacauuuucucuauuaaaaaaaauuaaagcauuauagguagaucagaauuuaccauuacuaacuccucaguccuucuuauuucccuguuaucaguuugguauauuuauauauuagguugauccauaugaaauugccaauauuauuucugaacugaugaaaagcagcaauuucuuaugauucaaccuauuauauaugcccauagacuacauauaaugacuuugcauguuuuuauauuauagugcuauaccucaaauacuguucugcaauuuauuuuuucacucaacaacgucuuuugauaauuucuuucauggcagucuauacaaguuucuaccucccuacuuuuaaaauguugcguaauuuucuaauguuuggauuugucauugcuuuacuuacucccuaaugaugaauauuggcauuauuaacacuuguagucauuaggguucauaugacuauaaauugcucuuauaaagcauuaguacuauccauuaaaacugccuuuaggcugggugcgguggcucaugccuguaaucccagcacuuugggaggcugaggugggcagaucaugaggucaggagaucgagaccauccuggcuaacauggugaaaccucaucucuacuaaaaauacaaaaaauuagccaggcaugguggcaggcaccuguagucccagcuacucgggaggcugaggcaggagaaugccgugaaccugggagacagagcuugcacugagccgagacugcaccacugcacuccagccugggcgacauagugagacucugucucaaaaacaaacaaacaaacaaaaaaacugcuuuuaaauguauuuguauugaaaaauacugagauguaguccuucuguuuaguuaaccaaccaaacuuccuuccuucuuuuuuuuuuuugagacagggucucgcucugucacccaggcuggagugcaguggcguaaucuuggcucacuguaaccucugccuccuggguucaagugauucuccugccucagccuccugaguagcugagacuacaggcgugugccaccacgcuuggcuguuuuuuguauuuuugguagagacaggauuucaccguguugcccaggcuggucucgaacuccugagcucaagcgauccacccacuuuagccucccaaagugcuaagauuauaggcaugagccaccacacccagcugguuaaucuucuuucaguuguuccucaagaaaaguaauucaguuguuuuauguuuugaccuugaacauaaccuguuguguuucaacucugucuuuccaggcuuagguuguaagcuuuuuaaagaaagaggauuguauuuuaugauuuuggcaaugcccuccuugucuucuucuacagcuucuaguucagagcuuuguuuuguuucauaaucacucuagaaauuauuaacaaaccaguggguacuuaguugauuuagucaaauagaacuaaguccagacugagcaauauugguugauaaucauauggcuaauacugaaauuuugauguuauucaaaauaauauucuaaagcagugcuaauagaaauauaaugagaaccacauaugcaauuuaaaacuuccuaguaaccacauuaaaaaguuacagugagcugggugcaguggaucauuugcggucaggaguuagagaccagccugaccaauauggugaaaccccgucucuacuaaaaauacagaaauuagcugggcauggcgguggacaacuguaaucccagcuaccugggaggcugaggcaggagaacagcuugaaccaggaggcagagguugcaacgagccgagaucgcgccauuacacuccagccugggcaacaagagugaaacuccucucaaaacaaaauaaagauuauagugaacaggcgaaauuaauuuuaaugccuuccauuucgaccgauauaucuaaaauauuaccauuucaacacguaauauguaauuaugugcuguauuuuauguuugcaggacaucucaguucagacuagcuacauugcagaucccaagugugugucauuaaaauagugauagauuuguguggguacauacauauauuaucauuuauaguuuccugauuagaauucugcauaaucaagucuuacuaagacagguuuauuauauuuucucauuacuucuuggucuauaggaauucuaccucuaaagagagaauuaggugaauaauaaaaugucacgacuccauuuuacgguaguaucuuagcauuaauauuuggaauuguuauucuagaccuuagccaaaauauauguuuugauuaugaauuuucugaagcuuuccaguuaaguguaaaacaagugaaaaauauaacuucguauucuguguauuuugcuuuuuauaggugucuacugcagauauuucaucaaauaaggaugaugaagaaaacucuaugcacaauacaguuguguuguuuucuagcagugacaaguucacuuugaaucagguuugaacuugacaauuuacugucuuccucauugaauuccuccuugcacauuucugcuuuaucucauauacacagaagucauucaauauuuagcuauagagcuauauuaguuaagaagguauuuuuaaaguaaaauuuguagguuuuuagcuuagucuccauuuaaaauauguucuguuuucuuaacuucaggauauguguguaguuuguggcaguuuuggccaaggagcagaaggaagauuacuugccuguucucaguguggucaguguuaccauccauacugugucaguauuaagguaaacauccuuaaauugaguuaacaaauauguauugaauuuuuauuugguuuuaguaguaacaugagcucccaguucucacaauuaaguauuaugauuauuaaacauaugugacaguauuuaaauacuuaaaauacugcuuuuaaggguuuccuaucucaagaaauuugcuccucuauaaaucuuauauuguacaauauacuugucuugaaaaaguaaaacauaaaaauauaugcauuuaauuuaaaagacaauuuauaguauucacaaagauuuuagguuuagcuaauucauuuugucugcugauuuaaaaagcugagaacuggaauauuuaguaaaaaauuauuagcccauucuguucuuucccgcauucucucuccucuaugcucacucguauacaaaaugacauuuucuccuuauagccaaaagaaacaaaacaagugucauauuuaaugcaauugguaauaaucgagagucagcgcugcucacuuugaagcauuucaggauagaggcuuucuggggaaccuuuuaagugguaucgugugcuugguuuuaaauauggacaggucucaauacuucacuaguuguaucuaagguucuugguuuuuucuuuuuaagaacucagucuuaauaaaacuuacauauuugaauaaagugucauggccacuggaagcaagcauggagguauagcuguacagcagaggucuuaaacuguauacuccacaaggaaaucuuuucuaguacugccauaccauguaauauaaauacuaaccucaguuucaguaacagguugugaaccaugagugauuuuuauaccuuucuccccugcccuucaaacaucacuguauuauaucauugucaguaaaaugucaguauaguaagcaaaucaacauuaucuccuucagaauucuuuguugauaacuacacuaguauuuauuuuauaggguaauacagguuuuugugaguuuaggaaucaaaaugaaagauuguaauuaauacuauccaaaauagaagacuaguacgguuaauuuauguagucuuuuaaaauuaguugcucaugguaugugacugaaaaacacagaguauauaaagccaauuaaaaaauagaguuauauaugcauaaaacauguuucuuuucuucuuuguacuuuauauucuguauaaaaguugcugcuaucauuagauuuuguuuuuuagaauacuuaauguuuuggaccuaaggaaauugaauaagaucccuuucaagauaguaauguauuucuuuuaacccauccaacaauuaccgaauucccauuuuacagaugaguacgacuuacauaaguuaagauuggacaauuagugcacuaucaaacacauaguuacugguagagcuagaauuugaauuccuguuuuuaaaaauuauguaugguuccuuuugcacgaugacacuguuuuggacaguauagaauacugcagucucauugagaaauacagcaguaucuagaaauauacuagggauaugugaauuggcucagcuugcauuuuuauuguaggaggcaauuguuuguggauaaguuugauaccuuugaagcuucuuuuuaagcuugcuggggcaagucuagaaagucuucacucuaagguggauauuuucaaacuuuaugguuuuagaaccuuaacacucuuuaaaauuacuggggacuccauaguuuuuguuuaugaggauuuuaacuauggacuguucagcauuuuagaaauuaaaacuaggaacauuuuauaacacaagacuacagaagcacaaccuguacaauaucaauguaauauuaugauacaacauguagccucuauaaacaccacuguauaauugugaaugaauuaaagugaaaaaaggcaaauuaaaucuuaguauuauuuaaacuuguuuuaacuuuacagacucacugggguucccuagaccacauuuugguagcugcgguccuagcauuaauuuaacccuauacuuaagacuuggccuuucugggaucacuacugaauucugcucccuguucaccagugucuuuguacucugacugguugugcuucacuugucuuugagccuuuugcaagcugugguaauugugcagcuuacaaauucccaguagauguacuuuccccugguugugggucuuugggcuucuagaaguacggcuugguguuccaccaaagacuucaggggauccuuuguagauuucuggagcucuuagucguuauugcuucuucauuuugaguacuguguccugcaaauuccacugccuugccuucccuaaccucagcgaggccauugauuguacucugcugagguucucccucccugggcagcauucuggaaaauguuucuaggcagaauaucauaggacucccugaguguuuccuuccucucagagaccacugucuccuguacuauguguuguccaauaucugaaaacaguuguaucauacacuuugucccauuuucuacuaucuuaugggagaacaggcuggucccaccuacuccauuauaguugaagcguguauccguauuagauuauaaaacauaucuguaacaacuuuggacaugguaccauggauggaauccuggaugacaucuuauuugaaaaaacuuuuaaaacuaaggcuagacugguucaacggaagaaaaaaaugauaguacaaccccaguaccuagguuaaaaggaaauuucaaagagggagaaauuguugaaguguugaaguacuagaagucaagaaacacaaacacuaauguuuccauuagauuugagaauaagaaggucuugacaagccuggcuuaagcaguuaugaguggauguggguguagagaccagacuguaguguuuugaagagugaauauaagcugagaaacuugagaguuugguuauaaaagggaccacagguaucugugaagaaaacuuaguaggaaugaagauaaauauuuuuaaaauucugccacugaacaccucagaucugucugccacuuuaucuucaggucauuguuuaagccagggucacgcagacuggcccauagacuaaaucuggcccauuuccuguguuugcaaauaaacuuuuauugaaauauggccauguucuuuuguuuacauauauuuguagcgguuuuugcauuacacuggcagaguuuuuauaaaguugcaacagaucauauggcccucaaaacuuucuguuuacucucuggcccuuuauuggaaauguuugcuggcuacugccauaagccacccugaucuuaccccuaggccauuuccuucauuugggcaaauaauacauuaacuugguaaucuaagacaaauucuuaaaaaucaauaagcuaaucaaaauaauaaauauacauguuuaaaaaucaaaugacauuaaaagccuuguaaugggcuggguguggugccucacaccugucaucccagcacuuugggaggccgaggcagguggaucacuugagggcaggaguucaagccagucuggccaacacaguaaaaccccaucucuacuaaaaguacaaaaauuagcugggugugguggcucauuccuguaguccuaguuacucaggaggcugagccaggagaauuauuugaacaugggaggcggagguuuuagugagcugagaucacaccacugcacuccagccuaggcaacagagcagagcaagacuccaucucaaaaaaaaaaaaaaaaaaaaaaaaaaggccuuguaaugaacaaccaacucuugucuuacucuaccuccacgucugaggcagucgcuuuuaaucuuuucaggucuuuuuuucuugugguuaaugcuauagcucuaaauaaucaacugguuuacugcuuuaucaaugcuagauuuuguugacuuucugcuaugaauaaauaaauucugauuuaggucuuaaaauacaccuccauccuucucccaauauaguuguauuacuauguuuaguucaauuaauaagguguugguuaugacucaguaaauguucacugcaggucuaaacaguauacuaugaguuucuuuugucuuucauggaguuuuuuauaacaagaaaguaauagugacucuccauucguucuuuguuuuugccuacucuagaacuaucauauaagauuaguuuuuaaaguacuguuuuuuucugggagaaguccuacccuccuucuagacauucccuucuccugcucugauaugugccaguggcuucuagguauguuguucucauccuuaaacuuccuggccugauguccuuuguuggaucuguugauuuauagaucccaagucuuccuauucuuuauaauacauccucauucuguuccgcauaucucuaaguaacuuuauuagaaaggagaaugagggagcugaauuuugagucuuccugugucuacaacguguucugucuucacacauaguugcuuguguagcuagguugagaauuguacuuugaaaaguauuuuccuguagaauuggaaacuuauacucuucuagcaucuggaguugggaaguuuggugccauucugauggguguuccuuugaauuuaacucuuuuauuuucuucucugguagcuuuuaggcuuucauguaccucaugaucugaauuuuuauucuguacccucauuacuugcuguuuuauuauaaugugggcacuugauugguucugucugaggauccuagucuuuugagaucuuuaagaaguuccacaaucuuaauauuacaugguguggcuuccuucaggaguuuauuagggauuuggagauucccaaauauucuacuaacuuauacccuugagagaggggagaauaaacagaggagugaaugugaacuucagaauuccuagcuucauagucuaaauagaaauccucuaagaucauaaaaugucccuaagaacucaugccuuacauuaauuuuuuugguauuuuuucuauugauucuaagcauggaaauguagauggagauuuuguugauguauuuucaaauuauguaucaauaauagggaagcuuacuugauuucuuuaaaaucuggucacuauaucuauaaauauaguggacauuaaauguacagcauaagguaauuauguggacuuuaaaaaggcguuaaaauaugugccauuuucuauuauucugcucaguaggcuucuaaaagcguguaugaacaugcccaacccaguauugggccuccguaggugcucaauaaauguuaguugauugccucuuuucugcuucuagguacauaagcaccauauuaauuuauauaguauauuugauuauguuagguuaaugcauaaaucacauggauugguuguuucuuuuacagaucacuaaagugguucuuagcaaagguuggaggugucuugagugcacugugugugaggccugugggaaggcaacugacccaggaagacuccugcugugugaugacugugacauaaguuaucacaccuacugccuagacccuccauugcagacaguucccaaaggaggcuggaagugcaaaugguacucuaggguuuguuugccuuguuagucuuucaaguucagagcuuucucauaccacuuugguuuuuaaaaauuagccacaccuauuuaauugaauaauacacauauucuaugauagauaccaguaaucagaaaaauuuucacauacacauuaaaucauuucccccauuauguucguauguagcuuccugaauuacaguaacugaguaacuaagaaaauaaaauugagacuuuucggggggauuuggauuucagguguguuuggugcagacacuguggagcaacaucugcaggucuaagaugugaauggcagaacaauuacacacagugcgcuccuugugcaagcuuaucuuccuguccagucugcuaucgaaacuauagagaagaagaucuuauucugcaauguagacaaugugauagguauugugcuauuuuuucaucuuuuuaaagcuuuucucuuugaaauguagcaaaaaaaaaaacaaauggaaaauagcuuuuccuuaaucacaaguuuuagguacagaacuuuuugccuuguagauuuuuagucaccuagaaacuuacagaagcgauuuccuguuuugaauucucaacuccggacuaaaauuuuguuuuguuuuguuuuuaaauuuagagacagagucuugcucugucaccaggcuggagugcaguggcgcuaucuuggcucacugcaaccuccaccuccgccuccuggguucaagcgauucuccugccucagccucccgaguaucugggacuacaggugcaugccaccacgcccagcuaauuuuuguauuuuuaguagagacaggguuucaccauguuggccaggauggucuccaucuuuugaccaucuuuugaccgcccgccucagccuccuaaaguuuuaugauuauaggugugagccacugugcccgcccaagacuaaagauuuuuaauuuaggccuuuuugaggguuuaggaaucccuugaaauuagauggagaauuauugccuucaucuaugccguuucuuaugaaggguuucugaaucuucuaauagauuauaaaaaauaucuaacacauucuguucuccuuaaaccacuuuuucuuaaagcucuagauacuagauaucuagauauuagauagcaccuucugcccucccuacguaauuauguggaauuucauaaucaagaauguuuccuugcuuucauugguauauuguuguacucuuuagaaguuaagaagugaacauauauuauuaauaguauuauuuuaucaguaguacaguauucuugggacucuggcuacuaauuauuuguuccauugcaagacaacuuuuuacuuaauuucccgauuaccauucaacaucgcuuuccgugagauaugucuacuucaaguuagaugcauuaccuggagcacauaccugcuagcacugccauuugcaguuuucugaauaccuuuguguuugcccuaacuagcuuccuuucugucuuugaaauauuuaauauaugaugauaaaauaauuagcuuccuuauguaaugugcuuugcuuccucucuaauaguuguucucauuccuuuuuauuuccuucuuagcuguaugaaaguuuuucuguuaauagagauaguuaggagaaaagggcaagguaggaggagcaugugaggcuuagggcuuuuaaguuugaagacucaguguuacagguuuuaaaagguagcaguucucaguauauuccauuuuuuaaaaaaaauguacaaauauggucuuuuuagauggaugcaugcaguuugucagaacuuaaauacugaggaagaaguggaaaauguagcagacauugguuuugauuguagcaugugcagacccuauaugccugcgucuaaugguaagagaauaauuuaaacugugagucugcacucuuguaccacucacuugcaccuuacuguccauaaccaaugaauuagcuuagcucuacucuauuuugucuuugugaaacuuacuuugacaaguauuuuaugaaaaauauuauuuuugguuauacaugacuuaucacaacuuguuauaaaacaauuuacaugaaacaauaaaaagcauauacuuuagauguaaacuauaauuuugcuuccaaggaacaugaucuuguaguuauugacaauaugucagaauccaauauguugauuguuucuuagccagguuuuccuccaugacuugaguauuuccuucaucacuucuuguuuuguuguugcuuuaaaaagcacuuuuaacuuuaguguucaaacauuuauuuuaauaaaaugaguauagaaacagaaauuauaaucauauauaaguauuuaaauacacuuuaccuuuucugaaaagaauuaccuggauuuuuuuuuuucguuucagugccuuccucagacugcugugaaucuucacuuguagcacaaauugucacaaaaguaaaagagcuagguaaaauuugaaaugcuuuacuugauuuaauuaauuuacuuugcuuaauuuuuacauaauuggcuuaccacuugucaaaccugcuucaaucauauggguguucuauccaaauucuguaauguugguaaucauuuccacaaugauauauaaaaugucauccagcuuuacuggggcaguauuccuauaaauuucagcaaguaggcaacaaaaauaacagcucuuagaauaaccauuaaugccauacuugcuuuaguuucauugauauauuacugugcuuaauuaucaguuagcagaaaacacggccuaguuagcgaacagauuucuuuuagaauuaauucaaucucuuaauuuuuaaaauaauuaauaagccuaguauggugauucauaugauauucuuauuaaacagucauucuuuugaauauuuguauuuaauagcaccugauacaaaaauguuuggauaguacaggaauuguucuaaggaacaacaguuuuguacauuuaaaauuaaaucugcaggauuuguacuuauuuauuacuucucccuauuaguaauuauguugauacucugauuuuuccagaugagcuucuggaguauucucucuucucuuacguaaauagaucccugccuuuugaucuuuucuacgaagaagcucauaguggauuagcugagcauugcauuuaguugcagugcuucuaacucuuuuuauugggacaugaaaauagaaauuccaggaagacuuuuuugagacagagucucgcccugucgcccaggcuggagugcaguggcacgaucucggcucacugcaaccucugccucccggguucaagcgauucuccugccucagccucccgcauagcugggauuacaggugcccgccaccacgccuggcuaauuuguuguauuuuuagaagagacaggguuucacuguguuagccagcauggucucgaucucaugaccucgugaucugccugccgccucggccccccaaagugcugggauuacaggcaugagccccugcaccuggcccaggaagaccauuuuuuaaaaacaugcaaccuuucugccuguaauccaaggaaauuugaccuauuguucauaguuuuuauuggguaucaugaaguuaauuauucaugcauuucauagauacguaauugcuuucuagaacuacagucacauucccuugacauggguauuuuggaacaguaaucagucaaauuugaaaugaaaguuuaaauuuguauccuugggauuuuguaauuuuagacccacccaagacuuauacccaggaugguguguguuugacugaaucagggaugacucaguuacagagccucacaguuacaguuccaagaagaaaacggucaaaaccaaaauugaaauugaagauuauaaaucagaauagcguggccguccuucagaccccuccagacauccaaucagagcauucaagggauggugaaauggaugauagucgagguaauacuaauuuauuuuccaugaaauaugugugcaagaauuaaagcauauaaaguaacuuuugaaauauguguaugauuuaccaaaggguaaaucacacugacuuaguuaaccccugaugugacugacccuugccauuuccaaaugagugaucuucuuagaccuugccuuuucagguucucuuccuuucacacauuuuagaacagaccuaccuuacagaaaucucaaggagcaccauaucuuugaagaucacagguggggaacuacagagggcuugacuuuaguuugcuagauaacgacacaaaccuucucagauacugugagcuuggauaauaccauguuucaguuaagguaguugaugcauacauucuagaaauggaaaagcugucauuuaauguuacuucagguauaacuucauauucaccagugugcaucauaaaguauugguuuauaaacauuuucuugaucaaaguaaauauaagguuuuucuagcugaauucuuuuuuuuuuuuucaguugggagacagggucuugcucuguugcccagguuagagugcagugacacgaucuuggcuuacuacaaccucugccuccuggguucaugcgacccuccuaccucagccuccugaguagcugggaccauggaugcgggccaccacgccuggcuaauuuuuguauuuuuuuguagagaugggguuuugccauguugcccagacuggucuggaacuccugggcucaaaccaucugcucugcucagccugcugaguucuugagauagcaaaauauuuuaauaguaacccaaaauccaauaugaguuaaagaggauuacuguugguuugcucauuuuuggggcgguuauuuauuuucaacugauucagaaaugaagugauaauuauuuguuugauuauauuuuauuucauaguuuuuuguuuuuuuuuuuuaaggggcagugucuuguuacguugcccaggcugguuuccaacuccugggcucaagugauccuucugccucagccucucaaguagcagguacuauaggcaugcgccacugcagcuggcuuugagacaauagaauuuauugaauaucuacuguaugucagauguuggaaaucauaucaguguacaaagcagguagaauucucugcauagaguuuauauuuuaauguuagguaacccaacucuuaaaaaaaaucaguuaauuauaauguguuuggcaagucccaugguaaaaauaaaguuugauaagaauugccuggccaggcgcaguggcucaugccuguaaucucagcacuuugggaggccgagguagguagaucacuuguggucaggaguucgagaccagacuggccaacauggugaaacccauucucugcuaaaaauacaaaaauuagccgggcucaguggcaugcaccuguaaucccagcuacucgggaggccaaggcaggagaauugcuugaaccugggaggcggagguuacagugagcugagauugcaccacugcacuccagcgugggugacagagcaagacucugucuccaaaaaaaaaaaaaggaauuggaaguacagauggguguuuaggguccauaugaacagaaagcaguauuugagcacagauuuuaaagaggugagugagugagccacuugauuaccugagagaagagcaucccagacagugaggaagccgauguaaaggcucugggugagagugugcugagcauguuugaagaaagaguguuguggagaccaacagagugagcagaggggacagucagaaggugagaagauuagagaugugaggacaagaaggacggcucaguauaucucacacaaccauaaggugaugugucaguaguuugugcuuaauagcaauggaaugggaggccauugaauguuccugaaaagaagaacaccaugaucuuauuuauauuuuaagaggaacacucuccuaugauauaaauagaugauuaggugcaagaguuaugacagguagaucagugagaaacaaugguccaggugagagguaauuguggcuuugaaaagguaugucauuuguggccgggcucgguggcucaugccuauaaucuguaaucccagcauuuugggaggccaaggcggguggaucaccugaggucaggcgaucaagaccauccuggccaacaugguaaaaccucaucucuacuaaaaauacaaaaauuagcugggugugguggcaggcaccuguaaucccagcuacucgggaggcagaggcagaggauugcuugaacccaggaggcagagguugcagugagccaagaucgagccacugcacuccagccuggugacagagugagacuccaucucaaaaaauaaauaaauaaaugaaaagauaugucuuuuguauguucuugauaauuuuuguuuuguaguguguuuugggucuauguuacugggagaaacacuuucugaugcuuguauguaacugauuuucagauacaauugaacagguaauuugauuugggcaguuggaguuugcaaagaaguaguccauauacuuaggaggaauugaucagaucagcuuuaacaagaauuuccauuucugaggauguuaaaaaaugucugaaaaagguuuccauagucucuuaaauuugggaagugcuccauuucacaaaauaugaaagguuucuugauaauaguacacauuguuucccaaauuaugagauuauaauaccuuuuaaaaacaacacaaaagaccuuggaagguuuuccuugugacuaccacuuguaaacugagaaauggugauauguuucaauuucauauuuucucauugacucguaucaggguaaaagaaaaucaguugaaaaauuacccuugcuuuuuuaaaauuuacgugauaaaauagcccaucugaauuuacugaauuuguccuuauuuuuauugaauaugaaaaaagauuguuuaguguguuggauguuaaaugcuaagacaauuuuagaauuuaaggaauugaauauacagcauuuucaugacuagucccucauguucauuuacgugccaggaucucacauccuuugcagaaggaaagguacauuccuagggauaaaauaagugcauguuacuuggacaacauuuuugcuuucuguuugcuaaauaaaaaucccuuuuaaaaauucaguauugccacacuuugccauauuaaaaauguuuuagauuacuauauuauccugaaacuacauguacacacacaccccuaaaauaaguuuuaugguauuucauaugccuguacaggagaaaaaauagggaaagaauacaaucaucguaaguucuuauuauuacauuaugcugagauuucuaauaacacugcccuuuucuggguauuuuguauuaaaccuaaaauuugugauguuuuagacuguuucacuaacguguuuugauaaugucucaguacccuugggaaaacauuauaaaguagugggcaaugaugaaaccuacucuggguguuuuuaggcaaauuuuuuaacuucuuugaugcuaguguucucauuuauaaaauaggugaaccaggaugagcccauaggauaguugugcugaugaggugcaaggaugcaugccaggcacccagcacuggcucuucccacacauggagugcucaguaaccgugagcuauuagaauacaagugcucaaccagugcuugagcaauugugucuuguguccaacagaacucaacagaaucccaugcuugucuuuauaugugaauucaguuccuuuugaguuaguaagaaauuaugccuguguugggguaauugaacuuuuaggaugagggaauugucugccacaauuauucuaugagcuuaauguuuccaugucuuuuucuucauuuuggaaguuguggaaaaauuauaaugaaagaguauauaaacguuuuccucuguauuauagcauaucugacaguuuccuuuauuaaaaaguacaauacauuagggagagacuugaugaauuuaaaauuaaaguuugaaaaguauuauugacuauaagugaucuucagcugugcaguuuucaacuugagguugucagaauguaauauuacacauuauauuacacacaucuacagaauccaaacugugauguuccuggaguauuggaacaauaccuaugacuuuuuguuucuauuuauuuuuaacucuucuaauaaccgcuuccuuaagaaaagucauacaucaucacuuugguguaucagaaacaaauuccuuaugcaauaaaagcauacuucuuucucauucaccuccugggaucuagaaacccuguuaaugcaagaaaaaaaucccauaccucaauaaaauaacacucuguuugucucaagaguggaaacacaacacauuuccucucaacugguggucccagaucgaccaucacaguguauggauguguugggaggugugggaauaggacugcacugaggcucuagaaggccagcagguggggcagacugaauggagggaggggacuggcauucaguaacuacuggagagugggaagagugagguagacuauccaucuggugaagguggcugcuuccuugagguuuguuacuuucuguaauguuaauucccucaacuuuuaaaauuugauuuuuagacaaguuauacauucaaaugauuuaaaauuggaaaauaauuaaaagguaaacagugaagucucucccuuuccccugccuucaugcccccaguuuacaucuccagaaaccucagagguuucuuguguaaccuuccagauguguuuuaugcauguauaaggaaauguguguguguguguguguguguguauauauauauauuuuguguguguauguguguguguauauauauauauuuuguuccuuuugucuuacuacuauuuacuguccuucauuuuuuuauggcugcaaauauuccuuuguauggaaauauaagcaauuuaacuuaccuguucuuuccccuguugauagaccuuuggguuucuuucaaucuuuuuuuuuuuuuuuuuuuuuuuuuuugagacagagucuugcugugucgcccaggcuggagugcaguggcacgaucuuugcucacugcaagcuccgccuccuggguucacgccauucuccugccucagccucccgaguagcugggacuacaggcaccugccaccacgcccggcuaauuuuuuuguauuuuuaguagaggcgggguuucaccauguuagccagguuggucucaaucuccugaacucgugaucugccugccucggccucccaaagugcugggauuacaggugugagccaccgcgcucggcuuucuuucagucuuuuacugugaauaguacaaugaaucaccugguauauuuauaauguuguauguaagugggccugcaaaggugaauuccuugcuaaauccaaagacauaaugcauuuaaaacuguuuuuggcagguaggauacaguuuuuuuuuucauuuauuuuuauuacacauaucugagguauacaacaugcuuuguauacauagugaaaugauuacuauggucaaacaaaugucuguauccuucaccuuccauaguuacucucuguguguguacaccuaaaaucucuuucagcaaauuuucauuacaauauuauuaacugugguucucaugcuguguauuaauuugaucucuagaauuacucgucuuaccuaacugcagauuuguacccuccgaccuacuucugcccaucccacccauccccuaccuccagacccuugauaaccaccauucuacucucuauacguucagcuucucaccccgcugccuaccauucugcuuauuaagugagaucauacaguauuuuucugugucuggcuuacuuuauuuaguauacuuuccucccgguucauccauguugucacaaauggcagugucuccuuucuuaaagcuaacuauuccauuguauaaaguccucauugucaucaguaaguucuuagaaacugugguuaagagggggaaaaaaguaugacaaaacugauuuuuuuuucauuuugcauuaugccaaaauuagauugaaggaaacaguguuacuugaggaccugcuguauguucauuuagcuuaacgucucaguucccaagaaccuauugaugacauuaagggaggacuuaauauauguguauacacacgucacaauuucuuuauccauucaucuguccuugaauggguaaguaaauuguccaucaggacacuuaguuuguuuccauaucuuggcuauugggaguaaugucgccaugaauaugggagugcagaugucucucucagaugcugauuuuauuaccuuugaauauaugcccaacagaggcauuguuggaucuuauggugguaguuuuuuuuuuuuuaaggaaacucuauacuguuuucaauaauggcuauacuaauuuacauuccuaucaaccauguacaaagguuucguuuucuacacauccucaccaacacuuaugucuuugccuuuuugauaauagucauucuaagagacaugagaugauaucuauugugguuuuaauuuucauuuuucucaugauuaugauguugagcaucuuuucauauaccauuugaccauuugugugacuuuggaaaaauggcuauucagguccuugccuauuuuaaaauccaguuauuugggauuuuuuugcuacugaguugugugaguuccuuauauguuuuggauuuuaaccccuuaucagaugugugguuugccaauauuuuccccuaaucccugugcuaccuuuucaccccgguguuuuuuuuuuuuuuuuauugcuaugcagaagcuuauuugcuugauguagucccacuugcuuauuuuugcuuuugcuaccugagcuuuuggugugauauccaaaaaaucauugucaaggaggauaucaaggaguuuuucuccuauauuuccuucuaggaguuuuaugguuucagguguuagguauuuaaucuauuuugaguugcuuuuuauguaugauguguaagauaggcaucagguccaguuucauucuuuugcauauagauaucuaguuuucuuaccacuacuuauugaagacaccaucuuuucccuauuguaucuuauuggacuugucaaaaauuagcucauaauauaugcuuggguuuauuuuugggcucuguauucaguuccauugauccaugugucuguuuuuaugccaguaccauacuguuuuguuaacuaucacuuuguaauauaacuugaaaucagguagugugauaccuucuacuuuguuuuucuuucucaagauucuuuuggcuauucagggucuuuuaugauuuaauacaaauuuuagaauuguguuuucuauuuuugugaaaaaugccuuuggaaauuugauagggauugcauugaaucuguagaucacuuuggauaguauggacauuuuaacaauauucuuccaaucuacaaacauggggauaucguuauauuuauuugugucuuuaguuuuuuuucuguuuuuugagacagagucacgcucuguugcccaggcagaagugcaguggugugaucuccgcucacugcaaccucugccgccuccuggguucaagcaauucugcugccucagccccccaaguagcugggauuacaggugccugccaccacgccugccuggccaauuuuuguauuuuuaguagagacaggguuucgccauguuggccaggcuggucuugaacuccugacuucaggugaucuacccgccuuggccucccaaagugcugggauuacaggcgugagccaccaugcccggcugugugucuuuaguuucuuuugucaauauuuuauaguguuuaguauauaaagcuuucacuuccuucauuaaauuuguuccucaguguuuuauucuuuuugauguuauuuuaaauggaaauguuuucuucauuuuuuuuucagaucauuauuuguauaaagaaaugcaucugauuuuuguauauugauuuuguauccugcuacuugacugaauucauuuauucuaguaacuguggaauuuuuggggguuucuacauacaggaucaugucaucugcacacagggauaauuuuacccgcuuuuuucugcugaugccuuuuauuuccuuuucuuaugugauugcucuggcuaggacuauguugaauauaaguguuaagaguaggcauccuugccuuguagcagauauugaagaaaagcuuucagucuuucccuguuguagguuuguuuuugaauaggcaauaccugugcaugauacaagaaauacagaggucuuaaaaagagugaacaguguuaaguuagccuaccuuuugaccaucccuuccuuggaaagaaccaguguuuucuuauagcuuuccagagauuagucaucuagauacaaguauguauauaugggagaauuucucauauuugggugauauggucuuuuucuuuucuuucugucugucuuucuuucuguccucgucucgucucuucucuucucuuuucuucguuucuuucgauggagucuugcuuugucgcccaggcuggagugcaguggcgcaaucucggcucacugcaagcucugccucccagguucgugccauucucuugccucagccucuggaguagcugggacuacaggcaccugccaccacgcccggcuaauuuuuuguauuuuuaguagagacggguuuucacuguguuagccaggauggugucuaucuccugaccucgugauccgcccgccucagccucccaaggugcugggauuacaggcaugagccaccgugccuggccgauacggucuuuuucuuuauuucagccugugggaaucagaaggcccuugugaagauguugguuagaagagacuuuagccuacagugauaccaccugugugagggcacuguaugugcuacuuuaugccauuugucucaacauguaugcuuacuggugucacuaugaaccucaucaauaaaagugcucucuugguuuuuacuguccuugugugcauuguuucaggugaaagguggccuuuguacuagauccaguguuauccuuggccacaaaccauuacauaugauuaacuuggggauuuccucuucaucauccuggagaucaucuucuguucucuccuguguuacauguguuuucugcaauuucaugaauuucucuuuauuuuuucccucuauuuggguggaacguauauuccauagcucccugacagagaauguguggaagguaaguuuugagcauuauauacuucugaaaaugucuuuauuuuaccuuccuaccugacucaucuuuuccagguuggaaauacauuuucauuuaucaauuuuagucaauugauccacugucuuuuaguuucuaguauaugaagaacucgguucucucuaugugaccugcguuuucuuggaagcuguuaagauuuugggaaauucuuuguccucaguguucuaaaauuucaugaggauaacgucuguuuuugucuauuuuugauuuuuaaaaucuguuuuguuaggcacugaguggucucuuucagucugcugucuuauauccuucagugguaggaaauguucuugaacuauauuauugauaacaauucccucuguuuuuccagaauucugcuuuucagaugugaaacauacucaguuuuucucugcuucuuuccaauucauguccuuauuuuaucuuccucuacugaguuuuauuucuauuucaguuauuucaagagcuuucuuuccucccuuugaauguuucuuuuguagcauccuauucuugccucauggguaucuuauauuaucccucagaggauuuuaaucuuuuuuaagauuuuuuuucuuccuacuuagucuguuaauuccaaauugucuuuuauguucucaggucucugucuuucauguuacagaucagggguguugcagaucuucuggcuuccauggcccacaauggaagaagcauugucuugggccacacauaaaauacacuaaugauagcugaugagcuuuuuuaaaaaaaaaaaaacucauaaaaagucucauaauguuuuaugaaaguuuaugaauuuguguugggcugcauuuaaagcaucuuggcugcagguuggacaagcuuguuauagaccauagucggauaaucuuuaugguacaugcaugauuaaaagugaagaacuaaagauggagacuggauagauaguauuuuuauuuuuuaaaaaaggaauuaaguaguugauuagaaagcuuucuguaugugguggugcuugucgauuuguaaguuuaguggggugauuugugcugaccauuuggugaacccucugguuuccguaucuuuagauguucuucuugaacugcucagguuccccacugcagucuuuucaaaccucauacuuggaggcuagagaucuggcugcuagcuuucugagaauucaguggggaaacguggggucuggcagcgggagcaggaugggguuguccacauuuaguaugcccauauuuucuugguccuauuuucagucuucaucccauuguuccauuuaaggucacccaggaauccugcaucccacaaaugagaguagcagcuucucaguguguaaaccuaggaagcagauguagggaguaugacuucugcagauaauuaaaucucuuguugcuuggguuuucucccacuuauuuccaaagguggccaguuuuccuaguuucucagccuucugaggaguguuauaaacuggauucuuuuuuucaguucuuucugcucucaacugagaauuugccuuuguuaaguuguuuuucuccuuuccuauugucuuuuuuuuuuuuuuuuuaaaggagauugggucuuucucuguuguccaggcuagaaugcaguagugugaucauaacucacuguagccucaaccuucugggcucaagcaauucucuucucccaccucagccucccaaauagcugggauuaccggcaugccaccaugccacagcuugauuuuaucuuuuaaaaauagauuauuucaguguguuuuuuaguaggguuucaggagaauguaauuuuaacauaugaauuuagucugccaucuuaacucaaaauucccugucauuuuuuuuuuuuuuuuuuuugagacggagucccgcugucgcccaggguggagugcaguggugccaauucggcucacugcaagcucugccucccagguucacgccaugcuccugccucagccucccacguagcugggacuacaggcaccagccaccucaccuggcuaauuuuuuguauuuuuuaguagagacaggguuucacuguguuagccaggauggucucgaucuccugaccucgugaucugcccgccucggccucccaaagugcugggauuacaggcgugagccaccgugccuggccuuuuuuuuuuuuugagaguuggaauuucacucuugcugcucaggcuggagugcaauggcacaaucucggcucacugaaaccuccgccucccagguucaagcaauucuccugccucagccuccugaauagcugggcuuuuaggcguguaccaccacgcccagauaauuuuguauuuuuaguagagacucaccauguuggucaggcugguacggaacuccugaccucaagugauccaccugcuuuagccucccaaagugcugggauuaugggcaugagccaccgugccuggccuauaaacuuuucuuuucauggcuuagucauaagccgauagccauuaucagauuguuauggaauuggccucaaauauagaccaaauauaauaaaaaacaaaagacaaauacccuguucaugccauuacugaaauauguuaucucuaauacugagaauauugaaggaguuaacaacuugauuuuaaaauguauuugauaaacaugucuuuuuccuguaauacaauguaaagcauauauaacuuggaaaaguuugauuaccauaguguuaaaauagcauucucuaaaauagcauucucuaagcauuccauuuaccucauucagugaaguauuuauugaacauguauuagguauccuacuaacaauacaucuguuacuaagaaaaucuguguaccuguucucauggagaauauagucuagcagggacacagauuuuaaagaaccaauaaaaauaaagcaugacauuaauacauaggagcauacaacuguuugacauaaucuuuucuaaauaucaggaauucuuuaauacagugaaguuuagaauaaauccugaaagauaaguuagguagaaggcagaaauuggggaagauaguggaagaaagagcuugauacauucaaagaacugaguguaguucacuggugggagugagaugaagcuggaaaguuuacaagagacuguuguaaugggccuugcaauuuaaaguuuauuuugagggcauugggaagacaugaaaggauuuuaagcagaaaauggauacauauuuauagaaagaucauuuaugcaguaauuuaaagaacugauuggagagagguaagcuuuaagguggggaacuagauaggagcauguuguauuaauagugagucaucugagguuggacuaagaugguaguagagagugauaaaaugcauuucagagguauugagaagucuugguuguaggaggaaagagauuaggaaugauugagguggucuuccaggccucugucuucuccggguuacauuuccaugccuuuuaaugaugauagguaacaugggaaaaaggagaaaguuuauuuuaaauuaguaguucauuuuggauauacaguuuucaguaacuagguaauauucaauuauagcugugguugaagcucagaagagaguucuagucuagagaccuggaccugaagacauaauuaaaagcaagugaauuuguuaagugcaaauggauugcacuuaacagaacucugaguucuguguuccccuucucugauuauguuuuauuucaugggaacacugcacuaagcagcacaauuucuacaaccauuuggggcuucuucuaucuccuuucauacuuucccuaccaacagggauguacaauuaaaauggcucagcaacaacccuacuuuuuauuccccauuauguagggauuauauauuugauagguuuuuccaguuuuguguauacauuuacuuuuuuccagaaggagaacuuauggauugugauggaaaaucagaaucuaguccugagcgggaagcuguggaugaugaaacuaagggaguggaaggaacagauggugucaaaaagagaaaaaggaaaccauacagaccagguauagugccugagguagacauuucaauaucaucaacacuugguuaauuaaagaaaaauacaauacugaagacuucaauuaaaauuaaauauucaggcuucagaacugucuaaacaaaaauaugugcacauaaauuaaagaacuaaacuauuugaauacgacuuuuuagcucuagaguucuuuauuuugaaugugugaauacuucacaaugaaucauuauugaaugccuugucccaaauguuaaccauuuuauuaaaggcuuuacuagauuggcuuuuguucauacuuggacuuugaaggccauuuauauaguuccucuggauguguacuucuguaacgcuuuuaauuuucaguauucacuuucuaauaucuuuuuuugaaaaaacuuauuucaguguuuaugcaggagugccaguaaguauacagugugaaggggaauaagacagaguuauuauggcuccuagaauuuauaguccaguuaaaaaccaugacugauuaaacacucauuucuuaucugccucaggaguggagagaaaagcggucuugcuugucaguuuuauuugccuuauuggaaaaaauuauuaaaauugucacaauacagaaguuguaggcuuuuauguauuuauuuaaaaaauuuuuuucccgcuuaucacacguguugaguaggcuuuccuuaggcaguuuauuaauaucuuguuuaccaaugagguuuuaaauuggauuuguacaaucuuuaugcuucuuauugcuuauauuuuauugguaagagugaucuaaaucccuuuugauauggaaggaagaacuuucuuacuucauucguauuccaugagaccuuaaaagauaaccuaucuuuuaaauaggucauaucuauaauaaggaccuaagauuaguugcuucugaauuguuuuaugaaaaugauuucauuucuuccugaucaugaggcuuauaaguguacuuuuuuagacauugcagauuucuuccaggaacuuguauuuaccguuuuuuuuuucuuuuccucugccucacauggaagucaacccucuaauugagggacccauuaggucacggaguaaauugcuagacaacgauaucauuucacaaaagcuuauaguguugacuguguaccagaccucuauucuaagcacuucacuuauguuauuuguccuuuuaacauguguaugagaagcugcuuugccucacccccuuuuuuaaccagugaaagaacugaggcauugagaaguauuuaguaagcagaauuacauagucugacuccagauuccaugcuguuaaacacagggcucuaugugucccauguauaaaugcccucauaccuuggaguaccagacaccgucccccugaaaucauaucagucaaagaauauuugugucaucuagguaguuugugccuucuauccuccagcuaauguaccaguuagccgguuaauauacagacagucauccaucacuuaaguucagagaaauacaucauuaggcauuuucaucguugcgugaacaucauagagugcacuuccacaaaccuagaugguauagcuuacuacacauuuaggcuguaugguacgcuaaauucauuuaaaaaaauaaaguaauugugcuacgguguuauaacuacggugaugucuguauguggugggaauuuuucagcuccauuauaaucuuaugggaccacugccuugacaugcagcccuuuguugaccaacaucauuaugcagugcaugacuguuaugugauguaugaggcacuaauauuugucaaauagauaagccagcguaauuuaguguuugauauuuacacugauacuguugagaagaggaagugcacacaggucuuuuuguauucuguuugauaagugauaagaguggcuuugccuuuuuuuuuuuuuuuuuuggucguuuuuaacuucuauuuuaccuaaaaaucagguuauugauuuagauuagcacagauuuaauuuuggaaaaugacuuacuauucaagauaaagcaguuuuauccuguguacuguggaaauguagggagaaauuacuuaucaguuuaccuaauuucuuuuuuggauagguauugguggauuuauggugcggcaaagaagucgaacugggcaagggaaaaccaaaagaucugugaucagaaaagauuccucaggcucuauuuccgagcaguuaccuugcagagaugaugguauaguacugacuuaaaaaaaaauuuuuuuuuuaauguaacccuuuggucuugauauuucuauuggaaaaaacuauccuaaauaauguuacagucaauaagagccuuauugccucuuauuguuacucaauaagagucuuauugccuuuuauugaugaaaggauuugagugcguauagaguucauaucuguaauacaguaaucagguuuuauaaggaaaugguuuaaauccaauagacuuuauucuuuugagauuuuuugacaagcucuuuuuuccuguaucaaauuauuaaauauauuuucuauauuuaaauauaaaugguuuagggacugaauaacuuaguuacauaagguacuuucuggucaucuccaaagccuuucuuugacugccuuagcuacuuaucauauaauuugaaauucucaagugacagugcaccucaguuuuuaucuauuuauguaucugucugucuaucuaucuaucuaucuaucuaucuaucuaucuaucuaucuaucuaggggucucacuaugucacccagguuggcaugcaguggcacaaucaugggucacugcagccuugcacuccugagcucagguaguucuccuguccucaaccucugauguagcuggagaccacaggcacacaccaccaugccuagcuaauuuuuuggcuuuuugcaaagacagggucucacuuuguugcccaggcuggccugcaacuccugugcucaagcgauccuccugccucagccucccaaagugcugggauuacaaaugugagcccagcugauaucuaaaaaaaauuuuguuuuugagacagucuuccucuguuacccaggcuggagugcuguggugccgucucagcucacugcaaccuucaccucccgaguccaagcaauucucgugcgucagcgucccaaguggcugggauuacaggcgugaaccacugcauccagccaggaguuguuuuuuuuuuuugcuauugguggugagcaggagguggcaagugaugguuugugugaagguguauuucuuauuaaacugacccugagcuuuaugcaagucaccucuggccugucugccuuggagagaggccuuaagcuuugucuucuauucccuauuccucgcaaugcucugaaaauuggaguuugaggucauuggauuucagcaaauuucggagagcuuuuacuuuuuugcuuacuucugugguuccuuauuuaucuuaauuuuuguuuuucauggauuccuuauguucuggcuagguuacuggugccuuuaaaaagauuguuguaaaaaauguuugucuauuucuaguuuucagaagagucaauucacuuacguagucuggugguagagugcccauauugauuuucagaagggaugugccauuugcccugccauuaugaagcaucugagaauaucauuugauuguuuauuugucaaauuuaagcuguguucuuguuucuuugcuaguuucauaguccccaaauuuauuuccauuucugauuucaagaauaaguguucauugcauauuuauuagcauauucaucgucauguuuucacaauguguauauccuacaaauaauuuauaauaaauuucugaacuuggaauugcuguauuaaaggacacacuuuuucuuuaagguuuuuguugaguauucucaauacacccuacaaaaaaguuacacccacagaauuucucuuaauaguuuauaaguugccauuucgucauacucaugagcuuuggguauuuauuauuauuauuauuauuauuuuacucuuuaacaaaauauguuuaaauaaauacguuuuugcuuuguaaucgauuauuaagaaaauaggaaaaaugcuaauacuaaguagacaugaaaucaaaauuuuauggcacuuaaaaguaacaaacuugauuugagauuuuuuuguucaaaaagcuuguuuguuuauaugaaacuguguguauguugguaagguauaaaauuaccuucaguggguuugucuagaaauuuuaaaugucacauauuuauaaaugugacuguuguuucaggcuggagugagcaguuaccagauacuuuaguugaugaaucuguuucuguuacugaaagcacugaaaaaauaaagaagagauaccgaaaaaggaaaaauaagcuugaagaaacuuucccugccuauuuacaaguaauauuuugcuuuacauuauuuuacaugguuuguuaauugaggaaauaaaauguauugaguuuuaaaacauagguuuguuguuuuuguuaauguuuuacuuguuuuguugucauuuagucaucauaaaugccauuuuuaccuuucagggguccauaaaaauuaaauuuacuuuuuuugugugcuuugauacuugucauaaauugcuuuuuuaauaccaguuguucacuucuaagcauucuauaagauguaacaaggacacuuugggauaggaaaaacucaaucuuccaagucauugauagcuauguauaccccacacccaaguucuguugaaauuuccuuugccaauacaaguuacauuaauuauauucauugauuaaagauaggcuuuucagccaaaguuauagcuuuaauaaucguuaccacuuuuagaggccuggagaaccaaagauuuaagcaguauucuuuuuguuuuccaaaauacacaucagaaaaauaccuuucaguacgaauaaauuauguuugauagauguagacuacaaaaaaaauuuuuuucuaguucaucuuguaaacauuaagucagaguuuaaggccaugugauacggaaacagcucaauauuagaaauuguacugagauuaaauaucuggcucugcaucuaacuaauuguaaauuccuaagcguguuauucauccuuccuggccucuauuucuucauguguuaaaauugaacuggaacagacuaucauugagaggccauccucauuucauuguagacaacuauucaucugaucuguuccuccuaagaaacuauggcuuacacagauaacccuucauugccugaguugcauuuauuuuuuacaucaauuuuccaguuagguauuacuaguuuaauugguuuuaaaauacauugccuuucaacuagcauacaacuuccucaauuuucuuuuuuguagcuacuaacaucuuaauggcaguauucauguuagagcucagccuauaaagucaggauuuaaacaccauuccacuaccaguuagcugugugauuuuguucuguuuaacaucucuugugucucgguuuccucauuugugacauaguggugccucucagaaaugcucagaaguucagugagaguauguauguaaagugccuagccugugccuuacuuuuuguauauccuucauacauguuuuuccccucaaucucuuauauccuagguuugcaccuuuguuuuuuuuuaaacgaucauuuaauuggucaggaaaaaaaauccauuuauagguuggcuuaccuuuuuuuuuuuuuuuuuuuuuuuuuucaucuuuguuguuguuuucuccugggauucccuuuaccucccuucuuaauaguccuuucuaggaauauugugauggcaaccuacuuuuccuccuauugauccuucuguaaaguguaauauaaauuuaagaagcuuucuuuagguguuucugcaaguaugaaaacuagccauuuaauacuuuggcaaaagagucuuuaaaauuauuaggucuaauuucccaauuacugcugugaucuuagucuccugggccgucuuguuccccuguugcacaucaguaacuuucagcgugugugugugugugugugugugugugugugugugugucugugucuguaugugugacaugagggaggccuuuuuaaugguaguuuucuuggacuuuuagagacgauauggauggagcccccucuuuauguuaucuacagggaauguaaaacacacuaaauuaauaagggugacacaguuuuugauaaacaccaguaaagucaugagucauuagacagaauucuugcugaugaugguguaagauuucucagauuuauacugaaggcauuaaauaaaugaccucuaaacuucuaaaacgcuuucugcuguucaucauuuuuucuaaugauaaaagcauugcuuauuauaagaaaugaauccucuucuaccugguauucuaguuuugugaauuuuuagauuuuucauagugagaugacuuuuucauuuaaaaugugaacauuucaaaucagauauaucauugccuccaccagacuucacacacucccaaucucuuuucucaaaggguaguauuguuaauaauuuggcauuuguccuucagaaacuuuuuuauaauuuauuuuugcaaacuuauaauagucuugauuugaacuuucuaauuuuuuuuugagacagccucacucugucacugaggcuggaaugcagugaugugaucucagcucacugcaaccucugccuucuggguucaagugauucucgugccucagccuuccagguagcugggauuacaggcauguuggcgcaugccuggcuaauuuuuguguuuuguguagagucaagaguuuugccauguugcccaggcuggucucuaacuccugggccuaagugaaccaccuaccucggccucccaaaaugcugggauuacaggcgugagcuacugcgcccgaccuguauuuuauaauuuacuguauguguaauucaacuuacuuucuuuuaguaauguauuuuagggcuuuuucuuugauaacauagaacuauauacuuuuaaaaaauuguuguauuuuguaauauaagugucuauaauuuggauaguucuaugccuguugauagacauuaaggccauuuuuacuucuugacauuacaaaauaugcuacagugaacuuuuuugugcauguuuggcaagaauguguuaaauguuguauugcaaaauuguccuguauggaggauccuuuuuccagauagacuacaucauaggauauagacuaaagcagaguuccuggguugaagcaggguaaagggguggaacugugcuucccuuuugucuuugguauugauuuuugagaaauuuuggagagaucuuggaguugcaaggaacccagcuugaaaguauauugaaauggaaaaauguuaauaugccuaaauaaauagaaaaccacaagccuuuaguagcuguaaauauugcacacauaguauggcuaaacugacuauaaaaccgucuuucagauugaugauguaaguagucuuauaguguaagugugguuauaugaaucaauagauuacaaaucuaccugaaguaaauauuaaagccguagaucaaagucuuaugcuguccucugcaaguaaucuauaaaaauuaauaauacucaugaagcuauucugcaguuucuagaaaccuuugguauaauugugugguuuuauuuccauaauuuugucucuaguaaagcuaccaaaaaaucuuauuuuuaaaauaaggagaaucuauauaaaauaauugacaggauauuucuauuuuuuaauacuucuguauucaguuucuauauuguuaaauauaaaccuuuucuguuauuucugcuuccuugucaaaaaccaugacagaauaaucuauugucuuuuuagaauuuucuaaccauuuuuguaugugcuuaucuucaucuaggaagcuuucuuuggaaaagaucuucuagauacaaguagacaaagcaagauaaguuuagauaaucugucagaagauggagcucagcuuuuauauaaaacaaacaugaacacagguuucuuggauccuuccuuagauccacuacuuaguucauccucggcuccaacaaaaucuggaacucacgguauguagaauuauucacagauauuuucuuuauaucauauaacauacaucuuccuuucaguuaaaucuuuuugaaauguuuuuguuuggccucauaugcauuuuaaaaaucaacagcauugaaguauaacuuacauucaguaaguggaacuauuuuaaguggacagguguauaagauguagcaaauuaauuuaccuguguaacuaguaccaacaucaagaguugugaaggaaaacauuugguuuacacuuugcugagggcaaugugagggguuauaauuuggccaacagugacuuuuugacuaaaaaucuaagauagauuuuuguuaaucauacagcuuaaauucaaaacagagaaaccgaaauggauguggggguacuugggaacuugcuggcauacuguguuacuacagugaagucuguugcccuaggucaugguuucuuacugcugacaguuugcaccaguaauucuuuguugugggagggagccuuucugguguauagaaggauguuuaacagcaucuuuggccucaugaugaucaaaaauaucuccagauauugccaaauaccuuuugguuuuggugggcaaaaucacccccgguugagaaccauuauccuaaaugcaggaacuauuaacaaucagagaaagguaugagaacuugauguauuuacagaguuacagcaaugucagcaaggcucuaggaguuuaacucauuggguagguaagugucuugaucaguguuucucccacuucuccccuaugguucugucaauuguaaaucauuguucuuuugguaagcuuccuuuuuuuaccauuaauugcauuuguuacucaguuaauuuuauaaacucauuuugaaaaacaauuuuaaagcaaucuuccacugaaaaaugacuuuggauguuaaguaguuaaugcuucauuaacuuggcauuauccugaauugaaauacugacaacuauuuuugauuuugacuuuuugaaauaauuagaagcaaucuuaccccguguuggacacaugugcauguccagucugccucauuguugguagugaggucaugcuucuuguuuguucaaucuuacauauuuuuuaccuccuacuuuaauucuguuguuuuaaguaugaccugcucuuguccuugucaguauguuguuaaaaauaauguauaaugaaagaccuguggguccuucaaaggauauuuuacgauaaaguuuaucuuauaacucucauaacuagccacuuugaagacuuaaauaggagcucuuugcacuugaguuuuaaaagcaaaaggauugaaauuggacagagaacauauaggaaagauauugauacaaguuuuuuuuuuucuuuauuuauuuuuuuccacaaaaauacugaagagagaacaguuuuacaauaaggccaaaacuuggaggacuagaaaaauauacccauuucaaaaccuagauuaauuguucuuugcaauugaacuacucuuuucacuuuauaauggaaaauuaaugacuaaaggcuuuuuuuuaacaugucauucauuguagccuauuauaucaauuuuaaugauuuauucagauauaaaauccuuuagguaggggcaaacuuguaaaacagucuuuaaaaaauuaguuauaauuguauaguagaauuccauuacuuuaaaacaaaaaacugcuauaugacuccuaaaaaaauuauccagauuuuuuuucauucaacuacaguguugucauuauugaaauaauuuucucuaaaaaguuccuggauauuugggcacgcaaaacuuaaugugauauguuacauaugaauuacauuuugaaaacuauauaaugggaccaagacuguuugacagaaguauuugaccuggaauauuacauuuaugcccuccucccccuuuuaaguaaaaauaagcuugagauggauuaaaaauuucaguuucucuuuacugaaugacuaauauaauuauuaaagcuagccuaaacaagaguuccaauaguuucuugguuaagcccaaacccguagaauccuccuugacuuuucuuucccuuucauucauccacguuugugucugccuucaaaauacgucccaaagccgaccacuugucucagcuuuccuuagaacccuggugcugucaucaccucaccucucagacugcaccagugcccuuuucuaaucuuaccagccccucucuaauucccaccccucaucugcucuacauauagcagccaguauguucccuuuaaaauauuagucaucuccuaucuuucagccucccagcaacuucucauuacacuucagaauaaaacccagucuuccccauaaucucuaaaaucuuaacauaaucuugcccuagcugccucuuuuuuauccuuaccacaguuuuucuuacuguuaacacucuggccucucguuggcaaacccggcuugccccaggggcuuuaugucugcuuugccuuaguuuggaggguuaucuccaucuuugugcauauaacuuacucccucauuuaguuuuaugcucagucaucuccuaaaggucuucauagaccacucugucuaauacaacauccccgcagcuuauuuuuaauccuuuuuccuuguuuuuucuuuaaauagcacuuacagcgaugucguuuauuuacuaacucccccugagaaaguaagcccucugagggcaggcacuuuguuucagucauuacugagugggcaaugccugauacgugauccauagacacaguucuguggguagugaaauacuuuuuaaaauaaaugagugaguaaucaguaugaacagcaaagcugcaaguaguuacuagaugguaccuggcuugugcuccauauggaauuucuggcuugugcuccauauggaauuucuaaagagugacagguuugucuuucauauuuuaacuuuuccuacuguguuuuaauuucucaaugucacuuuuagacaugccacuuucuuaaugaaaaacuuuuuuuucuuugcuuuguuucuuacagcauuuauucuguuucacuuuuauugccuacaggucuuuaaauuuugucucaauauacauuagucacaagacaaaaucgucugaauuuuuaguaaauuuuuguaauucaaaacauuaucuccuuugcuauggaaaauuuuuacuguaaaauuaagagucucagguuuuuauuccaguacuugccucacucaguaucugcuguacucuagguuuuuagcaaauggcuuaauaucugagaaaauacugaaauuuuaaaaaacauauuuacuauauuuagguccugcugaugacccauuagcugauauuucugaaguuuuaaacacagaugaugacauucuuggaauaauuucagaugaucuagcaaaaucaguugaucauucagguauauaugaauacuguuuacccuuuuucugguuucugaugugagcgagagguguaugauguguggaacaaguuuagccuuuugucuguuucccaguaacuguguuuuuguuuuuggcuuuguuaaaggacucagcauuuucuuugaucugccucagcuuuccugcuuuaggagggguauagcaaguuaguuaauuucugucgucuuucuaauugcaucacauuuaaggcauguugccuuaaagucuugcuguaucuuuuuucuucuuuuguuuguauuuucccucacuuccugcuccugugguaaucauccauuuuauuugguuugggucuuauaggucuugauuuaugcacuuuccagguugagagcucaccuuuuccauuugguaagaaacugagcaauggaugacggcugacuagaaguagucuucuuuuuuuauagugauuucagcugaaacaaccuguaggugcaugcuguuuaucaguagugcuaauuugucacuaauccauacuuugcuuuucccuuuuuguguguggcuaaagcauaguauagcuguacuguacuucgggugacuuucucaguaguuuuucuuuaaugaauaauuuuauuuuuguuaauaugugguuuacaauauuaccuaaaugucguagagcuaguuccuaauauaagaucaaauaagaacagacuaaauuuuuacuuuuuaauaguaauaauauugagaaagcaugaaaaaaauguagaugauaaaccacuuuuacaugugacucuuacaaauuugagcugcagcauguuacaauuuuauaaaauguaauguacauaaucagaaugugccuauagaauacuuuaaaaauauuaccuauaauugaaguuauuuacaaaggauaauauuaaacacugagcauuuuagggcuuuucauuaauucauaugaaacauauuccuuuuuacauacugugcauaauaauugaacuguacauuugauaacacuauuuuccaaauuaaagcaauuauuugcauaucgauuucucauaaacuccuaucuuaagcuuuuuuuuuuuuuuggcaggaguuggcaaguuaaaaucagauguauucuuuuauuccucaggaaauguuuuuacuugaaauagaacuuuacauggcaccgaauacaaauauauugugccuaauuuuuacugagcgacucuccaaauugauaugagaauucugauucagaauuacagacuuuauuucucuauuuuaaucauauuguuauauacuaaguacagguaaauagugcuauacauuuuugugugaguauucugaauguaccuuuaaauuuauuuuccuuacucuuguagauauugguccugucacugaugauccuuccucuuugccucagccaaaugucaaucagaguucacgaccauuaagugaagaacagcuagaugggauccucaguccugaacuagacaaaauggucacagaugguaaaauauuugcccuacaucuaggcuuucuaaaagaccugaguaaauaugauuuuuaaagauuuuugcaugguuauaauuuaacuucuaauuauuucugucaguuaaauacuauuuuauaucaguauauugaauuaguagcuguuaauguuucuuuuuuuuuuuuaauuuauucuaggagcaauucuuggaaaauuauauaaaauuccagguaaauguguuuugauuuucuaguuaaugaaaauggcguuccccauaccaggacccuacuagucuuuuaaucuuguuacuauuauuguuuuaucuccuagagcuuggcggaaaagauguugaagacuuauuuacagcuguacuuaguccugcgaacacucagccaacuccauugccacagccucccccaccaacacagcuguugccaauacacaaucaggguauguuaugacuuuauaauucuacauuauauucacacacauguguauauauguggguacauauacacacacaagcaaguuuugcccuauucuuuaguagccacguauacaaacugauagggagaaaaacccuuuuguaaugauugaaaaauacugacuucacauagcggucucccugaaauucucuguaauucuguaauuauccuuauguccaguggggaggauguaacagugccugcccucuucccucccugcaagucccauucccagcucacuccacucuagucauuugccacauaggcacuugcuguguguguguguguggaacuguccccgcucaccuggcugccuguacucauugaucugcccucgguuucacugucaucucucagagguuagcuggucaccaccccacccccauguuuuucauuuguagcauauggcacaaauauaauaccuguuuggguaauuaugucuucccuuuagauugugagcucuuuaaaggcuagaguuguccaugucuugcuuauaugcccugccacagaguauguguucaguacauacuuucauaguaaaucagugaccuuucuaucccuguagacacuaugaaauuuugugaauguuugccuauuuuguucauuuuucuucugccuacuuacaacuagcuaccaauuucuccccuuuucuguagagcugaaauuugauagccuaggauuaaggucuguaugaguagauagggaaauugguacagguaugggaaucuauaggaaggaguuuauggaguugcaugguggcguguauauaacucuaucuauauguauuuuuguuuuguuuugaaacggucucgcucugucacccaggcugacaugcaguggugugaacacaacucacgucagcugcgaucuccugggcucaagcgauccuacuguccucagccucccaugcagcugcgaccacaggcacacgccaucaugccuggcuaauuuuuugauuuuuugcagaggugggggucucacuuuguugcccaggccagucuagaacuccuggguucaagugauccucccaccauggccucccaaagugcugggauuacaggcguggcccucugugcgcagcuaguauauauuucugaugauuugagcauaggaacaucucucucuauccuauugucacugccucaugacuauacccugaauugaauaacaugaggauaucuucuccuuuucuuguguaagugccaaagugugugaauaauuuguaaccuuuacuaacaacuuuguauauacaugaaaauuccauaaugcacauaauggaaauauuuguguuuuuaccaguuuagccucuaaacauaaauuuaccuugauuuuugcuaggcuaaacaugugauuuacauuuggguaauauacuuaucauauaacuauucuugccuuaauuguuccuaugugcuuuuuuuuuuucuuuuuuuucugagacagagucucacaccuucgcccaggcuggagugcaguggcgugaucucggcucacugcaaccucugcccucugaguucagcgauucuucuggcuuagccucccgaguagcugggauuacaggugccugccacugugcccggcuaauuuuuuguauuuuuaguagagacgggguuucaccaucuuggucaggcuggccuuaaacuccugaccuugugagccaucugccucagccucccaaagugcugggauuacaggcgugagccaccgcgcccagcccccauaugcuguuuuaacgauuaagaacuauucaguauuucucuuuucaacauauaaaaaugaccugucuuuauguuuucugaacugaaagugcauauuuuaaaaaucaaagauguauuucuuuauaaaaaacaucuuacaaucauuaugaaaaucacuucauugugcagucucauuuuuaaaaggucuugggaggaugacuucuuuuucuuuuuuuuuuuuucuuuugcaagguguuaauguguaauacaaggugaaucagguugccuacccuuaggaguuuguaauucuaauacuguagacuuucagguauacaacuaauguguauuauaguacaguauaauucaaguacagccuugugaaucacuaagauuucauuguucuuguuugaaggaauaguaguucuaauguaagggcaaagcaugaucaaguuacauauagggcgacacauaguuauucaagaauggcaacuuuaauguuuuccagagcaaagggagugggcauuguuuaaggaagcaaaacuagaaguggacauuggugcugauuguaaagggcucugagaaauaggcagaggcagcuagccuuuucccuagaggcuuccaagagccuuugaagaccuuacaccacuggugugaucugaucacuuauguguuuugcuaagguagcucuggugucaauauugggaauaaauuugggacgagaagaauuguacuaaugagguuauugugguugagacuaaguuaaaaaguagguuccauguaaagauacuuccgugcugauugaaaggaaggaauagauacgagagaaaaugacauuagaacaaguaggacugugcuacugaauggauauaaggugugaggaaagggggaaauuaaagugaauuagacuauguauaaaccaggggcccagaggauaaucaugaaacagaggaagacuuagugugugugcugguagaagguaguggagguacaaugaauuuaguuuuagaccucuuuuagguugguagaaaugggacauauacacuauuuugacuuacaggcaguugcaguuagucaaggagauggaugaaaauguaggaauuaucuguguaauugugcuaauugcacaugugggaaggaugagauuuauuaagagaauauacugccaguagaguauagaaucucgaggaaugcuuuuuaauuaaauguaauuaaguauaugcuuaacucaucugauuuauauuaggugugcaauuacauguuucuuaucuuucuuccuuuuaaagguuaggugaaaguaaaaaaaguggugagagauuugagacauugagugagagguauaggaucuuggaaaugaaugaucauuagagacagguuguacaguuaaguaacaugacuacuugaaaaacauuguuucauuggaccaugggaagguuguugcuaaucuucaguggaguaacuucaauagaauugaugagaaaggggaggcaaaguguaauauguuauuauguaauauguaauaugcuuuauugucugaugguaauaaaguucagaaaguagagaauagaauuuucaagauugagauagaguaacuugaaauaccuuuauguaaaaguugugaaguaacuuuugaacuuuuauaaacuaauaugacuaguuuggguagauaugguagacuuggaaaaaaaaaagaccacuucuugaauaaaauaagaagaaauacuuugcuuuuacuuauuuguccuugaacaaauuauuuaauuucuguggguccucuuugcuuaaauggagcugaacauaauaaccuauuucaguggguuuucaugaagcuguaaagcuuuuaagacagugcuuagcauagcauaaaguacuuaacaaauaauagcuaauauuacuauugggaaaaguuucaauauguuaauauuguagauuauuacaagauuauuauuguaauaucgguagauggcacugauaccuagcuacaguauggaucacauucuccuugucaauaaacucuuguuucuccuaauuacaugaaagacauuugauauuguuuauuaaaauugcacauuccuuaacgcagcaguccccagccuuuuucgcaccagggaccaguuucaaggaagaccauuuuuucacaaacccagguugguggguuggggaaugguuuugcgaugaaacuguuccaccucagaucaugaggcauuagauucucauaggaacaugcucgcaugcacacuucacaauaggguuugcgcuucuaugagaaucuaauaccgccacugaucugacagguggagcucaggcgguaauggucacuugcccgcuguucaccuacugugcggccggguuccuaacaggucauggacugguaccagucuguggccccagaguuggggaccccugccuuaauggaaccugcuuuucacugaaguugaaaauagauguggcauucuaguuugaaaaaagcagaaaucuugcccuuuaauccuuggaguaaauguaagugucaugagauauuugucauugugaaaaccugauccaguggacccagcuguggcauuuaguaggguaagcccguuugugaaagucagagaguucuaggaagucuuugagacaaaaucuuuuaaacuugucagugaucauccuuaguaucugcacauacauacuggagcuauguagguuuuaguguuguaacauucaaaugaugugguuuaagugaaagaucauuauacauuguaaaauguacguguaugagacuuuuuuuuuaaucuaauggaaugacauuagauaaaaaaaaaucaagugaucagguuaggaauucucuaguuauaccaaguauuggucaacucuguauugccauuuguguaauuaauuggugauguggaucuccuguaauaguauggcucuaaguguugcaacaauuaacagaggccuuguguauuuccacaaaucaucaaguuuaauugggagggcuuuuugaagguaaacaaaguuuuuguuguuguuguucuuucuuuuuucuggaaacugcuccaauauggacaguuggcuuaguuccaaauaguuuagacaaguagacuuucacaauaaggacuggaguuacaugcuuaaaggaguguuguaaagaagcauaagaugguccuuuuauuugccuaaugucuauucagaaagaaaacgauaagguauuugauguuugugaauaagcucgaaugagaauucaaauguguuugggggcugaacuguaaguuauaaaaauuaggccaaaaccagaguguauguauuuuuaggaauaaucaucugauuuuuagugauagauauauugcuuacucaaaacuaauuuagagaaaguaucaauuuaagaaucauaggugggguggacacaguggcucacaccuguaaucccagcacuuugggaggcugagguggguggaucacuugaggcaggaguuugagaucagcuuggccaaaauggugaaaccccaccuccacuaaaaauacaaaaauuagcugggcaugguggcaagugccugugauuccaacuacucaggaggcugaggcagaauugcuugaaccugggaggcagagguggcagugagcugagaucuugccacugcacuccagccugggcgacagagugagacuccaucucaaaaacaaaaaaaaaaaaaaaaaaaggaaagaaucauagauuuuuuuuuuuuuuugguauuaagaggaacaggaauaaaauauaagaaacaucuguuuguaaauuuuuaaugaagagaaagaauauuugauaaaacuuacuagcauuugcugugauucauuaguguuuuuuaggaguuaauugugucgaauaguuacugcauaccaggaacuauguuuagagcuguacauacauuaucucaauuaacccaaauaacagaauaccuacgguuuacagaaauagaaauugauucugcuucuaacagguaaaauugagguucacacccugggcuuuuggacuccagaacacuugcuauuucuaguacacaauaaugaaauaaucacagcuguagagaucauauuucaaaaucuuauagccaaaagucacucuuuaaguauuauaaaauacugaaaaaaauccuacuuuuaaauugcauuaaagguuuugauuuagaaguauaagcaucucuucuguacuuggggcuuugguuccaggacccccagguauaaccaaaaucugagaauacagaagucaaauguuggcccuauggagcuuggcauacaagaaaaguugguccucucuaugcauggguuucccuguguuuucuauccacauucaguugaaaaaaauguguguuuauguggacccaugcaguuaaaaaccauguuguucaagggccagcuuuacuucaacuccuuguuacuugugaauaucaugccaacggaauuauuuuuuucucugaagaugcuuuuucacggaugccucucaugaauggccuuauuggauccaguccucaucucccacauaauucuuugccaccuggaagcggacugggaacuuucucugcaauugcacaauccucuuauccugaugccagguacaagccuuauuuucuauggaaacuuaaauugcacuaauuucuguuugauuuauauauaaauuagucugcuuaaaugauuguguaugauauuauuguauguugcguuuauuguggcuuuugcuauaaauauguuacuuuuaacuguuuuguaauagguuuuaaugaaagcuauacuugaacauauauuaagaaguuauuuuauguucauaaaguaaagauauuuauuuuuucccagggauaaaaauucagccuuuaauccaauggcaagugauccuaacaacucuuggacaucaucagcucccacuguggaaggagaaaaugacacaaugucgaaugcccagagaagcacgcuuaagugggagaaagaggaggcucugggugaaauggcaacuguugccccaguucucuacaccaauauuaauuuccccaacuuaaaggaagaauucccugguaagccaugaauauauuauuucuguuuuaccaacauuuucacaugugcaauaccuuuuuuuuuuuuaacugcaauagaaagguagcuuaacuaauuuuugucuaugaugacccacaacaugaagauucccuagaugucuagaaacaucuugcauuuuacuuuguccuagacccugcauccauccucauauuucccaaaaauuaguuucaauuagugaaaugguccguuuuucagcuccuagcaguacuuauuaauaugcagaaauccguguuaugugauucuuuaaaaaauuucuagaacccaaacuaucauuuaaucaaaaauacugcuaggcuaaaucagugaauccuaaauaguguuuuuaugaaacgaauucaauauugucuucccuucuuccccucucacuuucccugacugcccagcuauuaccacugccucuugaaaaaaacagaugauaauaguacaguuugugaaaauucugauuaaccagugaaugagaaauuuggauuaaugaaaugucaauuauugaauauaugcaagcaaugcgguuuuauuauuuugaguucaugguaucagacaaacuaggauugaaaaaguuauucaaacucaguuuugcaauaguuucccagcuaucuaucaauacacaaacucuuaaauuacuagagggguaccuggaagugacuuuucauuuggaugaccccuguauuuagguaccuuuuuggauuggcgucuucaugggacuuuauucauuauguauuguaauaaaugaaaugcuuuuuaucuaacaauagaaaucagugguuugaugcagggagaccugugaaggcaguaucccauucuucagccacuuucuuuccaugcuuacauuugcuguuuaugaacguacauggguauguugucauuuugugucagcacaaauuguccuuacagcagagcuguaacuuuuuuaaaaguaauuuucuuuaauaauuuuacuuugugauucaagaaccucaugaaauacuguguuaaagcuguuggucugugaacugauuuuucauuuucauuggcuuuuuggaagcuugcuuucuuuuuguaauguggaauaaauaauuucuguauuuaucauuaacuguugaucuuacccaggcuucuucauuuuguauaccgucaugacacugaguuucauauaaaugguuugaacucauuacuuuuccauguguuuguuguccacaaaugcuagugagaugcuuauuuaugacuuuguuuacuucugguaggucaaauugauagauuucuguuuagcacagauguuuuacaaacuuguacuuugguucugguggugucuuaccaccagagggaauuuauuaugucuggcuugcauuuuugcuacuuugucccuugaaucuaaaaacuucccaacuuuacaagcuacguuguuaauaaggcagcacuucauuuagaaaacguuuguuuggccuacagugugccacgaucuuuguucuuuguaaaaaacuuaauauaggucuaugaccucaugagaauacggccugaauaagauuaacugucagcaguucaucaacauucuuuauuacaacacaucauuagcauggcucugagaaaguguuauacucuguucuuuuguugcagauuggacuacuagagugaagcaaauugccaaauuguggagaaaagcaagcucacaagaaagagcaccauaugugguauuuuaagaaacuccucuaucuuuuaaauauuuaaauacagugcuugaaccuuauuuguauuagguuaauaaaaaacaaauuuccauuucagaaaaugcuuguuaguaccuguacaacaagcaacuuuauuuuuaaagugauuuucuaacuccuuaugucuuaauagagagugugacauuuuuauaagcaaguuaauagaaccaaaacguugaagauugaaaaucagcuguuuuaggggggaaggaguaauucauuucacuuuaaaauuguuuuaucucuucagcagagguacaguuggccgucuguauccaugaguucuauaucuguggauucaaccaaccauggaucaaaaauauuuuggaaaaacaucuauacugaacuuguacagacucuuucccuugucauuguuuuuaaaacaauguaacaacgauuuacauagcauuuauauuguguuaaguauuacaaguaaucuaaagaugacuuaaaguauacaggaggggccaggcacagugacccacaccuguaaucccagcaguuugagaggccaaggugggcagauggcuuugagcccaggaguucaagaccagccugggcaacauagccaaaaccucaucucuauaaaaaaugaaaaaauuagcuggguaugauggcgcaugccuguagucucagcuacuugagagacuugagagguugaggcuucagugagccagaauuguacgacugcauuccagccuaggugacagagcaagaccacccugcuaggucaaaaaauaaaaagggagaaaguauacaggaggauauguguagguuauaugcaaauacugugacauuuucuauaagggacuugagcaucuguggauuuugguaucugcagggaauccuggaaccaauaccccauggauacagagggacaacuguacuaaauuuggagacuggauuggcaugccucagugucuuccacagucaccucuuuucuuguuagguuucauagagaaucuuugugcaucuugaaagagaaauauuuagacauguuuaaagaguuuuugacacaugaucuuugccaugaacuauuagguaauuuuauaagauucgcaguucauaugguaaauuauuuucucccaaagagccaaauuaagauugucagcuggaaccaaauccuugcuuucguuuuaaagcauauuaaaucuguauuauuguuggaaaauauauauaguuauuuuccagcuuguuccccagugcacauauuuucaguuacagugauuauuuuggauagagcauauauguguguauaugcucuaucacauauauauauauagauguguuaauaugcuguguuuuauuuugacuugaauuagguaaugacagaauuuuuaaauuuuuaagugauuucuuuaaugauacguuucaaauauccagauuuuuuuuuuuuuaagacugauuggauauuuuuccuuuuuucuaaauuuuuuuuuuuuuuuuuuugagauggagcuucacaguuguugcccaggcuggagugcaauggugcgaucucggcucacugcaaccucugccuuccagauucaagcgauucuccugccccagccucccaaguagcugggauuacaggcaugugccaccaugccuggcugauuuuucuuuuucuuuuucuuuuuuuugagacagaguuuugcucuuguugcccaggcuggagugcaauggcgcaaucuuggcucaccacaaccuccgccuccugaguucaagugauucuccugccucagccucccgaguagcugggauuacaggcaugugccaccacaucuggcuaauuuuguauuuuuaguagagauggggugucuccauguuggucaggcuggugucgaacucccgaccucaggugauccacccgccucagccucccaaaguacugggauuacaggugugagccacugcgccuggccuaauuuuguauuuuuaguagaggugggguuucaccauguuggucaggcugaucucaaacaccugacgucaggugauccacccgccuuggccucccgaagugcugggauuacgagcaugagccaccaugccuggccccagccccuucuuucuaaauugaaggagacauaauuucuaaggauauguuaagaaaacuaggagcuaaaauauuaaaucacaccuaggaucuuuaagcuuaauucaaauacauagaaauauauccucaacugauagguacuaugcacuguaaagagagaagaugaguuaguguccagauccuuuuuugggaggugccguaaguauuucagcuauuuuaccugacuuuuuuuucuuuuauuugagaaaguucaugauaguuuuauuuuauuccuuaaaacauuuaacauaaucugggaaauuuuuuucucuucuuuugucaaagcaaaaagccagagauaacagagcugcuuuacgcauuaauaaaguacagaugucaaaugauuccaugaaaaggcagcaacagcaagauagcauugaucccagcucucguauugauucggagcuuuuuaaagauccuuuaaagcaaagagaaucagaacaugaacaggaauggaaauuuagacagguauggaauuuuuggauaaucuacuuuuugaaguugcauuuuuguuuugagaagggaggucuuugcauuauuauuuuagaauauaguucuuagaccaugaaaauuugauuuaggauagacuuguuucucuuuucaguaaaauauauuuaaauugauuugagaaauuuauugaaauauuauaaacaauauacugcccuaggcacaaauggaacauaccaugaugaguaauuucucuucuucaggaauucauaaucuaauaugggagcaaucugguagcgcugacaucaaacaaauuaacuuucuguugcuuuuuccccccaugaugguaguuuucuuccuuaaccuaaauaugauugcuuuuucuuuucuauuuuaauagcaaaugcgucagaaaaguaagcagcaagcuaaaauugaagccacacagaaacuugaacaggugaaaaaugagcagcagcagcagcaacaacagcaauuugguucucagcaucuucuggugcagucugguucagauacaccaaguagugggauacagagucccuugacaccucagccuggcaauggaaauaugucuccugcacagucauuccauaaagaacuguuuacaaaacagccacccaguaccccuacgucuacaucuucagaugauguguuuguaaagccacaagcuccaccuccuccuccagccccaucccggauucccauccaggauagucuuucucaggcucagacuucucagccacccucaccgcaaguguuuucaccuggguccucuaacucacgaccaccaucuccaauggauccauaugcaaaaaugguugguaccccucgaccaccuccugugggccauaguuuuuccagaagaaauucugcugcaccaguggaaaacuguacaccuuuaucaucgguaucuaggccccuucaaaugaaugagacaacagcaaauaggccauccccugucagagauuuauguucuucuuccacgacaaauaaugaccccuaugcaaaaccuccagacacaccuaggccugugaugacagaucaauuucccaaauccuugggccuaucccggucuccuguaguuucagaacaaacugcaaaaggcccuauagcagcuggaaccagugaucacuuuacuaaaccaucuccuagggcagauguguuucaaagacaaaggauaccugacucauaugcacgacccuuguugacaccugcaccucuugauagugguccuggaccuuuuaagacuccaaugcaaccuccuccauccucucaggauccuuauggaucagugucacaggcaucaaggcgauugucuguugacccuuaugaaaggccugcuuugacaccaagaccuauagauaauuuuucucauaaucagucaaaugauccauauagucagccuccccuuaccccacauccagcagugaaugaaucuuuugcccauccuucaagggcuuuuucccagccuggaaccauaucaaggccaacaucucaggacccauacucccaacccccaggaacuccacgaccuguuguagauucuuauucccaaucuucaggaacagcuagguccaauacagacccuuacucucaaccuccuggaacuccccggccuacuacuguugacccauauagucagcagccccaaaccccaagaccaucuacacaaacugacuuguuuguuacaccuguaacaaaucagaggcauucugauccauaugcucauccuccuggaacaccaagaccuggaauuucugucccuuacucucagccaccagcaacaccaaggccaaggauuucagaggguuuuacuagguccucaaugacaagaccaguccucaugccaaaucaggauccuuuccugcaagcagcacaaaaccgaggaccagcuuuaccuggcccguugguaaggccaccugauacauguucccagacaccuaggcccccuggaccuggucuuucagacacauuuagccguguuuccccaucugcugcccgugaucccuaugaucagucuccaaugacuccaagaucucagucugacucuuuuggaacaagucaaacugcccaugauguugcugaucagccaaggccuggaucagaggggagcuucugugcaucuucaaacucuccaaugcacucccaaggccagcaguucucuggugucucccaacuuccuggaccugugccaacuucaggaguaacugauacacagaauacuguaaauauggcccaagcagauacagagaaauugagacagguaaacacauuguauguucucaguuuuaaauguauuauuugaggaagcuguucauuucaucaaacugaguaauuucuacacaggaguuaauguuuuauuuuuuuuauucuguagaguuugucauacugcaaaaaagaaaaaugaaauugaugaaauuaacaccaguuuaauuuauucuguaucugauuucaguuuucacgaauucgcaggggaauccuuaaauauuaaagcuuuguuuugugauaguugucuggcaaggaaaaggacccaaaucaucaaauuauuuuuccuaauauauugaauaguuaaauguaacugguauuucaucaaacuuugaaacauuaccauagccacauaaugaaaguaucaggauuuaaaaagccacuaaccugucaggcacgguggcgcaugcuuguaaucccagcuacuugagaggcugagacaggaggaucacuugaguccaggaauuugaggccagccugggcaacauagcaagaucccauaucuaaaaauaaaaagccaguaaccuuuaaaaagccauuaauuaccacaaaucccagugauuuuuguuucuucccauuuagcggcagaaguuacgugaaaucauucuccagcagcaacagcagaagaagauugcaggucgacaggagaaggggucacaggacucacccgcagugccucauccagggccucuucaacacuggcaaccagagaauguuaaccaggcuuucaccagacccccaccucccuauccugggaacauuaggucuccuguugccccuccuuuaggaccuagauaugcuguuuucccaaaagaucagcguggacccuauccuccugauguugcuaguauggggaugagaccucauggauuuagguaaugcuuuuaauuuccugccgaauuuaaauugcuauuagaagagggaaacagagcugggugugguggcuugugccuguaauccuagcuacuagcugaggcaggaggauugcuugaggcuaggaguuugagaccagccugggcaauauagugagaccacccccccccccccccaaccucuucaacaaauuuaaaaauuuuuuaaaagaaauagacaaaugaaguuaguauuaaucaggaagcuguuacugcuuucuacuucuuucuccccuuugaaauauauauaaucugcuauuuagugcuaaugagaggucauagacauuuuuuuccucuaagaacucuacagacucugaaaacauuaccuuuguuuuuaaguauuaacuguguuagcauuaccuugcacccuuaaugaugcaguuuaucauaugacauccucaaaauguagcuauucugcguaggcaaagccuccuacgaugugaugagacuuguccucucuccaaauuucuaccuuuuaacuuuacauucuaaauuaauuuuaggcugggcgcaguggcucaggccuguaaucccaauacuuugggaggccgaggugggcggaucacuugaggucaggaguucgagaccaaccuggccaacaugguaaaacccugccucuaguaaaaauacaaaaauuggccggcuauggcggcaggcacugcaccuguauucgcggcuacucaggaggcugagacaaaaggaucacuugaacccaggagguggagguugcagugagccgaggucacgccacugcacuccagccugggagacagaacgagacucugucucaauuuaaaaaauaauaauaauaaauuuuagagauuuccgaacugaaaggacuuucccuuuaggaacuuuccauggugagauaggguuguaaguuaguggugaugaaucauaagaauguuuccuuuuucaaaguggcuaaagucaaagccaaaccuaugcccuaguuauaauaaggaaauaguucuuuaagauaugcuuuuuaguuuuaugucuuuuagucuuauaucucuaccuccauguuauauucuuuuaguuuccuuuucuucuaccuuaguuguaauuuaugccucuuucugcauuuuauauuuuguguaaguugccuguaaucuuacucuuaauuucccuuuuuucuuccaccuuguuauaauuuaugccucuugcuaugcuuuguauucuguguaaguugccuguaauccugucuagaaggaaguacaauauaaaauaguccaacaauuuauacauuuacuuaaucuuuauagaugaggccuacuuguccuuuucucuaaguuuauucuaucccaucaucaaaccugugccuuuguagucucauguacugaggccuguaagucccucaauagguaugaagaccuaucuucauucaaacaucauccccgaaucagcuuccuccaucgaaccucccuaaauauagauaaaagaaacucuuccugaaaaaguccaguaguauuguucuuaucucugaacaauugauuucaucugcuugguuguucuuccuuugucuucauuuuuguuaucuguuaaaucuuaagccuuuagagcucagauaugguguucauuauaggauucuuagcaaaaucuuacuugcauaugaauacuguaaauacuuuuuaauggugauagcuuugcuuuuguaagucauaguauuuggcaacauuuuguauguacaguuuaauugaagacuuuucuuuuuuucaacuuaacucuaaauuuaacauaauaccuauuugcuuuuuuuuuuuuuuuuuuuuuuuuuuuaaaagauuuggauuuccaggagguagucaugguaccaugccgagucaagagcgcuuccuugugccuccucagcaaauacagggaucuggaguuucuccacagcuaagaagaucaguaucuguagauaugccuaggccuuuaaauaacucacaaaugaauaauccaguuggacuuccucagcauuuuucaccacagagcuugccaguucagcagcacaacauacugggccaagcauauauugaacugagacauagggcuccugacggaaggcaacggcugccuuucagugcuccaccuggcagcguuguagaggcaucuucuaaucugagacauggaaacuucauuccccggccagacuuuccgggcccuagacacacagaccccaugcgacgaccuccccagggucuaccuaaucagcuaccugugcacccagauuuggaacaagugccaccaucucaacaagagcaaggucauucuguccauucaucuucuauggucaugaggacucugaaccauccacuagguggugaauuuucagaagcuccuuugucaacaucuguaccgucugaaacaacgucugauaauuuacagauaaccacccagccuucugauggucuagaggaaaaacuugauucugaugacccuucugugaaggaacuggauguuaaagaccuugaggggguugaagucaaagacuuagaugaugaagaucuugaaaacuuaaauuuagauacagaggauggcaagguaguugaauuggauacuuuagauaauuuggaaacuaaugaucccaaccuggaugaccucuuaaggucaggagaguuugauaucauugcauauacagauccagaacuugacaugggagauaagaaaagcauguuuaaugaggaacuagaccuuccaauugaugauaaguuagauaaucaguguguaucuguugaaccaaaaaaaaaggaacaagaaaacaaaacucugguucucucugauaaacauucaccacagaaaaaauccacuguuaccaaugagguaaaaacggaaguacugucuccaaauucuaagguggaauccaaaugugaaacugaaaaaaaugaugagaauaaagauaauguugacacuccuugcucacaggcuucugcucacucagaccuaaaugauggagaaaagacuucuuugcauccuugugauccagaucuauuugagaaaagaaccaaucgagaaacugcuggccccagugcaaaugucauucaggcauccacucaacuaccugcucaagauguaauaaacucuuguggcauaacuggaucaacuccaguucucucaaguuuacuugcuaaugagaaaucugauaauucagacauuaggccaucggggucuccaccaccaccaacucugccggccuccccauccaaucaugugucaaguuugccuccuuucauagcaccgccuggccguguuuuggauaaugccaugaauucuaaugugacaguagucucuaggguaaaccauguuuuuucucagggugugcagguaaacccagggcucauuccaggucaaucaacaguuaaccacagucuggggacaggaaaaccugcaacucaaacugggccucaaacaagucagucugguaccaguagcaugucuggaccccaacagcuaaugauuccucaaacauuagcacagcagaauagagagaggccccuucuucuagaagaacagccucuacuucuacaggaucuuuuggaucaagaaaggcaagaacagcagcagcaaagacagaugcaagccaugauucgucagcgaucagaaccguucuucccuaauauugguaggaguuuucuugagucucaacguauauuacuauggguauuagaguggcaugcgauaugcuuauaagauuuuauuauuagaauuacaguuggaauaaagcacugaguuuuucuauuccuccuugaggaguuuguuuguuuuguuuugagacggagucucacugugucacccaagauggagugcaguggcgcgaucucggcucacagcaaccuccaccuccuggguucaagugauucuccugccucagccucccgaguagcugggacuacagacacgugccaccaugccuggccaauuuuuguauuuuuaguagaggugcgggguuucaccauguuggccaggcuggucucaaacuccugaccucaggugauccgccugcuuuggccucccaaagugcugggauuacaggcgugagccacccugcuuggcccuccuugagcuuuagaaugaaagcaguuggcugggcacaguggcucacggcuguaauccuagcacuuugggagaccgaggcagacagauugccucagcucaggaguuccagaccaaccugggcaacacaggacauggaugaagcuggaaaccaucauucucagcaaacuaaugcaggaacagaaaaccauacacugcauguucucacucauaagugggaguugaacagugagaacacauggacacagggaggggaacaucacacacuggaaccugucggggguggggggcuaggggacggauagcauuaggagaaauaccuaauguagaugacggguugaugggugcagcaaaccaccaugacauauguauaccuauguaaccagcauauucugcacaaguaucccagaauuuaaaguauaauaauuaaaaaaaaauaacaaaaaauuagcugggcauagcagcgugcgccuguagucccaguuauucgggagacagaggcaggagaauggugugaacccaggaggcggaaguugcagugaggcgagaucgcaccauugcacuccagccugggggacagagugagacucugucucaaaaaaaaaaaaaugaaaacaacgaagaguuuuagauucuuuccagguaaauuaagagauucaaaacugaguuacaaacuucccucaauucuauuauuuauggaauuguuuaauagaaacuaauugucuucuuaguuccuacauuccaaccauuguugccauauguuuucagucauggaaggaugaauuuaagaaaauuaugauggaaauaaagcuucuuacuguccuuuuguguaugacaaaugcuuggcgauuuuuugcuauauaaaccucuuuaacuuguuucuaaugguuuacugauucuaaaaacaacaaaagcaaugcagucaaaaugccucagugccucuaagaauaagaauuagcaaucaaagggcacgugucuaagcagugugccuuauucuaaauaauaaaauugacauuccauuuuauauauccccaauuucaucauuuugcucccuuuuuuucauuuagaugcaaauagguuuuuucguaguagcuucuuauugagagguuauacccuuaagaaauuggugcauuuuucuuuuaagagugauaacuaauuuaguagaauuccuuaguauugcaaauucuuauuugugauguuauauuuacuaaagaagccauucugauuagcauugcaaaaguuuggaugaaaggaaauuaauugcauugcuuuagauuauugcuuauaaucucccuuaaacuugacuuuuuguuuuaauuccugcaggacuaagguauuaaagcaugauucaguuaaggacuacugagaugcgauuaaacccaggauaagguugccaucucagaaaucuguaaugauuauuaaauaauaaaauuuaagagcuuguaauauuugaauuacuucuuaguguacguugaacuaauuacuaugaaauaaguaacuuuauauuucuuuucuagauuuugaugcaauuacagauccuauaaugaaagccaaaaugguggcccuuaaagguauaaauaaagugauggcacaaaacaaucugggcaugccaccaauggugaugagcagguagguggaguggcugcuuguuucuacugggcaucuagacauucaugaaaucauuacuaguuuuuagaaaaaacauacagaaaauggaaagcccuugucuaggaaugaacaacacuauuuaaguugucauggcaucagcucgauaugaucagauacaaaaugcuauaccaauuuaagaaauuaguguaagaaccaguuuaagagcauuagucucaaggaugguaaauguaaaacaucuuaaaaagauuuggaagauuggauuuccugauuacucaagucaaaguauuuaggucugugcucuuuuaaauaccuuuagaauuguucauguuaucuaagauuuuuuucaguuaagacacugagugauuaaagcaauuauaaauucaguucuaaaauaaaauguucccaaaccgguuuugaaucagaaaaagaaaguuacaaggaauagauaagaggacaguuggaaguuggaguuacagaguuugucuuuucucucuuaggagaaaaacagaaauuacgcauuaaagaagacaguagggguuauuucaauaucugaauuuuugaaauuaugcccucuaaggguuguuaaccacauggcacuguuucuuaaauuuugaucauggaccaccaugagaauuaugggguaauuuuuuuaaaaugcagauuauuuugcucuacugcagaccuacuaaauaagaauaucuggagaugguugccugugugucuguauuuuuagcaagcgucaugaaugagucuuacguguauuacuauaugagaaccucugucaauaaaguaagcauagagccucaauuuagucuaguuaucuuguugaaaaacuuuuauauaaaaaauguggaugauuauagaauugaauauaaaauuugcacgaauuuaagauguauauauuucaaagaaauuugaauucuuaaggguauaauucuuuucaauuguugagauacuuuggacaugguuaagaagcauuuuugagaucaaaguagagauagugguuuccaaugauuuucauuauugagcaauauuuauuaacacuauuucucuaucauagagauuccuaacuguuuuaugucuugaauauuuuuggauuccagugaagccuuugaaauucucagaauguuuuauaugcagaaaauuuaagacauagcauuacgaaggaaaugauuauacuugaaauauaguuauuaaaauauaauuaaauuuauguauauauguuccuuaaaguauuaacaaauuuagcaauaaaccauaauuugaaaguaaugaugaacauaacuaaucuauuaggugccugcaacacucgauaggaaaauaaucugucuucuauuggugauaguugugguacuugcuaauaauauuguaguuucuauguauauucaaaacaaggaaaugcugaguuuuauuuacuacuuaguuuuguuuugguuuuuguuucugagacggaguuucgcuguuguugcccaggauagagugcaauggcucacugcagccuucaccuccaagguucaagcgauucuccugcaucagccucuggaguagcucggaucacaggcacgugccaccaugcgcagcuaauuuuuguauuuuugguagagacaggguuucaccauguuggucaggcuguucuugaacuucugaccucaggugauccaccugccucccccucccaaagugcugcaauuacaggcaugagccacugcacccgaccagcacuuaguuuuaaauauggaccucagaauuugaggccuuucagcaucugaugcucuuuuagcaucaugcaucugccgguuagauacauuagucauguaucagguauauggcuuaguauucuacugacugcuuuuuagaaauggaagugauagucccuucuuagaguagugugauauguugaguuaggaugauagaccaugugugauauucagauuagaagaucauuuagaccagaccuguagcaguggguagggugacagaucaaugaaaaaccugaguaaaaaauuuaaaaacauauucuauauccuaauaguacuuaaauaguaauauacagcuuuuggaauacauuuuuaaaauuguauguauaucuugauacguuaaagcauuugauaaugccagaggaaauacuuucauguaagcaguaaugcuucugugaaguuuuuauaguuuuaauuagaaugaguaacauuucucuaaacacguuuaaccaugcagacugaucuuggucagucguccauuuuugauuugcuuuaacauuagauauagaaauguaugaaaauguaugaaaauucuuaaauugggaaaugucuuuuguuuuagaauauaaaauaacuaagcucucaauuaguuuuuaacacagacuggaaugagaaaacauuuccuuagaguucguuauaaaacuaaaucaacuuauuuuuauucugaagucuugaauucauuuuaucguaaaguggagugaggcacauaauagaguaaaaccucuagagucagccuagcuggcuucuuauugcagcccuacuaguccuuguggggaagguuacggaauaucucugaaucuuacuuucaucauaaguaacaugagggugcuaagagcacacuucaucgaauuacagugaggaucacaucugcccaguacaugaaagguagggcuuuaguguuuugaugaagaagaaauugccacuguucuucucuggaagagaaaacuguuaagcaccuaauacaguuuuuaauuaauauuaauaauuucuaaacgcucaucacuugauacuuguguacccuguuuugacagguucccuuuuaugggccaggugguaacuggaacacagaacagugaaggacagaaccuuggaccacaggccauuccucagguaacacugccuguaaugagucccucuagaaugcacgcuuuucuguuucccagcaaacucaugcuuuagaguaaguccccugcuagagaguaguacuagguuugugcagaaguaaaugcggauuucaccauaugccauuugccaguggcaaaaaccgcaauuacuuuuucaccaaccuaaauaguagccuuaucuaucagcacagccaaaaguaaccaaaaagacacuuuacugcuuuuuaaacaaaagacaaauuaagguuaaaaaaauuggcugugauuucugaaaaggauuuauauacuuacggguaaaaagucacuugauggcaaaaccacacgcucaggacuuuugguuuuauuuuuauuuacuuauuuuuaacuccagaaggacauuuucauguccugcauuuuagaauuaaacccauuauauuuaaaauguaaaacuucuauaaauacuagaaaauggcugggcacgguggcucacuccucuaaucccagcacuuugggaggccgagaugggcaaauuaugaagucagcaguuugagaccagccugaccaacguagugaaaccccgucucuacaaaaaauacaaaaauuagucaggcgugguggcgcacaccuauagucccagcuacuugggagacugaggcaggagaaucgcuugaacccgggaggcagagguugcagugagccgagaucacgccacugcacuccagcuugggugacagagcgagacuucaucucaaacaaacaaacacagcaaguagaaaacaauaugcuauauuuguuuuuuccuuuuuucuucccauccuuguugaaagauaugcuauauuuuuaauauaauaucaagcaguaucuggggaaguaaaacucaugcaguauuuuugucagugauuuuuuuuuuauaaagggagcuaccuacuauaauguauguccuguuuucuuccuugcccugccaguuaugcuuuagauuuauuaugcugauaauuauauucuucucauuauuaaaagaggaaacagaagccauuugauauaaugggaaaagcauagccuuuauagcugaguuuuuuuaaagaaauuauaguuccacuaugaauuuacugugcaacuuugggcaaauucuuuagccucuuguuuuuuaauaugucaaauguuaaaccaacugcuuuguaguauugugaagauugcacauaauacauucuggcugcuaguauaaguuuauaauuauuaccuuguauacagcucauguuaaggagaacuugugacaacuggauaaacauuuuucaacauuaauuuguuaggugauuaucagggacuugugagauuaauaacugcuuguucagucaccuggaagaaauaagacuuuuaacuugaaaauaaaacgaauuaaauacuuuuuauuuauuuuuuuuauuuuuuugggaacaggauccugcuguguugcccaggcuggccucaaacaccugggcucaagcgauccuaccaccucagccucccaaguagccgggacuacaggcguguguagaaaauaagacuaauauuuuuauuaacguauuuuucuuuuauauuugugcauguuagagacauuaguuuuuguuauaaauaaccaugcuguggaguggcauuuagucaaucuggaacuuguguuugauugaagaagaaaccagguaaacuucaucaaaaagugagauuuuuuauauagaucucucgcuuaguauuagcaguaauugauuugcccuguauuauauuucugaugaauaauccuuuaccucaagcauaauuguuuucagccaaaaucuagacaguauaguaguucagagauaguaauaagaauucagaauuagguugccaccacuaaauucacucuacuuuuuauaaaaaaaccuuuaaaagauaucuuaggaaauuaaaggguuuuuucuuccauuucuuuuuuucuuucuuucuuuuaaaguuuuuuccccccuuuaacugaaauguggaauaaacauauuuguaaauuuuacuuauuuuaggauggcaguauaacacaucagauuucuaggccuaauccuccaaauuuugguccaggcuuugucaguaaguauaaaucuaauaaguuaauguuuucuggggauugcuugucugcacucuaugugugcuguucuaaaccugaagugaguguagguacaccaguucaagcccaggugcccuccugucuuauuaaacaucacugcccuauuaggcaacucuucuucaaggcguguguuuucauugcuuuuuucacugugcaugaagaauuauaguuacagaaaaguauuuuaauacagaaaaaccaucuuccccauucucuucaauauuguugcuguuuuuguauacagauugggcacuuuacagucuauagaacuaaaccacguuuugcucuaagaacugucuuccuaagugacaaggacacuaaaugggaaaaacaaagggauuauacuuagcaguaaguuggguuagcagcaugguguaaaggucagguaugcaaggugccccugaauccuuucuaguuauuugcaggggucccaaggugguucaggauaguguuuaaaguucuccccaaacugaaccuuucugaaaucuucagacuguuuagcuaacuuuuuuuucaccauuauuuuucauuuugcucaccucugcucuccugguuccagaaaccagaaaggcuuuccuugcgguaggucucauucuaccagaagcagaacuucugaaaucuugugaaaaagccuguucuuaaaaaaugcccuucaaauuuaguagacuagauuucaaguucauacauguacuggaacuucuggguuuaggaacaaacccaaagucugaccuuuugaaauucccccuacauuaauuguuacuauaauuugaauacauauuugcauuaaaaacaaguaaagaacuauaccaacuggcuuuuucuggcuuuauugugcccauuggcuuugguuggauucuuaauguaugacaauauucuguuaucauugauguuauuuucagcgaauguccuucuuagaaauguauuuauucauuucuuugucuuguagugagucaaaaagguauauucagaauuucacuacauacgaugacuuuuuuuuuuuccccuuggacuggguaucaaugaaguaaagugcccuuaaagaauaaagaagagaauauugguacaaaaugaagagauauagccauuuggggagaauuacuggcaguuguaaaaguagaaaauguuuugcuugguuaacuauucccuccccuuauuuuaaaaaauauaacuacagaauaauaauuaccaauguuuucaacuuauggauuuccuuuauaagucauagacuuuaaauuauuccauucuaaaacauucuggguuccuuuucucucuguuuaggauauuuuuucauuauuaagaaauaggaaagaacuuauaaacucaggaaaauuaacaugggaagugauuuccuagucuaugcgcuagaccuuaaugggauaugucuuugucucuucaaaaucuguaaaaucguauucauaaaaugcauguauaccuuaguauguaguuuggcuuguggguuagagaauuuguuuaguaaaaaaaaagaauuucauuacauaagucugcuuuuccaagauuggauuuguaauauuuauaagugcuaaguuaaccaguaucucaagaaugugcauucucuggcuuucucaauuaaauauuuuucuaaaaucugauauuuuaucauuacauaaucgucuaauauuuaguauuguguuuucaaauuuccuauuauguggucauggugaaacuacuuccuuacaaaauagauuuguguaacuuauaauguuggacucuuuagaaaauuaacacaacugaauuuuaauuuuuccucagaugauucacagcguaagcaguaugaagaguggcuccaggagacccaacagcugcuucaaaugcagcagaaguaucuugaagaacaaauuggugcucacagaaaaucuaagaaggcccuuucagcuaaacaacguacugccaagaaagcugggcgugaauuuccagaggaagaugcagaacaacucaagcauguuacugaacagcaaagcaugguucagaaacagcuagaacagguaauaaauagguuugcaaaauagaaacuaccaacaauuaaugaguagaauguuuugguguguuguucauuagugacuuugacuagugauuuuuuuugacuaguauuaaauggcauuaaaaguacauugccaaaaagugacagcucugagaccucuuaguaacugcagccauaacagcuccagucuuuuacuuaaagugacggucacagcacauacuaaauaaaugacacaaaagagauugagucucauaauuucgacuucgaagaacuauuuucaacuuugguauaguuggagacguuauuuuuuucugcacuaagaaaucacugcaaagaccauguuucuguuauacaucauugagaguauucgacuuaacugaggaccgagcucauggggagauacuggguuuaguuuggaauaagaauugggggcccagggaguauuuuuguuuacuuggaguugauauuauuauuauuucuuaauguuuuggucuuaaaauacauugguaugucuuaugugaaguacuguuccagaaaaaugaaaucauuuugccauuaucuucuauuauaaaccagaaguuuaucagaauauuuaaacugaauaauauacuggaaaagaagaaacauguaaaaauuguauuuaaaauaaaacaauaguaguguacaaaauggguucagagccaacuccuagguauauuuacccaaguaaauuaaaaacuuaagguucaggccaggcguggugguucauaccuguaauuccagcacuuugggaggccgagguggguggaucacuugaggucaggaguuugagaccagccuggccaacauggugaaaccccgucucuacuaaaaauacaaaaauuagcuaaguaugguggugugugccuguaaucccagcuauuugggaggcugaggcaggagaaucccugcaccaaggagucagagguuguggugagccgagcuugcgccacuguacuccagccuggcgacaaagugagacuccaucucaaaaaaaaaaaaaaaaaaugugagugcucuauaaugaacacuguaggaagcacuuccauuuacguugucuuaucuacaucuuucugaaggaguuaguauuauccccauuuuacaaacugauucauuguaaagguuauaaacacuguguacacguggccaggcacgguggcucacgccuguaaucccagcacuuugggaagccaagacaggcggaucaccugaggccaggaguucgagaccagcuggccaacguggcaaaacucgucucuacuaaaaauacaagaaguuagccaggcaugguggcaggugccuguaaucccagcugcuugggagguugaggcaggagaauugcuugaauccgggagguggaggcugcagugagcugagauugcaccauugcacuccagccugggcaacaagagcaaaacucuugucucaaaaacaaaacaaaacaaaaaaaaucccaaaaaauacccccacuguacauguuugcuuauaacuauuagauuagggauuuggacucacgugucuuaucuucaaaccacagcuaccacaauaauguaccaacaauaaggugaucauaauuccaguuguuuaaaacuaggauuauuccagaaugaaagguuucuuuucucuuuaaaucuacucucuggguucauguuuacuguagguuaauauucuuguaaagauauguuuaauaaaguauauuuuuuuuagcacuuucauugccaucuggcauauuuguacaaggucuuuugaugagggccuaauuuuugcauauccauagaucaaauccuauuuagaagcuaauacuugaaaaaugggauacaucaucuauuacauaguugccaaagauccaguauaaucauauuaagauaagcaguugaugguaauguuuuaaaaaguauuauaaaauaucaugggaaagacauggaugaccaccuuauauaucccacauaguguuguaggugcuuucuguacuuucuuacuacuucaccaaccaaugguaauuucucaguucuaaccaguaaacuggccaggaaaaauaagaaaauaggaguuacacaacuguugaagaagagaugaaacacgauuauuugcagaaaguauuagucuaccuggggaacccaagaaaauacuuugaaaaacuauuagaacuccugaguuuaguauauuaauauuuaucuaaaaauugaaugauguugagagauauacacauccuuuugcauuccuucuuucccuagcuugcugaaugagauggugagguucuccagaacauaguuugcgucuugauugauaucuggccuguaguauugagcacauugggacacaaagguuuuuggaaugaauuaauuaauugauauuagccauuauauuaagagucuauuuacagacuauucaaaauacuuccucggagcuuguauagauuucagaaauuauaauuugaguguuagccauuaaauugaaaguguucaacaaauuuagucuuuuuaaucuggguggggggugugauauucgugcugguaauucaucuugucuuaaaauguuguacaggccgggcgcaguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaauguuguacaauuuauauauuuaagaaaugaaaucuuaacauuuaaaugguucaaguuugaguuaagucuguuauucuaacauuguauauuguaauuucuaggacaucaaaauuagcugcuuguguaaccuuuuuuauuguauauuuuuuauguauaguauaaauaguauauaugaguuucaccauaagauuuuaauauuuuacuaaaccguuuuugauauuucauaugugaagcacuuuuacagauaacuuuauaaaaauccuguuguuaaagagauugacaguuguuaguuaaggcuuaucaauucaauuuuuuugugacuuuugcaguuacccaagcaaaauauguuugcuucugcagggccaaacugcccucuguguaaccucaaccacagucaucagccaguguuuuacuucaguaccuaugcuguauagaaaugaguaaugaugcauuuuguuauuccagauucguaaacaacagaaagaacaugcugaauugauugaagauuaucggaucaaacagcagcagcaaugugcaauggccccaccuaccaugaugcccaguguccagccccagccaccccuaauuccaggugccacuccacccaccaugagccaacccaccuuucccauggugccacagcagcuucagcaccagcagcacacaacaguuauuucuggccauacuagcccuguuagaaugcccaguuuaccuggauggcaacccaacagugcuccugcccaccugccccucaauccuccuagaauucagcccccaauugcccaguuaccaauaaaaacuuguacaccagccccagggacagucucaaaugcaaauccacagaguggaccaccaccucggguagaauuugaugacaacaaucccuuuagugaaaguuuucaagaacgggaacguaaggaacguuuacgagaacagcaagagagacaacggauccaacucaugcaggagguagauagacaaagagcuuugcagcagaggauggaaauggagcagcaugguauggugggcucugagauaaguaguaguaggacaucugugucccagauucccuucuacaguuccgacuuaccuugugauuuuaugcaaccucuaggaccccuucagcagucuccacaacaccaacagcaaauggggcagguuuuacagcagcagaauauacaacaaggaucaauuaauucacccuccacccaaacuuucaugcagacuaaugagcgaaggcagguaggcccuccuucauuuguuccugauucaccaucaaucccuguuggaagcccaaauuuuucuucugugaagcagggacauggaaaucuuucugggaccagcuuccagcaguccccagugaggccuucuuuuacaccugcuuuaccagcagcaccuccaguagcuaauagcagucucccauguggccaagauucuacuauaacccauggacacaguuauccgggaucaacccaaucgcucauucaguuguauucugauauaaucccagaggaaaaagggaaaaagaaaagaacaagaaagaagaaaagagaugaugaugcagaauccaccaaggcuccaucaacuccccauucagauauaacugccccaccgacuccaggcaucucagaaacuaccucuacuccugcagugagcacacccagugagcuuccucaacaagccgaccaagagucgguggaaccagucggcccauccacucccaauauggcagcaggccagcuauguacagaauuagagaacaaacugcccaauagugauuucucacaagcaacuccaaaucaacagacguaugcaaauucagaaguagacaagcucuccauggaaaccccugccaaaacagaagagauaaaacuggaaaaggcugagacagaguccugcccaggccaagaggagccuaaauuggaggaacagaaugguaguaagguagaaggaaacgcuguagccuguccugucuccucagcacagaguccuccccauucugcuggggccccugcugccaaaggagacucagggaaugaacuucugaaacacuuguugaaaaauaaaaagucaucuucucuuuugaaucaaaaaccugagggcaguauuuguucagaagaugacuguacaaaggauaauaaacuaguugagaagcagaacccagcugaaggacugguaaguguaaaucauaaaaacgacaacuuuuuucuuuuguuuuaaauuauacuuacagcagauuaguaccagcaacuguauuuccacauuauucuacaaccuuuuuauucuaaaggaccauuuuuuauuuugucauuucuaccucucuggaacccauguuuuuacuuauaucuaaacuauauuaaauaauaauuuguuuacuauuuuuuaaaaagcaaaggcauguauugcauuucauauauaacgugauguguagcaacugguuauuaccacauugaguugauaugacuaaagcaaaguaaguaaaugucuauguacuuuauuguaaauaagugauuaauuuccauuaaccucuuuaaaaugcagaggauagcccaugcaccccuauuaauacccuuggcacucuuagggauaccacacugggaagcuauugugugguuacaguguuguauugauacuuaauguaauguuacauguagauacuguuuuguaguuuuccauguaucaauuuucuaucaguuuuaaguuauuaacauuuaauuugcuuuuuuuuucauuuacaugaagagcuaacuuguaaauauaccuuuacaagaaucuguccccuuuauuucaguuaacuucauuaagauaguuccaaaacuggaguuugagucaugggaauuggucugcuuaauagcucuugccuguuuaucuuucagaaggugcagugccauuaccagugcauucauaaagcugucccuagagagcuucucaaauuggauuucauuuucauauuuuaauuaaggguugagugguauauuuaguuguccaguuuuuucauuuuaagauuguuaaugaagcucaucuuuuugcaaguguugcuuuuuuucuugucuuugaccauucaguagagauugaguguugacuugauagauuuguguaauuuuuguaaauuuuacugguuaugcuuuuacaguugucaccaguaaauauaggcaacucuccagcacagucuccauccacuuucuccaagacaucuuauacccugaggaguacugaauaacuugcagccuucugucuuuuuacccuucuauguauaccacaugcugcugcuucugccuguucuguucucccuucuuauauacgucuggacaauauauuuuuaucuuuugaaaugcaguucuugagucaucuuuuuccagauaccuuucucaccucucccaaucucaaauauguguugaugcucguguucucacauagcgauuucuguuguaccacuuaacauuauuuaaauagcuccuugaaggacguagacuacauuuugagcauguuuauauuaaaauuuguggguguaagaauguuuaauggcauggggaacaaccacgucaaguuuaaaaaguagccccuccccccaaauuaaagugugauuuaaauaaauauauagugauuuaaauauauauaaauauauacaucuauauauaaauauauauauaaauauaaauauauaaauauauauauauaauuaauuuuuagguucuugccacucagagugcaguccuuggggauccgcagcauccacaucaggugggagcuuuguaacacaugcagaaucucccgccacacaccugcuucucagaauguagacuuaggaagauccccaggugauuccugagcaucugaaggggagaaguacugcucuaggcaggugauucucaaagcuaaagugugaggagcaccaggagggcuuguuaaaccaagauugcugggcuccagccccgguauuucugauucugcaggucugggugggaccagauaaucugcauuucuagaccagcucuagaugcugcugccgcccuggagaccccuugagagccacagaacuagccuggagaugagcagucuaagccugcuuucgccucccuccaugagcuaaaaauggcuuuuacauuuuuaaaugguugaaaaaaaaucuaaggaagaguaguauuuugugacacauaaaaauuauacaaaauucaaauuuguccgugaauuuuaaaaguuuuauuugaacgcagccaagcucauugauuuaugaauuguuuauggcugcuuuugaaguacaagggcagaguugaguaauuaugccaggggcuguauggccuacagaggcuuacaauauuuaucaucuggcucuuuacauaaaaauguugccauccaugcgcuaaacuauuuagaauauaacuggaaacuaauuuucagaaccgucagagauucaaugcagaauucauuacaguaaguucagcuacuauaaucgucuauagcagaguacugcuguuaaauuuagaaauaauggagccugaaaauauuccuguguuuuaagguacugauaggacuacccuuaaaggccuuuucagggcuuggcuuauucucacuuuguaaugauaaaaauaaagaaaagguuuauuuguuaucaucuacguucucucccauugacuuuaaguauguggccauuauuuuucagucaaauacgguugugaacuaauuugaagaaccaguguuuuuucuuuuuauuguugucuggugcuaucuguucucucaccuaagaugcauaggcuguaaagcuuuucuggagccugugaauuguuucagcacaccucauauuucacuaguuccuaaggggaaccaaaaauaacucaccaagaccacuaugcagaggcuccuauagccaucuacaagcauuuccuucccuucugcaguaaguaagcaggaauaagggguuccccagccccagggaggucagcaugagggguaaugcuuugccagaaagggcuguggccuuacuaaugaguucugcucuuuccucaagcuucgcagcuuacugauuuccauacucgagaauaacguuugaagaaaaggaugguguuuuuggaaaaccagcauugacaccacucuaucuucccuacuuauuuaauaccuuuuagugccauguuaggaugacgcgucauagcuuggcacugcaugaacuaaaaaccaaauaugcaaauuguucacuuauuuuuuacccuuuccaauuacauuagcaaacuuugggggcucaaaugcaaggugguuuuggauguggcaaccaguugccaaaaacagauggaggaagugaaaccaagaaacagcgaagcaaacggacucagaggacgggugagaaagcagcaccucgcucaaagaaaaggaaaaaggacgaagaggagaaacaagcuauguacucuagcacugacacguuuacccacuugaaacaggugagggugagucauuuagagcagccucuuuuaaaagucaaggauauaggcugggggcaguggcucaugccuguaaucccagcacuuugggaggcugaggcagguggaucacuugaggcaugaguucuagaugagcuuagccaacauggcaaaaccucaucucuacgaaaaauacaaacauuuacugggcguggugguacacgccuguaauuccagcuacuugggaggcugaggcacgagaauugcuugagccuggauggcagagguugcagugagccgagauugugccacugcacuccagccugggugacagaaugagacugugucucaaaaaaaaaaacaaaaaaaaaacaaacaauucaaggacacgagagaucaaaugcuaaaagacaucuggacaaggaaccuaguagacuuuuuccaagcagaauugcaccguauccuauuggcaucugaaauuuacgguaauacaaauggauugauaggugauagucaagauuuucuuauguucauaaggaguagccucaguaccaagaaaaaaaucuguccucaguacuuuguugugacucugaauccaaagaaacacauugugaauucuguucuacaccuuugugguuguuacagaaggugggagacaguugcuaacagugcuguuggugguacccagccucaguugaugccccaguuuuugcugagcauagauaagaaauauguuuuucuuguuagaugccuggcagcauucauuuaguacagagcuuauuuuuaagucucaaaggucuguagucucucucacuuacuccagcauuuugauacuugaaaauuuuaagucucauuuuucugaagccuuauucaacaaaguugcuucgggucuuagaaaguugagcuacacugaguuccuuuuaucauguacauuacucuuaaauguguuuuuuaauagcagcucucucugcucccucuaauggaaccaaucauuggagugaacuuugcgcacuuucuuccuuauggcaguggccaauuuaauagugggaaucgacuucuaggaacuuuuggcagugcuacccuggaagggguuucggacuacuauucucaguugaucuacaagguauguuucucugccaagguguugucuugcuucaucuuuggguaacaugucagaauugauagagcuugucuuauuuuuguauuuaguuuacaucuacucuuccaaguuuuauuaaaacuuaaguucagcuacaggguuaaaauuuuaccuggugaaguauuucuagcauaaacauuugaaguuguuuuuauagguaagaauacaaauugcaagaaauaucuauuauguacuuccaugguaguggaaauccuuauuuccuuauaaccuuuauuaacacuuaaaaugaauucaaaaaucauuguaaaugguggggauuuaaaaaaaguaguaguuuaccuugaaaaaugaaauuaaacaauuuuaaguauaucuaauaauuuagguauuaauuacaaguaauuccuagacuauuguagguuuuuuuuuuuuuuuugagacagggucucgcucugucacccaggccagauugcaguggugcaaucucagcucccugcaaucucugccucccaaauucaagcaauucuagugccucaaccuaccaaguagcugggacuacaggcaugcaccaccacacccugaggucaaggcugcagugagcaugauugugccauugcccucuaccucuagcuugggugacagagcaagucucugucuccaaaaagaaaaaaaaaaaacuaucuuaacucauaagcuguucuccaaccuuauuuuaucauccucaugaaauucuuuaucuuugcaaaauuuguaauuugacuuugcacuugauuugcaugguguuauugguagauuccaagucucuccuugagagacuaaucaguaaaugacaaauuggugauaacuguuaagcugggagaggugucugaagaggaacuacauuaaugauuuaguuacuuuaguaguagcauuaguacuguugcuucuuuuaaaggucuuagucaauccagauucucauaucucggaugugaguuguauuacaaguuuaagaccagaaauucuuaaguuuuucauagaacuagggcauaucuuaaugagaacuuaaaggauauuuugauaauauuuugcaauuucuugauugcauuuuaaaguuauccuucacuagcuauaaccacgaaacuugaagaauugcauaaauaaaaucagguagaaaggaaauuagcuucuuaauuucagagcuuaaguagucaagcuggguaaaguaagcaaguugguauguccauaaaaucacgaguaucuguuccacuaagaagccuccuggccuuguagguauuguuuucuuggugugcaagauacaucuugauuacauuucuguagccuugcuucuaugugcaaaaaauucacagaacuacguuuuagcaaggucauugcauauucgcucaguagcauauaauuuaaauuuuuuggucuccugcagcagaauaauuuaaguaauccuccaacacccccugccucucuuccuccuacaccaccuccuauggcuugucagaagauggccaaugguuuugcaacaacugaagaacuugcuggaaaagccggaguguuagugagccaugaagguaugauuauagccuccaaauuucacaccucggagaaaugugccucugccaguuguguauugugaaauggcaauagaauuguaaaguucuacccauuuaucaauauugacugaauguauuuaugguuuuguguuuuugcuuuuccaguuaccaaaacucuaggaccuaaaccauuucagcugcccuucagaccccaggacgacuuguuggcccgagcucuugcucagggccccaagacaguugaugugccagccucccucccaacaccaccucauaacaaucaggaagaauuaagguacagguuauuuuuuucucaaauaauucuuaguuauuucuucuuuuaaaaaaaauaaauguauguauguggcauaaugucuuuaggaauagcauguaaaaacauuugaagaguacaauuuggugaauaaucuucaggauuuaaaguuuauaagacauuguuaccauuaaacauaauuaguuugcauuuuuuuaagccuacaucauauagagaguuaaauaaucuaauagacaguuaaguauuagauuauuuaaucuaauuaaauaaucuaauagacaugaagguaguggaaaaucuccaugcaacauauuucagaaaucauuguccuuuaaaggguauuaaugugauuuauuggguuuauuguuguuuguagaugucuaaaaugaaagagcagaaguugcuauaucagagaacgccgucguggaagagaguuuaagaacugucugggguuugaugucuuugugucaguucuuuaacuguaagauucuaauuggggagaaucaaguucccuuaguagaugaucgcuagccaacucuuuagauccagaggguucuuacaacuucaucaaauaauuaucucuucuuuggaaaaucugcccacuacccucuauuugaugagacauuuauuuaaccuaagucccuuacuuuauuaauggggaaacuuuggaccgaaguggagaauaaucugucccaauugaggauccagguccucuuucuacuguaccucaguaggccagccuuucuugggucuccugcaugacagcuacuucucugcgugaggagugggagacagcaguuccacaggguuguggaacuuagucugagaccucacaauuggccugguagacucaaacuugaacucaacagaagggaccagucuuuuguuuuucucaccucacuuuaucaguuaagaaaaauaagggccgaucaagucaauggcuaaguuuucucccaucuugccaguguaaagagcagcaguaggacagcuguuuucccagucaggugaaugcaggugugaccauugcauauguguuggacuucucuuuccuuuuuuuuuugucuuuuuaaaguuuuccuuuuuuauuguuaaauccaaccagcagcucuuuccuuuucaagcugcaggagugcugcccuaggcucaacgaucugggauuuugaaaaggugcuuucaugcucucuauguuacaugcuaaucagaacaucuuccucuuuggcaggucuucaaacuuuggugcugaagcuuucguuaaaaggaaacauaccauuuaaauuauuuuguaacuaaauauuguucuuguauuuuuuucccaguguggcucugagcugauucauuugcugcucaucguauaggugcugcccagaguauccuuacagcuguauucacagaugucagcaggguugguacaggaagcccccagugguggauuugcagacuuugauguguguguuuauguuuuuucaggauacaggaucacuguggugaucgagauacuccugacaguuuuguucccucauccucuccugagagugugguugggguagaagugagcagguauccagaucugucauuggucaaggaggagccuccagaaccggugccgucccccaucauuccaauucuuccuagcacugcugggaaaaguaagaacaacacuuaaccuuauuauuucccuuuacacuacgccaauuuacuaauguaaauauuuugauuuugaaaauccauuaacacuauuuuccucuuuuuuuucucucuuuuuaaagguucagaaucaagaaggaaugacaucaaaacugagccaggcacuuuauauuuugcgucaccuuuugguccuuccccaaauggucccagaucaggucuuauaucuguagcaauuacucugcauccuacagcugcugagguaaaagauuaaaugacuucuuaauguuaaacaguauguccccaauuuucaaagaugggucaggugucuaccauaaaacacacacaaacaggaucacugaggauaaagggucagagagcagagcugaugcucacugcagaccucucagcugccuuugagugccaucguuugucauugaauuggucucagccuacgucaaguaaaaagggaaauuagagcucacauuuucuuauuaaaggauguauacuuuagagaacucuuuuuuuuuuuuuuuuuuuaauagagacacagucuccuucuguugcccaggcuggagugcaguggcacagucauagcucacugcagccucaaacuuacugggcucaaguaauccuucugcuuuagccuccucaguagcugggacuacaugugugagccaucauguccaucucagaaaaaacuucuuuguaacuguuaacagagaagaaaauuaagcaaugaaaaagaacuuuaucaacaguaauaguuuugcagaagcaauagaaauguucuucaaguagcaucugcuuauaucaaacauaaguaauuuccugaggauuuuuuauuuuuuuaacucugaauucugugaagacauuucaguagagaccaaacuagaaguccaaugaugugauauuuugguuaucaacaaaauacagcaguagcaagaccuuugucuguucuuacggguugugucagagcuggagggaagccccuggaaguaagcuuucugaccaccuguaggaacugacggggucugucagauguuacaauaucuaaaauaguuuaauguguuacuagauauuuaauguuaauuggaaucccuuuaugaggauuucuguuuauaaauuucuuuuuuuggauauuaguucguuagagcuaauuuuuuuccugagguucuuuaagucuaaauaaaauuuguuggauuuucuuagaaucuauguaucaugcaaagaggauuuauccuaaguguguauuuuucuucagugguucacuguugccuucugggugaauaauacagcauuugcauuugguuuuagaacauuagcaguguuguggcugcauuuuccgaccuucuucacguccgaaucccuaacagcuaugagguuagcagugcuccagaugucccauccauggguuuggucaguagccacagaaucaacccggguuuggaguaucgacagcauuuacuucuccgugggccuccgccaggaucugcaaacccucccagauuagugagcucuuaccggcugaagcagccuaauguaccauuuccuccaacaagcaauggugagcuagugagcuuuuuguuaaccccaaauccauuccugauucaaaaguuaagcuuacucuuugagauacugauuaucuuuuaacaacggacagguaacaugcuggcguauaguccuuggugaacuuaccauguguggguguucuguuuucugugcugugauuuugaccucuagugcuuuggccuguguauucugucaugcugucaccaggggcuaugugagugccagccaucugugcaggcugccagaagaagccugugacgggcuugcccuugagcagcuuuuguucuuccugucucccaacccccaucccgcugcaccugggccaccugguacagauggggcuggugaccugacguggguucuguuuccuguucuccucugcuuuccauccucaccuaccucuuguuuuaccucugcaccagcucuauagggcccuucucuucccacagagguguucaugccccccaucucugagaauggaacaacuuccuuagaccgaccaugaugucgcuuuccuuccugccucacuggcaaucuuacaggcgugcucaguccaggcccuggcuuccuccucuuggcuucuagcuguucugucacuuuuucccugcuccuuuuugccuucacacugcaccugaaugaugcuuucuaauuccugaguccuuauuuaccuucuuauccuuggccuuggcucuuuccucauuucugacucugcaagucacacuuauuuaagacucuuauacauaugucauuguaucuuucauaaaauguuuuuuuaccaucuuaaccugcaagcaaaaguaauaucuguuucccucucugucuuacuuuguacuuagacugaauaguaaucucucuuggugacuuaguuuuauuagauucuucuuuuauacugccauugcuuucccagcuauuugagaauaggcauguuucuuuauuuuugcccuagugucagauaaucgacucuguaaccauugcuuagaagauaaauuuuuuuuauuaauuaaagaauaauguuaaugaaccauguuguaaugaguugauacugcauaauuuuucaccaugugccaccuugugucaucagucaguuuuaauuacuaacaaaaguugauugccuuuaggucuuucuggauauaaggauucuagucaugguauugcagaaagcgcagcacucagaccacagugguguugucauuguaaagugguuauucuuggaaguggugugcggaaaucuuucaaagaucugacccuuuugaacaagguacuuugcuacuccuuuuaugaccccaccuccuaccuccagcgaaaauguccuuggcagugucucuuccaacaucagagagagacaccacuuaugguggugugauggacacauguuccuggugauggcaccagcguauaucagaugugcuugggcugaacaccaaagagcuacaacaggcuguuaaagggaauauuaugaggacuacguauuuuuaaauagagugaaccguggaccacauaguuugguuuuauacauguauuuuuucccuagcuaaauuaucacaugcuaaauauuggaacauaguuuccuuucuacuauuaagauaaagaaccacugucacuuuugaauauaacauaaaaauaauguauagauccuguuuuuauuaaauuuugacuuguugagauucccacacauuucucuuugcuuuucaggauucccgagaaagcaccaagaggguagagaaggacauugucuucuguaguaauaacugcuuuauucuuuauucaucaacugcacaagcgaaaaacucagaaaacaaggugagauuaggauaaucucagcugauaacaauguguaacgagugacuucuguguucugggcauaugggagugaauaaagaugugucccugccuucauggagcucuguguggggaauccaaagcaggugcugacccggcagaggaggagaggguguagggagccuugagucgugcuacucuuucaacuuaguuauuugacagaagugggcagaguuauguuuuaaaaguucaguaaacagaacacuaauauuaaaaucuuuaauuuuaccaguuuaauuuuuuuuugagauggagucucauucuggucccacaggcugaagggcauuggcaccucuuggcucacugcagacucugccucccaauucaagcaauucuccugccuuagccuccugaguagcugggauuacaggugcgugccaccacgcccagcuaauuuuuguaguuuaguagagaugggguuucaccauguuggccaggcuggucucaaacuccugaccucgugauccgcccaccucagccucucaaagugcugggauuacaggugugagccacugcgcccggccguaaauaucuuaauauuuuaaaaucauuuuuauugauguuaccccaauaggaaaaccuguuuaaagauaaaauuuaagacuauuugugcauuuuaagagaaaacacuuugcucacaguauggugaaagaggucugcuuuacuugauuuuauguaauuugaguguguccaacuaaugguugauacaaaugauauguuuauaaucauguuuugaaggaagcuuuuccuguacaguaauacugccagucauuccuccauccagguuauugcucugguaugucuuucacagaagaacauucugaagacuuauuuuuaacagguaguuguuuguaguaugccuguaauaaaaucuaggcuagaugacaaauaaauuuagaucuuaaaauacaucagccuaaaugcaagaaggauuuuuuuuuucaccagauaguuuaaguuggugugcagucccugccugauuugguauaaggcaugucuuuuuucagauaccuugucaggauuggggcaugugaaaagagggcagccuguggguugguguuuauuaguuuaugauacucuguaccauaaaguaaauaagcuauuggagauuuccccucagcucaacuguuucagcagccggaucagagcugagaagccucagagaaaaguuaguaugauucauuuguugacaggggcuccuucccuuucuguaacauuuacaccaauugauuaaggcugagauuaacagaugugaauuuuagaguggagauaagcucucaagaaacgaugcugcagcguucuuauuugguuaaacaaaaaacacuguuccauuguacaaauuauauuagcucuucugacagcauugugaguguguguguguuuuuucuuuuucugguuuuaauauaguuagaaaggggauugucccagaaaguguaagagcagaauauucuccagaauuauggcuuuguggaaaaggccucgaaaggacgcggcacagcugccaucacccgcucucuaucccugugcaccuuagagcauggucagcuucugcggugcaugagcccccagcacuuacugcugacucucccucugccccucaggucacccauccucuucagucauacugcucagcuucuugucuuaacaagaauugcuuuccgggcuugugaauuauuuuucuuugucaugguuucuuuauguugcccaggaauccauuccuucauugccacaaucaccuaugagagaaacgccuuccaaagcauuucaucaguacagcaacaacaucuccacuuuggaugugcacugucucccccagcucccagagaaagcuucucccccugccucaccacccaucgccuucccuccugcuuuugaagcagcccaagucgaggccaagccagaugagcugaaggugacagucaagcugaagccucggcuaagagcuguccaugguggguuugaagauugcaggccgcucaauaaaaaauggagaggaaugaaauggaagaaguggagcauucauauuguaaucccuaaggggacauuuaaaccaccuugugaggaugaaauagaugaauuucuaaagaaauugggcacuucccuuaaaccugauccugugcccaaagacuaucggaaauguugcuuuugucaugaagaaggugauggauugacagauggaccagcaaggcuacucaaccuugacuuggaucuguggguccacuugaacugcgcucugugguccacggaggucuaugagacucaggcuggugccuuaauaaauguggagcuagcucugaggagaggccuacaaaugaaaugugucuucugucacaagacgggugccacuaguggaugccacagauuucgaugcaccaacauuuaucacuucacuugcgccauuaaagcacaaugcauguuuuuuaaggacaaaacuaugcuuugccccaugcacaaaccaaagggaauucaugagcaagaauuaaguuacuuugcagucuucaggagggucuauguucagcgugaugaggugcgacagauugcuagcaucgugcaacgaggagaacgggaccauaccuuucgcguggguagccucaucuuccacacaauuggucagcugcuuccacagcagaugcaagcauuccauucuccuaaagcacucuucccugugggcuaugaagccagccggcuguacuggagcacucgcuaugccaauaggcgcugccgcuaccugugcuccauugaggagaaggaugggcgcccaguguuugucaucaggauuguggaacaaggccaugaagaccugguucuaagugacaucucaccuaaagguaacgucugccguucacaugcugugcagugcuacuuacucugaugucaggcuaaugaauguauuuugucaauuuuccauguuugucucauguuaguuuuauauuuuauaauguguauuuuucauuuacaaaugccaauguuuguguucucacaccuugcucucuuugcuauacaguugucuaaacacuuucauaaucaauauaucuuugaacauacgaguuggugagguaaauccgagaaugauuuguagauaaagguugccugucauuugcauuggggaccuccuuuuucuuuuucuuuuucuuuuuuuuuuuuuuuuuuuuugagacggaguuucucuuuuguugcacaggcuggacugcaauggcgcgaucucaguucccugcaaccuccgccuccuggguucaagugauucuccugccucagccucccgaguagcugggauuacaggcuugcgcuaccaugcccggcuaauuuuuauauuuuuaguaguuuuuaauuuuguauuuuuaguauuuuaggguuucagcauguuggccaggcugggcucaaacuccugaccucaggugauccaccugccucagccacccaaagugcugggauuacaggugugagccaccguaccuggcagggacccccuuuuucuuaaagucaguuucuagaaggcaggaaugacaucuaaaucauacuguauacauugucauaagacaauguauaggaacaucagauauuacguaaguuuagagauggaaauuaaacacuuaguuuggaccuccaugguuaagucuagauugucacuuuugcuuauguagaaaguacacaaacaaaaguauguggagcugcuuucuuaaguuuagcacuuaaaaaaaaaaagucugaaaauacucuaaagauaauuccaaagaaaauaucaauuuaacauuuuaauuuaaaucugaggggaaaggaacauagcuauagacauuaccaauuagacuaaucauuuuaaaaucugguauguuauauggccacuaugaaaguaaaugaacuguuugcaugaauuucaguuacauuaaguuuuuucacuuuaauguccuuaaucuauuauuuuccccaaaauuuaggucuuuaaaaaaaauugcugccauuuaauaaacagguucauuagauuauuaccaaacagauuuauuagauuauugcccaacaggauuuauuuggaaauuaguaaauccuugugagugguuauucuucauuuugcucuuguuuuuuauacuguauccuauuuccuauaaaaauuauguuuuugucccuguguaggugucugggauaagauuuuggagccuguggcaugugugagaaaaaagucugaaaugcuccagcuuuucccagcguauuuaaaaggagaggaucuguuuggccugaccgucucugcaguggcacgcauagcggaaucagugagugucuuggucaggcuuugagauuggaauugcuuuccugauucagugugaccacuugaacacaugcuguaacauuuguggcacucuucagaaagugacugagccugugcauuaacccguuucucuuagaggaauaaggcauuggugauuaaucgggagagcucagccguguugguauucacccaguugagguaguuaaccaacuucagguucucuuccaggcuggaggcaagcaggggugaaggacaccaggcuugucacaucuucugggugugcuggaugggugaggacacucuccucuucccuugccuuucugaaguuucucccaccucagaaugucagugugcccauuuccugacacuuggguauuuauggccacucuccugcccucuuccuaggaugaagucacuagagggcaguagaucgcagcagcacugauuucuguccucucuugacauuucuuugcuuaaaagauuacaagccuguuugucagugagucuaacugaaccauaucuacacaauaguuuuagaaaauuguaugauucuaaggcauuguuuucaagaauaaaaauaucauugguguguuuucuuuggacaggcagaggaaaccccaaaagccacugaguaaugugccuaauuguuuucuuuggaaucgcccugccuaaaugauacuuaucuuuuaugacuacagagaaauaaauuucacaagcaauguauuccagaaaagaccuuuaacauguaaaugacuuugaguaaagcuugaguuaacaccuaugcuuuaugcucccaggacauggagagcgauaaccucaucacaucagagucaaauugaaaggagugagaaacgaucaagaaagaaaccauauagaugauuuuuuaacuguuuuuaauuguaaaauuccagacagagauauaaaaguuggcauuaauacaggggaaagaacucaaugcgaaucauuacaugcccuguguuuguggguauuguguguuucagucaggcccugaaaucacacaagcguguauauuggucagccaguguuuguugcaugggcuaaucuuuuucuucaaggagcauuuggcaggguuuaccuaaguuuggcuuugaaacugaauuugcauacucauauuuaaguagaucuaccugcaggccaauaguguuaacauaagcuagaagaccauuuuauuaucggggaaaacgcugaugaguuauuucugucgugggccauccuuugaccagcuugagauugucuguagucuccaucagauggggugacuuugugucugcuuugcuucuuuucagcuuccugggguugaggcaugugaaaauuauaccuuccgauacggccgaaauccucucauggaacuuccucuugccguuaaccccacagguugugcccguucugaaccuaaaaugagugcccaugucaagagguuuguguuaagguauuuuguuuuaacuucacauaguacagcccaggguuucuaggcguauuagugguuuccugugcuugauuugucugcugcuuacaaacccugcugucuggcuguguaugugcccaacuacauaagagaacucgccgugugucucugcuaggcagcuuuccauguauguuucugucaguaagaaucugaauuaaccugguuuugggcauuacucagagguaucuucaguuuuccuuguauuuuuuuccuguugauaugccauugucugcaggccucacaccuuaaacagcaccagcaccucaaagucauuucagagcacagucacuggagaacugaacgcaccuuauaguaaacaguuuguucacuccaagucaucgcaguaccggaagaugaaaacugaauggaaauccaauguguaucuggcacggucucggauucaggugaagaaauacuuuguguacaggaaguggagagacaggguggagucuagcaaucugaagcuauugauguccaguaugugaaaaugauuucacauagcugcagggacagaaacguguuuucaaaaucguaucaaauccugucccuugguaacacuagggauuuaauauguagucuugggacuuggugauuggcuuccccaaagggaaagcagaccaguggaauccacaucuuugcaucuuguugagagcuccugggaggcagguagcauuguaauuugcacacacuggauuuguggagugcucaguagagcuguuucaagcacuugagagaaauacaaaugaaaauauuuuccaaagguacaccaauuuuggaaguuaccuuaucuuuuggaagcuaccguuucaugaaaucagugcauguuuuuugguagacuguggacuaucuuacaaguaaggccguguauaggcuaagcauuuaaguuuacaccuauaguccauacuuccugagcugcagacccaaauauccaaaugccuguucagcauuuuucuccuuggaugucucagaauggaauuacaaagcucuuacuuugucaaacuuguccagcuccuaaaccccgccauccuacaagcuccuugcugagugauguuaccguuuguguacauuggccucaguacugccagauuaaaccuaaagcaucaucgaguucuguuuucuccuaaaaauucucucagauccacucuuagguuuaccagcccuaucuugagccacauaucacuugccuguaccacugcaggccuggcugucuccucccauccaguucccucucagcagccagcaaaguaucuuuacccuauaaacuggaucagcguuccuuugucuauacucauucagauucuuguuccuuuguuggaacccuuuuacuccucacuagaaguuuguaggaucuucucuuuauugauauuuggacauuucacagaacuacaccucaguggaggucuuuuuguugauugcuuuccucccuugaugagcccuuucaaccuggagcaucgugaccuuccgucugagaaauguguuuuguauucauucuuuugcaaguucugccccucuguuuccucuguguuugcacuaaaaccccugagauucaggaucucacaguguggaccugagacuagaagcagcagugucaccugggagcuuguuaggaugugcagguucgggggccccagcccagccucacugaauccagcucuggagguggggccuccuggaugauucucaugcaugucagagaguaauuucugucuuauauccuuucuccccuucuguucuuuguuuccuugucucucuguucuuucugagacuuccucuacuuuaucugcuaaucuuucuugucuauuuuuagagauuagcuacgagcccuuucugcucuugaucuuguuugauauuuuguuuuuacauuaugaguggaguaucuguguuuucucugcuguugccccucucuguugagccucucucggauucugugggugaauuagugcuuugccucuacuccuuccaguucuagcuuuccccugcuaagucaauuacuuuucauuuuaaauaguccauucacucuuauacccauucguguucucgaggagugugcuuuuacugugauuuuaguggguaucuuaacuguguucaaccugucaccuuuaaccugaagcauuuuugagagcucugguuucugucucuuuacuuauuucauccugccacccucccaucuguccaccucccuggggaucccguggaugaucuaauauguauccuguuuuucugugcuaauaucuuagaacuauauacacuuuuauguacauauauaaaaauggaaucauguuauauuuauuuuucuccgucuuccuuuucucuguaauaaucagaggucccucucgaucaacugacguagcuucauuucauucuuuugaaugguuaccugauguuccauaguguugaugaacugcaguuaaaccauugcauuacugaugaguguguauuugauuuauaauuuuucucauaacaaacaguguugcuauaucuuguacaaauaucacaaugaauuaauaguuucacuccuaugggguauauucccaaacgugagguuucuguguaaaagcguguguacuuuucauuuaaauagauauugccaguuuucuaaaaagucucuuacugcacacuucuuccugcagcaugugagacuguuuucuuguuucccauuuguagcugguguuacuauuuuuuuguuuaguuggucugauaaauauagacugauguuaccuuaauugaauaggcagcuuuucauguccgccauuuggauuugcuuucauaggaauugcguauucauauccuuuguccauuuuucaauuuuuagcaguuuacacuauucagaauuuuccccuacaaaauauccuuugccuaccagcaagugugacaucuuuuuucuuguaaaaguuacuguuuauauaaacaaacauacauaauuuucuguugcaucuagucuuggucaagacccuagauuauauacggauucuagagguuuucuugcauaacauuuuuaaaauacaauuucgcuuucuuccauuggauaaccaguuguugaagggccauuuagaaguaacccacucauuuuuaacugauuuucuuucuucuucuuugagacagggucucacugugucgcccaggcuggagugcgguggcacaaucucagcucacugcagcuucgaucuccugggcucaagcgauccucuuaccucagccuccugaguagccagggcuacaggcgcaugccacaauacuuggcuaauuuuuaaaaauauuuauuuagagaugagguuuugccauguuguccaggcuggucuugaacuucugaacucaagcaauucaccugccucggccucccaaagugcugggauuacaggcaugagcccccguggcuggcaugaauuuuuuuuuuuuuuuuuuuugagacagagucuuccucugucacccaggcuggagugcaguggcacgaucucggcucacugcaaccucugccucccagguucaagcgauucuucugccucagccucccaaguaacugggacuacagguguguacuaccaugcccggcuaauuuuuuuuuuuuuuuuaaguagagaugggauuucaccauauuggccaggcugguccucaaacuccugaccuugugacccgcccaccucugccucccaaagugcugguauuacaggugugagccaccgcaccuggccuuuuucuucuaaccccacgaaaucuugacuauaaacugaauuuuaauaccaguuacuacuguacguuagauuuucauacaugcagggaucuauuucucuuuucugagauggagucucacucugucacccagacuggagugcaguggugccaucuuggcucccagauuaaagcgauucucaugccucagccucuggagucucacucuguugcccaggcuggagugcaguggcaugaucucagcucacugcaaccucugccucuggggcucaagcaauucucuuggcucagccucccuaguagcuggaauuacaggcacacgccaccaugcccagcuaauuuuuguauuuuuaguagagacgggguuucaccauguuggccaggcuggucuugaacuccugaccucaagggaucugccugccuuggcuucccaaaguggugggauuauaggcaugagucaccacgccuggcccauuuggaaucucuucauuuccacugaucuuguuuauucuuaaaccacacucuauugaucuccauacauacuuuuuguguguucugguucauucacuugugaguuguaucuggaguagaacagauaaucaaagaugcuuguucagaggauaaaucaguucacauacuaaagucucucacauggcccuucccaccaugugcucccggaugugcuucaugaggaugcagcuggggcagcacaugguccuccuaguaauuccgacuagaaugcaguugauuucugcauucuagaauucaguucaauucuagaauugcauucuagucuaguacuucugauucaguugcaucuagucuaguacuuuugcauucaguugccuucuagucagaauuaagugcaaaaacccaaaauugggacaagaaaauacaacuauuuauggcaaagacccauauuuuguuaguauguuucucuacaaguugugcuaccaaccugaauagugcaccuggcaggccaccagcacgggaguacaagcugcgcagugagagcugcuuccauuucagcccguucaaacuucuuucccagccucagaauuuuguauuagugaaaaauuuaccuuccccaagagcuucauuuguuuccaacauuccugauauuuacagcagagugacguuuccugugucugcucuuugcccuggcugcugggaaacucagagccaagucugaacccuguuuacaguaucagugauugguuauaguuagccugauuucuauguuauugaauuuauuaugucuuuuuugaaauaguauugggguaaaauaaacaccacaagucaauaagcuuauuuaguuggugggaacucagcuaucucaucuggaagguuagauagccuaauacauaagacagccaagccacaguacuacuuuauacauagacucuaagaauuuagugcuaaaaaagauguaggaauaagcuagugauggcauaguuuuaaguaguaaaaauguccaauuuuuaaaauuucagaaaauagcauauucaaaaaugauuugaguucaagugaaacuuaaguauggcuucuaauaagacccgagggugaaaccuuuguaugaaaaacagaaaaaagacuuguugucacauaaauuggaaguauguacacacuuuuuuuuaggggcugggccuguaugcugcucgagacauugagaaacacaccauggucauugaguacaucgggacuaucauucgaaacgaaguagccaacaggaaagagaagcuuuaugagucucagguaggugucugguccccgagauuguauacacagcaccaucauccucucccuuucuccgugccagccagacacccuggaaggcagaaugaaaucugucaugcugcauucagcuuuaaacaaaagccauaucuguauauuaguguauuuuuaucaguuguaucucuuucaauugguguuacaguuuacuuugauagacaacuguaaauuaaugagccuggcuucacacacaaccuacugauuccaugcuuuccauucgugccauguaaaugucaucugugccuaauagaauauccacaguaaggaugaucaggcugccguuccguucaguuucgacugaguccuccugguguggauaggaacacagaggggaguuucaggucgacauugaugacuuacugacugacuuuucccucagaaccgugguguguacauguuccgcauggauaacgaccaugugauugacgcgacgcucacaggagggcccgcaaggugagacagcgaggaaccugacggggagugcuuuugcuuguggggccagugcugguggagagaacacugaagccaagggaaaggcucucacggcagccuggcggugacuaaacauucagagcaaaugaguugagaauuuuuauuuaaauguuauauuugugcuucuaacaaugggcaaauagaaauuuaauuagcaaaaacugcuuuaucaauaaaugggaaguuuuuaaagcugcuucuagcuguuuuacaauacaguuuucugacaugguggcuugcagguauaucaaccauucgugugcaccuaauuguguggcugaaguggugacuuuugagagaggacacaaaauuaucaucagcuccagucggagaauccagaaaggagaagagguaagagugugagagauugcaucugccauguuguucagauccugggcgaauaguucccuccucacacaggucacuuacucacuuguuucccaauucuuuguugugauaaaaacucuguccauaauaggccagauguucccacccugcaguaucucacccuucaggcacuccaguucaccuuccuccacauggcagcucugugagcauuugcugucaccucucccuucccuucugugccacggguucagcauccccauggcacccaggugguaucauuucugugugccauaggauccuucuuuauccccuuaaccuggacacaguuuggcaguguccccucugaagagcauccccguccuucuccaagggggccguggcuccugagauggcacuguugggcugugggcggcaaaucugggccgccgugcugcugaggauugugugcucacgcuggcgaucagugugugcuuaaccaagugcccacaucgccacauucuucagcaguucagguguggguuguugucuucaaaaugccgagugccaagcuugcuguuugucuccgugcucucagaggugacucugguccggcggcucacccauugggauuauuuuuggccuuaauugcugcauuugcuucccaccuuggucuuucccacugugauucagguaccuugguucuggaauuggcauuuccuggaaagcugucacugagcagcaggcuugguuucuguaggaaacgucccgcauuuggggagugaggcaccugagugacuugacuuuguuggugcuccucucccuucgugaacauagccaugggauucgugggauucuaucuguauuuugggucuuuguggaaucuccuuucuuagucaagaauaaggauccgacuagacccaaggcccguuauacaucucaaaguaacguguaaauaagacagugugugggagcccuggcacagugccaguaaccaauggcuaccaugguggucagaagagacucagcccagggccaccugccuccuuccuacuugaguauucuugaguaaauaguuuaauaugagccccuauuuuaucuucugcaagauagagaaaaugacuuccuuaccaggcucuuggaaggacucagcagauaccugaaagaaagcaguggaaucauugccaagaacagcugcucaauaaacacugguuuccuuccuuucuguguagaaggucuuuccagcuagcgucuagaaucauuucacucagaagagaccuagaaauuccugggccuccccuucauuuugcagcaucggcucucucuggggugguggggguugcagggccgcgcacugaggcuuguaccgugggacucacgcagacucccaccuaccuugauuggucugagauguuaauuuggugaccucuaaauagaaagacauccuuucagucuugagugaggaaaaaugaaggagggaaaacagaguuagcuggcaguucaucucacccagaauugcaugccccauucaguaaaucaggggaggugaaaggcuucuggguuuuagggagagggcuaggaaagcaguugcccuuccaguccccuccauccacuugcagggacagcauuaugagaagucacagaaauacagcuuucucuggucaggcucccguucucagaucucgcuguuuaaaaauacugccucccucauuuccucugugcaagcacaaugccucuuuucaggguucccccagggucccauggaaccucaauaaaucaggucuuccuuaauuuacgucuguuucguuugcugguuuuaaaaugcaagggagauggaggcagaaacgcuauugccuuccuugcuguccuuucuuacccugugucuuugccgugggcagcucugcuaugacuauaaguuugacuuugaagaugaccagcacaagauuccgugucacuguggagcugugaacugccggaaguggaugaacugaaaugcauuccuugcuagcucagcgggcggcuugucccuaggaagaggcgauucaacacaccauuggaauuuugcagacagaaagagauuuuuguuuucuguuuuaugacuuuuugaaaaagcuucugggaguucugauuuccucaguccuuuagguuaaagcagcgccaggaggaagcugacagaagcagcguuccugaaguggccgagguuaaacggaaucacagaaugguccagcacuuuugcuuuuuuuucuuuuccuuuucuuuuuuuuuuguuuguuuuuuguuuuguuuuucccuuguggguggguuucauuguuuugguuuucuagucucacuaaggagaaacuuuuacuggggcaaagagccgauggcugcccugccccgggcaggggccuuccuaugaauguaagacugaaaucaccagcgagggggacagagagugcuggccacggccuuauuaaaaaggggcaggcccucuaacuucaaaauguuuuuaaauaaaguagacaccacugaacaaggaauguacugaaaugacuuccuuagggauagagcuaagggauaauaacuugcacuaaauacauuuaaauacuugauuccaugagucaguuuauuguaguuuuugauuucuguaaaauaagagaaacuuuuguauuuauuauugaauaagugaaugaagcuauuuuuaaauaaaguuagaagaaagccaagcugcugcuguuaccugcagaacuaacaaacccuguuacuuuguacagauauguaaauauuuugagaaaaaauacaguauaaaaauaguuauugaccaaaugcuaccaggcucugcagcagcucgggggcuuauaaaauguucauagggauguuacaauauaauuuuguguuauaaaauaugccauuauaauuauguaauaaccaaaauuucaaccuagaguguuggggguuuuuuggaaaccgcagucuauuaguacucaaugguuuuauacaccuuacuucugacagagcggggcguaugcuacgacuacaacuuuuauagcuguuuugguaauuuaaacuaauuuuuucauauuauauuguugcaucccuacuucuucagucagguuuuuuugugcuuacaauuugugauaacugugaauaacugcuuaaaaauacacccaaauggaggcugaauuuuuucuucagcaaaaguaguuuugauuagaacuuuguuucagccacagagaaucauguaaacguaauaggaucauguagcagaaacuuaaaucuaacccuuuagccuucuauuuaacacaaaaauuugaaaaaguuaaaaaaaaaaaggagaugugauuaugcuuacagcugcaggacucuggcaauaggguuuuuggaagauguaauuuuaaaauguguuuguaugaacuguuuguuuacauuucuuuaauaaaaaaaacacuguuuuguguuugcuuguagaaacuuaaucagcauuuugaaccagguuagcuuuuuauuuuguacuuaaaauucugguacugacacuucacaggcuaaguauaaaaugaaguuuugugugcacaauucaaguggacuguaaacuguugguauauucagugaugcaguucugaacuuguauauggcaugauguauuuuuaucuuacagaauaaaucaauuguauauauuuuucucuugauaaauagcuguaugaaauuuguuuccugaauauuuuucuucucuuguacaauauccugacauccuaccaguauuuguccuaccggguuuuuguuguuuucuguucuguauaauaguaucuaauguuggcaaaaauugaauuuuuugaaguauacagaguguuauggguuuuggaauuuguggacacagauuuagaagaucaccauuuacaaauaaaauauuuuacaucuauaa

SEQ ID NO: 191456 - RNA, 212333 nt, Homo sapiens
gacugcgcggcgcccgcccucccuuagucagagcugcucgucugaggcugcugaggcgacggccggugucguggucgcgguaccuguuccaacacggcucgcgggcccgugccggcuccgguccccggcgcggcuguccgagccccugcggcgggcggacgaugguguggcggagcacgcggacgcgggcggcgcggcggcgggcaugaaggaggauggaagggcaggacgaggugucggcgcgggagcagcacuuccacagccaagugcgggaguccacggugcguggggaccgaggcagcccugacagucccgcgugcccgcccgggcccuccguccccgcccccgggcccccgguccccggaccccucaccuccgggccucgccucgcgccucccgccccggccucugccgcucucccuccccaccccuccucuccccuccccuccccuucccuccccaccucuccucuccccuccccuccccuucgcuuccucugccugcccccccgcuccgcucuugccuccccugcccccucgcgcucccuccguucgagccccgaccccgcccccgccccgcggccucggugcugcccuucccuucccgcggggagggcugcggugcgcgccgcgcucugggaccccaggggcuuccucucugggcgggugugcggcucgcgccucgggguguggacggcggccccgccagugcgcgcccccgcgcuccgccgccaggccagguaggcagguggaugcgcaggcgucccggagagccugggugggcccggcggguccgggaagggccgggcugcgcggagcccgcccgccucucgcguuuggacccggccgguuaccuugucccggucaacaccuccugcccuccuggcgccucacguuuccaucccucuuucaucucccccagcccccacguggguugaguucgaaaccuuaccguuugggaugagaauauugguuauuuuugggagugaggaccucagcaaaaguccauuuugcuauggaagcaacuucuuagggaagcagcuucuuuuuuggcccauguuccaugugugcuguuggcaggagucaggaagcggacuugaccuuggaaagucuacuuugauguuuuuaucuuuucaugaugcucuagaauguauuguaauuggguuuaucuguguuuucauaacuguuguaaaauaugucaauuuuuuauguuuauauuuacgccucuccuaaguugucuacgauucagucacacuugguuugaggugaaaaaauucugcuuuagaauuaucuaauuuguguacucacugaucuugaaaauugagaaucacuuuggaagucauacuuugaauaaagaggacauauaaagucugagcugguggaauuugaguuaguggaauuugguacacauuuaguuguaauuuuuauaauugaagcuaaaauacacagagauaaguucauguaaucauacauguacccuucagaucauuucauacuaaacacgccuguguacuccugaauccaccaggaguuugagacuggucagccugggcaacauagugaauccccaucucuaccauuauaaaaaaauaaauaaauaaacacaauuuuacuaggaucccagagacugauuccuuucccucuuccaauuacuuucuccuccaccaaggguaaacguugcccuggcuucuaauaucauagauuaguuuuugcuuaguuuugaacuuuauguaaauggaaucuuaccguauauacucuucuguguccaguuucuuguacaauguuugugaaauuucuccauguuguaugugguuauaauucauucucggugcaguaguugugugacuauagcacaauuuauuuuucauuuuacuguugaugggcacuucaguaguuucuagguuuuggcuaugaauauauauauguguauauauauguguauguauauauguguguguguguguguguguguguguauauauauauauauauauauauuuuuuuuuuuuuuuuuuuuuugugauggagucucgcucugucucccaggcuggagugcaguggcacaaucucggcucacugcaaccucugccuccgggauucaagugauucuccuaccucagccuccugaauagcugggauuacaggcacacaccaccacacccagcuaauuuuucuauuuuuauuagagacgggguuucuccaugcuggccaggcuggccuugaacuccugaccucaggugauccaccugccuuggccucccaaagugcugggauuacaggcaugagccaccacgccgggcuggcuaugaacuuuuuguacauagcuuuugguggacauguuugugcauuucuguuggggauagcccuaggaauggaaucccuagguuaaagagugugcauuuguucaucuuuaguagauacuuuaaaacaauuuuccaaagugguuguaccaguguacacuuccgccaguacugacagucucagaggugugguuguuacucaucuuuaucaauacuugauauuuucuguccuuuuuaauuuuagucauucuagcaaguguguuauaguguucaucauacaaauaauuuuaauuugcauuuuccugauaacuaaugaauuugagcaccuguuuguuuauuagccauuuggaaaucuugugaagggucaaauuuuuuuccccauuuaaaaauuaaguuuaucuuuuuaauauugauuugcaaggucuuuacagaauaacuuguauuauauuguuauacagguggauaugauuucuuugucagaaauauauacugcacauauuucuuucccacucuguggaugccuuucacuuuuaaugauaucuucugaugaacagaaauuauuaauuuuaauauaguucaauuuauuaaaauuuuuuugaguacuuuuaaugucccgauuaagaaaucucuccuuacucuaagacugauguucucuucuucuuuucucuaaaugcuuuauugaauuacucuucucauuuaaauuugcaaucuauuucgaauuuauuuuuuugugucuggugcaagguaggagucauauuuuuuucucccacaggaauguccaauugcuucagcacuauuuaggacuuuugucacagauagguaacuguauauucauaggguuuaauuuuggacuuuaugugguuuuauuggucuauuugucuuuaguuuuauuauuuuuuaaaauuugagacagguucucccucuguugaccaggcugucgugcaguggcgcaaucauggcucacugcagccuugacuuccaaggcucaggcgauccucccaccucagcuucccaaguagcugggacuacaggcuugaaucauacaggugugcacuaacagacccagcuaaucuuuuaauuuuuuguagaggugaggucucaccguguugcccagaccugucuccugggcucaagugauccuccugcucuuuggcuuuacuuuuaauuaauuagauauucuagaauuuggguugagaaagggacacauuguaaaacaguccagagcuucgucuacuccccugaaaacgguuuugguaccgauuauggaguucuuuaguucugacucuccucaccuguuucccucaacccaguaccccuggcugguugagucuacuccaucuucuacagaaccagcgcagacagugaccaggcucaggguucccagucuuuggcauuucuuucucaaaugauuuauauuuagagugaauguaaauacuuuuucucuaagaccuguugccaauuuuuaaaauuauucaauucuuucugauuuugcuacauaaugcuauaauugcuuaacuuuuuuaucauaauaagauauauauauauaacaugcaauuuaccauaucuaaauauacaguucaguggcguuaaauacauucacauuguugugcaaccaccaccacuauccauuuccagaucuuuuucaucaacugaaacuugauacccaugaaacaguaacucuccauucuucacucucuccagcugcugguucugccuauaugaaucugacuauucccaguugaaccauacaauauuuguccuuuucuaucuggcuuauuucacuuagcauaaugccuucaaaguucaccuguguuguagcaugugucaaaauuucuuuuucuuucuuuuuuuuuuuugagacagagucuuucucuguugcccaggcuagagugcaguggcgugaucucggcucauugcaaccucucccucccugguucaagcaauucuccugccucagccucccgaguagcugggauuacaggcaugcgccaccgcacuuggcuaauuuuuguauuuuuaguagagauggguuucaccauguuggccaggcuggucuugaacuccugaccccaggugauccaccugccucagccucccaaagugcugggauuacaggugugagccacugugccuggccucauuuuuuaauuuuuuguagagaugggguuuuugcuauguugcccaggcuguucuugaacuccuggccucaagugaugcacccacccuggccucccaaagugcugggauuacaggcgggagccaacgugccuggcccagaauuuguucaggcugaauaauauuuucuuuuuguguauacuguauuuugcuuacccauucauucaucaauugaccugaguuguuucuguuuuuggcuauugugaauaaugcugcugugaucauggguaugcaaauaucuauuagagucccugcuuucaauucagaaguagaauugcuggaucauaugauaauucuauguuuaauuuuuuuuuuuuuuuuuuuugagacagagucucgcuguguuucccaggcuggagugcagugacucaaucucggcucacugcaagcuccgcccccccgguucaugccauucuccugccucagccucccgaguagcugggacuacaggcacccgccaccacgcccagcuaacuuuuuguauuuuuaguagagacgggguuucaccauguuagccaggaaggucuugaucuccugaccucgugauucgcccgccucagccucccaaagugcugggauuacaggcgugagccaccacgcccggccucuauguuuaauuuuuuugaggaacugccauaccauuuuccacagaggcuguaccauuuuauauucccacuagcaaggagccagaguuucugguucuuccgcaucuucaccaacacacauuguuuucuguuuuucuucuuuuuuuuaaaauggaugugaaaugguaucugaugcuggauuugauuugcauuucccuaauuauaagugaaguucagcauuguuucaugugcuuauugacuauauggacaucuucuuuggagaaauaucuguucuuugccuguuuuugaauugaguugcuugauuuuuguuguuuaguuuuaggaguucuuuauauauucugaauauuaaccccuuaucagacaugugauuugcaaacacuucucgcccauucuguaggguugccuuuuuacucuauugcuaguguccuuugaugcacaaaaguuuuuaauuuuguaguccaauugaucuauuuuuucauuuguugccuguguuuuuuugugucauauccaagaauucaucaccaacuggcaucaucaccaacuggcaucaugaagguuuuccucuaagaguuguauaguuuuagcucuuagguuuaggucugauccauuuugaauuaauuuuuuuguacaauauaguguuuaacuuuuuuuuuuuuuuuuuuuuuugagauggagucucacucugucgccagguuggagugcaguggcacaaucucaaggcucacugcaaccuccgccucccggguucaggcaauucuccugccucagccucccgaguagcugggacuacaggcgagcgucaccacacccagcuaauuucuguacuuuuaguagagacgggguuucaccauguuggccagaauggucucaaucucuugaccucgugaucugccgccucggccucccaaagugcugggauuacaggcgugagccaccgcgcccagccuaguguuuaacuuuuaaauacucauguaauaauuuugucuuuuguauuaugaauaucucauaguucucuugucaguugcuuuagugaucauauuugacuuuggcuauuaguaucagguaguaaugauugauuuccuuucuuuugagagcuagcuaugaaauccuaaggcugccagcuaacugaguauacccucucuuggcuaaggggaccccaggaaaccuuaaaaacugaauucccaaccagaaugggaugggacaucugacacgccucaguauacccccucccuuuugagguuuaaacacagcugaccagcauuaauguuaaaauagagaucugaagacugagagaacagacucuuuguggcaauaaaauacccaacugugaacaaaauguagggccaugccaggcaaggguuaaguaaagcauccccuuaaagaauaaacugguucuaacugccucaagguguuucuuuuuuucuagcggcuaaacaagcacuggccuccagauaagcaauauuaagauaacugcagcucacucacugccagacccuaagugauccccacucuccuguuccacaagccauaacuauagcuuugauuggacaagagacugauuucaguaacuuucuccugauaagagcacugagcaugaacugguucuggccaguuuacagaggcugugcacuucagugccuucaugucccugcuucgccaucugacuacagggccucauuguaauccuuuuagauguuaagucuccacccacaagugaauauggauaaguauguaacauacauguuuauucagccugcaugugcaugaccucccccacuuugugaauauucauagcuccuccuauaaccuguuaaauauauaaacuuggccaacccguucagcauaaaucccuguucuauccucccuugaaggucuguuucugugcucugcgggaggaugcuucccagcuaucaggauugccaccuuguaggcugugacucuuuacaaaauuauuuuugaggcagagugugguuccgucacucaggcuggaaugcuguggcacaaacacggcuuacuguagccucuaucucccaggcucaagagaucuuccuacuugaaggaagucuuuuuuuuuuuuuuuuucuuuuuuugaggcagagucucacucugucacccaggcuggagugcaguggcacuaucucagcucacugcaaccucuaccuccuggguucaagcaauucuugugccucagccucuugaguagcugggauuacaggugccaccaccaugccuggcuaauuuuauuuauuuauuuaugauauggagucucugucacccagccuggagugcaguggcacaaucucggcucacgauaaccucugcuucccggguucaagugauucuccugccucagccucccaguagcugggauuauaggugccugccaccaugcccggcuaauguuuuugaauuuuuaguagaggcaggguuuuaccauguuggccaggcuagucucaaacuccugaccucaagugauccuccugccuuggccucccaaagugcugggauuacaggugugagucaaugcgucuggccauuuuuguauggacggguuauuuccguguuacccagacuggucuugaacucuccuggccucaaguaauccuccugccucagcuucccaaagugcuagaauuagaggugugagccaccaugccuggccuggcugcgcaaucuaaauucuuccuuauccuggguauggcuuaagcuccccucuuggcuagaauauuuuuggaaccaagucugggguugacugggacuuuuuuuuuuuuuucuuuuacacggagucucgcucugucaccgaggcuggaaugcaguggagcgauccuggcucacugcaaccuccgccuuccagauuccagugauuauccugccucagccucccaaguagcugggauuacaggcgccugccaccaugccuggcuaauuuuuguauuuuuaguagagaugggguuuugccauguuggccaagcuggucuugaacuccugaccucaggugauccgccccugccucggccucgcaaagugcugggauuacaggcaugagccaccgugcccagccagacugggacuuacacaacagagauuuuagaaccuucccauuuaguuggcuccuuuuaggccaaaugggagguggggagauaauggggauagaaguauccuucaucuacugccucucuagaugaguuuaccugcuguuuucuacuggugucuugcccucaacucuauggcuuacccuuuaugcaggagauaaaaaacuuuaguccuucccacuugggaauagugguugggcagaaggugggaaccaaucaccaaucuuguauguaaguucagaaugcaguuaucuuggagucuguagucuucugaccuuugucauugcccuccagugaaagaccuccaagagcacaccuguaguuggacaaauugggcuuauugcauauuucagugaguuccauggggaacugugggguguuucaguaacuuuucaaaugggauuugggcuucuacuagguaguuugggaaggguuuaaggaagugaggcuuugaucuguauggggugcuguuaggaagcuggaaaaauucuguaacuggauagcuuaagaaaucuuuucuagaaggaaagaagacuggaauaaagcuaaagcuguaacugguaaagaagcaacagucauuccuguuagccaggauagagaguuggucauuucugugauuuggacaauguucauguuuuuuuuuuugcuuguguucaggagugauuacagaguggucuuguuuagucuuuauccaucauggucuugucugauauugauguucucugaaauuguugauguucagcagaagagucagucaucaaggccuaggugugugccuugcucugaguuguuagccaguuuacagcaacaccaaggcccagcugugauauuaccaggccagcucccagaugucaggggcugcauuucuuuuucucacgugguuguaaagucuucuaguggaaugauguauuagaaacaaauccaauagccaacauaaguugaagugauuuucuaacauagaagagcaaaaaggaaugggauagagguauagagguuucauuuguauuugacuuuucuaaacuggguuaaaucagcuuccccucugcgguaggcagcauaauggccccugaaguugguaauccaugugguaaucccuggagccugugguguguuacuuuacauggguaaagggauuuugcagaugugaguauguuaaaggagaauuacccugaauuauccaggugggcucuauguggucacaggguccuuauaggagaggcaggagggucagagucagaggagaugugaugacagaggcagaguuggagugaugcccuuugaggaaggaggagggaccaugagccaaggagugugggcggccuccagaagcuagaaacgucaaggaaaugaauucuuuccuagagucuccagaaggaagcaaccuugcucacgccuugauuuuagcccagugaaacucaauaaauuuguguuguuuuaagucacaaaguuuguguaauuugguuacagcagccauaggagauuccuacuccuucaucaggaggcuuugacuuucacugcugucccuguauaucuuaccacuccauaguuguguacuugagguuaaaggaaacugggacauucuaauuacauuugagauaauuuuucaugucuuccuauucuguccuccuuuuuuuuuucugagauggagucuugcucuguugcccaggcuggagugcagugacaugaucuuggcucacugcagccuccgccucccgaguucaagcaauucuccugccucagccucccaaguagcugggauuacaggugugcaccaccacaccuggcuaauuuuuguauuuucaguagagacagguuucaccuguuggccaggguggucuugaacuccagaccucaggugaucugccugccuuggcuucccaaagugcugggauuacaggugugagccaccaugcauggcccuguccuucuuuuuuaaacuugauuguauugcaguaagaauaccuaaugugagaucuacccucuuaacaaaaaauuuuuuuuuucagucagagucucguacugucuguugcccaggcuagagugcaauagcgugaucucggcucacugcaaccuccaccucccggguucaagugauucuccugcuucagccuccugaguagcugggauuacaggcgucugccaccacguccagcuaauuuauuguauuuuuaguagagacgggguuucacuguguuggccagcuagucucgaacuccugaccucgugaucugccugccucggccucucagaguacugggauuacaggcgugagccacugcgcccagccccucuuaaaguuuuaagugugcaauuauauuguugauuauagguacaauguugcacagcagauuucuagagcuuacucauuuugcuugacugaagcuuuaugcccauugauuaguaacuuucaauuuccuucccugucccugccccugagaaccaccauuuacacucuuugagucugugaauuugaccauuuuagauaccuuauauaagugggaucaugcaguauuugucuucuugugacucucuuuuuuucacuuagguuaguguccucaagauucaucuauguuguugcauuuugcagaauuuccuuuuuuucccccuugagauggagucucacucuuuuucccaggcuggaauguggugacugcagccuugaccuccugggcucaaaugauccucucaccucagccuccuaaguagcugggacuacuggcacccacugccaugccuggcuaauuuuuuguuuauuuuuuguagagacgaugucucacuaugaugcccaggcuggucucaaacuccugagcucaagugauccuccugccuuggccucccaaagugcugggauuauaggcaugagccaucauaccuggcugaguguccuuuuuucaaauauuuuuaaaggugaauaguauuccauuguauaccacauuuucauuauccauccguuaauagacauuuagguuguuuccacaucuuugcuauugugaauauugccucaguggauauagaagugcuaauaucucuuugagauugugauggugauucuuaggauaaauacucagaagggagauugcugaaucauacgguaguuuuguuuuuaauuuuuucaggaacccacauauuuuccauagcagcugcaucauuuugcauucucaccaagugugcaaggguuccgauuucucuucagccuugucaacacuugucgucuucuuuuuuuuuuuuuaaucauagccauccuaacaggugugaggugauaucucauugugguuuugauuuacauugcccugauaauuggugacauugagcauuuuuucauauacauguuggcuguuuguaugucuuuagagaaaugcuuuauucaaguccuuagccuguuuuuuaaucaaguuacuaguuguuuuuacuuucgugcugugggaguuucuuagauauuuuggauauuaaccccuuuucagauauacaguuuguagauauuuucucucauuuccaucacuauguugauugucuacuuugcuguacagaaacuuuuuaguuuuauguauucccacuuacauauuuuuguuguuauugccugugcuauugauguuauauccgugaaaucauugccaaggccgguguugugaaggcuuccuucgguguuuuucucugagaguuuuauaguuucauguuuuacauuuaagucuuuaauccuuuguaaguugauuuuuguguaugguguaagagaagacugcauuuuuugaaugugaaucuccaguuuucccaacaccauuuguugaggacauuuuucuuuccccguuguguauuauuugcagccuuguguaagaucaggugacuguacauaaauggauuuauuucugggcucucuguucuguuccguuguucuauauaucugucuuuaugucaguacuauacuauuuugauaacuagcuuuguguaauaauauauuuugaaaucaggaggugugaugccaccaacuuuguucuuucuccagauuaauuuggcuauuuauagucuuuugucauuccauaagacuuuuagaauuauuuuuucuauuucuguuaaaaaaaaaugccacuggggguugggcgugguggcucaugcuugaagucccagcacuuugggaagccgaggcggguggauugccugaggucaggaguuugagaccagccuggcuaacauggugaaaccuugucucuacuaaaaauauaaaaauuagccgggcgugguggcgcaugccuguaaucccagcuacucgggaggcugaggcaggagaaucacuugaacccaggaggcagagguugcagugagcugagauugugucacugcacuccauccuugguggcagagugagacuccgucucagaaaaaaaaauaccauugggauuuugauagggauugcauugagucuguaaauugcuuggguauuauggauauuuugacaauauuaaaucuuccaauccaugaacauagggugucuuucccuuugucugugccuucuuuaauuucuuuuuuuuuuauuuuuaaauuuuuuguuuccauagguuuuagggaaacagguaguuuuugguuacaugaguuaaguucuuuaguggugacuugugagcuuuuggugcacccaucacacaagcaguauacacugaauccaguuuguagucuuuuaucccucaccccuuucccacccuuucccccugaguccccaaaguccaugugucauucuuaugccuuugcaucaucguagcuuaguucccacuuaugagugagaacaugcgauguuugguuuuccauuccuagguuaauucacuuagaauaauagucuccaaucccauccagguuguugugaaugccauuauuucauuccuuuuuauggcuggguaguauuccauaguuacauauaccacaguuucuauauccacuuguuaauugaugggcauuuguguugguuccacauuuuugcaacugcacauugugcugcuauaaacguguaugcaaguaucuuuuuuguauaaugacuucuuuuccucuggguagauacccaguagugguauugcuggaucaaaugauaguucuacuuuuaguucuuuaacaaaucuccacacuguuuuccauagugguuguaccaguuuacauucccaccagcaguguagaaguguucccuuuucacugcauccauaccaacaucuauuauuuuuuguuugugauuacagccauucuugcaggaguaaggugguaucacauugugguuuugauuugcuuuucccugaucauuaguaauguugagcauuuuuucauagguuuguuggcuauuuguauaucuucuuuugggaauuguuuguuuauguccuuagcccacuuuuuuuuuuuuuuuuuugagacagagucucgcucugucacccaggcuggagugcaguggugcgaucuuggcucacugcaagcuccaccucucggguucacgccauucuccugccucagcccuccgaguagcugggacuacaggcaccugccaccacgccuggcuaauuuuuuguguuuuuaguagagacgggguuucaccauguuagccaggauggucucgaucuccugaccucgggaucugcucgccucggccucccaaagugcugggauuacaggcgugagccaccgugcccggccaguuagcccacuuuuugaugggauuguuuguuuuucucuugcuaauuugaguccauuguggauucuggauaucaguccuuugucagauguauagauugugaagauuuucucccacucuguggguuuucuguuuacucugcugacuguuccuuuugccaugcaaaagcucuuuaguuuaauuaagucucagcuguuuaucuuuguuuuucuugcauuugcuuuuggauucuuaguuacaaaaucuuuuccuaagccagugucuagaaggguuuuucugauauuauuuucuagaauuuuuauaguuucaggucuuagauuuaaguccuugauccaucuugaguugauuuuuauauaaggugagagaugaggauccaguuucauucuccuacauguggcuugccaaguaucucagcacuauuuguuggugucguuuccccacuuuauguuuuuguuugcuuuguuaaagaucaguuggcuguauuuggguuuauuucuggguucuccauucuguuccguuggucugugugccuauuuuuauacuaguaccaugcuguuucggagacuacggccuuauaguauaguuugaaaucagguaaugugauaccuccagauuuguucuuuuugcuuagacuuguuuuggcuacgcgggcucuuuuuugguuccauaugaauuuuaggauuguuuuuacuaguucugugaagaaugauggugguauuuugaugggaauuguguugaauuuguagauugcuuuuggcaguauggucauuuucacaauauugauucuacccauccaugagcuugggauguguuuccauuuguuugugucaucuaugauuucagcaguauuuuguaguuuuccuuguagaggccuuuuaccuucuugguuagguauauuccuaaguguuuuauuuauuuguuuuuuugcagcuguuguaaaagggguugaguucuugauuugauucucagcuuggucacuguugauguauaggagagcuacugauuuguguacauuaauuuuguauccugaaacugcugaauucauuuaucaguuuuaggagcuacuuggaggagucuuuaggguuuucuagguauacauucauaucaucagcaaacagcaacaguuugauuuccucuuuaccaauuuggaugcccuuuauuucuuucucuugucugauugcuguggcuaggacuuccaguacuauguugaauagaaguggugagagugggcauccuuuucuuguucuaguucucagagggaaugcuuucaacuucucuccauucaguauuauauuggcuguggguuugucauagauggcuuuuauuacauugagauaugucccuuguauguagauuuugcuaaggguuuuaauuauaaagugaugcuggauuuuguuaaaugcuuuuucugugucuauuuagaugaucaugugauuuuuguuuuuaauucuguucgugugguguaucacauuuauugacuugcguauuuuuuuuuuuuuuuuugaguggagucucgcucugucgcccaggcuggagugcaguggcgcgaucucugcucacugcaagcuccgccucccggguucacgccauucuccugcuucagccucccgaguagcugggacuacaggcgccugccaccgcgcccagcuaauuuuuuguauuuuuaguagagacgggguuucaucguguuagccagaauggucucgaucuccugaccucgugauccgcccaccucggccucccaacgugcugggauuacaggcaugagccaccgcgcccggccgacuugcguauguuaaaccaucccugcaucugugguaugaaacccacuugaucaugguguuaccuuuuugauauguuuuuggauucgguuagcuaguauuuuguuaaggauuuuagcaucugucuucaucaaggauauuggucuguaguuuguuuuauuggucauguccuuuccugguuugguauuaggaugauacuggcuucauagaaugauuuagggaggauuuucucuuuaucuuguggaauagugucgauaggauugguaccaauucuucuuugucugguagaauucagcuauaaauccaucugguccuggacuuuuuuuuuuugguaauuuuuaaaauuaccauuuuaaucuugcugcuuguuacuggucuauuugggguaccuaauucuuccugauuuaagcuaggaggguuguaucuuuccaggaauuuauucaucucuucuagguuuucuaguuuaugugucuaaagguguuuauaauagccucgaauccucucuuauuuucuugguuaaucuugcuaaugguguaucaguuuuauuuaucuuuucgaagaacuagcuuuuuguuucauuuuucuuuuguauuuuuuuuguuuguuuguuucaguuucauuuaguucugcucugaucuuggcuauuucuuucuucugcuggguuuggguuugguuuguucuuguuucucuaguuccuugaggugugaccuuagauugucuauuugugcucuuucagacuuuuugauguaagcauuuagggcuaugaacuuuccucuuagcaccgccuuugcugucucccagagguuuugauagguugugucacuauuaucauuugguuugaagaauuuuaaaauuuccaucuugauuucauuguugacccaaugaucacucaggagcagguuauuuaauuuccauguauuugucugguuuugaagguucuuuuuggaguugauuucuaguuuuauuccacuguggucagggagaguacuugguauaauuucaauuuucuuaaauuuauuaagacuuguuuuguguccuaucauacggucugucuuggagaaaguuccaugcucugaugaauagaauauauauucagcgguuguuggguagaauguucuguaaauaucuguuaaguccauuuguuccaggguauaguuuaaauccauuguuucuuuguugacuuucugucuugaugaccuguuuagugcugucaguggaguacugaaauaccccacuauuauuguguugcugucugucuuauuucuuaggucuagugguaauuguuuuguaaauuugggagcuccaguguuaggugcauauauauuuaugauugugauacuuuccuuuuggacaaggccuuuuaucauuauauaaugucccucuuugucuuuuuuaacugcucuugcuuugaagucuguuuugucugauauaagaauagcuacuacugcucacuucugguguccauuugcauggaaugucuuuuuccaccuuuaccuuaaguuuaugugaguccuuauguguuaggugagucucuugaaggcagcagauaguuggugaauucuuauccauuccgcaauucuguaucuuuuaaguggagcauuuaggccauuuacauccaauguuaauauugagauuugagguacuauuccauucaucgugcuauugguugccuauauaccuuguuuuuuuuuuuuuuuaauuguauuuuuguuuuauaugcccugugagaauuaugcuuuaaagagguucuguuuuaauguguuuccaggauuuguuucaagauuuacagcuacuuuagcaguucugguaguucuggcuugguaguggcaaauucucucagcauuuguuugucugaaaaagacuguaucuuuccuucauuuaugaagcauaguuucacuggauacaaaauuuuuggcugauaauuguuuuguuuaaggaggcugaagauagggccccagucccuucuagcuuguaggguuucugcugagaaaucugcaguuacucugguuuuucuuuguagguuaccuggugcuuuugccucacagcucuuaacauucuuuccuucaucuugacuuuugauaaguugaugacaaugugccuaggagaugaucuuuuuacgauuaauuucccaaguguucuuugagcuucuuguauuuggacgucuaggucucuagcaaggcccgggaaauuuuccucaguuauuccuccaaauauguuuuccaaacuuuuagauuucucuccuuccucaggaauggcaguuauucuuagauuuggucacuuaacguaaucccaaacuucuuggaggcguuguucauuuuuucuuacuuuuuucuuucucuuauucauuuuucuuugucuuuguuggcuuggguuaauucaaaaagcuucucuucaaggucugaaguucuuucuucugcuuauuugagucuauugcugagacuuuccagaaaauuuugcauuucucuaaguguguccuuuauuuccugaagcuuugauuguuuuuuauuuaugcugucuguuucacugaagauuucuuuccucauuucuuguaucauuuuuuugauugucuuaaauuggacuucaccuuucucugguaccuccuugauuagcuuaauaacugaucuucugaauuauuuuucagguaaaucagggauuucuucuugguuuggauccauugcugguuagccagugugauauuuuuuggagguguuaaaaaacuuuuucuuugucguauuaauggaauuguuuuucugguuccuuuucauuuggguaggcuaugucagagggaaggucuagggcucaaggcugcuguacagauucuuuugucucccgggguguuccacagauguaguacucucccccuuuuucuaaggauguggcuuccugagggccgagcugcagugauuguuaucucucuuuuggauguagccacucaggaggucuaccaggcagggcugguacugggguugucugcacagaguccugugaugugaaccgucugcaggucucucagcugucgauaacugcacagcauuugugagaggugacagugugcuggcgguccucggggcccucgcuugcucuuggcgccuccccugccugggcucccacuuugguggcauuugaggagcccuucggccccccgcugcacugugggagccccuuucugggugggccgaggcuggagcccacucccucgcuugcggggagguguggagggagaggcacgagcgggagccggggcugcguguggcgcuugcgggccagcuggaguuccgggugggcgugggcuuggugggccccgcacucggagcagccagccggcccugcuggccccgggcaaugagggacuuagcacccaggccaguggcugcggagggugugcugggucuccagcggugccggcccacuggcgcugugcucaauuucuuguccggccuuagcugccuucccgcggguggggcucgggaccugcagcccaccaugccugagccucccacccacuccaugggcuccugugcggccugagccuccccgacgagcaccacccccugcuccacggcgcccagucccaucgaccacccaagggcugaggaguacgagcgcauggcgcgggacuggcaggcagcuccaccugcagcccuagugcggaauccacugggugaagccagcugggcuccugagucugguggggauguggagagucuuuaugucuagcucagggauuguaaauacaccagucagcacccuguguuuagcucaagguuugugagugcaccaaucgacacucuguaucuagcugcucugguggggccuuggagaaccuuuaugucuagcucagggauuguaaauacaccaaucagcacccuguguuuagcucaagguuugugaaugcaccaaucgacacucuguaucuagcugcucugguggggccuuggagaaccuguguguggaaacucuguaucuaacuaaucugauggggacguggagaaccuuuguaucuagcucagggauuguaaacgcaccaaucagcacccugacaaaacaggccacugggcucuacgaaucagcaggauguggguggggccagauaagagaauaaaagcaggcugcccgagccagcauuggcaacccgcucgggucaccuuccacacuguggaagcuuuguucuuucgcucuuugcaauaaaucuugcuacugcuaacucuuuggguccacgcugcuuuuaugagcuguaacacucaccgcgaagaucugcagcuucacuccugagcccagcgagaccaggagcccaccgggaggaaugaacaacuccagacgcgcugccuuaagagcuguaacacucaccgcgaaggucugcagcuucacuccugagccagcgagaccacgaacccaccagaaggaagaaacucugaacacaucugaacaucagaagggacagacuccagacgcgccaccuuaagagcuguaacacucaccgcaagaguccgcggcuucauucuugaagucagugagaccaagaacccacuaauuccggacacauuuuggcgaccacgaagggacagacuccagacgugccaacgcgccaccuuaagagcuguaacacucaccgugaggguccgcggcuucauucuugaagucagugagaccaagaacccaccaauuccggacacauuuggacugccuccuggguccugcaggagcaaucugcuucuuucagagcgucuuucgguucucuaggcuuuccugcaguaguuccggagcaaagguucacgaugugagucuccacacacuacucugucugagugggagcugcaaucuaguccugccucccaucugccguuuuuccuccaaauguagcuuucuuuaauuucuuucaucaauguuuuaugguuuucaggauacaggucuuucaccuccuuaauuaaguuuauucuuagguuguuuuuuuuuuuugagacggaguuuugcucuuguuacccaggcuggaguccaaugaugcgaucucggcucacugcagccuccgccucccugguucaagcgauucuucugccucagccucccaaguagcugggauuauaggcaugcgccaccacgcccagcuaaauuuuuauuuuuaguagagaugggguuucuccacguuggucuggguggucucgaacuccugaccucaggugauccgucugcuugggccucccaaagugcugggauuacaggcaugagcuaccaugccuggccuauucuuagguauuuucuucuuuuuuugugcuauuguaaaugagauuguuuuacuaauuuccuuuuuagauaguuuauuaguggauguugauuuuucuauccugcaacuuuauugaauuuauuaguuuuuuuuucuuuauaauucagucuccauggagacugucaaaaauugccagugcucacugcauuacaagucaucauggcaggguaucaggaaaaguuuuccaucagcaguaaucacaccucagauaaaccugacuggcuacgauacugccaguguucaaagcuaaauuuauugguucuaacaguuuuaaaaaacuguuaaaugguuuuuuauaucuaagauuaugucuuaugcaaauggacaguuuuaccucuuccuuuccgauuugaaugcguuuuauuucuuuuucuugccuaauugcuuuagguaggacuucuaguacuauguugaauaaaaguaaguaagaguggacaucucugccuugugccugaucucagugggaaaccuuucaguuuuucacaauuaaguaggauagcugugggcuuuucauauauggccuuuauuacauugagauaauuuccauuuguuuguaguuuguugacaguuuuuaccaugaaagggugcugaauuuuucaggugauuuuucugccuauugagaugaucauaggauuguuaucuuuuuauuuuguuauugugguguaccacaguaacugauuuucauauauugaaccauucuugcauccuaggcauaaaucccacuuagucaugguuuaugauccuuuuaaugugcuguuggauucagugagcaacuauuucauugaggauuuucguaucuguauucuucagggauauuguccuguuguuuucucuucuuauggcuucuuugucuggcuuugguaucagggaaaugcuggcuuuguaaaauguguuugaaaguguucucuccaccucaguuuuuugaaggaguuugagacagauuggugcuaauugcuccuuaaguguuugguagcauucaucaaugaaaccaucugguccugggcuuuucucuuuugggagguuuuugauuacugauucagucugcauacuucuuauagguuuguucagacuuucuacuucuucaugauuuagucuuguugguaggguguuauguuucuaggaauuuauucauuucuucuagauuauccaguuuguuggcauauggcuguuuuuaguagucucaugauccuuuuuauuuuggaggcaucaguuguaaugucucuuuccuuucuuauuugagucuucucuuuuuuucuuagucuagcuaaggguuuuucaguuuuaaaucuuuucaaaaaaccaacucuuaguuuuguuguuuuuucccuauuuuucuauuuuuuauuuuauuuauuucugcucuaaucuuuguuacuucuuccuucuggcaacuuugggcuuaguuuucuaguuccuugagcuguaaagugagguuauuugagacuuuucuuguuuuuaaugucagcauuuauuguuaugagcuucauucuuacugcugcuuuuguuucaucccauaaguuuugguauauuguguuuuuguuauuugucuugagauuuuuuuuuuuuuuugugacagagucucgcucugucgcccagguugugccgcgaucucggcucacugcaagcucugccuccuggguucacaccagucuccugccucagccucccgaguagcugggauuacaggcgccugcugccacgccuggcuaauuuuuuguauuuuuaguagagaugggguuucaccguguuagccaggguggucucgaucuccugaccucaugauccaccugcccuggccucccaaagugcugggauuacaggcgugagccacugcgcccggcaucuugagauauuuucuaauuuccuuuuuuucuuuuucaauccaguggguguucagaaugugguguuuacuuuucauguauuuguaaauuuuucaguuuucauucuuuuauagucagaaaauacacuuaguaugauuucagccuucuuaaauuugcuaaggcuuguuuuguuaccuaucuuguguucucuccuggagaaguauuccuguuugcuugagaagaauguguaguuugcugccauugaggagaauguucuguauauaucauuagauucauuuggucuacaguguuauugaagucuucuguuuucuuauugaucuucugucuggauguuuuguucaguauugaaaaugggguauugaagucuccaaucguuauucuaccguuuauuucucccuuuaguucugucaguguuugcuuuauauauuuauguacucugauguugguugcauguauacuuauaauugucauaucucccugguggauugauccuuuuaucauugucaaaugucuuuuauuuaaauuuuguuuuuuucuuuuauuucuguccuuuguaaacaaaaacuuguccuuuuuuauaaugagaaaugaugaaugucuuguguuucaugugacgguuuuucccaauguaaguauagcuaucucugcucuuucuugauuacuauuugcauggaauaucuaauuaucucuuuacuuucagccuauguguguccuuaaaucugaagagaguuucuuguaauagcauauaguuggaucuuuuuuguuuuuaaaucuauucaggcuuuuacuagaguuuaaucuauuuacauuuaaagugauuauugauagggaagaauuuuacuacugccauuuuguuguuuuuuguuagucuuauaguuuuuuugguugucuuacccuuucuugcugucuaccuuuggguuuugcugauuuuuuguauuuguaggcuuugauuauuuucuguuuuuuccuuuggguaacuucuguagguauuuuauguucuuuccuucuuaaauuacaguugaaaguauaucaccugagagguuagacauccaaaggauguucuggucuugcagcaugauuucugguguuagucuuccuuuuguuuccaagcaaaaguuaugcaauaagacagaauauaaagucuccgagagccuuaagcuuuuuuuuucuucuucacgucuguaguagauauuuguagauacuaauucuugaugaucuuaggguuuugaauauuauauccaaauauaauaguacagguuaauuuccugaacaccuugguaguaagauaauuuaagaaacuuaaggcaugaugggaaaaauagacaugagagucugauguucagaauuuaucuuugaaagcccuuagaaauguuuuaacacuuaauaaaauaauuuuuagaaagaacaccacguaaagaaaauauguucugauuuuacacuguuaauaucuauuaauagcaugauuuuuaacauuuaucuuuauauugugcaaugccaguuuuuacuuuuuauuguuuuucgagacagggucuuacuuuguuacccaggcuggagugcaguggugcgaucauggcucacugcagccuugaccuaccgggcucaggugaucuucccaccucgccucucaaguagcugagacuacaggcuugcacuaccaugccuggcuaaguuuuauauuuuuuguagagaugggguuucaccauguugcccaggcuggucuugaacuccugggcucaagcuaucugcccacguuggcuucccaaaguguugggauuacaggugugagccaccucaccuagccacugcaagccuuuuuuuuuuugagauggcaucuugcucuguugcccaagcuggagggcaguggcaccaucuaggcucacugcaaccuccgccuccaagguucaagcaauucuccugacucagcauuagauuauaggugcaugccaucacaccugacuaauuuucguauuuuuaggagacacaagguuucaccacguuggucaggcuggucuugaacuccugaccuugugaucugcccaccucggccucccaaagugcugggauaacaggcgugagccaccgugcccggccugccacuucaagucuuuagaagguuuccuuuccuuagccaggcaugggggugugugccuguaauaccagcuacuugggaagcuaaggcaggagaauuacuugaacccgggagguggagguuucagugagccgagauugcaccccugcacuccagccugggcgacagagugagacgucgucucaaaaaaaaaaaaaaaagaaaaucuccuuuucaaauuuauagaucuauagaucucaugauucuuuagcugacacuuuauuucuugucuuuuuucccuuuuucauuuggacuuaaggugcacagaauugcauuaaucacaguccuugguucauuuuuaaaacuuuuauuuuuauuaaaaaaauuuucuuuccaccauccuuagccucuaaaaguccugggauuacaggaaugagccauggcacccagccucaacuauuuucuuuuuuuuugaaacaguuuuauugauuuaauucacauaccauauaauuuauccaauucgguaguuuuuagcauauccacagacuuggacagccaucaccacugucuaaucauagaacauuuucauuaucucagagacaaacccuauguucaguagcagucauccccuguugcacccacauacuccuuccucuagcccuaggccaccacugaucuacuuugccuagauuugccuauauagauuugucuauucuggauauuucuuacguaaauugauucauguaauauguacuauuuuauaucuagcugcuuucauuuaagcaugauauuuucaaaguuuagccauguuguagcauguaucaguacuucauugucuuuuuaugguccaauaauauuccauuacuuggauaugucacauauuguuuauucaucaggugauggaccuuuggguuguuuccacuuuuuggcuuuuaugaaaaugcugcugugaacauuuguguaguuuuuggguggacauguuuucauuucuuuugagcauauaccuagggguggacaugcugcgucauaaaguaacuuuauauuuaauauuuugaggaacugccaaccuguuuuccaaaguugcuacaucauuucacauuucuaccaccaauguuugagaauucuaauuucuucacaucauuaucaucacuugucauuaugauuuuugauuauagccauucuaguggguaugaagugguauuucauugucauuuugauuugcauuuuacugaugacuaaugauguugagcaucuuuucaugugcuuaucggcuguuguguauuuucuuuggagaaauaucucuucaacuucuuugucaauuuuuuguuggguuauuuuucuuuuuauuauugaguuguaagaauucuuuauauaauuugugaaagucaccaaugcugugguagagucacuuacauccgacccaaacaaaguggaaccgggaggucaugacgaaggucucacgcuuguaugucugagauaagaacuaucacaaggaucuucuaaaaacucauaagaggcugggcgcaguggcucaugccuguaaucccagcacuuugggaggccaaggcggguggaucaugaggucaggaguuccagaccagccuggccaagauggugaaaucucgucucugcuaaaaauacaaaauuuagcugggugcaguggcgggcgcccauaaucucagcuacucaggaggcugaggcaggagaaucucuugaaccugggaggcagguugcagugagccaaguuugcgccacugcacucuagccugggugauggagcaagacuaugucucauuaaaaaaaaaaaaaaauccccagaaaaaacucauaagaaauuccuguauguccuacaugucuuagucauccugcauauucugcacacaucuguaacaggguuuauugcaagaaauuccucauggauuucagcauucuagauaagccgcucucacaagacgaacauuugcauagcaauggcugucuccaacaaugaauuagcaccagcaucuacaacuggccccuguaacuaaugauuuuuguuucaaaauagcuuacguagaccucuccucuuugccuuuaaaaguuucaccuuacuucauccuaucuguauaugccuuugaucuguuauagcaaacauauccuggauugcaaucgccugucacucccaaauaaaauuuucuuuuggagaguuucguugucacuauuuuagguugacauaaucuagacauaagaccccuaucagacauaugacuuccaaguauuuucuauucuaugggucaucuuuuuacuuucuugauuguaggacaaaaguuaaauuuuguugacauucaguuucucuauuuuuuuuuuuuuuugucuuuugagauuuuaaugucauaugcaagaagaccuugccaacuguaaguucauguagauuuacuucuauaccuucuuccaauaauuuuacaaguuuagcucuuacauuuagaucuauguuccauuuucaguuaauuauuguguauaauguaagaaggggucccaucuccauucuuuugcauauggauauccaguuguuccaguaccauuuguuaaaaaggcuauuucccccauacccccaacugaauuaucuugauacucuuguugaaaaucaauugaccauaaauguaaggguuuguuuuuagacucuuaguucuguucuuuuggucucuaugucuauuuuuauacuaguacuacacugucuugacaagugcagcuuuguaguaaguuuaaaauuggggaagugugaguccuccagcuuugcucuuuuuuuccacaguugucugauuuuucuggauuuguuccguuuucaugugaauuuaggauaagccugucaauuucuguaagaaaguaggaacuggaauuuugauagcaauuauauugaauauguagaucaauuugggaaguguuaucccaucaauauuaaauucuccaauccaugaacaugugaugucuuucuauauucagaaauucuuuaaugucuuucaauaauauuuuguggcuuccagaguacaaguuugacuccucuuuuguuaaauuuauuccuaaguauuuuauucuucuugaugcuauuugaaauugaauuuuuuuuucuuuuugagauaaggucucacuuugucacugugccuggagugcaguggcaugaucauggcucacugcagccugaaaccccuaggcucaagugaucuucccaccucaguuucccuaguagcugagacuacaggcgugcaacaucacgcccagcuaauuuuuauauuuuuuguagagcuggcgucucucuauguugcccaggcuggucuugaacugcugagcucaagcgauccuccugccuugaccucccaaaguucugguuuuacagcaugagccacugcgccuggcugaaagggaauugcuuuuuuuuuuuuuuuuugagacagagucucgcgcugucacccaggcugaagugcaauggcgcgaccucggcucacugcaaccucugcuuccuagguucuagcaguucuccugccucagccuccugaauaccugguauuacaagcacccaccaccgugccuggcuaauuuuuguauuuuuaguagagaugggguuucaccauguuggucaggcuggucucgaacucuugaccucgugauccacccgugucgggccucccaaagugcugagauuacaggcgugagccacugugcccggcccuggaauugcuuuuuaaauuuuauuuucagauugcuuauugcuagguuuagaaaauuaagaaguauucuuucauuucuagagcacaaauuaggaguuaggauuucuauuugguuuuauuccaaguauauagagguauaugaaaauguuauuuucucauaaaaaccucuuuucauugccuuauuuaacauuuauugagucuucauucguaaccuccuauggaccauaucuucacccuccaaggcaugcagugugaaugaauuuaaaaauauaucaucauagguuuauuguuugaaacauauuaauauagagugaaauuugaauaaggugauaagacauuuuuucacuaacuuacaauuaucauauaggcugcuguuaacuuaaagggcagugauuugacaaaaccaauacagauuauuacaacugguucuaauuauguuuaugaacaagaguuaagauuaugaaaccaaccuuuuuuggaggcacuugguuagaagagcuuuguaaaugauuuugauuuucuuuucacuagcuauuuuuauuuuuuauuuuuuauuuuuuuugugagacagagucuugcuuucacccaggcuggagugcaguggcgugaucucagcucacugcaaccuccacuucccagguucaagugauucucaugccucagccucccgaguagcuaggauugcaggugugugccaccacagcuggcuaauuuuuuuuuguauuuuuaguagagaugagguuucaccguguuggccaggcuggucuugaacuucuguccucaagugauccacccaccuuggcaucccaaagugcugggauuacaggugugagcuaccacgccuggucuucucuagcuauuaauaacacuuauuaauacuuuugcuucauacuaaaauuaaaaagcuccugccuuauuaauccucuauauagccuacugcaaugguaaauauauuuaauguauuuauuuuagaaagagaaaaauuaagucagagaauggcuaaaauaaaauaguuuaaaaaagaaaaugccagguucugauaaggaugggaagcaaccagaacucucauacauugcugguaugaguaugaauuuguacagccccuaagaaaacuguuuggaaguauuuacuaaaucgaacauaagcaaauuuuaccuugccgaguguauuagcaugauggaauauagagugucaacuugauuggauugaaggaugcaaaguauugauccugggugugucugugagggcguugccaaaggagauuaacauuugagucagugggcugggaaggcagacccacacuuaaucugggugggcaccaucuaaucagcugccaucauggcuagaauauaaagcaggcagaaaaaaaaaaaaugugaaaagacuagacuggccuagccucccagccuacaucuuucucucaugcuggaugcuuccugcccucggacauuguacuccaaguucuucaguuuugaaacucagacuggcucuccuugcuccucagcuuucagacggccuauugugggaccuugugaucaugugaguuaauacuuaauaaacuccccuuuauauauauauaucuauuuguaucuaucuauacauauauauaucuucuauuaguucuguuccucuagagaacccugaccaaugcaauuaggguucuuagcagaaauugagccaaugggauuuguacauauauacagaaagauuuauuauaagugauuggcuccgugauuauggagacugacaagucccauggucugcagugggcaagcuggagacccagaacuguugauaguguaguuucauuccuaguccaacagucucaaggccccggaagagcugauguuugaauaugaguccaaaggcaggaaaaaacugauguaucagcuugaaggcugucagacagaagaaauucccuauuacuaagucuuuuugcuuuauucaggccuuccacugauuggaugaggcccaaccacauuauguagggagaguucuuuguguuuuggaugcaagucuucuaucagauacacuuuuuacagaaauuucccacuagucuguggcuuguccuuucauucccuuaacagugucuuuugcagagcgaaguuuuaaauuauaaugaaguccaguuuaucacuuuuucuuucauggaucaugcuuuucauauuguaucuaaauagucauugccaaacccaaguucacuuaguuuuuuuuuuuuucuauguuauuuucuagaggauuuauaguuuuauauuuuacauuuagguguaugauccacaauaucguuuggcugugucccccaccaaaucucaucuugaauuguagcuccuacaauucucaugugucgugggagggacccacugggagguaauugaaucauggagguaggucuuuccccugcuguucuugugauagugaauaagucucaugagaucugaugguuuuauaaagaagaguuccccugcacaaacuucucucuuugccugcugccauccauguaagaugugacuugcuccuucuugcuguccaccaugauugugaggccucuccagccauguggaacuguaaguccauuaaaacucuuucuuuuguaaauugcccaguuucugguaugucuuuaucagcagcguggaaacaggcuaauacaguaaauucauaccaggagaaugagacacuguugaagauacccaaaaauguggaagugacuuuggaacuggggaacagagagugguuggaacaguuuggagggcucagaagaagacaggaaaauguggaaaaguuuggaucucccuagagacuuguugaguggcuuugacaaaaaugcagauaaugauauggacaguggaauccaggcagagguggucucagauggagaggagaaacuuguugggaaguggagcaaaggugacucuuguuauguuuuagaaaagagauuggugacauuuugccccacccuaaagauuuguugaacuuugaacuugagagagaugauuuaggguaucugguggaagaaauuucuaagcagcaaagcauuccagagguaacuugggugcuguuaaaggcauucaguuguaaaaggaaaacagagcauagaaguuuggaaaauucgcagccugacaaugagauagaaaagaaaaccccauuuucugaggagaaauucaagcuggcugcagaaauuugcauaaguaaugaggagcugaaugauaauccccaagacaagggggaaaaugucuccaaggcaugucagagaccuuuguggcagccccucccauuauaggcugggagguuuaggaugaaaaaaugguuucauaggcagggcccagggccccccugcucugugcagccucaggacuuggugccuugagucccagcuguuccagcugugacuaaaaggggccaaacaacagcugggucuguugcuucagaagguucaagccccaagccuuggcagcuucaacaugguguuuagccugcgggugcacagaagucaagaauugagguuuaggaauuuccaccuagauuucagaggauguauguauggaaaugcauggaugcccaggcagaaguuugcuucaggggcugggcccucauggagaaccuccgcuagggcagugcagaagggaaaugugggguuggagccaccacacagaguuacuacugggacaccaccuaguggagcugugagaagagggccaccauccuccagaccccagaaugguacguccacugacagcuugcaccaugcgccugaaaaagcugcagacacucaaugcuagcuggugaaagcagacagaaggcuauccuccgccacaggggcggagcugcccaaggcuguaggagcccaccuuuugcaucagugugaccuggaugugagacauggugucaaaggagaccauuuuggagcuuuaagauuugacugccccacuggauuucagacugcauggggccuguagccccuuuguuuuguccaguuucucccauuuagaauggcuguguuuacccaaugcuuguacccucauugugucuaggaagaaacuaacuugcuuuugauuuuacaggcucauaggcagaagggacuugccuugucucaaaugagacuuuggaccauggacuuuugaguuaaugcugaaaugaguuaagauuuugggggacuguuggggaggcaugauugguuuugaaauaugaggacauuagauuugggaggggcugggguggaaugauuugguuuggcuguguccccuaccaaaucucaucuugaauuguagcucccacaauucucacgucaugggagggacccagugggagguaauugaaucacgaggcgggucuuucccgugcuguucuugugauagugaauaagucucaugagaucugaugguuuuauaaagaagaguuccccugcacaaacucuucucuuugccuguugccauccauguaagaugugacuugcuccuccuugccuuccgccaugauugugaggccuccccagccacguggaaguguaaguucauuaaaccuuuuuuguaaauugccaguuucugauaugucuuuaucggcagugugaaaacagacuaauacaaucuauuuugaguuaauuuugggaacgccauagggucuaugucuugauucauuuuguuguacguggauguccaguuguuauagcaccguuuguugaauagacuauucuuucuucauugcuucuuugacaaagaucaguuguccauauuguguggguuuauuuaucaacucucuauucuguuccauugaucuuuuucuauucuuucaccaaaaucauagucuugauuauuguaggccuauaagucuccugaagucagguaaugucaguccuccaauuuguuuuucuucaguauugugucaccuauucuaggucuuuugccuuucaguauaauuuuagaauuauuuucuugauauccagaaaauaauuuacugggauuuugauugggguugugugaaucuguagaguagauuggguagaacugacguguuaacaacagcaaaucuuccuucugugaauguggaauaccucuccauuaauuuagauauuuuuaaaaucagaguuuuguaguuuuauauccaaguaauucuuuuuuggggcugcuaauguaaauggugguuuuuuuuuuuauuucaaauuccaguuguuaauugcugguauauaggaaagcaauuuauuuuugaacauuaacuuuuuauccugcauccuugcuuauuagugccaggaauuuuuguugauucauuaggauuuucuacauaaacaaucaugucaucagagaacaaagagaguuuuauuucuuucuuccaaauauguaugccuuuuauuuccuuuucuugucuuacuguauuagcuaggacuuccaguaugauacggaauaggaguguugagaggagauaucuuugccuugauuccagucuugggagaaagauucuaguguuuuuuuuuuuuuuugagacggaguuucacuuuuguugcccaggcuggacugcaauggcgcaaucucggcucacugcaaccuccaccuccuggauucaagcaauucuccugccuuagugaguagcugggauuacaggcaugcgccaccacaccuggcuaauuuuguauuuuuaguagagacagaguuucuuuauguugaucaggcuggucucaaacuccugaccucaggugaucugccugccucggccucccaaagugcugggauuacaggucugagccaccgugcccagcccuaguuuuuuuaaucauuaaguaugauguuagcugugggguuuuuguagacauucuuuaucaaguugagaauuuuuuuuuuauucacagguuucugagaaucuugaucaugaauggcuguuggauuuuugucagaugauuuuccugcaucuauugauagguuauguuucaucuuuagccuguuggugugauggauuguauuaauugauuuuugaauguugaaucagguuugcauaacuagauaauucccacuugguugugguauauaauucuuuuuauauacuguuggauucaguuugcugauauuuuguugaggaacuuugcaugugugcucaugagagagauuugucuguaguuuuccuuuauuucaaugccuuuauuucauuuugguauuaggguaauguugaccucauauaguguguuagaaagcauucccucugcuucuguuaucuguaagauauuuuggagaauuguaucacaucuuccuuaaauuugguagaauucaaaagugaaacuaucugggacuggugcuuggaagauaauuguugauucgguuucuuuaauagacauagaacuaguaauaugauuuguuugacuuggaaguuuugguagauuaugucuuugaagguauuuauucaucuaaguuuucaaauuugugggcacggaguucauaauauuccuguaauuuuuuuuuggugucuguggaaacaggaguaauggccccuuuuucauuuucauguguuaguaauuuguguucuuuuucuacuugguuggccuggcuagagguuuaucaauuuuauugcacuuuuugaugaaccagcuuuugauuuugugaauuuuaaaauugauuuccuguuuucauuaauuugugcuuuuuuuaaacuuuuuuuuuuuuuuuuugcuuacuuuggaauuacuuugcucuuuuuuuuucuaguuuccuaagguguagaagcuuauucaauuuagauauuucuucuucuguaauguagcaauucagugcuauacauuucccucuaagcgcugcuuuugcugcaucucacacauuuucauaagauuuauuuucauuuucauuuaguucaaaauauuuuaaaauuuguuuugagacuucuuugaugauguguuauuuagaggcuuuuuguuuaaucuccaagaaguuuuccagcuauauuucaguuacugauuuauaguuuaauucuauugugaucugagagcauaguuguuaggaauuauauuguuuuaaauuuguuaagguauucuuuaugaaccagaauaugauaugucuuagugaguguuuucacgugagcuugagaagaaugcauauugugcuauuguuggaugaaauauucuauaaaugucaauuagauccaguugauagaugaugccguucaguucaacuauguacccuuacugauuuucugccugcugcaucugccaauuacugauagaaggauguugcagucuccaacuauaauaguagauucaucuauuucuguuuacauuuuuguccauuuucaccucacguauuuugacauuuuguuaguucuucuuggaaaauugaccccuuauuacuauguauugcuguucuuuguccugauaauuuucuuugcucugaagucugccuugccugaaauuaauauagcugccguucucuugauuauuguuaacaugguuugucuuucucugucacuguacuuuuaaucugucuuaaaauacuuuuuuauagacaacauauaguuaaguauuuuuuauccacucugucucuuuuaauugguauauuuagaccauucauauuaaagugaucauugauauuauugguuuaauauuuaccauaguuuuaacuauuuucuauuguccuuguucuuggugguuuuuuuggucuuuuuuucugucuuugguucuagcugagcauuuuaugagucuguuuucuuuccucucuuagcauaucaauuauacuucuuucaaaauauuuucagugguugcccuugaguuugcaauuuacauuugcaaguaaucuaccuucacuuucacauaacauuguauugcuucaugaguagugcagguacauuaugagagaauauuccuaguuccccucuugcugucauucauuucacuuaucuagaggcuguuaucaccaaauacauuauuguuauuauuacuuucaauaaauuguugucuguuagauuaagaaaaagaaaauaaaagacuuuauuuuaccuucacuuacuccuucucuaaugaucuuucuuuucuuuuuuuuuuuguuugagauggagucucacucugucgccuaggcuggagugcaguggugugaccucugccucucagauucaggcaguucuugugccucaagucuccugaguagcugagauuacaggcacaugccaccaugcccaaccaauuuuuguauuuuuaguagagaugggguuucucgauguuggccuggcugguuucaaucuccugggcccaagugauccacccaccuuggccucccacagugcugggauuacagccaugagcccagccaccguucaugacacuggccuaaugaucuuucuuuacauagauuugaauuucuguccuguggucauguucuuuuaugaagaucuuuuaaaauuucuugcuaagccaccugugccuccaguaaaaacaaaaaaagaaaaaaaauucuugcuaauuaagucuauuggcaacaaauuccuucaguuuucuuuugucugacaaauucuaucuaucuaucuaucuaucuaccuaucugucuauauuuauuuauuuauugagacagagucuugcucugucgcccuggcuggagugcaguggugcgaucucggcucacugcaagcuccgccucccagguucacgccauucuccugccucagccuccugaguugcugggacuacaggcacccgccaccacacccggcuaauuuuuuguauuuuuaguagagacaggguuucaccuuguuagccaggauggucuugaucuccugaccucgugaucugcccgccucggccucccaaagugcucuccuuuauuuuugaaagauaauuuugcuggauacagaacuuuggguugguguuuucauuuuucguuuuuuccuuuuaacauuugaaauauuuuacagcuuucuuuuugcuugcaugguuucugaagagaagucugaugcaauucuaaucuuugauccucuauuuguaaggcauuuuuauuccuguagcuuauuucaagauauucucuuuaucuuugauuuucugcagcuugcagcauaugauaugccuagacauagguuuuuuuuuuuuuuuuuuuuuguauuuacguuguuuguuggucugugagcuuucuggaucuguuagguguuuguauuaauuuuggcaaauuaucagccauuaucacuugaaauauuuuaucuguugcuuucugucuuuuuuucugguauuccuguuacguauguuaugccuuuuguaauuguucuguacuucuuggcuauucuguuucuuuucagaauuguuauuuuuucuguuugcuuuucagcuugggaaguuuccauugacauaucuucuaauugacuaauugcuaugguguuaagagauggggagaggggaacauuguguagucuugugauuaggucucagucuuuuauugagccuaugccucuggucugugaccuucacaggugucuagucuacugaugagcucauuaaagcauucuucauuucuguuacaguauauuugauuucucccauuuaaaaaaauuauucuuaacauuuccaugucuuugcugacauuacacacauauuuuugaauguuguuuacuuuuccaccuuugcauauuaauaauuaaauucagacucucauaauccccaaaucucugucauaugugagucugguucugacucuuugacucuuuagauugugauuuuugcauuugagcaugcuucguauuuugugggaagccggauacgauguagauaaaagggauugagguaauuuggccuuuacuguuagauuuuauguuuauguaugugugaguuaggcugcuuacuguuugaaguagcuacagguuucagaggguauaauuuccccuaguguucuuguuuuuaucucuucuguugucuuugguuuccccuagagacuacuucuuaaauagaauuugagccuugcaguucuuuuagcuguaaucuccuguuauuauacuccagccugauugaggggaacauuuuguagucuugugauuaggucucagucuuuuauggagccuaugccccggucugugaccuucacaggugcuacucggcuuuugaccuccuuccuuaggugaagaaggcuagagggggcugaagcugggugucucucuucuuccagguugauuaggcucugauaaaauucaaauagguuaagcuguggguacaaaugguuucucuugcagacgggccuuucuugaggugaacagcaugcccugggcauauuucagaauguuuacguuuuccuuuuccugcuggaagcuugaagggauuuuauuuuuuuauuauuauuuuuuaauuaacaguuucccuaaucuuuacucugagaaucugguaggacuccugaaggaaaaacuuuaaaaaagugugggaguccccccugagacuagacuucuggaguuuuucucucucuaguuaguccacacugauccucuaguaauucaucaauuacaguugaaguguuuuaccagugcuggcucuagcagcaggcuucuguacaagggcuuuugucucuccacuuuuuagagcaguaguuugcccuguaauuuaacuucuuuuauggauuuaagaagaguuguugacuuucaguuuguucaguuuuuuucuuguuacgaggaugggaaagaugacuuccaagcuccuuucauguuggacuggaagccagaagccacuauguuaucuuuuaccuuuaugucugauuuacuugaagauugcuuuuaguguauggcauaugauguauauaggugguuuuuuuuuuuuuuuuaauuuuauucuaugugggccaggcacgauggcacaugccuguaaucccagcauuuuaggaggcugagguggguggaucaccugagguaggaguucgggaccagccuggccaacaugaugaagccccaucucuaccaaaaauacaaaaauuagccgggugugguggcaggugccuguaaucccagcuacuugggaggcugaggcgggagaauuccuugaacccaggaaguggagguugcagugagcugagaucacgccacugcacuccagucucagugacaggaugacacuuugucucaaaaaacaaaaacaaacaaaagcuuuauucuauguggugacuuccuuuggguucaucauuuggcagcugcuugagaaucuucauuugauacccaguuucugcauagauuuaauccagagaaguuauucuaggacuuuuagaaagugguucuauuuuacuuuuaauuuuaaauacaguuuuggauggcaugacaaaaauuaguguaaauguuuuucuuucuaaagcacagggugugagaucauaagggauagugcuuuuuuuuuucuuuuaacauuaaguaguuuggaaugaucugucccuuaaucuggcuaauauuucuuuaugugacccauuuuuuuuuaaaagagaaaggaaugugcuuauuacaauauauuagugaaauuaguauuaacauuuucuacuguggcaacuuacaauaaaaaaugaagcauuauucggccgggugcgguggcucacgccuguaauuccagcacuuugggaggccaaggcgggcagaucaugaggucaggagaucgagaccauccuggcuaacacagugaaaucccgucucuacuaaaaauacaaaaaauuagccggguguggugacgggugccuguagucccagcuacuugggaggccgaggcgggaaaauggccugaaccugggaggcagagcuugcaaugagcugagaucgggccacugcacuccagccugggcgacagauugagacucugucucaaaaaaaaaaaaaagcauuauuuguaauuuacuguucaaguuauguuguauauguaauuacuucugugcuuaucuucuguacuuuuuuggcaguuaaucuaaaacagaguuucucaacguuggcacuguugacauucuggacagauuguucuuuauuguucgggucuguucugugcaucaugggauuuuaacagcaucucuguucucugaccccagaugcuaguagcacgauucaccugguugugacaacuaaacuguccccagacauugcaacaugucuccugggggggacauugucacccucaguugagaaucauaggucucaacccuguuuagcaaaaggcaauaauguaaagauuuuauuugguguuacuuuuccaaauaacguaaaacuccaagugagaaucauagauagaucucuaaaggauuacuugaaaauuauugugucagggguguagaagccuauaauuuuuuaaaucuaaugcaugcaucagauaguauagaaacaugcuauccaucagauaguacaggaaaccuuaagaagaauaaggcuccuauccaaguauuuuccauaagcaaucucuuauuuuuuuuuaguuuuucuaagugauuucuguaaugcuugguaauauuuguuggcuuaccaacauugaacacguauauugacuucccaauacagacacugaggauuuaacuacuagcuuucugauaggauuuacacuacaguagugaguauucacacuacuuuguuuuucccauuuccucugguguuuauuguuauauuauuauuuguuauucucuugguuacccuuuugagaccuggaccgaaaucuuuauuacuuguuauauuacuuuguuccuagagguguguucuuaaagucucaaguggcagcuauuauugugauucuuguugcuaguaguaguaaugguaaccuaauuaucuaaaaguggaggaauguuucuuuauuguaauauaaauucccaggaauaacaguauugaaucagagugcauacauaggccaucauauugcuuuccugaaagguuauuagaauaaauuuuauuguguucauuuugaaaauaguacuuucauccuguguaaauaaaaguccuuauuguuaaaacuuuaauuuuuucauagaucuaaggaagaagguaaaaggguaaaaauaaucugaaauuccaccauucugaaauaagcacauuguuucauaccucuauguauaucuauacgacuuaaauaauuuuacauuagucacuauguguuuacuguuuuuaugugcgaguaucuuuacuuuuucucucuccauuguuuuuggcuuacaaucaugacuuauuucuacccucuucucuccucacuccccagccccccaacuuuaccaucuccucaagaaaccaguaggaagaguaaucugguguauagucguccauucuuguuacugggccuaaaauauuucacagcauguuguauuaaaguauaauauuauugaugacauuaaugaacuugaaauaugcugugauaaucuugaaaaagugaauauuuaccccuugcuaagggucuuaguguuuucugugaggaagcauugcuuugccuuuauugaagcacaaguugaaagacacagggcaauuuauuaugacaguuuagcaacuaugagaagaguagguaucagcauguguauuguauucaaauuaauuguucugaagauagggcauugguaauuuuguuuacuucucuguuuugaaggguguguuaguucauuuugcguugcuguaaaggaauaccugagacugaguaauuuauaaggaaaagauaguuauuuuggcacacaguucugcaggcucuuugagaagcauauugccggcaucugcuucuguugaagaccucagaaagcuuccaaucaugacagaaggugaaguggcgggugucauauggcgagagggagcaagagggaauggauaaagagagagaaaggaggugccaaaguccuuaaacaaccagauccugugugaacuaauagaacuuacucaucaccaaggggagggcaccaagccauucaugagggaucugccuccaugauccaaacacuuccaccaggguucaccuccaacaguggggaucacgcuucaacaugaaauucugaggggacacacauccaaaccauuucaaagggugauuuguugcaauuacaaacaauagaaaagugaacaucuuuauauauacauccuuguguggguauacaauuguauuugaaaggaaugcuuucagcugcaagcaaaaauauacccaauguguuuuuaaugaaacagagguuuuucucauaaaaugucuggaggaaagaacuauuguuacaugcuacagcauggaugaaccuugaaaacauuacgcuaagugaaagaagccagacacaaaaaggcacauacuguaugauuuuauuuauaugaaauacccagaauaggcaaauacauaaaaacagaaaguagauuggugguuacaagagucuaagcagggugggaggaauauaggacauugaauuuaauaaacacauuuguuacuagcugucuuagucuguuuugugcuacugaaacagaauaccacaggcuggauaauauauaaugaacagaaauuuauuugguguaugauucuggaggcugggaagcccaagaucaaggggcuggcaucuggcaagggccuuuguguuguaucaucccaugguggaaggcagaagggcaagaagggggccagacuugcuuuuauaacaaaccugcucucaccguaacuaacccacuccugugauaacauuagucaguuuaugaggauagaauccucaugaccugaucacuuuugaagccccaccucaacacuguugcauugggaauuaaguuucaaauacaugaacuuugggaaacacacaaaccauagcacuaaugcaaucguauuacuuuuuaaaauuagacuuuauuuuuuagagaaauuuuagguucacagcaaaauugggugaagguaaugagauuuuuccauauaucccuuggcuccacacaugcauagccuuggccauuaucagcaucccccaccagaguggaaaauuuguuaugguugaugaccuuggguugaacaucaugacuuagauuccauaguuuacauuaguguucacucuggugguguacauuccauggguuuggaaaauuuuauaagaacauguaucuaaccuuauagaaucauacagaauaguuucacuguccuuaaaaguucucuaagcucugccuguucauuccuuccuccccucaaccccuggcaacaaacaacugaugcuuuuagugucuccacaguuuuguuuugccuuuuccggaauauaguuggaaucauacaaauguugccauuucaaauugacuucuuucacuuagcagcaagcauuuaaguuuccuccaugacuuuucauugcuuugacagcucuuuuaauuuuuaacuuuuauuuagguucaggggcacauguacagguuuguuacuauguuucacagggguuugguguacagauuauuuugucacccagauaagaaacguaguaccugauugguaguuuuuccauccucucccucccauccucaaguagacccugaugucucuuguucccuauguccauguguucucaguauuuagcccccucuuauaaaugagaacaugugguauuugguuuccuguucuuguguuaguucacuuaggauaauggucucuagcuccagcuccauccaugucgcugcaaaggacaugaucucauucacuuuuauggcugcauacuauuccaugguauguacauaccacauuuucuuuauccauucuacuguugauggucauuuagguugauuccaugucuuugcuauugugaauagugcucugaagaauauaaugcauguaugugucuuuacgguagaaugauuuauauuccuucgggucuguagccaauaauuggauugcugggucaaaugguaguacuguuuuuguuuuguuuuguuuugcuuuuuuuuuuuuuuuugagacagagucuugcuuugucgcccaggcugcggugucaugguacgaucucugcucacugcagccuccgccucccagguucaagugauucuuguacuugagcuucccuaguagcugggaccacaggcuccugccaccacagccagcuaaucuuuguauuuuuaguagagacgggguuucaccaugaucccagguuguucuagaacuccugacuucaagugauccacccaccuuggccucccaaagugcugggauuacaggggugagucaccaugcccagccaguauuucucuuuuaaaugguuugagaaauugccacacugcuuuccacagugacugaacuaauugacaguuccacuagccaguuuauaagcauucccuuuucucugcaaccucaccagcaucuguuauuuuuugacuuuuuaauaauagccacucugacuuggugugagaugugauuuugauuugcauuucucuaaugauuaauaaugcugagcauuuuuucauaugcuuguuggcugcauguaugucuucuuuugaaaagugucuuuucuuguccugugcccacuuuuuagugggguugcuuuuauuagaccuuugucagaugcauaguuugcaaauguuuucuccuauucuguagguugucauuuacgguugauauuucuuuaguuguacagaagcuguuuaguuuaauuagauucccauuugucaauuuuuguuuuuguugcaguugcuuuuagugucuuugucaugaagucuuugucagggccuguguccagaaugguauuuccuagguuuucuuccagaguucuauaguuuuagguuuuacauuuaagucuuuacuccaucuuuugcauuuuuuuuuuuuuaguguugaaugaucuucuacauuuuaguuauuuaccuauugaaggauaucuugauuccuuccaaguuuuggcaauuaugaaaagagcugcuauaaacauuccugugcaaguucuuguguggauaguuuucaacuuuuuuggguaaauaccaaaucuaacgggauugcugaaucauaugguaagaguguuuuuaguuuuguaagaaacugccaaguuaucuuccaaaguggcugugccauuuuguauucccacuagcaauuaaugagaguucuuguugccccacauccucaccagcauuuggugguguucguauucuggauuuuagucauucuaauaggugugucaucacagguaucuuguuguuuuacuuuguguugauguggagcaucuuuuugugugcuuauuugcuaucugcguaucuucacucaugaggucuuuggccauuuuucaauaggacuguuuguuuucuugugguugaacuuucagagcucuuuauauguuuugcauaguaguccuuuaucagaggagucuuuugcaaauauuuucucccagccugugauucucuuuucauucccuugacagugucuguugcagagcacaaguuuuaaguuuuaguaaagucuagcuuaucaauucuuucuuucauggaucaugccuuuggugcuguaucuaaaaagcaauccccaaacccaaggccaucuagauuuucuccuuuguuaucuucuaggagucucacaguuuuguguuuugcauuuagguuuguaaucaucauccauuuugaguuaauuguugugaaguguauaaggucuaugucuagauucauuuuuaugcauguggauguccaguuguuucagcaccauuuguugaaaaggugauccuuucuucauuauauagccuuugcucuuuuugucaaagaucaguugaucguauuuauguggguauauuucugggcugucuuuucuguggaucuauauuuauauuugucuguguuuuuccaucaaugucaugcugucuuaauuauuguagccuuauaauguuuugaaacuggguagugucaguccucuuucuucuuuuuaaaauuaauuuuguuuauaugcauaauuguauguuuaugggguauagugugauguuucagugcauguauguguacauuguguaaugaucaaaaaggggcaguuagcauguccauuaccucaaacucuuaucauuucuuuguggugauaacuuucaagauacucguuucuagcugucuugaacuauacaauacauuguuauuagcuauagccacccuacuauguaauagaugacuuuguuuuuuuccuucaauauuguguugacuauucuggaucuuuugcuucuccauguaaaauuuagaaucaguuuguugauaucuacaaaauaacuugcugggauuguaauuguaaucgcacugaauguauagaugaaguugggaagaaccgacaucuugacaauauugagucuuccuauacaugaacaugcaaucucucuccacuaauuaaguucuuugauuucuuucagaguuuuauagcuuucuuauacagauucuguacauauuuugauagauuuauaguuaaguauuuugcuuugguggaaugcuaauauaaauaguguuuuacauuuauguauuuauuuacauuaaauuaauuaaugagacagggucucacucuguugccaggcuggaguguaguggcaugauuauggcaugauuuaucuuugcauauuuggcaucuuuguuuuuguuguuguuguuuguuuguuuuuuuaaaagacaggguuucuaucugucauccaggcuggagugcaguggcaugagcaauagcugugcacugcagccuugaacuccugagcuugagugacauccuccugccuaagccuccugaguagcuggcacuacauguucaugccggcuaauuuuuaaaaaauuguaaauuauuuuugcagagauggggucucucuagguugcccagggugucguuaagugaucacuuuuggucucaagugaucuuccugccucagccucuugaguagcuaggauuauaggugugagccacuguuccuguuuuguuuuuuuuuuucugagguauuuugguacugugcuuuuugguacaugaagauucaugacaguucuuuucccauugugguuuacaccauucuuccuuaagugcccuacuuugucuuacuucacacuuuugccuuaaauucagccuugucugagagaagaauaaauugaauugggcacagucguucacaccuguaaucucagcuacauggcgaauggaagugggggaucacuugagcccaggaguucaaggcugcaguaaacugugauugugccacugcgcuucagccuaggugacagagcaaaacccugucucuuaaaaaaaaaaauuucaacccaucuuucuuuuuuguuaccaucagucugguaugucucuguuuauuuugugauuuucaacccuucugagucacuuuguuuuaagauauguaucauucuaucaguguuuucuuuuaauaguuuuucccguuuacuauuauugauuuaaauaugucucaucuuuauuacauuauuaucuucauaacuauuuuugucuuccugucuuuuacuacauagucuggauuuuucuauuuuauuuuucuuguuguuaggguaauuucaaagaaguguauuuuuaauuuuaauuauuuuaguggguagcuuauuauuuauuuauuuggagacggaaucuugcuccauugcccaggcugcauuaucugugaccucucugcuauggaauauaagauuauugguuuaaaaauaguucacuugcuuucucucucaggauuuuguuauuuuuaauuuuuuauugauacauauuagauguauauauucuugggguacacaugauaauuugauacauucaaauaaucagggcaauugguauauccaucauggguuuuguuagaaauguguuggugauagcaguccuugaacccacuuuguacucaucacucuuuuaugauacuuauucuucacuugaaauuaguugaagccgauaggccuuaaaugaaaggcugggugguacaauuugauuauaacgcaccagucugaauuuagauucaggugugauuccucaaauuuaagaauauuaguuuuuaacaauguauauuaaagguacuauucaguuacuuaugacugugucaccucucaagugccuagccauucuugaucagcagcaucaggacuaaagccaugcugccuccuucuuccagggcugcguugccuucuuucugggcuagcuagcacaguaggacaugcaucccaguggguauuuugcugugagcucugaaauagggcauggcuguuccuucccugaccaggagcaaagcucaauuuguucacaguaucacaagaugccagaauagagcccaucuuuuuuuuuuuuuuuuucauucagguguacuucacuuuuagugaugagaagcuggacuguuuuuuucuuuuuuuugguuaggaauuuccuuucauccuggacaaagggagaauaggcaucauuauagcuuucuuuuauuucacucaucccucugacucugucucuggaagagacuuacaacuuuagaguagaaccuacuccucguccuacuuuugaaacuagaaacacagucuaaugaguucugugauuuuuguuuuggucuguuauaguuguauucuuauuuucauaguguguagcuuuuuuuugugugagacggagucuuguucugucacccaggcuggagugcaguggcgugaucuugggucacugcaaccugcuucucccggguucaagcgauucuccugccucacccuccugaguagcuaguauuacaggcguguaccaccauccuggcuaauuuuuguauuuuuuguagagacgggguuucuccauguuggccaggcuggucuugaacuuuugaccucaggugauccacccaccucggccucccaaaaguacugggauuaccggugugagccaccaugccuggcccuaauguaugacuuuuauuucaauaauaauacuuacauuuguuuuuaaauuauuagccuuacuuguacucuuaaauguauuauuuuccauuagucuuauccaaugcauuuugguuacuuguuuuccuuuucuccauuuucaugcuuucucaucuaccacuugugcacuaaaucccugaaucuuuucuuucuuuuuuuuuuuuuuuugagacagggucuugcucuguugcccaggcuggagugcaguggccccaucuuggcucaugacaaccuccaucucccagguucaagcuauucucgugccucagccuccugaguagcugggauuacaggcgugugccaccacaccuggcuaauuuuuguguuuccggguuucgucauguuggccaggcugguguugaacuccugaccucaagugauccaacugcguuagccucccaaaguacuggaauuacagacgggagccacugcacccagccuucccuggauuuuaugaaaugauuguguuucaccuuuaaacauaauuuuuaaaaaauucagaaacauccuuugaucaaaacauucuauucuugcagcuuccuuggucaagugcuuucguugcagcuacuucuguaccgugaacauuaggugauugaagucuuuguuucuccuguccaucagccuacccuuaguuucaguuuucuccuaaucuacuuugguaucauggccagucacuucacucacucuugcuaauacccuaaaccagugcuucucacacuguggucaggggcuuccuugggauugauguugaaauccugggaguauuugauguuaccuaugaagagcuuguggaguaagaauagaugggugcucaucccagaaauuacagagaagauuguuuaaaggcuggcaggaaaagggaagcuugugagggagacugggagaacaacagagagggaggaagacugcugacagaaguugcugcauagagcucagcaaaaaucaugaaguguaauuuuccuguuagguuuacugaccacuuugaguuggucgaugagugugaaguuugaugaguggcuggaaggagugaguggugaaagguagaagucugcaagcacaggcuauuauuuugaagcgcuuggcuggaaaggggaggagagagcuaggauaucuguuagaaucaucaagcuucuaguauuucuuggggacucuaccugcaucugccucagcaucuaggaaucuggcucucauguuuuacagcaccaccaggcugccagcacugcugaggguuuuagcuuggacuugccuggaacuuuaaaggccauuuaaucuuaccuugacucuuauuucuauuauauuugcuccauuuguucucccauaugauuuacauacuccuucuggaauaggaauuaaaagaaauuaaaaacuguguaagcaaaaacucaguuguaugucaaaaacccaguuccccuugaggaagagaaagggcuggaguucuuuaaaauuaacugccuguuuuucuuucugaggcuagugagccuuaucucucccuuucccaggcauuguacagacacuguuucucuagcugcgcagcugcaaggucacucaacagauaaucucaagucuuaaaacguguuauuccuuaaaaaguaaaaaauaauauaacgcacaucuuaauuaaauaacugucuuuguuucucacuucuauaauacgcuucccccuguacaaaucuccccccgccccacaaaaugcuuaaaagguagcuugacucuuuguucgggccucaguccuuuagauguuaaucugacuggguuggggcaccuaaauaauuaaauaauuacuccucaaccccaucggucucucugauuccuuauuacccugcagcacuucuucccucacucuccguauguaucugauuugaugaacuugcuucuguugcacugaggaaauagaugccaucaaaaaauguagucaugucuuucugcuuucaccacacguaacuaccugcaacugaacugaaauauucugucuccuccuuguucuccuccuuuuuauuuauggauacauuuuauaucacucccacaacuugagcacauaacuucagcaauugcuucuuuuuucucuugcaucaauaauuuuucucucuacuggauuauucauauaaucauuuguaaugcuuuucauuuuuuaaaaaaacacgucacaaucccuucacauuuucuuugcuccucuuuauaaucaaacuccuggaaaguucuguguacuugcauuucuguuuccaacuauucuucuuucuuaaucugccucaggguuuuaccuccacuacuccaucaagauaacucuugucaaggucaccagugaccuccauggugcuaaauccagcuguuaauucccaguccucaucuuucuuggccugucagcaguguuugacacugucgaugauuccauuuuccuaaauaaacuuucuucauguggcuuucaagacaucuagucucuugguuugccuccucccuugcugacugcugcuucucagucagcuuuugugaauccuucugccaagcugauuucuaaauauuugagagcucuaggucucuauucucagacuucucuucucuggcuauacuuacucccugggauggaaaucucgucuagucucaggacuuuaaauaucaucugcagaugauucuaagguuuuaaaaaauuuauggccuggcccuuucuucugaaugguacagauuuuuauccaacugcccauccagccucuugaccugagugaauuauauguaugucagauucaacaguguuaagcuauacuuauuucucccucaaaacuacuccucuucuaaucuuuccugaguccugaaauggcaacucugucuuuccaguuucucaggcaaagaaccuuauauuuauucuagcaaaucuuaucaugucugcuuucaaaacgugcccagaauuccaugucuucugagcaccuccuugcacagguccgaguggcugcucucggcuuccugcaguucuuuguugccugcucuccuugccucuguccuggcccuuuuccaguuucuuuucuuuuucuuuuuuuuuuuuuuuuuuuugagaccgagucuugcucagucgcccaggcuggagugcaguggcacgaucucggcucauugcaaccucugccucccagguucacgccauucuccugccucagccccccgaguagcuaggacuacagacgcccgccacgacgcccggcuaauuuuuuuuuuuuguauuuuuaguagagacgggguuucaccauguuagucaggauggucucgaucuccugaccucgugauccacccgccucggccucccaaagugcugggauuacaggagugagccaccgcgcccggccuccaguuuauuuucugcauagcacuuauagugagccuuuugcacugugucagauccuaucacccucuacucagaauccuacaguggaauucugucucacucaggguaaaaaccgacacacaguaccugagucuugcgugacccgaauagugggcucccauuauuuucugaccuugucucuuacuucugcccacucauuguuugagcacaccagagccauuauugccuccgacccuuggcacuacuguucucucugccucaaauccucccccguuccucuagauuucugcaugucuuggcccuucuugucccacaacucuuuccucagaugucaccuuauuagugagacaugcccccaccccugcuggcacuuccuguuccucuaacguugcauaauuaucauacgacacacuuuauauuuauuuauugucuuuuucucgcaguguacuguaagcuccaugagggcuauaacuuuguucacugcuaugucccaguuccuagaagagugccugguauauagcaagcccacaguaaaaauuguuuuuauuugaaugaauaaaaugugaaugaauuuaaaucagccucuguccuaaauauuaauucccuuggucaucgaaucucucugacuuuaaccucaugauucacuguguuucugucuucucuccauugcucuuguagccuuacucagacuucauuccauuguaaacaauuuccccuuauucucaacuucuuagaagaccucuccauuuacauuucuucuccaagagcugguuuuccucuuuggcccaucuucuacacuccagauaauuuugggagaagguagcgaugcuguugacauuuucuugucuagccaguguucccaacagguacguggcuuccaguggcagggaaucuuugaugcccuuugguccuuuugguugcugucaguacugucuucuguuucucucccuuguguauugggagagcuuuggcacacagcuaguagucuucuucauucuccguuugucauuccuacaugaugaugugcagggaauguccacuauccugguccaaaguuguucucagucauauggccaccaguacuucuucagaaauacacacaagggauauucucuagacuucaucaucacucagaaugguuucauuugagagucuucaauuuuuuuuuccauguuccacaacaagcuguggcaaaccuuuauuucuagcacacagucuuugacuguaacgagaucuccuguugacccauccuuuuuugucggucuggcauuccccagaucugauagaaauucaauugaaauuaaacaauuaaccugauuaaaaaaugggcggcugggcacaguggcucacaccuguaaucccagcacuuuaggaggcugacacagguggaucaccuguggucaggaguucgagaccagccugaccaacauggugaaaccccgucucuacuaaaaauacaaaauuagccaggugugguggugugagccuguagucccagccacuugggaggcugaggcaggagaaucacuugaaccugggagguggagguugcaaugagccaagaucgcgccauugcacuccagucugaacaacaagagugaaacucuguccaaaaaaaaaaaaaaaaaaaagcaaaggacuagaauagauauuucucaaaagaagacauacagauggccaauagguauaugaaaauguguucaacaucacuaaucaucagggacauauaagucaaaaccaccaugaccuaucaccucacaucuguuaggguggcuguaaucaaaaacacaaaagauaacaaggguugaugaagauguggcgagaagggaacccuuguacauuguuggugggaaugcaaauuaguauggccguuauaaaaaacaguguggggauuccucaaaaaauuaaaaauagagcugccauaugacccagcaguacuucugcuggguauauauccaaaagaaaugaaaucaauguguugaagagauaccugcccucccauguucaugacagcacuguucacaauagugaaguuguugaaucaaccuaagugucugccagcagaugaguggaucaagaaaauguaguguauauacacaagggaauacuauucagcuguaaaaaagaaagaaucuuguccuuugcagcaagauggaugaaccuggaagacauuaauuauguuaaguaaaauaagccagacacagaaagacaaauacuucaugaucucacuuagaugugaaauuuaaaaauguugaacuuuuggaaacagugaguagaaugaugguugccagggacuaggggugggggcuuggagagauguuggucaaaggguacaaaauuucaguuagguaggaggaauaaguucaaaaucuauuguauaacaugaagacuauaauaaauaacaauguauuauauuuugaaaaucacuaaguagauuuuaaguguucucaucacaaaaaauuauaaauauuugagguaaugaguaugcuaauuagcuugauugagccauuccacaauguaucuuauuuuaaaacauuuuguacacaguaaauauguauaacuucuauuugucaauuaaaaaagcaaaauuaggcugguugcaguggcccaugccuguaaucccagcaguuugggaggcucaagugggcagaucacuugaggucaggaguucgagaccagccuggccaacaugguaaaaccccaucuuugccaaaaaauacaagaauuagccaggcaugguguugccuaccuguauucccaguuacucggcaggcugagaugggagaaucgcuugaaucugggaggcggagguugcaaugagccaauauugugccacuguacuccugccugagcaacagagugagauccugucucagaaaaaaaaaaaaaaaagcaaaauuaaaaauacagaauuuaaugauaucuuaaagaagucuuuucuucaacugccuuuuauuuugauaugggguauaucuauugaauaauuauuucccaccuacauugauuugugauuccauuuguauguuaaauuuuuauauaguggaaaauguuuaauguaucugucaauuuuuggugcuggcacauucuuuaaaugaauugaagcuuuugauaauguuuuaauauuugguuguguuaguaguuuccaguugacuuuauuuuucagaguugucaguggugauggucugauucuucacauuuccacaugauuuugaaaaacauuggaucaaguuacggaaagaaaagucuccauugggcuuuuuuuuuuuuucaaaugguauuaaauggggcuaauugacuaguucauauaaauuaauauuuuauuaacacuuuuuuuuuuuuuuuugagauggagucucacucuuguugcccaggcuagagugcgauggugugaucuugguucauugcaaccuccgccuccugcguugaagagauucuccugccucagcaucucgaguagcugggauugcaggugcaccgccaccaugcccugcuaauauuuuuuuuuuuuguauuuuuuaguagagacaggguuucaucauguuggccaggcuggucucaaacuccugaccucagaugauccacccgccuuggccucccaaggugcugggguuacaggugugagccaccaugcccagccuauguuuuauuaaaacuuuaaugaguaaaauguccagcauuuuaacuuuuuaguaguuuaaauccuuuuuuccuauaaauaucacagauauaucuucuaguauuuaaaaaagauaugcaaaaaaguaaaugaucuguuaacuucguuuuguuucagauauguuuccuucuuuuugccauucucuacguuguuuccuacuucaucaucacaagauacaagagaaaaucaggcaaguggaaacaugucaauuaaaaccuuuguuagaaugccacauggucuaggcaugguauauaagauauauuaguacacuucagugucauaguguauugaauaugccggugauugaaguaagcaguugucugguacuaggagaccuaaaaauaaccuccagggaaucugacuacucuuagagucauccucuuagaccagaguccuuguuuaucacaauucuuauguccaacuaagaauagugcuaggcuauuuaguaucugggaaauucccgaguuuauaaggauauuugguuccuugugagcggcucugacuuugaauguuuuacucauccacaccucauaccuuuucuggcuacuagagcauauaguagauauuuagagucuccauaauacuauuuaguauccaauuacuagcaucuuguauuaucuuuuuauucuuucacauauauccuuauccagccagagggacuaccauaucuuuacucuuuuuaaugaacuuugugcucauuaauucagauuuuuuaggucaggguuuuauaaguaccuaagcaauuaccuuacuauuuuuuguuaaaucucagcuguuuucugaaaaucacaggauuaucugcuugugauguugggcuaauaguaggugcuguaugaauacuuaaugauuucuuaauauuaugcuaucaguuuaaacuugcgggacuuuugagagaaauagguuauagugccugcucuaguguauuaguuuaguacuguuacuuggcucugugacugcacuugaaguacuccauggauuccauaaccucuaaaaauucugaagauacagauucaaaauaguaucguagcuauuuaaaaaaauucauuggcaugguuucaugaacuguagacacagaaggagggagagagaaagaaugaauguauauaaaugcaucauucuaagugaaauuagagguuggugagugggaaaauuggagauuuauuagaucauuuuuagaguaacgcaggaguggugggagagugaugaggacccuggaccuaguugguagugugcugggaauagaagugaaaugaauauggagacauuaacacauucucuaagacuugauguuuuuuuuuuuuuuuuuuugagauggagucucacucugucgcccaggcgggagugcaguggugcgaucucggcuuacugcagccuccaccuucugggugcaagugauucuccugccucagccucccuaguagcugggauuacaggcaugcacuaccaugcccagcuaauuuuuguauuuuuaauagagacagggcuucacuauguuauccaggcuggucucgaacuccugaccucagauaaucugccugccuugacuuccuaaagugcugggauuauaggcaugagccacugcgccuggccaagacuggauaauuaauuggaugugagcacaacaguauauaaaaauuaauuguaacuauguucuuuuguggucccuuugguuguaaaaguucuuuugggaaucuuggaauuaagaauggagguggacuaacagaauggcccaaauacacccuugacacugaagcagaugggugcucagaauuccagagaccugagcagagagucuuggaggacauuaggcauuuaagaaggaggggccaggaggguuugugguauucuuuuuuuuguuuuguuuugagacaagucucgcccugucaccaggcuggagugcaguggcgugaucucggcucacugcaaccucugccuccuggguucaggugauucuccugcuucagccuccugaguagcugggauuacagacgcccgccaccgcaccuggcuaauuuuuguauuucuaguagagaugggguuucaccauguuggccaggauggucuugaucucuuuaccuugugauccgccugccucugccucccaaaguguuggaauuacaggcaugaaccacugcgcccagccugugguauucuuauaauugggcagucucuuuagcuuguaaguuuaugugggaggacaaaagagauugcugacaggcaugagcgagaaggagagugugagugaagaccaucugcuacuuaaaaaagauuaaacaaacuuuauauauaauauaauuuuaaauauauuucaauauauuuaauauauuuauaauuguauauauuuuauuauauauuauauauaauuuuuauuucuaaauauauauauacaauuuuuuuuuugagauaggaucuccuucuguccccuaggccggagagcaguggggcaaucauggcugacuguagccucgaccuccugggcucaagugauucuccaaccucagccuccugaguauccugcacuacaggcaugugccaccaugccuaguuaauuuuuaaaauuuuuuuguaaagauggagucucccuauguugcuuaagguggucuugaauuccugggcucaagagaucugcccaccucagcuucccaaaguguugggauuacaggugugagccauugcgcccagccaauuucuguuuguaacaauaauuaugaguuacugaggcaguaguauccaaguuauuuaggaugguccaggagacuccuuguuacuauuauuaaugacaaauucauauuauagaaaauuaugaguucuauguuucugaauuuuaauuuuauaguaacuuuuguuggcuguuaucacccagaaaauuuuauuuauuagcaguuucacuuaacauuguauaauaauuuacuuuguagugguccuaagguuguacuaaguuuuauuuucuugagcaaauuuuaauuuacauaugguaguuuuauuaaucaggauuuuguuaauugaaacaucccauucucuauauaccauacuacuugauuuaaugagauuuaaauuuggaucuaugcugaaacaaauacagugcuuuuugaaaauuguuucuguucaauaauugccuuuuaaguuuauauuguguuuauaguuuuaauaaauuaaugacgcauuuuguuagaagauaaaggaauauuaauaccuuaaacauuuuugcagaugaacaagaagaugaagaugccaucgucaacaggauuucguauguauuuuaaaguucaguuguucuguuucugauucugaagucaucaauucucaaaauccaauucuaauuuuuggauagaaguauggaaaauauucacccagcacauuacaauagcuuuaucauauuaauuuuagaaagcacauguaagcaaauauguguggauaauccaaucuccuauuggaauuugcauauuuaaggagcugacagauuuuauccucaggggauuaaaugaggaaauggccuuaauuuaauugcuuggucauaagaaagaagacucuuggcuguuugaacagucugcugagaagacuaugaugcucuugaaccgagcagcggacaucuccucugguuagcugaaccugccugcugugagcaggaacaugggcccagaccguccuguagguuccuuauguacaccggugagauaugauagggagguccuguaauuuuauugaaguaucaaacugaauggaaagcagcgaauuccuuucuguuaguuuuugcuuguuuaaaugugaaauugcacagaugcaccuauguaggaaaguucuguauuccaggauuuuuuuauugauacauuaaaauucuuuugaaauuucaaguuuauagaaaagguggaaguagaacacaaaguuuuuuuuacuccaacuguuuagaagucgcucaucugaugcuucauuuccucaggauacuuuuauguauaauuccaauaaacagugcauucuaccuauguaucaaaauagugaaauuagcauagacagcgguaccacucacacuccauucaaacuuacuaguuaucccaauaauguccuuucuguagugaaaggauccaguucagaaucacacauugcauuugggugucauguccuuuagucuccuucagacugaaacacuucuucauuauuuccuugacuuuccugaccuugauaauuuugaagauuauugaguaguuauuugguuuugucugaucuuucuucauaauuaguaucagauuaugcauccuuugcugaggaggaugaggaaguaagaaaaggggaagaggaagagaaagauucugugugcuuucacauacuuguacacacauacaaauaaaugcuucuacauacaauggaauaguauucagcuguaaaagaaaugaaguacugauacaugcugcauuguggauggaccauaguaagugagcgaagccagacacaaaaggccacauagugugcaauuccaucuauaagaaauguccagaauagauaaaagcagauugaugauugcaaggagcugagggagaggagaauggggagcagcugcuucauggguuuggcauuuuauuuuggggcaaugaacaugaaagaaagaggugauugugcaacauugugaaugaacuacacaccccugaauuguucaccuuaaaaugguaaauuuuauguaaugugaauuucaccucaauaaagaaauuaauaacucccagcuaauaaaugacuugacucugccugauuugauucauaacugaaaaaugaauauaaauggauugugauuuacuagauuugguaauuuauuuuaaaugacauagggaagcuagauaagaaacaaaaauagcuguaacuuuaugcuggaaauucuuacucucacuuuaaaaccuaggcccaaaacuugauguuuuaaauuuacagaauuacggguuuuaguuuuauucuuagcccugugacauuugugaaaauuaagugaaucauuuuuuuccucuguauaaauuagagcuccuuuaaaaauucacuucacucaccucacaaaagcuacaacgaauaagagacugaauaaaagguagauauucucuccaugugaaacccucuaggugugaagggcaagugagauacauaccuuucuccucuccauucagucugugugccaccuguggugguaaaucgacuucaguguacucguagauccguaauuuauaaacagaaaagaacacaucacuuugucuuuuaccccuaaaaguacauugaaugacaauagggugaugugcuguuuccuuaugguagaugcccaggagcaucuuaccugcuuuuggggcagcuggcacagcacgugcgagggguuuggguuuuccgagucacgggugguuucuguauccuggggaugcauacagaaauccucuuccugaaggucaguggguucguauaaaguggugauacaguuaagggaggggcauggggaagagggucaccugaggaggagucugacuagucucccucaucuuucuucccugcccuuauugaucucuuugucuuuugcugugguagaaugagugagaacugaugaguuagggugaucuggguucaaauucuggacccaugauuaacuugaguccagaagagauggagaaacaaauauucacuuucuguguauguaaaacagaguucucaccuacuuugcaguacuguuguguggauuaaauagcauuugccaaaaaaaaaaaaaaaaaaucuaggguagggugcuugauacaauuaggggugaaauuaauguuuccuccaccguagcgcuuuugaccuguuuugucugcuuagaauucuuuucugucagauaucccacugaauuaacucucaccuuauuuaguuuuguuuugcuuuguguuuuucccuaagucucaacuuuucagugaggccuucccuaagugccacacuuaauauugaaaccuguguguccuccuccccauuuccagucuuccuuaccguguuuuccuguaacacuuaucaucuuuaguuuauuauacauuuacauauuuaauguuuuauuguuuauugccugacucucugcaguccaggauaagcccuccuugggcaagaauguucgcuuguguucguucacuguucucaagugccuagcacaguccuggcacgggagcaggcacucugcaaauaccuguauagugagggagccccaccugaaagacccacugagguagaaucuccgagaugggcuuuaacaaaagcuccauaggugauccugacaguguuaccgcuuaagaaucacuaguuuagagugacguauuaggaagccuaauucaugcagcaaauguuuauugauuagcugagaugaagacuuaagauggaaugcugguaugccaacauuucacagaugaauguaaaaugucacucaauuuguuacuuuucuguugcacagagaaucagaccuuuugaugauauuugggagggugugagcaaaaugcuaaauaugaaacuuucuuugucaucaacacuauauacaucuuacugaauaauuuugaaugauuuaaauucaacuaugauaaagucuuguuuccauauguacuucuugauuagauauuaucaaccuguuaaacuuuaagauguaaaguggcagguuuugcuuaugauuaguuuuuuuaauuuaaaaaaauugaaauacuaacccaugaaauauauuuuuauaguaaucuguauuuugcaguggaguuuuaaaaaggugaggucuuucauuuuauugauaacuacaaauaaauaaaaagcauuuauuuuuuguuuaaaaaaauugagugucacauugagucugagauugaaaaaugaggaagagggaguauuguagaaguuggggaaagaguuucaagaaggaaguagugcuuaucaauuugaaaugucauagaaggucacauucagauugcaauuaaaaaggaucugauggauuugaccguaaggagcaccuguuucacucuaggugaggagcagaaguccuacuguaguggguuaauaaagaaguugaggauaaagaaguaaaggugugauaugugaguucugcuucagaagcauuuugaaagagcagaagcaccugaggauauuuauuuuuggccggucagcagcuagagggaggaugacuaaccggugaagcaaggccccuggagacggcagagguagagaucggcacagaugagcaggagguugacagauaggagaauaauugugucuguugauagcuuuaucaggugguaaguauggagggaucauaccccuuuuuucauucugaaacgggagagucagucauuugcugggaaugaggagcagcagggccaugguagaaagcuuaggaagagccugauaguguuagucuguuauguguugcuauaaaggagcacuugaaacuggguaguugauaaagaaagauuuauuuggcucgcaguucugcagauguacaagcaugacacugccaucugcuuggcuucuggugaggccgcaggaagcguuuacucauggugcaaggugaagggagaucaggauugaagagaaggugccagguuccuuuaaacaaccagcucucuugugaacuaacagaaugagaacucacucauuacuguagggucugucugcuccuacgauccaguaccucccaugaggccccaccuccaacacugggggaucacauuucagcaugauauuuggaggggacagauauccaaaccauaucacuguuaggaauaacacugaaaauccuaaggaaauugaacgcucaaacaaagaauucuuaguaaagcaauuuuacuucugcgcagaggggugucuccuuggccagucgccaugagagcacaccugaauaaaggggcacgagagccuuuauuccugacgcaaguccugccccuguaugcuuuccccguuggcuggggucggauuguacaaucuaaucccaguuggcuaaacguuugauuuuuuuuagauaagguaggcacguaaaagcggagaggaaagggaaaggggcgucuaaugagcuagaaaguucucuuuccaaauaaggaaugugagcugguacugauaacgccugguacuguggugugccugggcaucuaacaaaggcaaaaaggaaaaaggaggaaaagggaaaauuuggguggggcaccaugaauuaaagaguaaaagauugaucagauuauucgaagagaaaccucaucauaucccacaucacugaugauggggguuaagaacaggagaugagagacucauaaaucaaggauccugguccuuguuugcuaacugaaaguaugugaaagcuuuguggaguguuaaagugauuuaaggugguuuuauuguuuuaauuaucaucaccuugcaaagacacuuuacaauaugaucuguagauauggcuuuuuuuuacacuaguuauauucagugacuaguuauauucagcaucugaguguaugcccucaucaccuuauuuuauuuagacaaagguucugucuuccugguuggauugaggaccuagucacaaaugucagauauuuggggaaacacuugucuuacuaccacaauuagaaaagaugcauuacucugaagauguaauuuuuaaaaauaaugcuccauuucagaaggugaaguugaggaaugcuucacagggcaaaugauguuuagggucugucuugaaauucauguaugaguuugccaugcaacuuagaggguauucuagggagugaguagacugugcagaggggcaagaaggaacccugaaaauccauuucauguuugggcuaugaggggguuagguaagucuaaguguaugucgaaaugggucauagugagagaagagccuggaaaauuaucuugggauagccgugugggaccuggaauggugagauuuuggauuugaucucaauuuuagcauaggaaggaaugauagcaaucaggauagcuuccucccaugacuggagaagcuugcuggagaccgcuugcuggcuggucgcugccagagcuggcugcggaccugagacagcacuugucugagggcuuuucccaggaaaugcggugucuauugagcaaaaugaauucacagaaauucuguaucugauaucaguuguauuuuucuuaaguaucauauggucuguauuuuaaaauuuauaauugauuuacuaaaccaaggagguuuccugguuauuuuuggcuuuugaaguaggaauacacuucuguugguugccacaagauggcauuggccucaaaguuucucuguuagauguguuuuuggguauuuaguauuuuuuuuuccugcuuuuaaaaaauauuuucuuauauuuauuuuuacuuucuuccaauauuaacuuuaauagaacuuuaauauccauucuaucucuaauauuagugaaguucuuuuuuccuuugccaauuuauccuuuuaaaaucuuuuaaaaaguuagguguuucuuguagaaaauaaaaauguuucagaaauguguaacugagaaggugaaagcaccuuauaaucccucuuuccuaugggauuguuacauguuaugcuggauuuuuuuguaccucuguauaaauaugcauuugguggggggagaacauguuuuacauuuauuguccaugcuuuucuucauuauuuuguugacuuauuuuagauauucuuccauauuaguaccuauuaaagcuaucuuuuuuaugacaaaguaguguuuuaaauauuaauaguacaauacuguuuaauaguuuucuguuuuuuauuacuauaauuuauuuaaucuuuacccauuaaaaagaugucaggccaauggcuuucuaaguuuuuuuuccucugaaauaaacauuuuaaauuaauuuguuuuuuuauacugcuuucauaguaauuuuuucaccucaguuguugcauugcuguuagcauauguugucaaaguuguuaauuaaaugcaauugugaaauaaauacuuacauuuaaaagaggaaugaacuacaauuuuuucuuuguaaaauaugugaaguacugugucuucaguaugucuuuaucuuuuagguacuauuuguuagacuuacugaccuuuucauagaguaaggaguuuuagaguuuaucuaguuuaacuucuaggcccauauguauaucauuugucucccaacuacauauauuuaauaaaguucuuaauauaaugcuuuuuugauuaaaacauuaaagaguuugcauucuuuuugaugacuuucguguucauugcuuuuucagaucacuugugauggugacucuccuuucuuccagguuguuuuugagcacguucacucucgcagugucagcuggggcuguuuugcuuuuacccuucucaaucaucagcaaugaaauccugcuuucuuuuccucagaacuacuauauucaguggcuaaauggcucccugauucaugguuaguauauauugcuuaauauaaucacaauuaauauuuuaauuuuuuacugcaccauauuuuuagauuuuucuuuucucaguuuucuucauaauuugugacuuccuccaguaaacgauuugggucuuuaauaaugucagaaaaccagauuuuacuuaucauuucuauguuuaauuaguugugaaagacuuuucucuuaguuaagaagcaguguuuauacuuaugauuuugauaaauacauuuucauuucaguauuuagcuagaguauuuugguuuaucugacuaugucagaagaacucaaccuccauuuaagaacuagaaaacuggccgggcgugguggcucaugcuuguaaucccagcacuuugagaggucgagguggguggaucaccugaggucaggaguucgagaccagccuggccaacauggagaaacccugucucuacuaaaaauauaaaaauuagccaggcaugguggcacgcgcuuauaaucccagcuacuugggaggcugaggcaggagaaucacuugaaccugggagguggagauugcagugagccgugaucgcaccauugcccucuggccugggcaagaagagugaaacuccaucucaaaagaacuaaaaaacagcagcuauaguuucuauuuuauuuauuugcuaguaguuucuuuagucauuucaaaauauagaaggggaaaaacacucuaugucaaguacaaauagauaucaugguguauugcuuuguagucuuugggaaagccacuguccucucaccgcggcuuccuguugucuuaguugggaugauaaauaaaacccagcuuguuuuugcaauaggaaugauguauguaaaguaauugucuuuuaguaggcacuuaauaggugguagcuauuaugauaguuauuuaggcugugagguguuuucuuucugaagaaucuuacuguuuuuacaaaucaauuuaguguauguaaacugaacucuugucucucauagaacaugcuggcauaauucuuuuuugaguucuaauuuauuuuuauuuuuuaauguuuuaauuuuaauuuuugugaguacauaguugguguauauauuaaaggcaugcaaugcaaaagacucacaucaggguaaacagggugucuaucaccucaagcauuuauucuuuguuaagauuuuguaauuauguuuuagaauuauagcucuuaggaauuuggauaucuuucuugcucaucauacccauacccgucucucauuuuauuaguguugauuuguguuacuaguaacuauauuacuaauuauuauuuuguuaauguaguuaguugguguuaucaguguuaauaguuauuuuaauuuguuauguauuucaauuucuucaucucauuuuaagguaaaaguuuuuugaaaauuuuuuuucuuaguaagaaccuuaugaguuaaugguaaaauguccuccuuugacaauauuuaagcuaaguugccauuugacuuaaauauauaucagagauagcuuguuuccauuaaauuuguauuauaggucagugaauuuggaauuucugaguuaacauaaggacguguuaggaucucaaauccagggaaagaaauggaauaacuugcuugugugguagcguuacagcuaaguaugcuuucguuuuuauccaaggaaagaaauagaauuucuugccugugugguagcguuacaguuaagugugcuuucguuuuuauaguaggcauuuuccacuuggaaaacaucacuuuuuuuuuuuuuuuuauugagacagggucucgcucugucgccuagccuagagugcagugacacgaucauggcugucugcaggcuccaccuccugggcucaggugauccucccaccucagccucccagguagcuggaacugcaggugugugacaccacgccaagcuaauuuuugguguuuuuuuuguagagacaggguuuugccauguuucccaggcugguuuugaacucuuggguucaagugaucucccaccuuggccucccaaagugccgggacuagacauguugccaagaugucacuuuuuaugugugacacgugauuacuugaguugcuguagaaggcuguggugcauuagacuaauaauguauauucuuuuuucauugcuauuauguucauggugcuguaauccaguggaagaaaaagcaaguuuaaauuuaagagauuacuaguuuuauauguaagauaaauauacuuauuugucuuauuuccugucucuuguuguuugagaaaguauagaagauaauuuuuguaggugaugcuaccuuagcaaucccguaagcuucugcugagacuguggcccuguguauuaagaacaacagcaacaccaaccgcucccuuauuuuuuucugcucauaaaguagugugugcucacuauacagaauauagaaaauacuaaaauguagaaacaaggaaaacuccacauuuuuucagcgcgcgcgcguguguauauauauauuguuguuguuguuguuguuguuguuguuguuguuuuuugagauggagucucucucugucacccaggcuggggugcaguggugcgaucuuagcucacugcaagcuccgccucccagguucaugccauucuccugccucagccuccuaaguagcuggggcuacaggugccugccacuauacccaguuaauuuuuuuguauuuuuaguagagacugguuucaccguguuagccaggauggucucgaucuccugaccuugugauccgcccgccucagccucccaaagugcugggauuacaggcgugagccaccgugcccggcugcauguguguauuauauauagcauaugcaguuuauaccuuuaaaaccuuuaauauuauauuguguuuuccauaccuuuuauguucuucaaaaccauuuuuagugguguaaccugagccauguauuuagcaauauauuaagcuagugguuuucaaaggcuauuucgucauuuuaaaggguggaaccauuuaucccuccagugacuugcuaccugcauuuuuuucagauuugcaauagaaaacagcugaguuguuccucaggcaccaaacccacccuguccucuuugugaaacauuucacuucaccaguaaacuguuguugagcaucuagaggauuuuuaaauuuucauuauuauuuggguuucugacaauuucuuuacauggaaauuagaaugaaaauuauuaggcuaaugaguauuaauugcuaaacuguuuucuagaauuacuuguuuauauucucuugauagaccaugaaggugccucuuguuuuuagccauaaacuuaauaacagugaauauuaguaucuuuaaaaucuuuuccauuuucauggguagaagguaguuucucauuauuguaauguuaauuuaaaaaauuuuuagucagauaggacauuuuaauuuuaauuuauaaaauauagaaaaauaucuaauacauauaucauuuuauuuuuauuuauuuauuuuauuauuauaauuuuuuugagaugaaguguugcucuguugcccaggcuggagugcaguggcgcagucuuggcucacugcaaccucuaccucccggguucaagcgauucuccugccucagcuuccugaggagcggggacuacaggugugugccaccacgcccagaucauuuuuauauuuuuaguagagacaggggguuucaccauguuggccaggcuggccucaaacuccugaccucaagugauccacccucuucggccucugaaaugcugggauuacaggcaugagccaccgugcccagcccauguauauuuuauuugauuaauguccuuugcccuuuuuugugguuguugcuuuuuucauauugaauuuaugaucucuuuguuugaacacaucagcuuuucauuucaauuuuuuacauguuuuucugauuguuauuuugcuuuuuaauauuaauugcuuuuuuccagaauuugaauauuuuuuauaauauuugguuuuucuuuuucucuuggugucucuaauuguuuuuguguuuagaagauuguuucccacccugagauaugacagcuaguugucccaauaccauuaauugaauauucuuuucuguacugauuuuuuaugcuucauuuucaguaagcuaaauauuauauuagcguuuguuucugggcucagguaugcagguuuuggagucagauagaccugggcuugaauuucaaaucugucugaaacccuuagcaaccuugagcauauuguuuacgcuuucagagucucagucuuuuaucuauaaaaugaccauaucaaggucuaguuuauagaauuauuauauguaguaaguggaauauauguauaguauaaaguaccuagucuauugccugguggccaagaguaagcaggaaauaaaugcugaguuuuacuuucuguuuuuucccucugguuugucugucuauuccuaugccagugccauauuguuuuaaagacuguaguuuuguaauacuuugcuccuacuagguuuuaaaaaguucauacauuuuaugaagguuuucguaagcaaaggcauguauuuugugcaauaugggacauuacaaugcuauggaaauuugucuuuuaauuguuuugucuguguuagggaaauguauguguauaaacauguucguguguguuuaaauaaauaaauauuugguggggagauuuggaaaacaaaagucacaguuagcagauuggguccuuagcaguggcuguagccaggccagccuuggugaguagaaggugcuggguccauguaugaucuccgucccuaccaucauggugacuuuguuccugagcccauugggcaaugacagggguggcuggggaaggaggcugacuaguauccacagagccagucagccuauccacuuaauuauuaaaaucuuccucugcugaggucacccuuuggugagcauucacaugggacacaaauacuuucacauuuuuuucccauucaaagaggucuguucauguaccucaucccaauuuucuuauuuccaguuuuccaauuguguuucuucaagacucugagcaucuggccaaaccauuggccaugguccauuaauauguaauaaucacacauuuggcuauuucucuuuccaagcaaagcaaaccaccagauguacagcccauagaucugcccaucggagaguuucccuucaccgcuguccuuuuagggauguuccagaaaggggcaguagugcugcaguuguccacuaacgugggggccugcauaucaugcagaaccaucuguaaaccaggcccaggucuuccuccgucagcugauuuuagggaacucuccaggagacuguaggugcaggcugggagagagaaggcagcguagcgggaguggggaccgucggcauuggcggcacuucuuuauguaacuugugccuuuagggccuacuuaggcccagacauguaccacuuccauuugaugauggaaugcugcugugcacacccaacuuucuggcuuggugggucggaaaacauucaguucaugaugggcaacucaggucccaugguaacuuggugguccauguuucagcauucaaucccuacuaaagccccauagugggucaagagcuguuucucaaaggcaguuguuacccacaaggauggcagggcguugccccaacauccuaagggccugugcugcaguucaccuugagaggaaccugccaaaggcuccacacagcaugcgucucugccucugcccuuucagacacccuuggaucugcugggucauguggcccaggaggcagagcagccugcacagagccuggagcugccgcagagccuucccuccuucugggcuguacucaaaaccagcagcuuuucaggccgcucaguaaaccagcuggagcaacacacgcaaaugagaaauguguugucuucgaaguccagagaggccugcuagauguuaugccucuuuuuugaugcaggaggcgccagauucaacaauuuauccuucaccuuagaaaggauaucuccauauacccuacaacacuggaccccuagaaauuucacugagauagaaggccccuaaauuuuugucagauuuauuucccacuuuuugacacacaaaugucuuaccaauaaguuuagagugguuguuaacuucucacucacuaguuacaaucagcaaaauaucgucaacauaaugggccagugugauauuaauauccuauggaagggaaaggugaucaagauuucugugaacuaaauuauaauacagggcuacagaauuuauauacccuugacguagggcagugaaggcguauugcuggccuugucagcugaaagcaaacugcuucuaguggucuuuacuaacagggacagagagaaaagcauuugccagaucaguagcugcauaccagauagguggcauguuaauuuguucaggcaaugaagccacaucugguacagcagcuguaauuggacucaccaccuaguuaagcuuaacgauaaucuucuguuauucuggaagcucugucugucuucugcacagaccagauaagaaucgaauggggguguagugggaauccccaccccugcaucuuucaaguccucgacgguggcaguaaucucugaaaucccucuaagaaugcaguauugguuuugguuuacuguuuucccagguagaugcaguucuaguagcuuccacuuggucuuucccaccauaauagcccucacuccacaggucaggaaaucaguauggggauucugcuagccauuccauuccauuaauugccuucuggaagagaggagacaaccacaggauggguucagggacccgcucugaguugggccucugcuaaaauuccacugauuaccugaccuccauaagccccuacucugacuggagagccacagggaaggucuccuaggaucagugucaguucagagccaguguccagaaguucacgaacggucugguuauuuccuuuuccccagagcacaguuauaucacuaauauucauuugucaaucugucauuuacaguuuugugacauuuaugggauucugugaguacucagaaaauguucagauuccuuuaaucucccauggagcaucuguucuaguacuuucauguugaaaguguucaauaaauauugauugauugaaggaauaaaagucauuauaauuauaucauuaggaauauuuuggcaaaagugaauuugaaaggaaauuuaauggcuuauuuuauaaaauugucaguauggauguuuuugauugugccuuuaauguguaaaucacauauggauuagaggcuaaauguguugauaaugcuuuuuuuuguaugugcaaauauauuuaguuuggcuuaaauauaguguuuggauuuuggauacagguuugagauguuauguguuaaccauauuaccuuggaaugcuacuuuacuuuucugggcaagaauuuuguaacacaaauaaaauaauaaccuuaguaaacugugucauguaagcaagauguaucucugucugcagugagaaaauagcuugaaaaaugugauacagaaaaaugacauuggagcauuggaguuaggagaccugaugaugauccucuggccucuggguuuuggcuggugguugucaucacuugucagcuugaugcugugagauguguucugucauucacacaguguggguccaugacaugccagcaacuguaguuuguuguaggauagggcagagaugacaaauuaaaaugguaguguaaguucuuuuuguuguuaaaauaggaaaaaggguuaaaaaauggaccgaaaaaauaaaguauccacuucuauacauuuucuauaucuuguguacuguuaaaaaauuaauaggaaaauaugaaacucuucauuuccauaaguugaaaaacaaugauacagcugcuuuguggguuuuccuuuugggggugauaaaaauguuucggaguuagguaaagguggugguugcacaccauugcaaaugaacaguucagugcaaaugccacugaauuguucacuuuaaaaucgcuaauuuuaaguaaugugaguuuaauaucaaaauaagagcuaaauaacaauaaaaauuuggaagauaggaaaaugauggaguuagauuguacccuuaaauaaaaccaggaaauaauucuucaguuuuugagugauuuuuccccaguggggcccaauuuuggcuaagcuguccacucacuuaugaccagagauagagacaaaacaaacauuugugacaugaaugcccaguuugagauugucuguuaaaauauaaccacaaugaauccgacaagucacugcaaggacugugugcuuuauuuugauuugucaucaggaauaggcgauacacuguuuggacaucaugaaggaacaaugcaaaauccauccuuuuaaaauucauuuuuaaguuccauagaagauccaaaaaaccagacuuuuagaguauaagcagucaaacuuaagaaaauauuauauuuacuuaugaauagaugcuaagucaaaaguaagucccuaauaaauuuuaauguacuguuguucacuaaauguuccuagucauuugggcucaguaguucagucauuuaucauaauguguaucaagauaguuacuggauauugagguauuguuuauaacauuacaaauagaaaaauccuaguguuugggauaggaaauuaaucauaucuugucgauccaaacaguggagugcuuuucuggacauuauagaugauaauguagguauuuguugauauacagagauaccagaaaaaagcccauauuuacgauccaaugccuauuuuguaaaaagaaaaaagaguacauguguagguagcugcaucaaaaaauaccuggaaggguaaauacaaagaguuuaacuuuuuguaggauuuuaugauaugcauuuuuuuuugguauuuacauugcauuugguguuugcauuuauacaauggacauauuauuuguuuuuuaagaaaaaaguuaugugaagauaaaaagucccacauuucauugguaguuguuauuuauuuuucuucuaaguaaauaagcagaggcuauucuaauucugaaguucucucucugucugucucugucucucugucugucucugucucucucucucucucucucucugucucuuuuuaccccaaaucaacaguggcuaauaauucugaaguccucacacuacuugaaaacagacuguaaucucuuuucuaagccuuaugcuuuguugguagaauuuuuaaaaauuguguaaauugcuuuuugauaauuggauuagaucuuuaauucuacugaaauauugaacuuuugucauuuuggaaauuauugaguauggcugaacucugauuaauuuuuuaauuuaaauucaugaaggcuuuugucuaugugaggaaaaaugauaaauuauuuccucuauaguauuguauauuguaguuugaaauauuuuguaacuccagcagauggagcuagaaguuaaugcauccuauggugaucuggaaauucagucuuguuuuguuuuauuuuaaaccacaguuaaauaacuuuaaauucaaauaccuuuucuggggaugggcauuggauaucuuucaaauagguuucuguuauaguguugcugaauuuuuuaggguuugacuacuauauggaaauauguaauuuuaccuuucuaaagcagagcgauuugauuaauauuuauuuuacaaauuaauaugaaauaauguauaaugaaauauauguguuggcccuaacaguaauuuuuaagaaugauuuaucaaaauuauagaauauuauuaaggaauauguauguguguauguugauguauauuuauaaaauguuagaaauuuacuaagcuuugcaaaauugccaagaauguaauuacuacuuagcaauauaucuuagauacauuauuaugucuauguauuagauguucuucucauaguauuuuuacuuucuuauauauugcaaauuguauuagauuagcguaaguugagucugaaauuuucacauuuauuuauucuggcuaauaaacuuauuauuuugcauuuaauuaccuagguugaaaaaagcugguugaucaguacaugaaacaggcaucuaauuucuugacaaacuaaauuaacugguauuuggaacccuucuugauucaggguacugaaucguuuucuucaguuguccaacagacauuacuccuuguuugaucuacugauaaagauuucuucaccccgucucccaucacuacuaaaaauacaaacguuagccuggugugauggugcgugucuauaaucccagaugcucgggaggcugaggcacaagaaucacuugaaccugagagguggaggcugcagugagccaagauugcaccacugcacuccagccugggcagcagagugagacucugucuccaaaaagagaaaagaaaaaaggaagaaagaaaaaaaaauauuuuuuucauuuagcuuuugauaaacuaucuuuguuuuaauaaaaguaaguguauugguuagucagaagagauacuuuuuagugauuugugagcauugccuaaggcaaaguuuuauuuuuuuaacuuugacaucuagagaagaauuugaauuuuacuguauaaaagggacauguaugauuagaaagauaaauucuggaagcauguauguuuauggaucaauaacaauagaaagagccuucuuuuaugcuccagaauuuaucuuuuuaaucauacaugucccuuuuauacaguaaaauucaaauucuucucuggauguuaaaaguuagaaauagauuuuaaacuuuuuuucuucugaauauaaaagcauaguggacccuuaguauucgaggauuuauauucaugguuacaacaauuugagagcaauauuugaggcuccccaacacgugguaauuuguaauuuugcugaggcuaaaaucuaaacugugcacucagagaaacuaguaaguaaagugagccacguggcuaaugagugagccuagcucagcauccccaucucaguuuagcuuuauuauuuucugcccuuuuaauucauuuuaugggggaaacuguaugauacagggauguggggaauuuugaguuucacaaagauguuuaaauauaugcuuugugaauuuuagaggacuuuauaugcuucuuacagaaaacuuagaauauccagacaaaaaaaucacgcacaguugugcuacauugauauuguuaauuaguugggguauuuauuugcaguugauuuucuaugccugguuuuugucauugucauuuuaaaauauuuucaauaacaccuauguauauagguuuugcugguuaaauuuuuuuuuuuagugaaauuaaugagaauaauucuuuaaggaaaggguugagagcuaacuguaguuacaaccugcaucauuuuguuguuguuauauggucuaaaugcugguguaugucagaacuuuucaguuuuuuuguacuuuuuuuuuuuuuuuuuuugagacggaguuucacucuuguugccuaggcuggagugcaauggcaugaucuuggcucaccacaaccucuucuucccagguucaagcgauucuccugccucagccucccgaauagcugggauuauaggcgugugccaccaugccuggcuaauuuuguauuuuuaauagagaugggguuuuuccauauuggucaggguggucucgagcucucaaccucagguaaucugccugccuuggccuccuaaagugaugggauuacaggugugaaccaccgcgcuuggccuuguaccauuuuuaugauguugagacagggcagggaagaggcacugacauuuguuuaacauauuggguguuaauuuaucuucuguucuucauaagagcccugugaauuauagccuauugcauaccugaggaaacugggugacagaguugcagucccucuucaaggucacguauuugugauaggugcaaauccaggcuguuagacguaaagugcuacgcacuuagcuaucugccauugagaacuggugagguuuuaaaaaucacaaauugugugaauaccuugauuuuguuagaguacauuauaguacacuaaauagaucuaauauauucaauauuuuacugaaauuagauuuuuaaaaaccuuucuguaguugaaagauguccugguguuuuaagaagccuugcuuguacauguacacaccuacauguaaacaacugagaaaacaaaugcagacauguuuuguuccauuuuacaaaacugauugcaggcucaguuaagcauuuuguuuuauguugauagaauuaauggaauaucauauucauuauuucccuuaguaaaaucuuacuaaacuaauauauucuuuuuggcagauaauauuaagaaaacucaaaacauuguuccuuuuucacccagaauguuaaguaugagacauuauucagucauauguagaaagaaaaagagaucugggauuuaaucccagggcuaccauuuguaaguuguggaauuugugaggaauuuauugagucucuuuuaagaaaaaguucaguuuaugggugcguuggcuaaggggaucuuagguucucuucugcucuguaucuuauucuuggugcacuaaaauaagagcaagguuuuauuuauuuugaacagauuuuaauuuuagauucuuacaauuguaucuguucugcuuaaguauugaaauaaauauguauuuuaguucguuagaggaaagagguuauuucagucuaaaacaauucuuugucuggaaaagauaaaaaaaaacuaggacuuuuuuucuucaagagaugguguuuuuucugaauguggauucaaaguagcagguauugaacaguguaaaggaacuuaaccaaagugaggcuuugcaauuauuucauuauuauuuuaaaauuuucuaauacaacaucauuugaguagacuuuauuuucugaguguaucaaagaacauaauagaaagaaugugggaaaaggagaaaaagaauaagcuugaugauaucugugaagcaucuuggaggcccacuguagaaauguauacuggaauaguuagguuuuaggaauuuggggcaagagaaugaagagaacguauauuucacaauagggagcaguauuccaucuaguaagagaaaacuaagacauaggaguugaggcuuacucuuuuaguaauaaacagacuuuguuuuguuguugaguuguauguugagagaauuaaacaaggggcaaggauaucaauaaguauuuggggaggccaacuugaaauagaguagguaacuacaguuuuaaaacauuuuuucuaugaucagcaaauccauuaggauagauagguagugaagaacaagcacucuuugcugauguuuuaugcccagagcuuuuucuguauuauugaggacuaaggcucagacguggaguaugaaaaauuaggccagguguggugagccuguaaucccaacauuuugggaggccgaggugggaggauugcuugaagccagaucaagaccagccugagcaacaaaacgagacccuguaucuacaaacaacaaaaagccaauauucaaguguugguagagaaacacuuuaaaagcuaaauagucuggcuaagguggaguaagguggacuggauauauacccucccaccugaaaugacuagguuuuugagaaacuauaggcaaagaaggacaauaauccccagagaugggggcaaacaaggugcugccuugagagaauuuccacacugcaguacagagagggggaacccagguggagcugagcaguguucuggguugagaacccaggaguuuugagagaccaagggggcuagaguguaccaggcagaguacuggaaaggagauugcugcacagagaaucauuuuguuuuacacugauggguagaauuaaugggauaucauuuucucaguucgaacguuuuccguaguaaaaccuuacuaaacugguguucuguuuuuggcaaaugaaggcccucuguguagagucuuacaggcugaaaucaagauguucacaguguugccuuccucauuggaggccccggggaagaauuugguuucagacuguuggcugaauuugguucuuuguaguuuuaggacugaggcccucauuuccuuccuaccucucagccaggugcuagccuuuguuucuagagguugcuugccucuuuucucuuccaugugauacccucuaacaaaggugggucaaguuuuucucugacuucccuucugcugcaucuuucugacugcagcuggagaaaguccucugcgcucuuguguuuucucucccucucucccucuugcugucucucucucucucucucuguguguuuaaaaaucacaugaaaggcucauguaauuagauuauggccaccuggauaauccaaaauggucuugcugucuuccuauuugaagguccauaaccuuaauuacaccugccaaguccuuuuugccauauguacugaggugaguaguaucguguucccccaaaauucagguucacucagaacaucaggaugugaacuuauuuggaaauaacagucuuuguagacauaauuagugaagaugaagucaucuuagauuagcgaagacccaaauccaaagacugguaucccccuaaaaacauaaagcagagacacagacacacagggaagaaagcugugugaagacagaggccaagcauggaauaagggcaucagcaagcccaggaaugccaaagauugcaggcagccacccacagauaguaggaaggauucuucccuggagacuuuggaaggagcgugguccugcugacaccuugauuucagacuucuagucccuggaacuguaagagaguagauuucuguugcuugaagccauucgguuuguggugcuuuguuuccucaguuccagaaaaccaguacaccaugcaacauacucacagaaggcuggggauucaggcauggggaccuuguccacuaugccuaccuugagucugcaacugagaugucagaauuaguagacaaauacaugaaaacaauucuuuuuuuuuuuugagacggagucugacucugucgcccaggcuggagugcaguggugcaaucuuggcucacugcaaccuccgccucccggguuuaggugauucuucugccucagccucccgaguagcuggacuacaggcgugugccaccaugcccagcuaauuuuuguauuuuuaguagagacgggguuucaccauguuggccaggaugguuuugaucucuugaccucgugauccaccugccucggccucccaaagugcugggauuacaggcgugagccaccgcgccuggccaggaaaacaauucuuauaacuauuccauauguuccagaaacuuagaggaaauguugaacauacugagauguaaaagauguaaaaaaacaaaauucuagagaugaaaacuauagcaugugaugugaaaguauauaaaacaguagauuaauagcagauuagacauugcagaagagauuaaugaauuugaggacauagcaauagaaaacuauucaaaaguggggcugggcgcuguggcucaugccuguaauccuggcacuuugggaggcugagguggguggaucaccugaggucgggaguucaagaccagccuggccaacuuggugaaaccucgucucuacuaaaaauacaaaaauuagccaggcaugguggugcaugccuguagacucagcuacuugggaggcugagggaggagaaucgcuugaacccgggagagguggagguuguagugagccaagauugcgccacuguacuccagccugggugacagagcaacacuccauguaaaaaaacaaaaaacaaaaaaaucaaaaaacuaugugaaagugaaacacagagggaaaaauggcugaaaagugacaauagugcuguaguuuggauguuuauucccccauaccucauguugaaauuugacucccagggccaggcaugguggcucacaccuguaaucccagcacuuugggaagccuggguggguggaucacuugaggucaggaguuugagaccagccuggccaacaugaugaaacaccauuuuuacuaaaaauacaaaaauuagccaggcgugguggugcaugccuguaaucccagcuacucgggaggcugaggcaggagaaucacuucaaccugggaggcagaggcugcagugagcugaaauugugccacugcacuccagccuggaggacagagcgagacacuaucucaaaaaaagagagagaaauuugauuccuaguguuggagguggaucuagugggagguguuugggccaguggggcagaucccccaagaauagaugaauucccucccgggaggugggugagugaguucuuuauucucauaagagcugguuguuaaaaagagccuggcacaacccccucuccauugcuuccugucuucuccugugaucucugcauaugccagcuccccuucgccuuucgccacgaauggaagcagcuugaggcccuccucacagcagcuguuggcaccaagcuucuuguacagccuguagaacugugagccaaauaaaucucucucuuuuuuuuuuaauaaauuacccagccucagguauuccuugauggcaaugcaaagugggcuaacacacaggguaucagugauguaguugguguuucuaaaggaggggaguugagaaaaauauuuggaaacuuaauggcagaaacauuucaaaauugaugagaacuauaaacccacugauuuuagaagcuuaaccaguucuauguacaagaaacaugaggaaaacuguaccaacgcauguaaucugauggcucaaaaucagugauaaagagaaaaucuuaaaugcaucuacaaaaagagacacguuaaguucagaggagcaauaauaagaaucacagcauguuucuggugggaaacaaugcaagccagaugacguugugacaguguagcaacaguguagucagcccucuggaucuguggauucuagaucuguagauucaaccaaccacggaucacaaauauuggaaaaaaagaugguuguguuuauagugagcauguacagaguuuuuucuucuuauucccuaaacaauauaguauaauuauuuacauagauuuacacuguauuagguauuguaaguaaucuauggaugauuuaaaguauauaggaggauaugcauagguuauaugcaaauaccaugccauuuuacauaagggacuugagcaucuguggauuuuaguaucuaugggaggucuuggaaccaauccccuacagacacugagggaggauuguacuaaaagaaaaaucccagccagucuaguuuuauccccagugaaaauauuuuucaaaacaaaggcaaaauagugauagugucagauacacaaaagauaaaaauucaucaucagcagagcuguacauuaaaaaauguuacagguuguccuucaugugguaggagguggguaggagauagauaucuaggaaccgugagcuaaacaaacccgagggaauauaucuuaacucauuuccuaacucuacaaaaugaaaugaagagcacuagaagcagcaguuuauauguagagaagcuuuuuaaaaauccuguguuuagaaaagauaauuggcuguuuaaaaaguaguaacaauguauuaugaauuuuauuauagauguacaaguaaguuauaugacaacgauaacacacaggaggaaagccacggaagcacacuguugugaaguucucaugcucuacgugaaguguuaucuuuuuuuuucuaagugacagcaaguuuauuaagaaaguaaaggaauaaaaggaauggcuauuucauuggcagagcagccaauaaaaucaucugaaggcagauugugaugaguuaaaggcguauaugauaaaccugaagacaaaccagaaauagcccaacagagauauagugaauaaguaaacaaaggaaauaaacuagaaucauaaaaaauacuuaaucugugggaacauagaagaagggaagcuaacacauggggcaaauagaaaacaaaaagcaaguugauagauuuaaagcuaacuauaucaauaaucacuuuaaauguaauguucuaaacacuacaacuaaaaggcagagauuaucaaauugaauauaaaagcaagacugaaguauaucugcuugcaggauacccacuguaaagacaaaacuaggucaauggcaguaggagaaaaaagauacaccaugcuaauuuuaaacagagcaaaguuggaguggcuauaugauuaucagacaagggcaaagaauauuaccagucauaaagaagaucauuucaucauguugaagugguuuguucacccaaagagccuaaugauacuuagcauauaucugccuaaugacauauauuaaguacaugaagcaaaaacggaaaguguagucagaaucacaauuacauucagauauuucaacacccuucuuucaauaauugauagaacauauagaagaaaaaaucacgauauagaagauuugaauaauacuaucaacugacuugaccuaauuaacauuuauagaacauccaagaauagaauacauauucuuuuccaguacaaugugggcauuuaccaagagagaucacauucuuugccauaaaauaagucucaauacauuuuaggauuuuaagucauacaagauacacucuguaaggacaaugaaauuaaauaagugucagaaaacuuaccuagaaacaaucuagaagaucccugaguauuugguaauugauaacauacuuuacaauaacucacuggucaaagaauaaucaaaagggaaauuugaaagugcuuugaacugaaugaaaugaaaauaaaacauuuuaauauuugcgggaugugucuaaaaaguuuuuaaaggucaauguauagcacgaaauaccuguauuacaacagaaaaaaggccucaaaucaguuucugcagagucaacgaauagaucccaaagaagggaaaucuuucuuuaaaaaucuugagagaggaaaucaaugaaauagaaaacaggaaaucaccaagaagaacacugaaauugauaaacaaugccagaaugaucagcaaaaaagaagagaccaauugccaguauuaggaaugagagaggugacaucacuacauauugaacagugauuaaaaggauaauaauugcauauuaugaacaccuuuauccaacaaauucaacaacuuagagaaauggacaaauuuccuuaacaggcaaaaacuauuaaagccuucucaaauauucugggaauguuagaaacauucucacaaauaaagcuuuaggccaggaggauuuacugucaguucuaucauauaguuaaggaagaaauaauagcaguucugcacagauucuucuagaaaauugaagaugugggaacauuuccuaauucacugaggucagcauuacccucauaccaaaaccaggcagacaauacaugaaaacugaaaguuucaugacaggccagugucacgaacauagaugcuuaaguucuaaauacaauuuuagcgaaucaaauguaacacuguauaaaaaugauaauacaucaugacuuuugcaaugccaauccaugugauuuuauuaacgugcuagaaaaaaaaaagucauauggucguaacaauacaugcagaaaaagcauaugacaaaauucaguauccauuucugguaaaaucucucagcaaaguaggccugaaaugggauguucucauccuaauaaaaugcaucaggcugggcguaguggcucacgccuguaaucccagcacuuugggaggcugaggcggguggaucaccugaggucaggaguucgagaccagucugaccaauguggugaaacccugucccuacuaaaaauauaaaacuuaacugggcaugguggugugcaccuguagucccagcuauucgggaggcugagacaggagaauugcuugaaccugggagguggagguugcagugagcugagaaaucgcaccacugcacuccagccugggcgacagagugagacuccgucucaaaaaaaaaaaaaaaaaaaaaaaaaaaaagcaucuacaaaaaaccuacugauaacaucauacuuaauggugaaagacuggaugcuuucccccugagaucaggaacaaggcaaggacaucuguucuuaccacuucuauguaacaucauucuggagguuuuuuuuaaaaaaaauaagucacugaaguuggaaaggaaacaguaaaacuauuucacagaugauauuuucuaugcggaaauucugaugggaucuguuauaaaaaagcuauuggaaccaguaaguaaauucuucaaggcugcaggauagaagaucaauauacaacaauuauauuucuauauacuggcaguuaauaauuggaaauugaauuuacaacccaauaucacuuauaugcaauagcaucaaaaauacgaaauacuuagggaugcgugagaccuaaguacuauaaacuaagacauuguugagagaaauuaaagaguaccacaauaaguggagacagauacuguguucauggauucgaagacacuuuaucaguuugggcugcuauaacaauaccauagacuggguggcuuacaauacaaaacaaauauuuuuuacaguucuggaggcugaaagucccauaucagggugccaccaugguuggguucuugaugaggacccuauucuuggcucacggaugguugucuccucgcauccuuccauggcugagagcagagacagagaaagcaaacucucuucugucuccuccuauaggggcaccaucccaucaugaggauugcccucuugugaccuaacuacccccaagggcuccugucucuaacgaccaucacacugaggauuaggguuucaguuaugaauuuggggguggggacagaagcauucagucuguaacagcaauauuaagaggucagcucucuucaaauugauagagauucaacaccaugccugucaagauuccagcauacuuuguagaaauugacaagcugaucuaaaauucggaugcaaauucuauggacuuagaauagccuaaacaacuuugaaagauaacaaaguuagaggauugaccaucugaccuaaagacucuuuuaaagcuacaguaaucaagacugugugguguggcugggcacgguggcuuaugccuguaaucccagcgcuuugggaggccaaggcaggcagaucacuugaggucaggaguucgagacaagccugaccaacauggugaaacccugugucuacuaaaaauacaaaaauuagccugguguggugcaugcaccuguaaucccagcuacuugggagucugaggcaggagaaucgcuugaaccugggaggcggagguugcagugagccgagacgugccacugcacuccagccuggaugacagagcaagacuuugucucaaaaaaaaaaaaaaaaaaaagugcaugauguuagcauaaagauaaacagaucaaaucagcagaauagacuguccaggauuagauacauacauauauugucaauugauuuuugacaaaggugccaagggaauuuagugggaagaugauuuuuuuuuaaacaaauggugcuagaacaauuuuuuaauuauaggcaaaaaaugaacuucaguccauaccuggcaccauucgcaaacuguaacucaagggaucaucgacuuaaauguaaauccuaaaacuaugaaacuuguagaagaaaauguaggagaaagucuuuguaacauugaacuaggccauaauuuuuuagguaggauagcgaaagcacaauccauaaaagaaaaaaauggauaaauuggacuucuaauaaauuuuguucuuuaaagauacuguuaagagaauaaagagagucuacagacugggagaaaauauugacaaaucacauaccuuauaaaggaguuguauucagagcccauaaagaacuugucaaacucaguaauuaaaaaaaaaugaaaaaaugggcaacagauuugaagagauacuuagcuaaaaaagacaugaauagauggcaaauaagcucaugaacagauguucacaucauuauuuauuagauaaaugggaauuaaaacagcaauaagauauuccuguguaccugccagaaugguuaaaauauuauuuuuagugaaaauguggaugaacuugaucucugcuggugagagacuguaaaauacaaccacuuuggaaaacauuuuggcaguuucuuaaaauguuaaacagguaucuaccauaugaccuauguauuucccaaaagaaaugaucgcauaggucuacacagacuuguacaugagcauuuaugacuauuuuauuuuuaauagccacaaauugggaacaacauagauuguuugcaggugaauggaugcaguccaauagcgauucaaucuaaucucaaaauaguugugcuagauaacagaagccagacaaaaacaagaguauauaucacacaauccauuuguauaauguucuagaaaauccaucuuuuuuuuauuuuauuuuauuauuauucuacuuuaaguuuuagguuacaugugcacaacgugcaggcuuguuacauauguauacaugugccauguuggugugcugcacccaucaucuccucauuuagcauuagguauaucuccuaaugcuaucccuccccccuccccccaccccacaacaguccccggugugugauauuccccuuccuguguccauguguucucauuguucaauucccaccuaugagugagaacaugcgguguuugguuuuuuguccuugcgauaguuugcugagaaugauggguuccaguuucauccaugucccuacaaaggacaugaacucauccuuuuuuauggcugcauaguauuccaugguguauaugugccacauuuucuuaauccagucuaucauuguuggauauuuggguugguuccaagucuuuucuauugugaauagugccacaauaaacauacgugugcaugugucuuuauagcagcaugauuuauaauccuuuggguauauaccuaguaaugggauggcugggucaaauggcauuucuaguucuagauccuugaggaaucgccacacugacuuccacaaggguugacagucccaccaacagugcaaaaguguuccuauuucuccacauccucuccagcaccuguuguuuccugacuuuuuaaugaucgccauucuaacuggugugagauggugucucauugugguuuugauuugcauuucucugauggccagugaugaugagcauuuuuucauguguuuuuuggcugcauaaaugucuucuuuugagaagugucuguucauauccuucgcccacuuuuugaugggguuguuuguuuuuuuccuguaaauuuguuugaguucauuguagauucuggauauuagcccuuugucagaugaguaaguugcaaaaauuuucucccauuuuguaaguugccuguucacucugauggugguuucuuuugcugugcagaagcucuugaguuuaauuagaucccauuugucaauuuuggcuuuuguugccauugcuuuugguguuuuagacaugaaguccuugcccaugccuauguccugaaugguaaugccuaggguuucuucuaggguuuuuaugguuuuaggucuaacauguaagucuuuaauccaucuugaauuaauuuuuguauaaaguguaaggaagggauccaguuucagcuuucuacauaugacuagccaguucucccagcaccauuuauuaaauagggaauccuuuccccauuucuuguuuuugucagguuugucaaagaucagauaguuguagacaugcggcauuauuucugaguucuuuucuaaagugcagagucaguggcugacugggaaucagggggagguggggaguggcagggggcagggauuauaaaaggauaugagaaaauuugggggugauggauguguuuauguucauuagcuuaauuguggugauggugucauuggugcauucucaugacaaaacuuaucaaauuauauacuccauguguagcuuauuuuauguaguucaauaaagcuguuaaaaauuaauauuucuuauauuuguauauguuauaauuuuguucauuuuguacugacaauugagaauuaauucugagacuacuucuuuaguucagccugugaccuuuuuccugagagagucuuuuccuguuaacauuuagcuauauggauuguaauauuguuuguuuauggaacucauuuuuauugauuacucagcacuguagcaggcauugggaaauaaaaaaugagguguagaaauauauucaugccucauggaccuuugaucuagagauuuguaaucauacauuugcaagcaucucuaaagaauauaagaaguuuaggggccaggcgugguggcccaugccuguaaucccagcacuuuggaaggccgaagcgaguggaucaccugaggucagggguucaagagcagcccagccaacauggugaaacuccgucuccacugaaaauacaaaaauuagccuggcgcaguggcgcgugccuguuaucccagcuacucaggaggcugaggcaggagaaucgcuugaacccgggaggcggagauugcggugagccgagauugcgccauugcacuccagccugggcaacagagugagacuccaucugaaaaaaaaaagguuaggaaaugguggaauuuauguugccuaaaaacauuacagcauauuagaaggaauagcuuaaguuuuucuugcucugggacaagggcacguuucugaaccugaaguccgucuguaaaacgggggaccuucccucauaaaauauuaaggugguagcuggcugagugcaguggcucacaucuguaaucccagcacuuugggaggcugaggugaguggaucgcuugagcccaggaguuugagaccagacuggacaacauggugaaaccucaucucuacaaaaaauacaaaaaucagccuggcacgguggcaugugccuauagucucagcuacuugguaggcugaggcgggaggaucaccugagucugggaagucaaggcugcagugagccaugaucacaccacugucucagaaaaaaagauagcaucuuaacguauccagaacaaugccuacuauguuacauaccuaacagugacaggcauaccuuggagauacugcaggguugguuccaguguacugugaugaagcgaauguggcaauaaagugaaucacacaaauuuuuugauuucucagagcauauaaaaauuauacuuaacacuauaaugccauuuauuaagugugcaauagcaauguguguacaugccuuuauugcuaaaaaaugguaacaauuaucugagccuuuagugagcuguaaucuuuuugcugguggaggucuugccuugauuuugcuaaagguugcgugaccguggcaauuucuuaaaauaagacaacaguguaguuugccauauugauugacucuuccuuucacaaaagauuucuguguagcaugugaugcuguuugacagcauuuuacucacaguagaaguucuuucaaaauugaaguccauccucucaaacccugccucuguuuuaucaacuaaguuuaugauauucuaaguccuuuauugucauuuccacaauguucacagcaucuucaccaggguagauuccaucucaagaaaccacuuucuuuguucaucccuaagaagcagcuccucguucauuucaaguuuuaucaugagauugcagcaauucagucacaucuucaggauccaccucuaauuccaguccucuugcuauuuuuaccacaucugcagagacuuucuccacugacaucucaaacccaucacuuccaaacuccaggugagguugauauuuugaccucccaugaaucacagauauucuuaauggcaucuagaauggugcauccuuuccagaagguuuucaguuuacuuugcacaauccaucagaggaaucuguagcagguauagccuuacagaauguaucuuaaauaauaugacuugaaagucagaauuacuccuugauccaugggcuacagaauggauguuguguuaaggcaugaaaauauugaucuuuuuaaacaucuccaccagggcucuuucaucuccaucagcaggugcauugucaaugagcaguaguauuuugaaaaucuuuuuuuuuuuuuuuuuugaguagcaagucuuaacaguaggcuuaaacuauuuaguaaaccaugcuguaaacagaugugcugccauccgggcagguuuguuguucuuguuuauagaccacaggcagaaugggcuuaggauaauucuuaaggguuuuaggauuucuggaauggugaaugagcacuggcuucaacuuaaagucacuuucuguauuugccccuaacaagugagucagccuguugauugaagcuuugaagccagacauugaacuugucucuggcuaugcaaguccuagauggcgucuucuuccaguguaaggcuguuuuugucuaccuugaaaaucuguuguuuugugcagccacuuucauugauggucuuagccagaucuucuggagaacuugcuacagcuucuccaucagcacuugcugcuucaccuugcacuuuuauguuauggagguggcuucuuuccuuaaaccucaugaaccaaccucugguagcuucagacuuuucuuuuggagcuuccucaccucccucagccuucauagaugugaagaguuacaaccuugcucaggcuguggcuuuagggaauguuguggcuggugugaucuguccagagcacaaaaccuuucuccauaucagcaguaaggcuguuuugcuuucuugucauuuguguguucacuggaguagcacuuuaauuuccuuuaggaacuuuuccuuugcauucacaacuuggcuaacuggcauaagaggccuagcuuucagccuaucucauuuuuugacaugccuuccucacuaagcuucuagcuuuugauugaaagugagagaugugugagucuuccuuucauuugaacacuuagaggacauuguaggauuauuacauggccuacuuucaauaucguugugucucagggaauggggaggcccuaggagaaggagagagaugaaggaacagccaagcagaggugcagucaacacacacaauauuuauugauuaaguuuggcaucuuuuaugggcacaauuugcagcgcccccaaacaauuaacauaguaacaucaaagaucacuggucauagaucauaacagauguaauaauagugaaaauguuugaaguauugcaaaaauuaccaaaauaugacauggagaaaugaagugagcacgugguauugggaaaauggcacagauagacuuguucaccacagaguugucacaaaccgucacacgguaucugcaaagcacaguacagcaacaugcaaucggcuuuagguauacuuguaguagauaacuucuuuuuuuuuuuuuugagauggagucucgcucuguugcccaggcuguagugcaguggugcaaucucggcucacugcaaccucugccugcuggguucaagcaauucuccugccucagccuccugaguagcugggacuacaggugcgcaccaccaugcccagcuaauuuuuuuuuuuuuuuguauuuuuauuagagacaggguuucaccaugcuggccaggcuggucucgaacuccugaccucguaaucugccugccucggccucccaaagugcugggauuacagguaugagccaccaugcccggccaguagauaacuuuuaaaaauguuuuuuuaaaaagacuaugagauauuuaauuggaauaaaacuaucuuguguaaaaugaauauaauucgugacacacugaccuuuaucuuucauaacacaaaugauuugaaacggucauguauuuuucaccacgccuaaauaaagcaauagauuaacaaccaugguucucuagccuacuaaagaauaauaauaauguaauuuacauaauacuaauuauuguuauaccccacauaucugaaaguaacuuacuuggaaaccauaaagaagagaaaaugcuguugagcaggcaaaagagaggccaaagaccaugcacuuuagguuaugaauuggaccuggaagguacagcuuugauccaggucaauuuauucuuuagauacaacuuuuaaaaguugcguauaugauaccuuuacccauaggcuguugggggagggaagagauuguuccuggacacaugcucauuucuaguaacaaaaaccaggagccaauacacuugguagaaagaagaugaaagggaaaacuagcaagcgagccuggagucucaggaaggaugguaguuuggugugggagcugauagcacuguuacuaguagccucuggugcuguaacuuaaaagcaaaaauuaauuaaaugcuuauuuuaugacaggcauugugucaguuguuguacgugcauuauuuaaugcuuaccaaugucuacagacccgucauuagccauauuugauagaugaagaaccugugauuuagcaauguugucacauagaagugcagcaggacgugcacccaggucugccuagaacucaauugugugcaugcagccaucguucuguaugcucuuccaguaauuagcacaauaaaacaauugacucuaauuauacucuuuuugaauaaagaaaacagaauguuuggcuuuuuuuaaaggcuggaaaauauaaaauuauuuacauuuuuuaaaauuuaaaauuuuuaaaaauuuuaaauaguucaaauugcaguuuuuccacuaaaagauguuaagauauuguuuuauaaaagauuuuacuuucuacaaagauaaauguacauuguaaauuuguuaaauccauguagauuuuugaauaagaaacugugaguugauuuuauuauauuaccuugucuacuaaaggaagugaaucuccccagcugacccguauuaauugcuaaauuaauuguguuuguuuauacuccaugcuauuccaaaggacauuaggacaguuacaaaccuuuauguuuauucaaaacugcaguaguuagggacggcucugcucccugugcccacugccagcucagagguagucucugcaugcagcucugcagcgugagcagcucugagagcagagggguuguguuucuucaucaccacaucuccacugcuuggaaaugaagguguugagaaagcauuaguugccuacuuucaaaaacauugaauuauaauggcaaacaguucauugaauuuauccuugacguaaauuuuaucuuugacucuugauuuuauaaacuuuuguaaugauuaucaccaucauuuugaaacucaguuuuaaauuuuauuuuuuuaccuguaaaaaauaugaucugacauguugggccaaauacccucccaaugacauaccuaacagggcucugucuuuugcuaaaucuguucuuauuuuacuugccauuuugugccagggaggaaaaggucacuuaagauugccagucucugugacuuuuucuuucccacuuggaauuguuuaccaaaauuucugugauguagugauuuuuuaaaauccuggaauuaagucagcucugccacuuggaugcucuacagcuguggcaaguugcauagccugcuccucuucugucaucuuggggcaguaaugcuaccugccucaugggauugcuguggcaaguaaaugaguucggauaaugucuguaaaucacuuagaauagugcuuggcacauaagggcucaauaaaugcuaauuauuauuuuuaggguuuuuaugaggcuuaaauuaaaugggauuaugcauguaaaauguucaguagaguaucuggcauuuauuaggggcucaauaaaugcuaguggcucuaauuuaaauauuccggugccuauaugucuaaagaggcugugccuuuggaucucugcacacgucauauuuuuagugaauuuacuuuagggcauggaaaaaaacauuaguuucuauacugacuuuucccaauagguacaaguuacaauguuaaaaaaauuuaaauaaauacauacuauaauuauuuuaugauuucuaaguuuaggucauuuguuacuuuuuguuuauuuuuacuauuuaaaaguauagaucuugauuaauaccacaauuucaauaucuaaccuguuuuucuucuuuucuuguuacccuuuuuauagguuuguggaaucuugcuucccuuuuuuccaaccuuuguuuauuuguauugaugcccuuugccuuuuucuuucuggaaucagaaggcuuugcuggccugaaaaagguaagugaaucuaguauuggaauuaaauugguuaagugaggaauuaaauaucauucacauugaacuagaaaaagcagacuuaaauuauuuaaauggaauauaaaaaaugcguaguaaauaauauugauaacacauuguuaacaauaacaguaauucugcauauugaauuacuuugcauguccaugagagagagacaucuuuuagaccugugaguacuuuuacaguaugcauacaucuaguguaauggauaaaccugauauaauagcuuuuauucuuuccuuaggguaucuuauuuaguuuaaggugacaguaaaguguuauuuccaugggcuccccuuucuguuaucuagcuguuauuccauacguuaacagucugcagcugaaaacugacagcugauuucacauuuaguaaauauaccaggaucagaaugaaugacucuggcagucaaaccugacauuaagaaaacuggcuuuuaugcauuggaauuuaaaaaaucaugauguauucuuaagacaggcaauuaaaauuuagucaauggccgggugcaguggcucacaccuguaauccaccacuuugggaggcugcggcaggaggguugcuugaggccaguuuuucgagaccaguuugggcaacacagugagacccugucuguacuaaaaauaaaaaaauuaacuggguguggcgauggguaccuguggucccagccccucuggagacuaaggugggaggauugcuugagccugcagguugaagcuguggugugagcugugauugcgucacugcacuccagccugucucagaaacaaacaaaaaccaagaauaaacaacaagaagaaaggaggucauuguagacucuugagaaggcaauuucuguagaauuuuggaaacauaacuuuugauggauauucauucauucaacagagaaugaauuuuauugagaauucaguuuuauuaaccaauuccuuaaguagcaguuauuaugcucuuuauaggagcuugcuggggacacagaugaaaagaugggccucuggccuucaagggucggacagugggagaaaugacagauguaaacaaauaagaugcaguuugaagcccuuuuauauaaugaaguccuaugggaaacccugaaaggaaaggauaucuugauuuuccuggggaaucugagcaggcuucacaggggaagucaaucuggacuugggcugggacuugaaggaugagcagggguuugcuagaguguggcauuccaggcuugagcaaaggccuagagcucugacaguauugagggaauggccgguacuuagauacuggagaauggugagagaugagggugcacaagccgcuugccagggucgaauucuggaggccuggaguccuccaucuggucauuugaguuuuauguuguaggcaacagagaagccagaauaggauuuuugaaaauaauuuuuuuucaucuaccacuugaguauauuuagagauaaauaugcauuuuagacuuugugcaggucacaaaggaaaggaguacaaaggaguacaugccccacacagugcagaacacugaucuguagacacggcaccgaaucaguccugcaccugacucugugacauugccugccgacguuugcuuucaauaagcaaaguucuucccucuuccugacacuaccucuuguguaauaguaccacauacaaaaaacaaaugauaaagcuuggugugaacuauauuuucauauuugacauuauaaacaguaucuaccuaauuuauacuuuuuauaacaaucuaguugaauagauuguuauuuacaauaacaggguguaauauggacaaacucuuugccuccaaguuauuuucuucccuucuugugaauuaaccaacuaggaaagggacuuggcuaaaucuguuugaagaauuagcaacaaucuccagaauuaaaaaagaaaaaaaugacaaaaaaucccagugacaugucauuuuucuccuguucccccuuacagacuuaaggucaaagggagaaucagcugaggagggaucauagaaguuaauuagagauauuucacacauacgauuguacagcacuuacuuccucuauuuuaaaaaaauuuuuagucuuuuuauacaugauuaauauucuuuucuuagcacaucuuugaccauguuaguugccuaaaaaucacucgagggucaccagcuguguuucuugaccucaaaugggacugaaauauugaaugacuguaggauacaggcaacuaugaauccaauuaauucccaaacacagcagaagguggagccccggacgacugccauuuguccaacuugggaaguuguaauaggugcugcagaaaaccaaauuaaagaauuugguuguuaaugccguuaaaggaaggagggagaugggauucuagcuugaagguagggaaagaggccagcggaagauggugaagcugcaaccgugagaaaauuuggcaucagucagacugccugggaggugacuucaucuaaaccgcgggguugcuuucuauaaaauggguguaauaaugaucuuuacuuuauuguaucauuuuggugauuaaaugagaugugauuauucauguaaugcacauagcccaggacuucauuuaguaaauuagcuauuauuaaauuaccuuuaucuucgagguagucuuuaaaugcauuugacuaauaaguauucuauaaaauaucacuaaucacuaauaaguuuucuagaauacuuauuaucacuaaauauucuauaaaauaugagccucagaaagcaagcaacugaauacaguacagucaucuuuuaauuccucacagauuauuaucucaggcgguuuuaaaauauguuucccauuuugcaauggcauguacugaaguagaauaacucagcuugagcauuacagcuagcauacuuugaaacaaacuuguuugaagauaagguguguucuagauccuaguagaaauguuuagaaaguuuuaaaauuaagcuaaucaagacauguuauuuuaaaauauucauauuuuucgguuuuaaaaucagucacaugaaaguuggaaagguuacuaauauugugucguuaagucuaaauguguuaagcauacauuugagcccuuucauguuguauauuucuguagucuagaaucauuuguuaacuaccuguguaaguucuaaauaacauuuuuaaagauacaugguucuuuacacagugcuuauuagaauuaacuucguugcuuuauugaaauuaauguuaugauugaucacagucauuagaauguuuaacauauuuggcgaauaaguacauauauuuauguauauuccuuuaaagcugcuugcucaucgauuacauuugacacauauaguugcugaagugauacugaagagaggcuagaaacauuucuaauggguagauucagcgcacuaauuugagcaaugacaaacuuguaauaugguuaaguaaaauuuccuuuuuuuuuuuuuuuccuguggccacccuccuggugcuguuuuacugugucuaagucugguguaucccuaaauggcauauggccccacucuacucccauggauuccccugggcaaucgauguucaaacagcuucuugcauauugugccgagaugcggaaauuggccacuggccaugggcggaugcagagcuugaauugaaaaucaaauuaagcagaauucucuacuuaguuuuuaauuaaaccacuauguuaauucaaacaggacauauuaggccugggggguugacuauguccuuuuaagggccuucaauagcuuugcuucucucuucuuaccguggcagcgguguguguuucuauuuuauuaggaccaucuccuugcuauucccuuacuuuauaauucugaaguguaagagcauagaaaugguuuugauaaaguaaaaguuuuuuuuuaguaagcagcuaacuuuuaucuuggaauuuagacuuauuauuagcaguuaaauguuuaccaaauuuagauuauuuugcugucaccuauguguauugagcuuuagguauguucauagguauuugaaagugacuccguuuacaucuuaauuuuucaacugauaaaaagguuccauuuggugauuuuuguuuuguuuugcaguaagccugcuuuuucugcaguauguggcucuuagggcucagggaacaucuuaaggcagccaucacugcugugcuuaucauaccucagauuggcuguaugauuuaucucccuccuccacuccagaaaagaccuccagguuaucuggauuaauaucagagauguuuucugauuuuguaaggaacucuggagguauaaccucuggccaguguuuaaaugguaguuaggcauauauuuguuuuauauuauaucuuaacaucuuauuuugaauaaaaaugucaggaggaaaaaaaauucagcaacuuaaugaaagugggagaaaauaucuccauaugauuguuauguaaaauuuaugacagauuaauucauaaacccaagauuuuucugggaguaaauuucuauuguacuuaacuuuaaugccuauguuugauuugaagucauagcauaaaagguaacauaagcaacauccugaccaauuauccaaaccauccagacaucccugaauggccagagcguagcacacggucuguaggauuaagagguuaacuccuauaacuucaaacaaagugccugauaauaaaagcaaaaaguacaaaauuuuagguaacuuccuuucuuaauuaauuggacugaccagguggaagcgaagaguucugugcuggugcuuggaaugucuauaaagcugagcaacaugacagcacaauagaggaggaacaaagauuuuuuuaauauguuucuauccugugucacaguuugaaauuguccugguuuaugucccuuuuggcaaacuuacauaaaagugaccuuguacuguauuuuaugaccagaugacuuuuuccccccaguggcuaauuuguaucaggccuccaucuuaaagagacacagagugaguaggaaguccagccucugucuccacgagcuuucauugcauucuuucauuauuuuugcucguuuuuugccacugaugauccauaaauuguuggaaaugagugauuaaggaagugcugcuuaguguuaguggcacaugcgcauauuuggccugguucuggugggugagaggaaaucacagacaaaagggaagccccugcugggaacccugcaaggaaauuuaacuugggucauguuuugaucuuaguguuuauuacagaaaaugaagccauaucucacuaacuauuguuacguguuaauuugauuuucccaacaccuucaagaaaaaaaaucauagagcaauuuauuaauagaaauccucuacaaucccccaauugagagcacuaguuuuuaccuuagaaaugguuauggaucagaaugauuauuuugaaaauacucuauucugauaaugcugugauacuucagcuuccuuuuggaauuguuuuacuguaaaggugugguuauaaccauguaaagugagcauuugaaacaucaaaucugggcguaugggaacucagaaagaaauaggaaaguauuauuuugaggaaaagaguaaauacauuuauuucauuuaaaaaucauuagagguuauaaaaauuuugaauugaaaaucauuuaguucaggaaaugacauuaauuuugucacuguucuuaauacaguuggaucuaggagggcacuaaauuauggcuuuauaguaucuguuacuguuaaguaacagcuuuuuuuaaaaacaucacucaguuuccauauacacuguaaugguauacuuugaauugaacccuauauaguauguucaucuuugccucucaguauugaaaaaugauaaauuucuauacuuaaaggcuagauugucucuuuauuugcauaacaguggcaaaaaaugugaacuuuggaauucagaauaccuggacuucaaucuucacucuucuuacugacugugacuuagggcauauuucauuguguccacauuuauaaaaugagucuaacaguaccugucuaccaggguugcugagggauuuaguagccucaccuaaaagguugguaaaguacccaagacacauuuuaaauagcaguuauuauuaggugcuuaaaugcaccaacuauguuaaagcugaugaugaaacaucaggagaacuuguguaggauuacuuuuuauaucuaacagcaaagugacaugaaaaauuacauugguauugacauauucagcuuuuauuuuauuuuuugaaauaggaucuguuuuagaacaguauagguuguaaaaaaauagguauuuguuuaauagauaacuaaacuucaaacccuuuuauaugaugauuaaauuacuaacuaaugucucauaauguuugauaguucaggccucuguuuaaaugaagaaaagcuuuggcagagaggaaacagaaaguuaccaaguacagauuuuaaaguaauuauacuuuaaauuaaacuggcuguaauacuacuccaauacucaugaaacaguuuuauagaaauagucauuguuaauuagaguaucuuuucuaaaaguuuuuggggggaauagaaaacuacucacccuugguuggaauaaacuuuauuugaaaggaaaauuaaaugucagauuuagugcuacuagagagcuucuuaagucauuaggauaccacaggccugcaggacaagagcucaccagagaggcuagggguugaauuguuacaaucuuagauuuauuuggcacuuaagcucauauuuauucauguauaaaaucauuuauucagugggucacaauguugaucuuugaucuaugaaacguuugucaauauauaacugaaccuugguacauuaauuuacaguccauuuauuugucauuuaguauaccagaaauagaaguuguguauuuauacacaucaaaggcaguaagauuguuugauaguuugacguuagguaauauuuuagccugugauaaaucuacuuuucuuuaaaacuuaagucacuaacaugauacgacuuaaauauuuauugguuugcacauuuuacguuaaagaaaggaaauucucaucgagaaagacaagguuguauuguucugaagugacugaauucuaaagcaaccgaaacauuaaaaaauauguaugugaaugugucuucuuuuagggauuaaaaauaagaucagcaggcaaaaacggaaaaaauaaggacacacuaacaguagaaaaaguuaggauucaauauauugaaaugaucaguuuuauggaaaacauuuauucuauucguagcacagaggaagaagaaauuuuaaguuguuuuauaaugcuagauuuauuuauuuauuuauuuuuagagacagaguccugcucugucacccaggcuggagugcaauggcgagaucuuggcucgcugcaccuccaucucccggguucaagugauucuccugccucagccuuccaaguagcugggauuacaggugcccaccaccacgcccggcuaauuuuuguauuuuuaauagagacgagguuucaccauguuggccaagcugcccuugaacuccugaccucaggugauccaccugccuuggccacccaaagugcugggauuacaggcgugagccauugugcccagccaauuuauaccaaaugauucucagaucuccuagaaauuacagaagguuuucugcaguuucauucuguaaauauaccucguacuauuucuuauuuuuuuaaauaaaaaucaauauuauauauuuaugaguauuuuuuuuuucuuuaaaacaagauauguugagagccugugaaugugggguuuggugaguacgccagguauuaguagagggcaggggagaaugcucaugauuucagugcuugacucagcugaacuggacaagccauaggcgugguuuugagcuguuuucuauuuuaaaaaauuccuagucauagauugcuuaacuaaugccuauaauggauaguugguuaaguaucauaaauaaaagguacacugauguuuaaauacaagguaacgaagagcauacuaauaguaacaauacagauaguaaaguucuguccaaguuaaucuucacuagauccuguauuuggcugaucaaaacuguuuuuuuucuuuuaaagaaaugggguuuugcuauguugcucaggcuggucuccaacuccuggccucaagcaguccgcccaccuugacuucccaaaaugcugggauuccaggcuugagcuacuguacccggccuuaugaaaacuuucguauagcacaucaggauggcccuaaaaccuuaaaauuaaugccacacagaggaaauggaguacuaggccagguaugguggcucacaccuauaaucccagcacuuugggaggccaaggcagguggauuaccugaggucaguuugagaccagccugggcaacauggugaaacacugucucuacuaaaaauauaaaaauuagccaggugugguggugggcaccuguaaucccagcuacucaggaggcugaggcaggagaaucgcucgaaccugggagguggagguugcagugagccaagaucgugcuguugcacuccagccugggcgacagagcgagacuccgucucuaaaaaauaaaagaaaaaaagauccaguuauaucuaguuugacuuuauugaaaauagacaacuuagacauggaauguuacuuacugagaaauauuuaucacuuauugggaaauaacuccuugaaauguuuucuuauuucagcauguagaaauaacauggaaauuauaaaaaauaaaucaggguuuuagaaguucagcagauuagaguuucaaaaauauuguuaaauugucaugcaaagagaaauuuuggucuuuguauuuucuacaucaggcuuuauuugagccugauuauauauguuuguugucaccucaugaguuuuuuuuacauaguugguuuaaaggaaguuaaacagcacauccuauuguaaaauaggaccuugucaaaaauauaacuauauaacaagcagccuguauuauuaaguacauagauaaguucucaagaaagccagaaaaaucucugaguauuugaagaacaacaaacaggaacaacaaaaccccaagaguaagugaauaagccaggcuaugguuuccucagcaggggagagaggguggucacaagguaacgugggaccuuuaguuugggaaaaaugagguuagaggcacauagagacuaggagucagaacugaggcucaguaagaagcgcucaggcaaagggcagauuuuaaagcaugcgcacaccuugcccauugauagaggaagacugucagccuuagcucugggcagaagaaagucuccccugcgagcucaucuguaggcgcugacuucccaagaguuugcggcuaauauuacuauagauaccuguauuguuggaaaauccuaagccaagaaaauagcauuaaaguugauuaaaaauguuauguauaauuuaaucauuuuaaucaaauauauauuagguaaauuuugauuagaaaggguauauauauaaagauauaauuaaggcugguuuuagaaaguugauuuauuauaauuuaagauucauaauauauauguuugacuugguccuacuuaaccaugucacaugcuguuuaauuuucuuuaaauuaauugugugagaaaacucaggacuugauaacaaacauuauauaagcaggcccaaacaaaaccugauuuuguuuucugcuagcuuuucuacauuuuuacacuucaacuaaacucuuaguaauuugauaguugguuucacucuucaaguguuaucauuccuucaaaguugggaugaauaauauagucuauucuauuuuggcuacuuuguccuugaguuuugcaaagaucuaauauuuucgucuaccuguagcuaauuuugugaggugguuaaaaagagaaaaucuaaguuauuuucucucuguauuacuauucaguuauucuagagcaauuuauacaauaacguuacccuuaccuaugauuucuuaauauucuuaccuauuauuaaacguauuuuugaacuucuugacuauaagcuuguagcacugggaaucacugcuaaccuuuuucuucuuuuuuccccucccuccuuccuuccuucccuccuucccuucccuuccuccuuccuccuuccuccuuccuccuucucuucccuuccuccuuccuucccuucccuucccuaccuccuuccuuuccucccuccuuccuuccuuccuucccucccggccucauuccuucuuucccuccuucacagccucccuccuucccucccucccugccucccaucuauaccuuuccuuggacauuuucccauagauuugaucccauuuauuugcugucuuuuaggaacuucucaaugucacuagucugcuggugcuucuguccucuggcauaauuaaaucauucaguuaauauuuauugguggcuuauugcaugcuagguacuauuguuaguguuagggacauguagauuggugauuuauuguauauuucucucaucuuuuaugcuaaaaaguguguguugugagacccaucaucuugaacuaaugacuccucuucuaccuguuagcuuuacugaccuuuuaucuggaacauaguaguaguucaguucuuuauuaacuuuuuugcauucuuuggccuuguuuccaccucugggaagauucagauugucucugcuugaaucugcucagauuuauucuacagguauggagcccaagucuuuucuucuguccuuugcucuguagcaaacagggcaaagcuuuguaguugugucagucucuccugaccuuaagguucuguugaaggaagauuuuuuuccaaggcagcguucagaaacuccuucucaagguugcaagaugauuccuauaaguuugcgagccacugcugaauacauccguaugucaggauucuuaguguuuaccucuccugggucuuauuuggcuugcgugaagcauauuacacugaugguuuugguuacuuuuacuguuuagcuugccuucuauugcauuuucguuaauauucuaauuuuuacaauuuuauagaacuccaguuaaccccaaaucauauuggguuuuguuuguuuguuuguuuuuguguuuuuugagacagagucuugcucugucauccaggcuggagugcaguggugcaaucuuggcucacuguagccucugccucccgggcucaagugauucuccugccucagccucccaaguagcugggauuacagguguaugccaccgugccuggccccaaaucauguuuuguaucauuccaaaguaccugucaacauuuguacuuggauuauuguuuuacuguaauuaguguguacuuauauuuuauguccuucuuacuuuaacaguucaucuuguguacauauauuuuucuggugccgggaaaaauuguccaagacuuggaacugggcaaaagagaugcagaugucuguuaguggaguccuggaugggcaaaagagaugcaggugucuguuaauggaguccugggcauugugugguagauccuggggauuaucagguccuggaggaguaugugccuuugacugacuuuccacugccuaggcccuuuuacaucuguguagaguuagaguuaccuuggaggaaguagagagcaaugcagaugaauuuuaucuaauagagacacaauugacuucccccguauaaaagauaacccuaacauuucauuuuauuuucccauaggauauuaugcaguuucacagauugauuuuaggauuuuugauugucugcgcuccucaaguucuccuuugaccuggcuuuaagagaauuaaaaccauguggcucugcuacugaaggacauaagggacagacagaagcagggugcugagaagggagcugcagucagcaggcaguguagcauuugcuuugggcugaaguagugaacguggguacuggugaugugagaguucauguuaaugcucauaaagguccaccaacauacaagacagcucccagaauuaguccugccugccuccguccacucucuagaucuauucacuaaauucaguaucaucagaggcaggagaugauagggagaacaagcaggacaagaguucuuaaauacggagaugaacagagaauucaaagacgaacaaacauuugagaaaagccaacaccgugagaggccccaaacucgguguauuacucaaagaguuaguagacaaaaaauauuucaaggagacuuuuaauauauuaucuaggggauuuucuuuaacagaaaaacuuaaggauaucuaguccucaguauugccagaaaugcaugcugcugagucauucuacaccauucagagcugguuaccacuuuuagaagcaagcuaguauuauagugugaugcuguaaaaaaaaaaaaaacagaaaaaaacccaaaauaacaaaaaauaaacaaaauacaacaagaagagugauaauuacgaagguauuaucugacaaaaaagacuuucauuucugaagcaaauucuacacauacacuuugaugaugaaguugaugagcugacauggccugaucucuuacaccauugaaggagcugucuucuuucuuuccuguuauggguaagagcagugucuagaagggauaggaauguuuucaugcacuaccuguacaugaguccuaaugaaacugcauagcggcaaauaaaacuagaaagucaagcucagcugaauuuaaaaauagauuauucaaauaaaaaaauuuaacaaggaugcuggguacaaggauuaauauauuuaaaaaaaucaauaaauaccagcaacaaacugaaaaucaauuauaauagcaagacagccuaagguauguugaaauaaaucuaacgaaugauauuuaaagccuuuauggaaacaauaauggaaacaaaaaaucuuauugaaagauguugguuggacacaguggcucaugccuauaaucccagcacuuugggaggcugaggugggagaaucgcaggaggccaggaguucgagacuagccugggcaacauagcgaggcccugucucuacaaaauacaaaauaaaaaaaauuaacugagccugguuggugcaugccuguagucccagcuucucgggaggcaaaggugggaggauugcuugagcccaggaguuugaagcugcagugagccaugauuguaccacugcacuucacuuuuggugauaaaggaagacccugucucaaaaaaagaaagauguugaagaaaaccuaaauaaauugauagauauucuguguucauaauuuuuagaguuuuugcaauucuaauaaaaauucugcaaaguuuucuuauagaaugugacaagcagguaguaaaaauuuaauggaagugcagaaagccaagaauagccggagcaauuuugaagaacuaggugauggaacuuccucuaucaaauauuacaagauaggcaaagaaacugaauagacauccaaagucuauccaaagaagauacacaaauggccaauaagcacauaaaaagauuaucaccaucacuaaucacuagggaaaugcagaucaaaacuacaaugaggcuaggcccaguggcucauuccuguaaucccuccauuuugggaagcugaggcaggaggaucacuugaggccaagaguuugagaccagcccggccaauauggcaaaacccugucucuaguaaaaauacaaaaauuagcugggcaugguggcgugugccuguaaucccagcuacuuggguagcugaggcgggagaaucgcuugaaccugggagguggagguuucagggagccgagauuguaccacugcacuccagccuggaugacaaagugagacccuguuucaaaaacaaacaaacaaacaaacaaacaaaacugcaaugagauaccuccuaguaggaugacuacuagccaaacccagaaaacagcaagcauugguaaggauguggaggaauugggaauauugugcauuguugguggaaagguaaaacggaagagcugguguggaaaacaauaugacgauuuguuaaaaaauuaaaaauggaauuaccaucugauccagcaauuccacuucuggauauacaucuaaaagaauugaaggcaggaacuccaacacauacauguacacccauguucauagcagcauuauucacaauaccuaaaugguggaagcaauccaacuguguaugaugaauaaugaguaaaccacacgugauauauccauacaaugaaguauuauucagcccuaaagaaggaaauuaugacacaugcuacaacguggaugaaccuugcuaaguuaaacaguccagucacaaaaggacaaauucuauaugauucuccuuaaaugagauaccuauagcauugucaaaguuguagaaacagaaaguagcauagugguugccagggauuguguauugggggggaaguuauuguuuaauggguacagaguuucaguuggugaauaugaaaagcauucuggagaugggugguggugaugguaccauaacagugugaauguaguaaugccacugaacuguacacuuaaaaaugguuacgauggugaacuuuauguuaugcauauuucaccacaauuuuaaaaaacgcaaauggaugauaaacauggcaguguuuugugguuaccuguggguagguuggugcagaagguugacuugguugggaggauggucaugguaauguuuguucuaguuggguaguauauccauggguauuuaauagacauguaaagcuaaauaguaaacuuuuauuuuaaaauagaaagggaaaagggugauuuguaucccuugaugaucagcucacauuagcuaaacagaggcugauacauaaaaccaaaugccaacuugcugauuuucaauggaaaaauauauaaauauauuaauaaaauacuaauauguauguaugcaucugcacugauaccugcccacccaaaguagcuauuauuuauugagagaugcaggaaauguggaaaccugggagagaagggcccaaaggagcuaacgggggacuagucuggagugagagcaggaagccggaagcuuucauguacaucuuuccuauuuuguucacugucauaaaggaucuucugugguguuuuggaauuucuagugcuuuuuguguaaaguauuauuugccacauaagcaauaugauguuauuaccuaaauugucacguggcauugcuuuuuauuauauuuuaaaacuuaauaucuuuuauguuucacuguaauaauaaguaauaaugcuaaugaucuuucuuuuguuguaucuuuguuggaguuugugccugaguguuucaugaaaugaaaguggauauuggcuaagauggucuucugcauuacagguuucuuacaagacugagcauuugaccuuaguaugagcuugcuuuuauggaacugaaaacuaacguuccaguaaaagaagcuuuuagguccuuuacuaaaaucauagguuugucuuguuucuuuuaagcauucucccccacuuccucauuuccaugugguguugucuuuugugacuuauuucugucacuggggaggugggggugaaggguggaggugaaggguagggguggaaagcacagggcccugagggcugacagaccugaauugaaagugaauucuggcaugcaggcaaauuauuucacuuuugagugugaacuuuguuauguguaaucaaauuuaccuuuuaauauauugcaaagauucaguaagcacguauaaagcaacuaguaggagcucugcaaguguuaguucucauuucuucuuuucuaugaauuuugaacugaagaauuauuagaacaaaaauagaagaaaagagccuuacuagugaaccagugaauuauuugaugugauuugguguacuaagaaauauuuuuuucccaaauucagaauuauguguaaaaauuuugauaucuaguuaccauagucuuuuuauaauucaguucuuucauuuacauauugaaaacauguauuaauucauuuguaaucuggaggauuuuuauuugucuaauaucauggggaauuucugccuacaaauuuuaaugcaauggagauguuaauucaaugaacuggcaauguugguguuuuuauuuuagcuuaccccaagcacuuucuuuuuguccagcuuuaacagcuugagcaucuuauaguuuuaauuuuuucaucuuguauagaccacauuaaguauauuuguguauaaaauagacugcauagcauauuaauauuaaaaaacauuucacuguuuuacuauagaccuuaacaaagcuuuucacaaagccguuuucucugacgugagaccaaagcuuuuucguguaugcucuuaaugauuacuugggagcaaagggagaaauguuugacacucucuagagaugcuuauuuguaguuuuuucauggcuuaaaauaaaauaauuaauaccugcuuuuauuuucuguucuuuauuaguacuucuaccgaucuuccccugaugacuguguauauguuuggugcaaucuugaugccaugcugagcaaaccuuauuuuaauguuacugagagacccuuuuuguuaagugaaaacaauagcuugauauuuauuuuaaauguucugugaauguagaaguuuucccaggcuuccuaauggguagagacauaguguaugaagugguuuuuacaucccuuacaggagggcaagauguccaggcaaaaccuuguuuaaauguucaucaccauagaaacaugacagcuucuccauagagcuuuuguaaguacauuguaauuuucacuucauugaugugaauuaaauguauaauugaccagcacaaaaauuccaagaagcaauuauaucauaaccauuugaguguaguagacuauccauuuaguucccauuuaaaucuaaaagaaaucugugugucuacaaguguuuagucuuuacuaaucuauuucaucgaauuuaaccuuuuauaauauugagguuguuguaauuucaaaaaaugcugguaugaaauaacgugauuaauucuauagcuuacucaaaacaacucauguuucauuggcagaaaaguacuuaauuucagugguguuucuaauauacugacugcuuauuauacugcaauuuuaaucagaaggaaggaguuucgcuaaaguaauuuaaacuuaacggguuuuuuugugggggauggcaggauaaguguucauacugggaaauaaaaauauugugaaguucaugaaauccuggugauauaugacauaaucuaagcauucaaaacuaggugaaggaaguacaguuauugauuaauaaauagaaguucuuauaguccugugaucuuguauucaggagacuuuuuucacuagaggaacaaugaagaccuucuuccuuguuuacaguguuuugccacuuuguuguuugaagcgcauuuuaauaaguuauucugacaucugguacaucuuuuagcucaguauaugcaagaauggaguugauaggaagcuuccccucggggcuuucuagcuccugauucugacccuuaauggaaaaaugagcagucggcauauuuuuugcuuauaugcugugcugcuggugauuaaugguggugauaaaagugcucacaaugcuuuucauuacuuuguagucagaauggcauccaaaagucuaacaaucucacacauggcaugccauaaaggcuguguucuugaagcuugguaauauuuuuaugaucucaagaaagauagugauaacagcuuauagauuuugaguacuuguauauuuacuaguggaagcugaauuaacaaaugaaauuucugacuauagucucaucaucucucuucucucuagcucaaaguuuuugaagguaaaaaauuugccaccuugcauuuaaugaacauauuuaucuuuuuaaaagguuuauguaaagcucacgcaugugguauuuaauugauuuuaaguuggacagguuuugucucauuuaaucacagaaagaaaauaaaauuaacaaaagggaaaacuuaacuauccuagccucccaguggauuaagucagaauaacagcucuuucuuacuauaucaguuaucuuaauauuucauaggacaagcauaaucauauuaaauaauuuugauggcuuguaccguggcagccuuuucuauuaguauuguugauuuacucuuguaauguagaucgauaacuagaaaugagcagauuucuuuuugugaguuauuuacugacuuucaaaagaaauauugacuaauuugaaauaacuuuuugaacaauuuauaugauugacuacagagaguucuuuuggcuaaauguuucugaauggacugcuuaaacaugugaguauguauuucagacaguucuuguuauuauuuguguaccuauaauagaaaaaucaucgucuuggauggguaugguggcaguaggaaaagaagggaugaauuugaguuguaauuacacaguagaaucagaagcacuugguguuugacuggaccgaggcucaggguguaugguggggguaggguaugggguucagcaggaaagguaggugacaaggguguuuccaaaguaucuggcauaaacaacaaaguggguaaugaugucauguuuucagguaugugauauugaaggaggagcagagauagagaauaaaaugaugaguuuggucuuagaauuaaguuuaagguacuggugagaugucuaaugaaagacggcaguugguguauaugguucuuggccacagcaguaagauuuggacuaaagauauaaacuucagaguuguuggcuauuggaagaggcaagaucacuuagguaaaaacugagcaguauaucugugaaccgucuucaucagaaucaacugagucaccacuuugugguugaugcucaggaacuggcaggccccuugguaauuaugaugcagguugacauuugagaagcacugauaugacaugugagaagaugaacaucugagauugggccacaggagaaaagggauucaagguauuuucuuuuauagaacgaaagaauuagaaauggaaacaguagcuaagguguagaggagggaaggugagggacucacagaccccacucagcuguguccuacugagguagaggaaagucaauuguaguuggaaggaaguagaggaugagauuauagauaaaaaagaaaggaaaacauuuuaaaaaauguugugaaaggccaggcguggugacugaugccuguaaucccagcacuuugggaggcugaggugggcagaucaugaggucaggagaucgagaccauccugguuaacaccgugaaaccccaucucuacuaaaaauacagagauaauauuagcugggcgugguggcuggcgccuguagucccaacuacucaggaggcugaggcgggagaguggcgugaacccaggaagcggagcuugcggugagccgagaucgugccacugcgcuccagccugggcgacaggcgagauuccaucucaaaaccaaaaaaaaaaaaaaaaguugugaaaauugcuaaagucagccagagaucaguauaaagauugccaaguagcauugaaggcccacuuuggaaugucguaguaaaacuuucucaugauuguauaauacaaaguuuuuuugacagggcugggaaucaaggaguaggcgccaggggauuguugaagcuggccugguggaagccaaagguucagggagcuccagaauauuguugauacuggcucaucaucaaaauucacuagugaaccaugggguugaggccagggaagagaagacugguuggaaggauuaggagggaacaagggagugaagguucugaggauguggaggcagagcuaggcuagggcacugaggggacaagaaaagacaggaaauuguggacuaagagggcaguuucaaaguuggaguucuuagaggugauccugagagaugguggaauaggaucaaugcauguguggguggcuacuguagaaugggaaugaaucucacuggaauugaggugaugagcuaggauguuacuuacgagggcaggggaugugauaagaaguacuugugaaccaggugcucauaucauggagaaagaugggacugcuucuuauagguuuguagauggucgggaacaaaguugggaagagagugauaggauggcauuagaagguggcauacauuuaauuuagaaacacaaaugauaugugaacucccaagccuuggaaauuucagagacaaagguaauaguuugagucauuauagugaaccauuacauuguguuuacuaagaaccagauauuguccuaagcauauauauauauaaaauauauauaauuuacauauauaaaaauguauaaaauauguauaauuuacauauauaauauauauaacucauauauauauaauacucauucgaucuuuauaacaacccuauaagguaggggugcuauucauauccucauuucacaugggaggaaacugaggcacagcaaagcuuaguaauucgcccaagguuauacaguaguggaaacaggauuuggacccaagcaauuuacuucuggcauuggggcucuuaaccagccuaguaugucucauaaacugaaaucagaucuauuuuuuaaaagcuuuuuuggguuccagucucuuggaaguuacuucuuaagaaaaaauuaaaaauuaaaaagaacauuaguugguacucuuacuacauaagucauacacacccacucuaaaaaauucagaaaaaaacagaaaagcauaaaguauaauggaagaauuauucccuauaauuguaguucuagagauaagacuguuaauuauccauguucacauauuuuuucuaaauguauuuuuaaaaauaggucauacuguuuaugcagugagguuauauuaugaacauucaccaugauuuaagauauaaugucuuacgcuauggaaguauaauaauucauucaucuguuuuuuuacaauuagagguggagguuguuuaguuugucaauguaugugugcaugugugaucuuuuaaaauauuugguaaaauuauuuaggaagaucuucauuuuuuauuuuuauuuuugagacauagucucacuucgucgcccaggcuggauugcaguggcuugaccucggcucacugcaaccuccuccucccagguucaagugauucuccugccucggccuccugaguagcugggauuacaggcgugugccaccacacccagcuaauuuuugaauuuuccguagagaugggguuucuccauguuggccaggcuggucuugaacuacugaccucaagugaucugcccacccgggcuucccagagugcugggauuacaggcgugagccaccgugcuugucuucgucacccagguuguaagcauaguaccugauagauagguagauccuuccccuugucccaccguccaccuucaaguaggccccagugucuguuguucccuucuuuucguccauguauacucaauguuuagcucccacuuacaggggagaacaugcacuguuuggauuucuaucccugcauuaguucgcuuaggacaauggccuccagcuccauccauguugcugcaaaagacaugaucucauuccuuuuuuuugagauggagucucgcucuugucacccaggcuggaaugcaguggcacaaucuuggcucacugcaaccuucaccucccagguucaagugauucuccugccucagccuccugaguagcugggacuacaggugcccgccaccacgcccggcuaauuuguguauuuuuaguagagaugagguuucaccauguuagccagguuggucuugaacuccugaccucagaugaucugcccaccucagccucccaaagugcugggauuacaggugugagcugucucacccggcugaucucauuuguuuuuauugcugcauaguauuccaugguguauauguaccacauuuucuucauucagucugcccuugaugagcauauagguuauuccaugccuuugcuauugugaauagugcugcagugaacauaugagugcauauaucuuuauguuagaaucauuuauauuccuuugaguauauacccaauaaugggauugcuggauuaaaugguaguucuguuuuaaguucuuugagaagucgccacacugcuuuccacauggcugaacuaauuuauauucccaccagcaguacaugaggauucccuuuucucugcaaccucaccagcaucuguuguuuuuuugacuuuuuaauaauagccauucugacugguaugagguggugugucauugugguuuuuauuugcauuucuguaaugauuaguguuguugcauuuuuuucaugugcuucuuggccacauguauuucuuuuuuugaaaagugucucuuccuauucuuugcccacuuuuuagugugguuuuuuuuuugcuuauuaauguguuuaaguuccuuauagauucuggacauuagaccuuugucagaugcauaguuugcaaauauugucucccauucuuuagcuuguuguuuacucuguugguuuguuuguuuguuugcuuguuucuugcugugcagaagcuguuuaguuuaauuaggucccauuugucgauuuuuguuucuguuuuaguuacuuuuggugucuucauccugaaaucuuugccagggccucuguuuagaaugguauuuccuagguuuuuuuuccaggguuuuuaacgguuuuagguuuuacauuuaagucuuuaauccaucuugaaucgauuuuuguauaugguguaaggaagggauccaguuucagucuucugcauauggcuagcuaguuaucccaguaccauuuauugaagagggaauccuuuccccuuugcuuguuuuugucgacuuuguugacguucagaugguuguagguguguggcuuuauuucugggcccucuauugaucuauguguuccauugaucuaugugucuguuuuuauaccaguaccaugcucguuugguuacuguagccuuguaguauaguuugaaguuggguagugugacaccuccagcuuuguucuucuugcuuaggauugcuuugacuauaugggcucuuuugguuccauaugaauuuuagaguaguuuuuuuuaauucugugaagaaugucauugguaguuugauaggaauagcauugaaucuguaaauugcuuugggcaguauggccauuuuagcaaugauucuuccuauccaugaacauggaauguuuuugcauuuguuugugucaucucugauuuccuugagcaguguuuuuuaauucuuguagagaccuuucaccucccugacuagcuguauuucuagguuuuuauuuuauuuuauuuuauuuuguuucauuuuuuuguggccauucuuggauguuauuggucuauagaagugcuacugauuuuuguacauggauuuuauauccugaaacuuugcuggcauugcuuauuagauccagcagcuuuugagcagacacuaugggauuuucuagauaugaaauuauaucaucugcaaacagagauaauuugacuuccucuuccuauaugaaugccucuccucuccccucccuuccccuccccuccccuccucuccucucuucucuuuucguuuuuugucguccaggccgaagugcaguggcacaaucucggcuugcugcaaccucugccucccggguucaagcuauucuccugccucagucucccuaguaguugggacuacaggugccugccaccacgcccagcuaauuuuuuuauuuuuaguagaugcaggauuucacuguguuggucaggcuggucucaaaugccugaccucaggugauccacccagcucggccucccaaaguguugggauuacaggugcgagccaccacacccagccuuuuauuucuuucucuugccagauugcucuggccaggacuucccaguaauaugcugaauaggaguggugagaaugggcauccuugucuuguuacgguucucaaggggcuaugcuuccagcuuuugccuguuccauaugauguuggcuguggguuugucaaagauggcucuuauuauuuucacauauguuccuucaaagccuaguuuguugagaguuuuuaacaugaagggauguugaauuuuauagaaagcuuuuucugcauccguugagaugaucaugugguuuucuuuuugagauggagucucgcucugucacccaggcuggagugcagugguacgaucuuggcucacugcaaccucugccucccagguucaagugauucuccugccucagccuucugaguagcugggauuacaggcuugcgcuaccaugccuggcuaauuuuuguauuuuuaguagagacgggguuucaccauguuggucaggcuggucuugaaccccugaccucaugauccaccugccucagccucccaaagugcugggauuacagacaugagccaccacgccuggcugaucaugugguuuuuguuuuuaguuuuguuuauuugaugaaucacauuuauugauuugaguguguugaaccaaccuuccaucccagggauaaagccuacuugaucaugguggauuagcuuuuugaugugcugcuggauuugguuugcuaguauuuuguugaggauuuugcaucuguguuuaucaagaauauuggugugaaguuuucuuuuucuuuuugugucuuagccagguuuugguaucagaaugaugcuggccucauagaaugaguuagggagguguccuuuauuuuuaaauuuuuggaauaguuucaguaggaaugguaccagcuguucuuuaaauauuugauaggauucggucaugaauuuaucugauccugagcguuuucuagucaguuggcuuuuuauuacagacucgguuucagaacucauuauucaucuguucaggguuugaauuucuuccugguucagucuugggaggcuguauguuucccggaauguuuguauguuuauccauuucugcuaaguuuucuaguuuguaugcaugaaaguguucauaauagucccugaugguuuuuuguauuucuguggggucagugguaaugccgucuuugucacuucugauugugauuauuuggaucuucuuuuuaucuuuauuagucuagcuagcagucuaucuaccuuauuuuuucuuucaaagaaucaacuccugguuucauugaucuuucauaugguuuuucgugucucuauuucauucagaacagcucugauuuugguuauuucuugucuucugguagcuuugggguugguuugcucuuguuuuucuaguuccucaagucguuuguuuucccauuuauugacaguuauacuugguauucuuuuuaaaaucuuaugucuugauuacauuuuuuucauauuucuaauguguuuuugcuacuuuauuuuguugauuuuucuagccagacauuuaucagaauucuuuugaauucugaauucuucgauuuauuuuuuccuacuuuuuugcucuuuuuuauuauacuuacuuuaauuuccuguuguauuuuguuuuauuuauuuguuucugagacaggauuucacucuguugcccagguuagagugcacuagcgcgaucauagcucacuguaaccucaaacuccugggcucaagugaucuucccacuucagccucccaaguagcugggacuacaggugugugcuuccaugcccaucucauuuuaaaauuuuuguuagagauaaggucuugcuauguugcccaggcuggucuugaacuucugggcucaaaugauccuccugccucccccuuuaaaaguacuaggauuacaagcaugagccaucgugccuggccuauuucuuccuguauugugguuugcuaggauuuauuuuguuguuccuuuuacaaauucuugaguugagugcuucauuuuuauuuuuauuuuuucuuucauaauaaaacucauuuauuugagcaucugaauacagauuuucuacacuuuauguuuuuauaaaguauucuuguuuuguuacuuuuuaguuggccuaugauugcauuaguguauuuuaauuuaagcuuuguuguuaauuuuuugcauucagauauuuugacuuauucucuguuguuaaugcaguaguucugaugcaguuuagaacuugauauauuuuguugggcaggguggugcgcacuuguaaucccagcuacucagggggcugagaugggaggaucacuugagccuaggaguuagagaccagccugggaaacauagugagaucucaucuuaaaaaaaaagauagacauacuuuuuguaguuuaauuucaaauucauuuuuguaaauuuuccuuuagugauugaaauagagguauauucccuauaagggauuacuuuagguuuauuaagucaaccuuguuauuauuuuucagauucuguguaucauuguuaauauuuuuucauucuugggcagucacagacugauagaguggugugucaggagaggcggucugcaugggccguaagcauuccugcguuuucuuucugggugugccaagacugugaggucuugacugcucuuuaccugggccauuuguuaggguuguguuucuucugagcaaacuugagggaugaagugauggcucccucugggccacagagcagccuggcuuauuaccacgugcugugaaaacaguggauuccccacgcucacuguucuuuagcugcugcacagaucugucgcauaugcaacauccauccauaagacuugggagcaggggaaaugaccugcuggcacucaugccucuugcuguaccggaguaauaaaauccuuugcuucugauccaggagucuugugucuccugccagcauccauguaacagcaacaggcuaacuuauuaauuuguaaggauagaaccagaccccagaccugacaguuuuggcaaugagauuggauggugcagagaaagaacaaggaccuuguauuccagguuuagugauaugaaaagaccuucagaucuggugguggaugugcucaacucaguggugagagggaggcggaggaggaagggccccugguaauuacauuacuccuaccuguaaugagucugaauggugcuuuggcugucguucauuccucuccuguuguaagacgaaggaauguugguaugacaccagggcaguaagcccccagcuccagucagaaggcauuauggguguggcugcugagucaaggagucucaguccugaaaugaguggugccucagcuuccugaagcacugggauuacaggugugagcuacugagccuggcaucaggugacuuuuugaguaggguguuugggcuuauuccaucugugauguagcuugcacugcugacucuauauuaaauugguauucguguuuuacaugaucauacuaugcaagcuuggccucagggacugugccuucccuuuggcccaauauaaacaguauagggccccaggaggagaagcgaauaucucagcuuuugugagagacuuaauagcucacaaauacuccaggaggccauuuccuaaaauagcaggugccucuccugccugccacugccuccgaguggacuccugagaaaggacagcugugaaucugcugcucagcucuuguugaaauggauuacccaaccuguggggccaugugacucucuagccuggcaucccucuucugggguggaacaauuuagauuccauguccaguaaaauggaagaagcuuaacaggccuccuagccaaauaaaaauggucucuuccagagcucaaccugccuggcgcuaccugguaucaagguuucaugugaaaaaguggcagauaccuccugggggaaacccuauuuccuaauccacugcugaagccaaaccacccaguuaggcccucaauccccugagcccuccuaaugucgaggcugggcucucugaccuuuggcugcaucagaagcugaugguauucacugagugguggcagcccaucacaauggaggcauacuuaggaauuuuuuauuuuuaaaauucuaaaugaauuucuuaucaaauuugcauaaacaugcuaaauauaaugaauaaagguuuucuguuguauuuauuuauuuacuuuuuuguuuuuuuuugagaccgagucacucuguugcccaggcuagaguguaguggugcagucuuggcucacugcaacgcaaccuccgccucccagguucaagcgauucuccugccucagccucccaaguagcugggauuacagcuaaucuuuguguuuuuaguagagacgggcuuucaccaugcuggucuugaacuccugaccucaagggauccaucccccuuggccuccuaaagugcugggauuacaggugugagccacugugcccagccucguuuucuguuuauuuaaauauuguauaaagaauaauaacaaugaagcgcuauguacucaccaguuaaucuaaagaaauagaacauaauaauauaguggauaguaaauuucuucaauaugaaauguccuacuuuaucccauuuaauguuuuuuguuuugcauucuucuguauuuaaaccagacuccuguacauuuuuaaaaaauuaaacaauaauuuuuaaucauuuucacuuuuuuuaguaucacuuucguuuugauaggucuuagacaguuaauuguguuuuuugaccuaauuugcauauauaguuauaguagauauauuugguuuuuaucauuuccuguuuucguauuuuauauauuuuguuauguuuauauuuugcuaaacuugauuuucuguuuuuuacuauauuaacuauuacauuuuuguucuguuuucuaguaucuuaguaauauuacuuuugauacuaguuacuauuacuguuacuaguuuuauuauuuugauacuaguaagauuagugguaaccuuaaguuuuuaguagcauuauuuaacuuuaauuucucugcugucaguaaaaagugaaauauuaucguuuuaaaugaccccuauuuaaaauggaauuuuuucuuuaacucuuuuuuucucaucugaaugucacuucuuaauguauaagauaauaaaaaauuauuaaaugauuuaucuuucaaaaauauuuuuuggcauugcauuuuaguuuauaacuauauauaucguuauuuauauuucucuuuauuuagaaaaaauuugucauuguucaccaacaauuccgugcagucacuucacaguccuuugugaaggaccagguaggauggugacgugggcuccuguacucagcagagccgugaguuugaguccgucugcuuccuaaaguuccccugcaugcucaggggggucuguacggcuuuuacaccccugaaggacagggagacccccacuuuaccccaucaucuuuuuuccuaagcaucugaggucagaauugggggaggacaguugaaugagcauggcaaaagcgacuggcccacaccguuaagcaaggcgcguuucauuuugaguggcuaguggcuacucauggcucaaccaaauuuguaaugacaucaguuuaggcauuggucuacagccucauuccugacgcuguuuauucagcuuugggacuccuugaaauagcagcuguacccacaggaccuuuuaccugguguugcauggcucacaguucacaccaucaugaugacauuccuucaugcuuccgcucagaggagagggagugacaaccuagccagcagugggcucagccucacugcuuaccucagccugcagacugucaccagcagcuaggacugcuuggggucccugcuccuccugcuugcccaccacuugggugagcacacucacugcuauuaauagaucccaggagucuucucauaucccuuaagccaaucugcaugggccccuccucuuucuuuuccagaaagccaucuauuaguccccuauccuuguugccaaaaaccgucaagaacugugaaaagucugagauuuuauucugcuugcaaacuaacaaguuagucuccgaguuucauggaugcuaguuguaaaccugagaugucugggucagagacaaaggacuugguuaugcacagcacauaaccgagugcacaagcuuccuuuuggugccaguugcccuugaacccaagccccacagugggccuguaucacagcuggggaacccaccauauuuauaucgggcugcaagcaacccugucuaaccuuugcuuggaggugaacauugugcuaccagacaguaaacaaaccucuccuuugcuucagagauacacuaucucuaaaucccaaggccaucugcuguacgaccuuaagaagacaguuccaaauaaggucugucccugccucugcuugugagauguacagaaaugugagagcgccguggagauugucucccagcacccaggcacauaccugaagaaaacaaguuuaauuacuaagaaauaguucuuaccagaauaucaaaggaagucuaaauuuuauggugauugauuucccaacacugauuaucauccuaaaaauuauuguuacaguguuauaauuauuuaacauuacaaugacaacuucuuuuggacaguggguuuuaaaugguuccaaggagcugacacuguguaguucauauauuguaacacuucagacacuauuaacacuguuuagcucauguauauuacagguauaaugcauguguuauuuguuuugggagcccuacucuuuaguucauauauuucuuaggggcugguuggaggcagggaaagacaggauugagagaguguaacacaaacgcuagaacaaaucugcauaaacgugcaagauauaauuuuaucuccuuuugucuguuuauugauagacuuuccauaaaauauuuaguguguaauaaaaaggauuuuagaaagagagaaaaggaggggaggaggaagaaaggaagagagaagucauuguuaaaggugguagauuauguuuugguaucuguauuagucuguuuucugucucacacugcuaugaagaaauaccugagacuggguaauuuauaaaguaaagagguuuaauucacucucaguuccacauggcuuggggugccucaggaaacuuacaaucauggcagaaggcaccucuucacaggguggcaggagagagaaugagugccagcgggggacaugccagacgcuuauaaaaccaucagaucucaugagaacucacucaauaucaugagaacagcaugggggaaaccaccccuaugauucaguuaccucccacuggguccuucccacgacacauggggauuaugggaauuacaauucgagaugagauuuggguggggacacaggcaaaccauaucagcaucuuaaauaguuugaaaguugugaaguggaaguucaaaggacucuucaguaaaguaguaguguguuuugugacuauucacauuucaucuccugugauuaauagcuacuuacuaugagaucucauguguuaaaauacaagccuaauucauucugguucacuggccucccaugcuaugaacacuuaaggugagcugacucucagauuugaggaaguguuuuaaacuugccaaaugcagccuugugguaagucugcgauauuguugaaggacuaguaagaaaaagucacuucaccucagagguuaucauuuagggcuagguauaccucuccaugcuuuuaggacguuuucuuuccuuucuauugaauuugaagaacuggggugccgugauuuuaaugcauccuauuccugcaauucagaaacuagaaaguaauacuuaggacaaaauugaaauaaguguauguuuuggaauuuuauaacucauauuuuuauguuaaauguggaaugagauaacauaauuuauugagaaauauggauguauuuauaauuuuguugguuguguuagauaauuguagguuagugcauugcaguacaaaauaucaauaugaugcuuuaacuuauaggugcagauucaaucauugggugauuuuuuggggaguaaaagcgguuucuuuuuuugucuuauccugcaguuuuuaaguuuuaaaagucuggccuuuaguuugguccugaagucagaauuuguuuuacauuuaaaacaaaguugugcauaaugauuauauuauuauauucuugucucauggauuaaugaaaauucuauauaaugugaagaaaagcaucauauagaacugauaaaagcaguaucucuauaguuuauaaugcuggauuacaauggacaguucuucagcggcacaguagagggcuccggaggcugugaggagcaccagaguccaugcuagagagagccggcgcucuccagcagcucggagcauuguggcgcaccaaguucagugcucacugaacuguuuggcucugugccauaauuagccuucuauucccuugauuagaaucacggauagaaauucauuaaucugcuuuguuaguggaaaguguuaggaaaguaauuguuaaaaauggcucugcagauguuuuuuaugaagaauuuuuuuuguguuuuauccaagcuuaauaauauuuuccauaauuugaaaagucagucuaaacauuguaaaccauaaguaccuaguguuuuuuuccuuuuaauaaauauaaauuuccucuccuuccaagggauuauuuuaugcuuucauauaggcagaaaccuuauuguucaugaaaugaaguaaaauacuaaaauuauauuucuacucuauuuuucagggaauccgagcccgcauuuuagagacuuuggucaugcuucuucuucuugcguuacucauucuugggauaguguggguagcuucagcacucauugacaacgaugccgcaagcauggaaucuuuauaugguauggauuuccuuguuuuaaccaguuuccuuacuggaaacuguaguuugggauauaauuacacacucaauuuuaaaaacauuuaaaucuuuguguaguuaacaaagauguuugauguuaauuuacagaauuaagaaaucuuuagauauuuuuaucuaaaaaugaaguuuuauuuauuuuauaugugaagaacaaguaagcagcuuuucagauuuuuuuuuuuuguuuuuguuaauugguuucuguucuucaaauuccguggagacauuuuuucucccuccagacagguuuugcuaaaggguuacuucuugguuuucuauuuuagaucuuuuuauuguacaauuuagaaauuauauggcuuaauaaacuaaaauaggcaauuacaauguuuacaugagguacagucagccucuaucuuaucguaagauagacugacuaucuuaaugugcaguauuuuggauuuauuaaaauauauuuacuuuuuuuuaauagaucucugggaguucuaucuacccuauuuauauuccuguauaucauugaugggauguuuguuacuucucuguaaguauuuuucagacuugauauuaagagaaaaguagaguuguccuuauucuggaaaauucagggaaguuuucugaugagauuucuuaacuauuuggauuuuuuuugaguucgccuuaacuauuuuuauucaaaauaaauuuugauaaauggaaacuuugaaauaauaagaugcuuuuauuguucucuaaggaaagcuucuucuacuggguuguagagugagacagacggacagacacacacacacacacacacacacacucacacucacacacuuucacacacucauauacagucauacuuacauacacugacacacaaaccaugugcacacucauacacacaugcuauagccucacccccauaccugucauaaugcuagauucuacuuuuaaauggaaaugguagaauuauguaugauaaguuugugguuuuuuaaaaguuuguuuuguuuuacuugaagcaucacagccuaucucagggauaaguagauaaauguaguuuaaaggacuuaagacuaugguugucaccuuuagauauucuuguuuguuucucaguccuauuaauacuugaaauuuaaccuguucuuugcuaauuuuucuuuauuuuaagcaaaaguauuuauuauuauucaacugcuagaaucuugaauauuauucuaagccuuuuuuuguugucacauaucuuucauaacuaauuacaccuauccugcucacauggccccucuagcuucuuuauugaugauggugaagaguucucugacaaaacacugacaaucucaguuggagagaagaauguucuuaaaaugauaauccuugaauuucccuuauuuuuacagucuaguuguuuaucucuuucuccaagcucuauaaugucgcuuucugucuuuuggugaucuuauuucugcaguguguacaccaguuggccuuucucguauguucacagugaugggucaguugcuagugaagccaacaguaaguauuuaauuauaaaucauuuuguuuauuaaauaaauguguuuacauuugauugucuuugauauugugagcuagcauuuagaaauagaagaagaauauguuuuguauguuuaucacucaaauuguuguuuuauuaaguuuuuuuuuuuuuuuugagacagagucuugcucugucgcccaggcuggagugcaguggugcgaucucggcucacugcaggcuccgcccccuggguucacaccuuucuccugccucagccucccgaguagcugggacuacaggccccugccaccuugcccggcuaauuuuuuuguauuuuuaguagagacgggguuucacuguguuaggcaggguggucucaaucuccugaccucguuaucugcccaccucggccucccaaagugcugggauuacaggcgugagccaccgcacuuggccuauuaaguuuuuuguuuaauagaacuuugguuaaauuuccagucuuuggaaaccaaauuugguuuugcuuuuaaaauacuaacuauaggugcauagguaaaaauuccucuagcaaauuuuaggacaaaauuuacaaauauuuacagguauuuuagguguccauugccuaauaucaaaaaguaccucuauuauguuucaaaauuuacauguaugcuuuaauuuacaaaaugguuauauuucugaaaauuugucugcauauugugucucgauuaauugaagcauacuuuaccuuucaucuuagaaacacuauauauuaguuuuuaaaugauuuucaguugauuguaauucuaaugauuugucgcuuucuuuggucucuauuuugucagauauuuaauuauauaaaaacgauuucuuagcugccccuaggaaaucugucacuuauuuucauggauccucacugccuaugaacucaagaguaaacuacuuacauguuacaaagccuuucacagccugguccacacucaguuuuccucuagcugucccuguguuuacugucacucuagcucaugagcgaacuugcugugcucugaauaggcucuaugcauucugucuccaggacugucucuuucccuucaaggccucuuaccugcuccagcuaccuagcagccuccuacggccuagcucaaauaucagcuccacugucuacauagcuuugaacguugccuugcuucuucaaggacaaagaauuaaaguccuuucuuugcauuucucauauucccuuuuguuucugucucacuaguaauacuuauuaaaucguuauaguuauguguuugucuuccuugucaugauucauuuagggaaaauacugaggaaguguuauaggggcuauacuuuuaguaaaugcuugcuuaauuuugaaaaucauaauauuuuuauauuuuaaagaugaaguuuaauuuuuuauuuuuaaaaaaugcguaaauacauuuuacaaaaaguauguaaauguuguauacacacuuguguaccacacacaugcugccaagucuugaaauuccuuucccuuguaaagagguuuugggacauugaauucauuuaguuucuuccuacauuuguuguuguuuguuuguuuguuuggucuucuuucuccuuuucugcuuccugaccccuaacuauaggcaaauguuuaaaguuccaucauuggucuaaauuucuauuaaugcucugcuccuaaaccaucucugccauuuccacaucacuuuuaaaugccuaauucuaaugaggaaaagacaauggaaacaaauuccaguacauuuuaagugcuauaauugaauaccccauggagcugaaaacucaacguauauaaaacgaaacuacuuacuuagcucccuuccccaagcuaauuuuucuccuuaacuugucucuuauuaauguuaaauauagugaaccccaaguuuuuccucaaagaaucaguaugucaguguguucagcucucuucuucuucgauucuccauuuuaaaguuuaacuuccugguucucuucucccccuugccucugguuucaguaaacaacuuucccaccaguccuaaucaguauuucacaucuguucgcuggucaccugcuccauccugacucaccccuggucaccuucuuugaccugagucaccccuggucaccugcuuugaccuaagucaucuuuaguuaccuguuccuaacuguccuuccugcuagacuagucacccugccacucuggcucauaugccugcucccuuuaaaauagccagucggaauuagcuuagacugugugguccaaccauugucaauaggggaacgacacacuaguagggcccugugucagaaauaagaacuccuuccccuccccugugcaggugugcucucuccauuacuccauuugccagucgcacccuucuauagaaguaaaaauugccuugcugagaaaauuaaauuuauguucgagugcuauuucuuugcagcaccagggaacgagcauuuugcauuucuaacauuaacaguauccucaaagucuugucuuuguuucuuuucuuguugguaacauucaguaauaaagauuauuuauugaguaauugaguguauuauauaugcuagcaauaaacacuauauuuuacacacauaauuucauuuuauccugaugacaaaccuauaaguuagauaguaguauucuuauuuuauggcuaaacuaaugucauuucaggaagauuaaguagcuuguacaagaucagagaucuaugagggggcagagugugaacccaagaggcugguuucauaccagaagcuggucugccauucuauuuugcuguaagcuccagagcuguaaaaccgauuuguuugcugaguggacuuuaccccuccacuucuguguucugcuuacaguuuccucuaauugaaaugccuuucuuuugguaauuuaagcugucagauaagaugcuacuaugcuacuaccaucaaaaacacuggucgaaacuuuugucuccccaucugggaauaauuuuucuuccuuugaacuuuuguaauguuuuauuuaagccacgguuaugacuuuaacaaaucuucuaauuauuuuuuaaauucaucugcucucuucugcuacacuagaauaucagcuguuugaggucaaggacuaugucuuacccauauuuaagcccccauuagcccauaguaguugaguauaggguuugaaggcacguaacauuucuuugguaacccugcuucuuggaauauaaaauggagaugagaacagucuguuuuucguaggauuguuguagaaaucaaggaggauggugcucauaagaacuuaacacaaauauauguguguuauuuacauugucacugcauuagucuauuaugcauugguauaaaccugaggcugaguaauuuauaaagaagagagguuuauuuggcuuaugguucugcaggcuguacaagaagcauggcacugggaccugccucuggcuagugcuucaggaaguuuccagucauggcgagaggcaaacgaggagcauuugugucacagggcaagagagggagcaggcgagagagagguccauacucuuuuaaacaaccugcugucaugugaacaaauagagcaagaacucaguuauuacuguguggacagcaccaaaucgguuauucaugagagauccacccccaugacccaaauacuuccuacagggucccaccuccaauacuggggaucagauuucaacaugagguucugaagggacaaauauccaaacuacaucagucacucauucacacuaagacauacccguggugauaaguaauucuuggacaauuugcauaagaaagauaaaaauccuuuuguaugccuuagaccuuauguaaaaacugucaauucugauccagauaguagaaagugaaaagaaguguugaugggaaaggaacuuuggaucaaggcccccaaggaccuggucccagacauguggguuuucucugggauuccucuccccuaacccacugcauccaggagauccucuccguguaccacucuuucuccucgggaguagcucacauuccagcacuugccacucauuucagccuaaauguucccucuuuggagagggcuugcuggcuggccauuuagguaucucuuccccuuuucuuccuauuccuuucuuccucauaggauggucauucuuugucauuauuuguuuguauauuuauuuguuuauuacuguugauuauuauuuuaguauuuguuuuuucucaccuuccaagucaggcuucucaaggaucgaguugguaugugugccagugaugaguucagugcuaggucauaggggaccguaaagauuuguugaaaggcugggaauuauuggauugcuucaaauaaauuucacaucagcuguauaaauuggacaucugacagggauugcaugauuugaaaaucuguuuucugaaaauacuuuaaagucugaaaggagauguauauaugguuucugucuuuuuguccauuagcuccucacaauuuauuuuuuuugcugagugugaguaguuuggaugugaggauauggaacacugauaucagcucuagacuucuuugagauuugcccuacagcuacgaagauaauaaggauccucucagaaggauagcuauguuaacaaaacuagaauuaaaucaauuuuaggauuuuuaacagugcagacaauaucccauacaauugguaaauuauuaguaugguuuuuucuuuugaacuacuguuguuugacuugguuuguauguaaacauaccacuucucuagauuuuggucuauuggaugauuuugauaauaccaaucuuuaauauucauggaguguuuuuaguacauaaagaugauauaaauggaaaguguugcauguuacugauguaguuuauggauuucuuguuuuagacauuauguagguaaauguaaaugagaaaacaaauguuggacugggugucuguuccuucuaucucuaaaauauuggcuugggccuauauuuacuguaguuauuuaccguaguuagcuuuuuggcuguuuaaaauugguacauguaggcugggcgggugugguggcucacuucuauaaucccagcacuuugggaggcugaggcaggcggaucaccugaggucaggaguucaagaccagcuuggucaacacggugaaacccgucucuacuaaaaauacaaaaauuagcugggcaugguugugugugccuguaguuccagcuacuagggagguugaggugggaggaucgcuugaccccgggaggcagagguugcagugagcugagauuaucguaccacugcacuccagccugggcaucagagugagacugucucaaacaaacaaacaaacaauaauaaaaaaauucauacauguagcccacaucucagaaugucacuaaaaaaccccaaaauucauacauuuguuggccauugagaagaguuccuuaguuuaaucccuuaaacuuuaaaaauauccaauuuaaauguauauaggguuugugauaacuuuugauguguuugguuauauacuaaaguauuuguacuuaauuuauaaauaacauaguuggaguuuuuuuguuuuguguucuuagaaauuugaaugaauacguuaccuaaaauaaauugaccaaauagccuaaauggucucauaagcauucguuuuauaacguugaauuauugaauaguuuuaucuuuaaauuuagauucuugaagaccuggaugaacaaauuuauaucauuaccuuagaggaagaagcacuccagagacgacuaaaugguauguuuauauuacauauuuagacggggauaaaaaaaucuuuuuaauuucaaaaagauagauaauugaagagaaaaaauauaaaccucucugaaucuugugcugcuacaagaggagaacacuuuagaguaauaaaagaacuucccuggugaagagaggguuauugcagacccuggcugagaugagcuguaaccuagcaggacccauucuuuaugagacuuuggccacuaagggacuagacaccucucuacugccaacuguguuuauguuuuaagcauaugacuuuaaaauuuaauuuuuaauuacugaugguuuuugaagaaccaaugaagaaaagaguaaugauauaguuuaacagauaguauagguaaauuuucuuuaauuuuacuuaaguaguuuucaaauguugaaaagccagucucccgccaacaagaucagauaauuaauaacgaacugcauuucagaaucaugauucaagaguagguauaaaauagaagguuaguuuaugaaaugcugagaaacagguaucuaccuacuuucuucaguuacaaauagugaauuuaaaucaucaccccaaaaauguucauaauauuuuagagcuuuuuccuucgauccaggaauuucaguuuguaucuguucuagaggauucuugucaguaacauuauauaauucgauacagauaaacuuuuagacuggaacuacauaugucuuuuauucuucuaacuuacuuaaaacuaauguuuaaaccuguuuaauuucagaguuauaaacuuuagucaacaaugucagcuuuauaaaguuuccuuaaagcaguaaauauuauaauaaauuugucuuauuuggauaaucaugcuacugugcaauaaacaugccugaguuguaaagaguaugugucaagcugcucccugcaguguaggauuguuucagccucagguagccaccauuucuguuucacagauaaggaggcugacauccaggaaggguaaaauguagugccccaugaauugaagaauuuugaauugacuuuaaucaaaacaaaacaaaauccaaaaauacagccuuucucacuuuccccuuccacaguaggaaaaguaaaaaaggucuuucuagaaucuuuauaaauccuuuggcuccucaaauuuaaaaguggcugauuauauguaaagaaguugaaaaggaaacccuugcuagauggcuaaauguauuauaaaaugaagccaagccaaaaucaguaaaaacaccucacuggcauagaaauguuacagagaagagauggauuggaccuggagaggauggaggauguuaugauaacuaaugcuaaguauaauuuuuuuacauaccauuuugguaggccaugcacuguuuaucauccguuugguagauugucuaaaaucuuuucagugaaacucuuuaagugauguguuaggauaauuaugauuuugcuguuugcugcugguuagccacuguggacuguuucagguggaaaauaaagagcuaaaugauuuauguuuauaacauaaaugguucuauggcaaaauggacauuuugacuaauacagauuaagaauugugagcuucaguaggguaugcuuagaaauauguguaggaaggcaagacugaaaaaaucacgacuuaccauuucuucagaaaauagaaauaggagguaagagaaaccauccccuggauuuuauuuaaucuaguauuaugacuaguguguuuuguuguaacaguuacuuucuauuuuaauuuauaaaacaaaaguaaagaguuuauuguuuuacucuugcuauuaaaaagaauuccagaauaaugagacuaaaagacuuuuuaaaaaauacaaauuccauugcugauugaucacagaguugcuggcggcgcuuucuuaguguguguugggauguguggugugcauugcagaaaucuuuggggugucaguguggcuuacucugagcucaguuguaccguuaaugcaaaaaaacaugacagccagcaccaagaagugcuuugcuguagaaauaacaguauuuuuuuuaaaaaguaacguugaguuauugugguaguuaugauauuacuagaguugaauuuucauacuugguuuuaaaaauaaucaguaucaguuuguuuuggaaugccugacugugacuucucaauuuguuuauuugauggugcuguaggcauaaagcuauugggagguuuuguucuuguuaauauuguuucauggaauguuaauaaaguaaagcaaagcugugugcugugauaauguuaauugguauccugaauaagccaucuuguuaucagcugcucucuacccuuucuucuuuccuuuuuugcuuauuacggaucuuaauuaagcacuagauauuguguagaugaauuaagacgcugagucucgagaucauaggcuaguugccugaagaagaagagaaaaaaggacaagaauuuguaaguuuucaucuagugcuuaacuacuugaaaaaaaggaauagagaggaaggaguucuguguuucugagacaggagggagccccagagcaccugucguuuggcuaagacagcgccucccucaugucccuguugucauggcaggaguagagagauguccacagagcucacugugaucucggcaggcggccuuccccuuccccacagcacacagccuccccucugccgucugcuuugggacugucaggacuaauggguacauuguguccaucacuccucuuuaucauggucagcacauggagcccagaacauccagguuccuugcgcccugugucucuauacaucccauuucugaccugauuuuccacuuuccucuagcuucugaaacuuucugcuugugccauuuggaacugagaauuaacucaugaacaaaaccccuguaucuucaacugccacuuucuugcucaaagaaacuuggcacacauuccugccacccgcucaugugauggcucgcuucuacccacaucccucauuuggcugguccuggaguuugaguaggugcccuccuguucccuuuuacuacucuccagcacuuuggaucucaugucaucagaccaugaccuaguccugucauuugcucaccucccaggccuuuucugcucccuucuggaggauuuuugcuccucguuucuaauccuucucugauucugugccuuuuucguggugauuuggugucugugugcauguccuucccaucacuccaggacacuccuugccugucccugugguugucugccucacccgcucgugccugugacauaacccauccaaguucuuuugcauaaucuuacaaucaagcauccuacucuccaccuaccacuucuccuuuuuccaguucacuucuucuagcacucccauuuccuacaauuccucaguauggagauuuaacauacccugauccuaacaccuuuuucucaccccccaucauuuccccaucccccuacuuccuugcacaguuuacauuccuggacuguuguuagaaucaguccccugcguacacucuuagcucccuuuuguggucucacuggauugugcugaaacccgagccuucauucugcuagccucucccuguucugugcucucacuccuagcuggcugacugacccucuugccuggccuuccuuuauauaugugaccaauauccuaaauuaacuuuacauucuccuggaugacuuuauucugucuuuucuucccucagaucuucaccuuacucuccacuggugaccuuguuuucuauuuucuuaagaaaacagaagcaaucauaagagaauuuucacaagcuuuuuccuucaugccaacccuccucccugcagcuccccucacagcugccuuuuccuucgaugcuguggcugaauugucugugugccuggcuaaugccagcgcuccccuagugcccuggauuccaucucuucucacugauucaaggacacgaucuagcaauucuccucuuucugacucucugucucugucaugauccaguuuuuccccaacuguauccuuuccaucagcauaaagauaugcuauaauuuucccagaaagagacagaagaaggaaucugccuugaccccauauccccuccaggucaccacccauuccuuuggucuuuauggcaaagcucacaagaguugugugcucauggguuucacauuuuguuuugaaacucacucuugcuuccacuguucuaugaaaugccauggucagguuggucugugacuucguaguccuuaucuuccucucuuuccuccucgaaaugucuuuuauuccacuugguuuucaguucaccauacuuuccuguuccuuuuauuuaacgggcugcuuuuucucaauccacuuuucuggcuuuucugugucuauaacuucuucaccuggaaagucucaugccuccgucuuuaaaauucucuauuugcuuuuacucccuuauuaguucaucugguuucauggcuuuaaauaccaccuauaagcugcgaccucuacucugagcuuugaacuuaaagaucuaacugucuaguggaaauuuccauuuggauguccaauaggcaucuuaaacauauguccaaaguaaacucaagaucuuuacuucuagauuuugcugcuuuugccaucggcccuucucuacaggugacaaaucauucuuccagcuacucaggccaaauccuuggagucucuuucucuuaauucccauauggauuccuucugcaaagcuguuggcuccagcuucagaguagcuccagaaucugacugugccucaccaccugugcuaccaccaccccuuggagagguuuuugcgguagcuuccuaauggcuuccgugcguaucugucuugggccuagugagucagagagagucucugacaauaugagucagaucuucccacuuauuugcuccaaguccucagaugaugguuucuguuucagucuggauaacagcaagaguccuugcaguggcugcucacuccugccccaugucugaugccugcugucucuuugcucuucccccacugagccccuucccuuggggcauuuuuauuguguuuuccuccaccuucucucuuccaggucuuuaccuaaauacccuuucguggagcuuucccccacucuggagugagccuuguggauaucgauuguaucacuaagcccuaccucugcucuacgcuuccccuuuccugcauuauuuuuuucuauagcauuuuuuacugucucacauguuaagucuuuuaguauauugccugucucuccacacuagaacaugaacuccagggauuuauuuauuuaauuauauuuauugagacaaggucucacucugucacccaggcuggagugcagugacacaaucacggcucacuguggccucaaccucccgggcucaggugaucguuccccuuuagccucuugaguagcuaagacuacaggcgcccaccaccauacccggcuaauuuuuguguuuuuuguagagacaagguuuugccauauugcccaggcuggucucaaacuccugggcuuaagcgaucugccagccuuggccucccauaguguuaaaauuacaggugugagccacugcaccuaacuggggcagggauuuuuguaaauuacaggugggagccaccgcaccuuauuggggcagcgauuuuuguuaguuuucuuucccucuguacccugauucuauaauguugcuagacacaugguggauaugugguaaacauuugucccauaaguaaauuaauagaugaaaaacgcacaugauggagaguugucauuuuaccauagaagugaaaaaggaagaggaaguaaaauuuggugacaagaccggacagaaucacuuggagagauuucuuaggaaggcccauaguggagacugccaaggacacaccaacguugagaggcaggaagaccacgugcacuggaguguuagugaagaggccgaaauaaggcaguuuuccccuuacuguuauggccauggaauaugaguaaucaagaaccauuucuacuccaagacuccuaaagaguagcccaacagaaagucccauuacauuaauugugguagaaaaucuuuuguaauuccuuccuagcauuaagaggauacacacacacacacacacguacacacacacacgcacacuuaacauguuuaaauguuuaaguaaugcaacggcauuaauugaaauaaucagcuuuuguguguguauagccuauggguguacuggguaacuuuggaaguaguaccauaaugaagagaaauuauuuuuuguuguuuaaguucaaaaccuccggaguucuuuuaauuuauuuuaaaauaucauagucuuugaacuuaauaauucaacucaguuucuuuagauacgauuuucaucuucaugauaaaaaguuaguguaucauuucuuauggcaguuacuuuccugcuugauucucaucuuuucagugguucacaccuguaaucccagcacuuugggaggccgaggcaggcagaucaccugagguugggaguucaagacccaccuggccagcauggugaaacccggucucuauuaaaaauacaaaaauuagggggugugguggcaggugccuguaaucccagcuacuugggaagcuggggcaggagaaucgcuugaaccugggagggggagguugcagugagccgagaucacgccauugcaccccagccugggcaacagagcgagacuccaucuaaaaaaaacgaaaaaguccuugccauugaagcuuguauuaauuauuuauucuuaaaagcacagauuauauuguuguuucauuuuugcugggugucagauuggaauaccuuuuuauccuaaaaaauaaaaauaaagggauugaaaaaaaacaagacaugucuuauacaagcuuuuuguagaauuugugaccugucagaagcacuuagugucaucaucaguccuugaauuuugcuguuuauaaccaaguugaauuugccagggaauuuuaugaaggugccaagguuuaggguggcauuuaugguugcuuuuuuagagcaguugcuucuuuagacuaucucagaguaguagucugucagagacauuuucaguuaucauuggcaaggugauuugcuaauuuggucauuacauucuuucauauaacacacuugauauauggaagcucaugccagauucucuucuguccucuaaauuacuuucaucuuggcuuucucuaggcauucuucuagguucuggcaaugacaauccuacaaauacuauuugcuguuaguuacgucacugaagggagaauauuuugaauuuaucagacucugggccacuuugagaaaugucugguauuagcgugaaagugaucaaauauaaucaaaaaacauuuguguccaaggaucugaaauggucagaaauuccuuguuauaauuuauucagcuucuugggccguuauucacaauuuaugacaauaaaauguggcccauagaaauuauuuuuuugcaagaugaaaugaggugacugccagagauauaugcuaauauaaaaucaguaaaugaggaaugcuuaggaauaaugaacuauagaaugaguuaaauaucauauauuuuaugaaauauauauauagagagaguuauucuauaaaaaugauccaaauuggcugggugcaguggcucacgccuguaaucccaacacuuugggaggcugaggugggcagaucaccugagguaaggaguucaagaccagccuggccaacauggugaaacaccgucucuacuaaaaauacaaaaauuagcugggcgugguggcaugcgcauguaaucccagcuacucgggaggcugaggcaggagaaucacuugaaccugggcagcagaggucgcaaugagccgagaucaugccagugcacuacagccugggcaacagagcaagacuccgccucaauaaagaaaaaaaaauccaaauuuguguaguagaagaugaauuuaauauacccgagcuacuuucucaacuacaacuuagauaggugaugguauucccaauaguagcuuauauaaacauaaaaguuuaaaaauuaucuuaacaucuuaucuaguuuagaucuaguagcuuauaucuaaaguagaaaaaagccaaaccauuguuuuaauuguaccuagcauuauauaauguuccuaaaguugauuauuuaacaauuucuaucuugcagucauuaguaaugaaagcauauuugcauuuucacaguuuuguuggaucucaaaagucucacauuacuaggucaauagccauauuuuuguggauaugucagaaguaaaaagaaacuauuauuuuaauaauuauuagcauugcaaguggaauagacauagauacagaguuuucgaguauaugggcugacucucuccuuuguagauaguaacaguguuaguucaugcugaaauagauacauuagagauuugaauguccuggcuucaguuuucaaaugcuuucuggaguuugccuaaucagcauuggcucugugguguacaguaaguaguguuugcuuagagagauggaaacuguuugcucugugaauuauuaggagauuugggcuuuaacaacaaaguuguuugccuaagugauuagaaauaauuuauaguauuugagugaccucacauucuuugugauagagaucacuuuggucaaauuuaaaguaauaaguauaaucaaauuuuuaaagagcuucuuggauaauauuuucuaaucaaacuuuuuuuugguuauaugguaaauuaaaaguuaaauguaacaucaaucuguuuauguuagagguaucuacuuccaaauaguacucauuaugagacuaaguuuaggacacugaauuguuuagggagauaauuguauuucaucaauuauuugaagggcuugcagaucuaauuggaaauuuguauuuguuuuuaaaaauacauuuuauauuuuaaguuaaauacuuaguaccucuccuuuuauauaugaaggcugucuuauauauuaagaaaguuguaaggacagcuuaguuauugaauaaauacuggacuuugggaaauucuguuaucuuggaagcaaaauauuuuuaauaccacacuaguuuuucagcuuaagaauaaagcugggaaaaguugccuucagcuauuaguuuuccugaauccaaagagacggguggggcaggaucaaaaauacuuacuugaucaaaguuauuggcucugaaguuauucuuaccuauguaagaaagaugaaagguguuguuuuuauugcauguuaguuaacaguguaauuuugaacuaauugguguugaacugccaaucaccuaaggggaaugcaaauagauacucuuacaauuuccuuugagguagugaaaucuuauguuggggcuggaagaaaaacagaauaauaccauuaaauugaccuuaaaugagcugcuuugugguuuucuuggagaaucccuuuuuauuucuugugacuugucuaaacagguuuugucuaccaguuugacuuauugacuagacaaugcugacacuggacauuuuagauucauuuggaaauaaaguaaugauaaugcaguuccucgggauauuuuaaauuuuugguauaacuuaaauccacauaaugccucaguauuuguuugcaguaugucauaauuucuuacgauagucauuguuuccuucuggucauuuauaaugaaauauuuacucaaaaaagcuuacauuucucccuuagguauugcucuauuauaauaaagaguggucuuguccuugaauaaugugucaucucagaugaaucuagucauuuaauaaaaguaugauuuauuugaggacaacaagaauguaguuuugauuuuuauaugcaagucagucaguauuuauuaauuaccuauugugugccuaguguuauaucaccugcaaauagaagcacagcauuucagaaaugccauuuuaguuauuuuccuuugaagaaucauacauugaguggucuagacauuuguauugagcucuguaaacauacccacaaaguaggcauuuuugucuuuucacuuaauuucaaauuggcaucaggaauacuuucuauucugauguccauucucuuuugaaauucuaaauacucaugagcuuauuuuuucuacccuucagcugguuaccagaauaauaaaucuuugcaugaauggggaaugaauguaguuuggaauuguauuuccagucaaugagauauacaaguuaaaugagcauuaauuacagauacacaguuuaauugauaaagaauggagauaaaaguaaaauauauuuauuacuaagacuauuauguaguuuaaacuuugauucaaagacaccugaaaaccuuacagagcugugcugucuuucuguaaaucacauuauauggaaauacucauucguuauguaacuuaauugcuucccccuuugcuguggcugccagaaacucaaaacuaacuuuguaaucaaaguuuaguagcuugugucacauuaccugaauauuucuguacuagcuuuaucccuccucucauaaauauaucaauuauauauuaacaaguaaagugauaaaacucaugaacucugaaaacacuauaaaacguuucaguggauuugagaucucagguucuuugaaagagaggguauucgauugcugucucuucagugaugggcagaagugagcaaggagcugcaaagggaaugggauuuacuucuccuagaaaccugggauaagacuggaauuuugugauuccccaaaggggcuuagaaaaagaggccucugaauucccuuagugagauugcauuugccccuguguugcaaagguuugucugaucuugcuggccuugcguuguuguucugaauccuccuuucagucucucccuuugagaaaggaccacucuuugcaccuagagagacccagcgagguuuccuccuccuaaaucaguuuuucuggccaguuggucccuagccccuaggaacauaauugaauugcuguaccuuuuagcugguuugucacuguuugagggagugucugaccugauuagagaugaagggaacaacagagguggauagagaaaaauuaccaguuguuuaagguucagugaagaagaccaagauagauaucuagaacaagugguucccacuugaguuaacaauuaaugggagagacaaauaagaauucauaccuaauccucaaaaguaguaagaauguccaaggaaaugucauuagaacagaaaaagacugaugcugagaacuugaaaaaaauaaaaagcuuaauagacaaacaaaaaaagaaauagucuuugugguagucagaauaaugguuuccuaaagauguccaaguccuaauccccagaccuugugaauauguuaccuuacauggcaaaggugacuuugcauaugggaugaaguaaaggaucuugagauuauucuggauuauguagugggcccacuguacucacaagaguugguauaagugaaggcugagauggucagagaaggagacauugguaauggaagaagaggucggagugacucaaggaagggaccaugagccaaagaaugcagguggcccucaagggcuagaaaagacaaggaaaugauuucuccccuagagucuccagaaggauuauaguccugcuaacacuuugauuuuaggacuucucacuuccagagcuguaagacaauaaauuuauguuguuuuaagccagaaacuuuaugauaauuuguagcagcagcagcagcaauagcauacuaauauaguccuucaaaaauugaauuaaucaucuugcagaaucaaggggaagaacuauuuugugucacacaccaaaaguacaaaaagaaggaaaguauuaaugaaaaauagacgugaagugcagagcuaagauacugaauguaaauaauaggcaucuaaaaggagagaaaagaacaaguaggaaaaguagguaaauaaaaaauagaagaaaauaucaaugagcuuaagaaagacuugaguucagguuaaaaggccacacacuccuaggcaagauuauucaauagaaaaucaaaaagauuuggauuuaguuuguaagauuccugaauuccaagaacaauggaaaaaaaaaaaagcccuuacaaacuuucacauagaaaaauuccagacaaagaagagagagaucaacaucaagcuucccauuugcaaccugcuacugguugcugaauaguacccauaguuguaagggaggaauaaagacugcaguugaaaacucagcugaguguggcggcacgcaccuguagucccagcuacucgggaggugggaguauacgcucgagcccagaaguucgaguccagccugggcaguaauauaaagugagacccugucucuuaaaaaaaaaauucauauauucccaaagaugucauucaucuguuaugcauucccucauuuguucguuuuauaucuguauauugagcaccuaauuugugccaagcacuauucuaacuuccauauugaaagaaacauuugguaacagucuugaacuaaauauuguuaaaacugucgcagcaagauccaggaguugggggcaugggugggcagcagugagagaaugauuaaagcguugugagagcuucacuuuggugugggguaaguuacucagaaaagcaucccuguagggcuaggacugugugaugcugauauuauaaugaaaaguauaucuaaguaugaguauuaaaaaugugaaaguaaccauugaacugccaaauuaacaugggcaaaaaggauaaacuaaaguuucacuagcugggaaagaagaaaaugaagaaauaaagaacaaauauaaugagcagaaauuacagaguuacauaaaaagagaaagagcaccagucuuccugucaacuugaggauggcaguacuuuuagucccuugaugucacuguugagcugcuggaaaauccucuuugaaguuugcucugugucuaaacuucucauuauaugaaauuauuuccucauuuuuaagcuacuuugaguuuaguuuucugauucaguauauaguguccuaauagauacacccccuuuuacggaugaaaacacugagguucagagaggcauaaaccuaaaaagaugagaaguugagaggagaaaaucacaauaaaauuuuggaauuuagaagaccugagaaaauuuagcggacuuaaguaaccaguuucacagacccaaggaagcuaaaucguaagucauuugugcuugauuuauaaauuuauaccccagaauccccaaaagucccaaaaaguggcaccaccagacgaaguagagugagcuacuucauaagagaauugauuggaaauccuguuuauauaaugguuugauugccacaucuuuucgcuccauccaagguaccaauuuucuaaagguuuguaucaugaagggauguugaauuuuaucaaaugcuuuucaguaucaaaugaaaugaucauaugguuuuuguccuucauuccauugauaugauguaucacauugguugauuugaauauguugaaccacccuugcaucucggauaaauccaacuucaucaugaaugaucuuuuuaauguguuguugaauucgguuugcuaguauuuuguugaggacuuuugcaucaauauucaucagagauguuggucuguaguuugcuuucuuugaugugucuugguaucaggguauuacuggccccuuaacaagaguuuggaaguauuuccuccuccucuguuuuucagaguaguuugaauaggauugguauuaguucuuuuuuaaauguuugguagacuucagcagugaagccaccagguccugagguuuucuuuauugggaaacuuuuuauuacagguuugaucucguuacuuauuaauggucuguuuagguuuuagauuucuucgugguucaaucuugguagguuguaugugucuagaaauuuguccauuuuuuucuagauuuuccaguguauugacauguaauuacucacaguaacuacuaaccauccuuugaauuucugugaugucaguuguaaugucuucuuuuucaucucugauuuuauuuggaucuucucuuuuuuuucuuggucuggcuaaaguuuugucaacuuuucaaaacaacuuuuuguuucauugaucuuuuguauuccucauuucaauuuuauuuauuucugcuuugaucuuuauuauuucuuuuauuaauuuuggguuugguuuaaucuugcuuuucuaauucuuuaagaugcaucauuagauuauuugaaguuuuuucucuuuuuuuauauagacaccuguagcuauaaacuucccucuuaguacugcuuuugcugcauccuguagguuuugguauguugugcuuccauuaucauuuguuucaauaaaguuuucaauuuaccccuuaauuucuucauugacccacuggugauucaggagcauuuuguuuaauuuccauguguuuguauaguuuugaaaauuccucuuguugauuuuuuguuuuauuccauuauggccagagaagauacuugacauuauuucaauuuuuugaauguuuuaagacuucuguugugaccuaacauauggucuguccuugagaaugauccuugugcugaggagaaggauguuuauucugauauccauuagaugaaauguucuguaaauaucuauuagguccauuuguuguacaguacagauuaaguuugauguuucuuuuugauuuucuguuauuggaagaucuauccaaugcugaaagugggguguugaagucucuagcuguuauuguauugagguauuucucuuuagcuuuaauaauauuugcuuuauauaucuggaugcuccauuggugcauauaucuuuacaauuguuauacccuuuugcagaauugaccccuuuaucaucauguagugaccuucugugucucuucuuacauuucuugucuugaaaucuauuuugucugauauaaguauagcuacuccuguacuuuucuuguuugcauuagcauggaauaucuuuuucuaugccuuuauuuucaaucuauucguaucuguauagguaacguguauuucuuuuaggcaacagauaauuggguuuugcuuuuuuauccauugaaucacuaugucuuuugauuggagaguuuaguucauuuacgaucaguguuauuauugauaaguaaggacuuccuccugccauuuuguuacuucuuuucugguuguuuuguauagucuucucuucuuuccuuccugucuuccuuuuagugaaaguuauuuucucugguuguaggauuuaauuucuugcuuuuuauuuuuugaguauccauuguauguucuucaauuugauguuaucaugaggcaugcaaauacuauccuauaacccauauuuuaaacugagggcaacuuaacacauugcaaaaacaaacaagcaaaaagaaaacuaauacagacucuacacuuuaacuucguccccacacuuuuaaacuuuuuguuguuucuuuuuaugucuuacuguacugucuaugucuugaaaaguuguuguaguuauuauuuuugauugguucgucauuuaaucuuucuacuuacgauaagaguaguuuacacaccguaauuacaguguuauaauauucuguguuuuucuguguuuacuuauauuaccagugaguuuguguaucuucaggugauuucuuauggcucauuaacauucuuuucuuuccuauugaagaacucccuuuagcauuucuuguaggacaagucuaguguugaugaaaugccucagcuuuuguuugucugggaaagucuuuauuucuccuucaugcuugaaggauauuuucaccagauauacuauucuaggguguaaguguuuuucccucagcacuuuauacaugucaugccacucucuccuggccugcaagguuuccacugaaaagucugcugccagguggauuggagcgccauuggauguuacuuguuucuuuucucuugcugcuuuugggauccuuucuuuauccuugaccuuugagaguuugauuauuugagguaguugucuuugaguuaaaucuacuugguguucuauaaccuucuuguucuuaaauguugauaucuuucuguagguuugggaaguucucuaauauucucccuuugaauaaacuuccuaccucucucucuuucucugccuccucuuugcugccaauaacucuuagauuugcuccuuuuaggcuauuuucuagcuaucguaggcaugcuucauucuuuuugauucuuuuuucuuuugucuccacuauguauuuucaaacagccugucuucaagcucaccaguucuuucuucugcuugaucaguucugcuauuaagagacugaugcauucuucaguuugucaguugcauuuuucaacucuacaauuucugcuugauucuuuuuuauuauuucaaucucuuuguuaaauuuaucugauaaaauucugaauuucuucucuguauuaucuugaauuucuuugaguuuccucaaaacagccauuuugaauucugucugaaagguuauauauuucucuuucuccaggauuggucccuggugccucauuuaguuuguuuggugaggucauguuuuccuggauggucuugacgcuuguggauauucgucagugucugggcauugaagaguuaaguauuuauuguagucuucacagucugggcuuguaugugccugucuuucuugggaaggcuuuccggauauucaaaggaacucggcccucaagcccaauaaugcugugguucuugcagacgaaugccucaguggguuuagauaagauccagaagaauucucuggauuaccaggaagagacucuuguuuucuucccuuacuuucuccaaacaaauggcaucucugugugcugagcuuccuagagcugaguuggggugaugcaagcacuccuguggccaccaacacugggacuacgcugggugagaccugaggccagcacggcacuacgucucacucaaagcccacuguaaacacugcuuggcuacugccuguguucucucaaggcccuagggcucuacgauuaguagugggggaagccagccagguuuguguccuaaccuucagggugaaaaguucccucagacccagggcagguccagagaugcugucugggaggcagaguuugaagucagaaacuuuagaaaucuaguugguguucuguuuuacugcagcuaaacugacccucaaaccauaagacaaagaccuuccuauucuucccugcuccugccacugccagcccauggggaguucugccaggccacugccaguggucacuuaauguccagaggcucugcagucagcuuguagugaauguugccaggccugggacucacccuacaggguagugggcuccccucugucccagggcaggucuagaaaugcuguucaauagccuaggccugguuucgggggccccaagagcccaccugauacucuaccccacuguggccaagcuaguaccuaagcugcaagacaaaguacucuuuacuuuuccuucugcuuuucucaagcagaaggagucuuucaguguagccaccacagcugggaauaugcugcaucagaccugaagccagcaugucucagagucuucccaagcaaggcccauggcauacuagcuauaugucacuccuggaucuuuggggcccaagggcucuuuagucaguaggugauggauccucccagaacugagucccccacuucaagguagcagguucccuucuggcccagggugugucuagaaaugucauccagaagcuagggccuagaauggggcccucaugacugugcccaguacccuauuguacuguggcugagcugguauccaaaaugcaagacaaaguucucuuuacuuuccucucuucgagcagaaggaaggagucacuuuccuugcugugagcucugcugccugggguugguggagagguggugcaaccucucccuuagccacugugucugguacaugcugcccuaguccacuggcucuaagcccagcccagcagcaggacuugccuaggaauugcaguucuuguguccuagacugcuuuucaaguuuacuuaggaccccagagcacuguagcccguuguggugaggcuugcugagaagcucaaguuuugaccacugggauggggaauuucuuucuggcuagggcugguccacaugcuccuucugugggcaugcagugguugagcccagcacagcuuuacugucugcugugacagggcagcauuggugcaauucuaugucccccauuuguugugcucucccucccccaaguacacagauucucucuccacacuacacggccgcugcugggggauggaagagggguuggcaucggcaguucaaggcugucuuuucuacccucuucagugccucuuucagguguaugaaguuaaaaccagguacugugagugcucaccugguuuuuaguucucaugacagugcuauuuuguauguaguuguuaaaauuuggugcuucugcagcagggacaaucgguagaggcuucuauuuggucaucuugcuccgcccuccuacugcuucagucuuaaauaugagcagacaacuaaggcucaccacauauccaaggaaagccucccauaugcaucaaacaggagagcuuggaggagaugaaauaugcaugggagaagaaugucucaaaacaaauccgucaauauccuggcagagauagagaugacauucaugagaaagaccagguuccauaaaaaugggauauucagugagcagaaaaggauccuugaaauuuagaaauaacauagcaaaaagauuagaagauaaagaacuuuuacagaagauaggucaaaauggcaaaaauagguaaaauaggagagaauaguuaagaauauuagagaaccagcucaggagauccaguguccaacuuagaggaguuccaaauugaggagagaaaaugugguggaggaaaugacaaaaugaagauuucccagaucuaaaggacaugaauuuggagauugaaagggaucaucuagugcccaacacaguacaugaaaauggacucucaucaagaacacuggggacaaagauccuacauaguuuaaaagggaaaugacaagcagcucacauucaaaaagacaggaauaagaauagcuucagacuucucaaaagcaaaucuagaagcaggaagacaaugaagcaaugccuucagaauucugaaggagaauuaguuuugaccuugauuuuuuauacuuaaucaaacuauaauguaagagcaaagguacaguauucagacuuguauagucuuuaaaaauuuaccucacauucaccuuuucuuagcaagccacuggaggauacacaccaucgaagcaagggaguaaaucaagaaaagauacgggcugcguaggaaacaagagaugcuccacaggagacgcgggcaggcagucccggggugaaagggugcaggaggcacagagggcaguccaucuggggugggcaggucuaaagacacugggggaaauuucuucaagagagugaaguugauaguauaacugaggaauagaaaaaccaggagaaaauaaagaccuuuggcaggauguuuuggguuugaauuuguguuaaguacauagaaaauuaaguaaaagaaaaauuauugcuaauucuaggggugggaagaauguuaaggaaagaaggaaagcuggucauaguuugcuauguggauaggcauuuugguuguuauaauaauguagacauugaauaucaaucuagcuaaaaugagcauuauggccauauugagagaaagggaggagugaagagguguguggcucagacacuuguguccucaccugccacagugggaaugcuuugugcgggaaauccagaaguugcaacaggaagacaagugccagaagaacaagcuggacagcuacuuuugggaaaauggauucaggagggaggagacaugauagcaaacccacguauguguuugacacuuugagcuaugugcaugcuucaucuugauaaagauaaaaccuuuaaaaaaaucacuuaaguaguauagaaaguauaaaauaaaguuuaucagcuauuauacuaaauaaugaaugcaagcucuauauuuuacuaaguguaaaugggcugaauuugacuguuaaagaacaguuuaucagauuggauuauucaaccuguauuuaucauuuuugcuacaagcaucuauugcccuuucuucuaguaaaguaccugauuuggauuugcggauuuccccgguuagaugagauuggcagaacugcucaucaaaguucacggcucuccaagaaacugacaugugacucuaagcuaugccauuaggacgucugcuuccuagacuuuuauucuuccucauagugacauacagacugggaguacucgggacugagucaucccagcuauuacaauaugaggaaacuguccaucuguucugccaccuggaccucuucgcuacccauuugcucuacuuucuuuacuggaaaauuuuccuacugguucuaucuuacgaauuccuuuucuguuuuaacuagugagucuauuucaguugccuauagccaaugaacucuaacugauacaguugaaaccuccaauaagauucagcuggauaagagaaaaagaaagauuaaaaugaaagguguguguauaaauguauguaaguaagcaagcaagauagguaaaaacaaaaagaaagcagaacuuaaaauccacaaaacagaauuuaaguugaaaggcauuagaaacaaacagggucauuaugaaaugauaaaauauaugauucauaaggaagauguaacagucuaggaugaaaaacaaaaacaaaaacaaaaaaacccuagcaaacagaaccucccagucucagcagucaaauacaauugcauaaugaaaaaaaaaaaaacaccacucuuaaaaacugagagaacuuaaaguacaguuguaguggguauuuuaauuucucuguuucagaauuuaacagguaaaauauaaagaauacgaagauccaccauuagagaaacaagcagaaaacaggaauagggaaaauucaggugauaaaugcauagaaauauguccaaccacauuuagggaaaugcauguuaaaguaacaggaagaaaacauuuuccacccaucacauugguagaauucaagaguuauaacauccagugcugaagacgauacuggaaaauagauacuuucaaagcuauugauagaaauguaaauuauuacaauaguuuaaguuauuacaauauuugggggaaguaaccuucuauaaauguucauacccuacucagcaaucuaaguuuugggaaucugucuuacagaaauaauuagaaccaaaauguacuggaugggcauacaagaauguuuauugcaacacuguuucuaguggcaaaaaguugaaaacuugaauauguguaaagggaauaaaguuguaguacaucuguacuauggaauguuauucagcugucaacuuggacauauaauugacuaggaaagcaaaugguaaaguaauaggucugaccccauucguguaaaacauguaauaaaaaccaugcauaugauacauauguaugugugaaugugcuucugaaugugaagaaagguauggaagcaucagccaagcuguucacaauugucauuuuaaggaggugagauagagaagagaagaucuugauuuuuuucacuuucuauaguaagcccaaguugcuuuuguaauuaagaaaagauuauuaauagaucaaauuagaacuuuaccacguuaagaaauuuucuaggaaacauguagcauuuauuuuuaauauucuuauuucaauagguuuugugguacuggugguuuuggguuacauggauguauaguggugugaucugagauuuuaauguacccaucacuggaguagcauacguuguacccaauaugucguuuuuuaucccuugccuccaucccaacccucucccuucugacucuccauaguccauuauaucacucuguggaaacguguaguguuuaaucagcaagaaguuuuaauugguaaauauauggaugugcuuuccucugaaucacagcaacauuucuuguuauuuuugauuagcaggauuugccauguguuauuuuagauuuuaauuaaagggcuaccuguucuauaguguuagggguucuguuuuacuucuaaauauuuuuugcuuugaacagggcugucuucaucgguggaauacaacauaauggaguuggaacaagaacuugaaaauguaaagacucuuaagacaaaauuagguauuguacuuuuuuuuucuugacuuguguauuggccuugguuucuuauuaaagacuuuacuguagucugaaauauuagaaaauuuaugaaaucuuuauguuaaaacuuuugaccugcccaaaaucauuaauaaagacuaucuuacaguuuggggagaggauaaguuuacauuuauucacuuuuuuugguuuuauauauauacaaaaugacuuuucaaagguucacagguucaaagauguugcuccauugccuucucacuugcauuauuuccaacaagucaucugucauacuuaucuuuuaaugugucuuuuuucuguaucugcuuuuaagaugucuuuauuguugauuuugaacaauuugauugugauacgccucagaguaguuuucuucaugcuucuuagagcuaggagguuauaguuuucaacuaauuuggaaauuuuuugaccauuacuucuccaaauauuuuuucuuuuccccucaugcuucccuuuucagggacuccaguuacauguauuuuaggcuauagcugaaggauguuccuuuauuuuucaguuuuuuucuugcuguauuucauuuugauuagcgucuauagcugugucuucacuuucaccaaucuugugcaugucuaaucugccuuuaaucucaucuagugguuuuugcuuuuuuuuuguuuuucuaccaucugcaguuuucaucucugggggccuguuugggccuguuuuguaucuucuauuaugucucuaacacguucaaucuguguccucccucuuugugaaaauauagaauauaguuaugacaacacuuacaauguuuuugucugcuacuucuaacauuuguguuaguucuugauauguuuugauugauugauuuuuuuaccucauaaucacugguauuuucgugcuucuuugcaugccuggaaacuuuugauuagaaaauagguauuuugaauuuuaccuugucaggugagauuuuacccuuguugggugccucacuuauaguauuucuuuuuguuuuguuuuguuuuguuuuuuaagacagagucucacucugucgcccaggcuagagugcaauggugcgaucucaacucacugcaaccuccgccuccccggcucaugugauccucccacuucagccuccugaguagcugggaccacaggugcaugccaccacagcuugcuaauuuuuuguguuuuugguagaguugggguuuugccauguuggccaugcugaucucaaacuccugggcucaaguguucugcccacgucagccucccaaaguacugggauuacaggcaugagccacgaugccuggccacuuauaguagcuguguaagugaggaacuuuguucugaaauguaguuaaguuacuuggaaacaguuugauauuauuguaucuuguucugaagacuuuuuaggcuggaccaggggaucauugccucuaggguuaaguauuccccacugcucaggcaagacccuuccacagauucuauccaauguccugugauugaugacauucuguacugucuuguggaagaagcaacuauuuuuggccuuuugugauuguugagugcuguuucuuuucauauuuuggggugguucuuucuuuagcccuggguuguuucuucacaugccugagccgauauacuugagaauuuuuuaugaauucuuuacugaauacucaagggugacucuuugcagauccuuggaguucuuuuucugugcuucagucuccugucuggcacuuugcugcacagacuccagcugacauagucuccccagauucccauuucaugcucucaacucaagggaugagcugggcucagcuuguguuccuccuuccugcaucacggccuggaaacucucaagacaguaagcugggucagaaagggcuugugugguuuguuuccugugucucaggcaucauuguucuuccacgaucagauguccagugucuugaaaacuguuguuucauuaucuguguacuuuuugguuucuuaauuguuucaagcuggaugacacaccuggucccuguuguugccgcagcuucagaaguggaaguccaguguuauguucuugaaaaucaaauacgauguucauuuauuuucauuucuguuaauaauauuuccugaaguuacuucagucauccugcuguugguggauauuagauuugcuucuaguuuuuugcuguuacaaauaauguuguuauaaucauucugguauguaacucuugguauauauguuuuuucaggguacauacuagauauggaauuacaagaucauuguauaugugccugugcaacuuuuguagauaaagccaaauaguuuucucacauaguuguauuaguuugcauuccugcugggcaugaguauuauacuugacaauguuggacuuuaaaauuuuuacugacuuaguggaugugaagugguguuucuuugguauucuaauucauauguuccugauuuguauuuuuauuuuuacauuucuaauguucauuuagcuucuguuugaaaaacacagguuugcuggcaauagauucugucaguuuuuguuuauuggaaaacauacuaaaaauuuuuguuugguagcuaucagcauuggaaagauguuguucuacugucuucugguuucuuguuaaaagucauguuguugcucuuucaaagggcuuuaaagauuuuccuuuugucuuuguuuagcaauuuuacucugauaugcuuagauuugguuuucuuuguauuuaucuuucuugaaaucuaugugucacuucaugauacuguggcuugaugucuuuuaucuauuugggaaaaucuuggccauugucuuaucagauauugcuucugcuccauucucucuuauuuccuuaggcugcaguuacacacaugcuaggcuuuuucauucuuauauucuuuucuguauuuaucuccuuuuuaucuucaugcuucagucugauauuuucuccuggucugucuuccauuuugcuuucuuucagcuaugucauaacuauuguuaaaacuauugaauucuucacuuuaguuacauuauuuuucaguucuagauuuucuguuuauuuuuuauagauuuaaauuuacuugcaaaauuuuccauuuaucacuuauuuuauugaauauguuaaucauuuauuuuaaagcaucuuucugauaaauccaauacauggaucaccuggaggucuguuuccauugucuuuuuuuuucccucuuuuuccauuuauuuauuuauuuaugaaauggaguuucgcucuuguugcccaggcuggagugcaguggccugaucucaguccacugcaaccuccaccucaugguucaagugauucucuugccucagccucccgaguaacugggauuacaggugcaugccaccaugccuggcuaauuuuuuguauuuuuaguagagacgggguuuuaccauguuggccaggcuggucucaaacucuugaccucgugauuggccugccuuggccuuccaaguccugggauuacaggcgugagccaccgugccuggccucuuuuucccauaucugguaauguuuaauugaaugccagauauuucuuauacaaaacuauagaaacucugcaugguguuuucuucuuuuugggaggauguacuuuugcuucugguagacaguuacgguagggacguaucagucuaauccauuaggcuugagaucauucaaggccaggcuucagucuuuaugacgaccgguccauuuccacuuuguccuuccuucauacuaggauauagcuuuucauugguccuaauugaaagccuaguucauuaguuauugacuaugaccucauuuucuuaaugaauuuuaguuuuuaccucucaagaaacaugagccugacagaagcuuugcuuggcuucucagccucauaguugcaucuuucuguuguucuucuuggccucuuagccacuggugucuugaagggaaaguggcacugucugccagguucacuucuuugcccuuuucuuuucuguaugaucauagccucucaaguuuugacugcauugguagccccaaaugccaaugucuguccucuuggcucuguugaguuugcugaaagguuugcuuuagaaucauugccuuuuacccauugauuucucacccucuuggguccaugccauuuauauauugggaaaugucuugcagaagaagguguaguacaaauuggaggucuuagcucaguuuacuucacagaauauuggccccucaauuuucauugucuugauagcucucugauacguucauacagauuuuuuaaaaauuaaguuugauuuaucuuuucuucuuguucuuagcaugaggauugguguuauagguaaaaguagaaguuugcuuccagccuuuagaaaacuagaagugcuuaucuuugggaaaauagaagggggcugggcgcaguggcucacgccuguaaucccagcccuuugggaggccgagguggguggaucacgaggucaggagaucgggaccauccuggcuaacauggugaaacccugucucuacuaaaaauacaaaaaauuagccgggcuugguggcaugugccuguagucccagcuacuugggaggcugaggcaggagaaucacuugaacccggcaggcagacguugcagugagccgagauugugccacugcacuccagccugggagacagagcgagacuccaucucaaaaaaaaaaaaaaaagaauagaagggauuuuuauucauauaacuuuauucauucagauauauauauauauaucaauauguagaucuauaugaaauacaaauauagcccucaguauucgugggggacugguuucagaacccccauggguaccaaaauccacauaugguagaaaauuauugcagaaccuguggcuauagaaggccuacuguaugucuguauuuucagagucagcuguauaucaacaauauauuuccuuaaugauugagaugucuucacagagcugaaauuuacgcaucacaggauugagguguuuaauguagcaaacugguuuuaaaacucugauuuuugucuggguaucguaguucgugccuguaaucucaccauguuaggaagcugagcggggaggaucguuugagcccaggaguucaagaccagccugggcaacauagcaagaaccugucuccacaaaaaauaaauaaaaaaauuagccaggcaugguggcauguaucuguagucccagcuacuugggugguugagaugggaggaucacuugagccuaggagguugcagugagcugcggcuauaccauugugcucuagccugggugacagagcaaggcccuaucuguaguuuuuuuaguuuauggaggaaaauuaaaaguaauuuauguuuuuuaaaaagaaauuauguauaaaacagauuauagcauuauggaaggaaaauguuaauuuggagaaaacuuuguuuuauuuuguuuuuccuuuuaauagagaggcgaaaaaaggcuucagcaugggaaagaaauuugguguaucccgcuguuaugguucuccuucuuauugagacaguaagaauuuauuugccuaguuaaauaaaagcaaauuauauuuuauuuacuucagcauuugaguauggcagcucccucagcuaaaugguuuuucauaaacuaguuuucuaucaacaggauuaaaauccaucuaugccuuuauuuaugaaaauccaauaaagcaaaaauggaaauuaauggcaauuuaaaaaaaauucugaagauuaucuguuucuucaugaaagcaggaaauucagucuuuguuuucauugaaaauuaagaaaacaagguguugcagauaaccugcuuuaaauucugugauaaaauaugaaaauuacauuaugaaguuaguucugauaauauuuuaccacuuuuuuaagucuguggaguuguguguuuccaauuggugagaucacuuaguaaaaggaucuauauacuaccagcuuuugucacaagcuuugaaaugacaauaacuugcagaaucuuuuagaauuucuucaguucuuguuuguagucugauuacuuuaguuuuauauauagcguuuuggucuugacugcuuucccucuauucugaaacguguauuugguuaccuagauuuuaauauuuuguauuggugaaaaaucuugagagcugacaguuugcuguuugucuuguaguccaucucgguccucuugguggcuuguaauauucuuugccuauugguugaugaaacagcaaugccaaaaggaacaaggguaaaguaaaauccuuuaaaaugucuuucuuuugcaaaaguauucuaugucuauacccugaguauuucaaguaagcaaaugaaaacauucaccuuugugcauguauauacuucaaguuguaugaauuucuuuaugcaaagagccuuuaaaauauaaacugugauuuuuguuucuaauuuuuuacuuuggauugacagggccuuuuuucaaguguuggaauuuccuuuuagauuucuuaucagaguuuaucuugauuuuacugaaauucauuuagcuauaugaaauuccuuuagccauagucuugauucagauccccccaccugagucuuuccaggaccuugugccaucuguuauugccauuguuguauucacuuacagccucuucuccaugaguacaagcccaccaucaugcuccaggugccucauccuacagacagacaagaaacuacccuuugccauguacagucuuaucuuuuucuuuaguuuuauacccaaacccacugauagaacaggaagucgcuuacuauacugacuuccuagucacuuuuaacccauuuuacuauaccaacaaaacaagucccaagcccuauaguauauuuuuguacccaucccccuuagugcuuaguggagaaugacuuguacgucauaggagaucccuguauaauuguguaaaaaaauuagauacucuuaauccuuccuacauggcuucucuugagauagcauaauuccaaaguauuaucucuguugaucaauaagcuucuguaggggagaagaaguaauaccuuuuucuaaccuauuggaagguucauggcugagaugccuauaacaaaagauuaauaagagaaaagcugacaaacuuauuuaagauaaguuuuacauaucacaggggucuucagaaauaaagaagaccaaagaaacagaaaaagcuguguacuuuuaugcucugguuuguugaagaguggacaguagugggaaguaugauuggaagacaggggugugaucuaaugauuauaaaccggggggauuuagcaaggccuguucauauucuucucgguguccucgugucuccggagauaaacaugugcuucuccucuggguggguugcggggggcacccuuggaugggggucuuauggccugcuucgcaggagaaggagacagaucagugugugaccuuccuagguuuucucaaauaccaggucccaaauuuuggaguagugugucuugaaccccaucacuuucuaccagcaucauuuauuucuucuucaaaagauugucaaaaaguuauuuuuuauugggcugacuguagauucuuaauuaucccugguguuucuauuagauguaaucugugcugacuaguaaaacauucagauaguuucuuuuauuaguaaucuuugaaaauacuucaguagggaaugauuuuuucagaucuaauuauaaaaauaguaacuuuuuuguguuuuuuuuuuaaguucuagguaaagauaguuuuugagauagggauaauuguuuaggaaaaaauuuauagcauuacuuuuuuaaaaaucuauguuaacaguuacauccuuuguaacucugaauucccaaggaaaauuugggcaaaggaaacuuucagguaugggaacaggauaugcacauuuacucucuuucuacucuuagcuuaauuuugacauacuugaauuguguaaucuuuguauauuguguaagcauucagauagcuauguauccuauucuuauuuuucuauuguguuuuuaaaaacucuuucccaaaacuauucaggauuuuuuuccucaaguggcaaguugccccauuuuauaacaguaagcauaaucaugucaucuugacaaguaacuuaaauuacauuugagauaaguaauuuuucuugagcuuauuaaaauuguuaacauggugccugaauuuguugaugaaaucagucuaaugucaugucuuguuggccuuugaaagucuagauguuauuucaaaguaguaaacauucauaauuucaacugucuuauuuuaugaaacagcuguuuuagggaaaccaauauaauggugucaucaaauucugaaaagugucuuucucccaccccaggggccuggaauaggaaaugccucucuuucuacguuugguuuugugggagcugcgcuugaaaucauuuugauuuuguauccuuucuuuaacugaacguucagccuauccacaaauuuuauaccaaguuuucuggggcaguaguuauuuacuaagacacuugucuagaagagaaaacaacagguuagucuuccucaagcacuuaaagcggcuuuuuguuuugcuuuuccuaugggccuuaagacuuuuuggagacugccgagaacuuaggaaacuugcauucuguuggagaguuuuuuuccuugauucucacagcuaucuuaugguguccucuguugucggcuucuauagccuucgauuuuuuggaaacuuuacucccaagaaagaugacacaacuaugacaaagguaagguagaaucuuaggugacuguggccucucguuugccuucccugacagacugcuuuauuuaauagucauucugaaugguucauuugcagugauagguauuuguuuguaaguugcguaaacacaaacuggaagauuuucaaaaugcugagugagugggaaagggauguacccuguuuaauuuggauggcguccauucacuguaaaugcggagaacugcagagcuuguuaacuagcuauagaaggcuccugaaaggacucuuuuuccucuaaagaaaacguauugcuaaugaguaacuuggauugugcuaacuguacuucagggagcuuguuugaagucugaagaacuuaguugcuacaaguaguagggacaaaguauuucaaauuugaauaauuaaaguaagacggaagaguucuauucagaaacauuuuguagucugaggcuaauuugacuuuuuccacaacaugucauuggguucagaauaaaaaggcuguugccguauauagugacugaaucuuuauaaaauauucccguaggcugacaaagaagaauaacuaauaagagcugaaagcuuguuuuguuuuuauuuuauauuuuuagccuacuuaaaggggagaaguuauuuuacacacacacacacacacacacacacacacacacacacacacagcuauuucuuuaaacuuaauaaguaguugagauauuuaguaucuaguuuaagugaucauaaauauuaauugauauuuucaacuccucuuauuuacuauggaagaauaaacaugggaugcauuauuacaaaaguuuagagguuuuggauuucuggugcuuuuuaaaucuuacaauuaacauuagaaauagaugugauaaaagagaucuuaagcaauaaucuggccuuaaaaauguagucagaaguauccaauauguuaauuauuuuuugcuugacaggcagagccuuuugaaaguaacagcugcaaucaguaauguaaagugcauuaucuaggugucaaguaauuuaaguauucuauaacuauaucugugcuagguacuguaaacaucuucuagaacuuacagauauaacuuuauuuauuuuaaaaguguguuauucuuugaaaauucuguacugaauaguaucauuaagaaaucggcaaaguacacuagguaacuagaaugcacaaucauuucucagaauguuacuggguuugauugucauccugcuguuuaacugcccaauauucuuucucguuucucauaacagaucauuggaaauuguguguccaucuugguuuugagcucugcucugccugugaugucgagaacacuggguaaguuucagugagaaauuuucacuuaaagauccauguuuuuaaaaacugucuuuacugaacuuauuuaacauuuacucauaaagauuaccuuugaaauacaguguuucuuccuacauuauuuuacacuuuuacuucuauacuuuauguauaggggcauaccaagacaaauacuuuuaucaaauaaugacuacuuauuuuuuaaacacuuaaaagcauucuuucuccaaacaacgggcugguuuuuguuguauuuuguuuuuacugacacaucuauaaguuaggcuuucgaguccucuagugaggaaacugcauuaaacuaauuuuucuauuuaaaagcuuuugagcguuuauaauuuaguaugguuuaaaaaauugaaaauuuguaaauuauuuuaagcugcuuuguguccacaaaauagaggugaacgcaguguaaucucugagaacacacucugauucaaaggacacccuugagaguuccuacuugccugucauucauuucugucauuuucuuauuguuucaguuuacggagaauuugauaaucuuuuaaaagaaaaacagauuuuugcuuugucauugaaauaguugaguaagucuucccuuaguugucuuuuauaaaaugcuauuguagaccauauucugaguucuucacuaaauauuauuucagacaaaaguuuccauuaagcauuucuaucuaauucucuagacuuagguuuugacuuaagagugcacacgaaugauuggaaaauuuugaucauuaaauuuuagcuacuugcucauaacaaaaauugcugguaacuuugaguugcuuuugcauuagcucucauauugccuccauuauuuauugaagacuuacagauaccagggaugcaggcugugcaaagaaaguagaagcuuuguaguuaucuucauaauucuuacaaaggauuucauguuuguaauagaaaacaaaaaguauaaauguaaagggaccacuguuccauaagcuaauaaaaaacugguguguguaauagucuuauuucuuuuguguuugcuuuauaggacuuguaauuguuuugacaucugcuuaugugaaucuugaaaaugccaaaaguaugcucuuuagcaaccugauuugauguuaaauguuaucauuuauauuaugacagucuauuaaauaauuucuguuauauuucagccaaccuaucauuuuaauacuuaggaaacucauucacuguacuauuauuuaagauugauugcuaaucauuaauauauaccgauuuuauggaagaaaauuacaugcugaguauaguuuuaacacaaagaaaacaaacuaaugguaaaauuuacuuuuugaaggccaacaaauuaaauuccagaguaguuugccauagagauaaauaaaaagaaaaaaaagaaagauggaacaauuaaaaugcagcuaacaaaugccuggacccagcuguccaaacaggauuaauggagugcauuaggguacagugagucauguggugcuuugcaaaauaucaacacgcacugcauuacauguuaugcccaguggcauugaauagaugaaaagaaauaaauacguuaaacagauucauagaggcuuuucacaguauuaaaaaagcaaauuucuagacuaaaagaaaaagcuuuauuuuagcauuaugggaaaugcaaacuagagaguuacuuuguaauuccucuauuaacccuuuagaauugagucuuugauuuuaagaagauaaaauauagggaauugucaugaauauuauccuaguguauaacaggauuuugauuuaccagcugaaaagcuuauaagacuagaauagaggauguauuuaagcaaucagauuccaagcugugacauuuuucagucuuucuugucgccucucucaaggaaacccugaccuuaguguggucuccuuugcuccugugaaaucagccagcagcgucccaucacuuacaauggaaugagaaaugcaguaacaagaaaaaucauauuuuaucucuauauauguaauuucucuauuauuucaacaguuuuuuuagugaagaauauaaauuugauuauaacuugaaauacaucgaaucuaguauaaaagaaaugaugauguuuuugcuucaaaaaugaaaguguucaauggacauguuucuuuuuuaaacauuugcccacuauuauuguugaugcaucgcaggcuuuagauuuaaguacauggugugauaugacauauuuauuaaauaauuccuuuuaaauagcuuguuauauuugaaugaaaaauuuuguacuaacugaaaaaucaccacuaaguaaauuuuauaagcauauuucuugccacaaagaauuaaguugugagaaaaauuuugaccauguauucuugguuaaguagaauuaguauaaaugaugguuuuauuuuucauaggaaacacaaagaaucuguaguuaaaauuuuuuauuagaacccugaaaaaguaaugcuauguaaaugaauauauuuuucaaaacauuguuuugcugccuguuuauauuuaaguuuucagaauccaaaauuuggggagauuugaugucuguauuuuuaguaaacaguuuacuguguaguuuaauagacucucagggugauaaaaggagauguuugcaaacaaggugaaaauagaacaagaucaaacuaauuaucuauagauguccaaaauucuaugcaauaaaauauuuugaauguugcagugaauuuuagaagaauagauucugugugauugcugauauguucuuuauuaugcuuaaucaugaaacaauuaagacguugauuuuuuguguuauucuuuauuugaauucuccuuuaaagaggaaaauuuuucucaaaugcaaaugauagucuuugaaaugcuuuuaauaauuucuauauuguaauuauuuuuacaguuauuuuucaucuuggaagcucuuucuauaauuuguaaguuauuuaguguccaaauacaauuuguuuuuaauguacuuaugguaguaaaacaaaaacacuuacucuuucaaaucagcuugaauuuauuuucaguauuuucacauauuucucauuugggucccauauagucuauuaucuuacaggaguuaaaguagauuauuccuuuuugcuucuugaugaagggaccuuguuuuauaacgggucuuuuuuggagaggucuuuauuugggguuuugguaaucccuauuuaucuguacccugggcuuucucuagcucuuguugugaaacagaaauaaacaaugcuuucacagaggcuuagcaaugacaaaugugaaauggaaguauaagucauauauuccuaauuaugacauugauauaaaaauaauuucaaacccuauauugaaaauuucucaccaaaaaguauauaugauuuuauuauauucagauauauuauagaaaauaauaaaugaauaauaugacuuauuauuauuaacuuuauuauuuaacuuuauuaaaguuauuuauuaacuuauaguaauuaacuuuugguugauuacuaauguucuuauaucugagcaauaagcuuauauauacaguugagaucuuuaagaauaaagaauucuuaaaaauguuuugugccaaaugucuaaaacaguuaagagagcaacucaugauaccaccauaaaaacucauauuccugauaucuacgaaauguguuuccugacacuacacuucuuucagggcaaacagcccugucugagaaaaugucugugggucacacauaccuaaauuuagucaccuguugauauucagcuacuuuaaauuuacuuuauuauaauuuucaugcggaaaauaauuuccuuuaggaccauuuagcuggagggaaccuuaagagguaauuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuguguccugaaugguaaugccuagguuuucuucuaggguuuuuaugguuuuaggucuaacguuuaagucuuuaauccaucuugaauuaauuuuuguauaagguguaaggaagggauccaguuucagcuuucuacauauggcuagccaguuuucccagcaccaucuauuaaauagggaauccuuuccccauuucuuguuuuugucagguuugucaaagaucagauaguuguagauaaugcggcauuauuucugagggcucuguucuauuccauugaucuauaucucuguuuugguaccaguaccaugcuguuuugguuacuguagccuuguaguauaguuugaagucagguagcaugaugccuccagcuuuguucuuuuggcuuaggauugacuuggcgaugcgggcucuuuuuugguuccauaugaacuuuaaaguaguuuuuuccaauucuaugaagaaagucauugguagcuugauggggauggcauugaaucuauaaauuaccuggggcaguauggccauuuucaugauauugauucuuccuacccaugagcauggaauguuuuuccauuuguuuguaaccucuuuuauuucaauguuuauugcggcacuauucacaauagcaaagacuuggaaccaauccaaauguccaacaaugauagacuggauuaagaaaauguggcacauauacaccauggaauacuaugcagccauaagaaaugaugaguucauguccuuuguagggacauggaugaaauuggaaaucaucauucucaguaaacuaucgcagggacaaaaaaccaaacaccacauguucucacucauaggugggaauugaacaaugagaacacauggacagaggaaggggaacaucacacucuggggacuguugugggguggggggaggggggggauagcauuaggagauauaccuaaugcuaaaugacgaguuaaugggugcagcacaccagcauggcucauguauacauauguaacuaaccugcacauuguacacauguacccuaaaacuuaaaguauaauaauaauaaaaaaaucauugcccagaccaccauugagaaguuuuucccuguuuucuucuaguaguuuuacaguuucaggucuuaccuuucaguuuuuaauccaauuaaauugauuuuuauguaaaaaaaaaaaaguaacuugaaaaacguuacaguuaaaauguuacaauuaaaacuagacaaaugaucguaagggucuaauuuguccuaagaauaaagaccucuagcuaucugaguauucuguuuguuuucuuuuuucugaaacagauccucauucuguuacccaagcuggagugcaguggcaccaucauagcucacugcagccucaacuuccugggcucaagcaguccucccaccucagccucccgaguagcugggacuacuggcagcuacuuacaccacaccaccacaccuggcuaauuuuuuguauuuuuuuguagagacgggguuuugccauguugccaaggcuugccucaaauuccuaggcucaagugauccaccugccuuggccuccuaaagugcugagauuucaggcgggagccacgugccuguccuugcugaguauuuuuuuuuuucuuuuuccuucuuuuuuuuuuugagauggauucucacucuguugcucagguugaagugcaguggcacaaucucggcucacuguaaccucugccuccuggguucaagugauucuccugccucagccucgcaaguaccugggauuacaggcgccugccaccaugcccagcuaauuuuuguauuuuuaguagagacgggguuaugccauauugcccaggcuggucugaaacuccugaccucaagugauuugcccgccuuggccucccaaagugcugggauuacaggugugagccaccgugccuagccaggcugaguauucuuaauaauacauaugcacagucauuucugagauagaugaacaaauuauuucauuuguaggaaauuguguuuuuaguuuuuaaucauauaagugaaugcauaaauaaauaguccugauaaagaauacuaaaaauuagagauccggccgccacuucuaauuccagucuccucuuccaaguuuccagaaaugucuuugguuuacagcuuuucagaccuuuuccugugcauauguauacauguguuuguguguauauauguguacuuuguagaaaauuuuaaaaucucaccugaguauuacuuuguuucuaauuguuuuguuggcauucuccuucuuucugaugacucuuaacuuccuaugcugccuagagagaguuaaaagaagaaaauguuuugaaauaauuuccuuuaucagaucucagucaccugaacauuaauuucaaaccaaaagagaguuacagaaagagauaauuaaauguuugccagugacuuguaauugccucauucuauggauucuguuuuuaauuucucugugguguuuacuguuuguaauuucaccccccacaucuugucugucuucauuucuggucacugcuccucucuuuuucccucugcuucucuggccauuccuuagcugugucuuuuacugcucuucaacuaccacccauucacuugcccccaaaucgagaccuccaaaccaccacccacccuaagcuaaaacagagaaaucuagcucugugcuacuuacggguguccuccugccaccucacacuggucauuucuaaaacagaaccugucauuucucucucuccuguauuucccuucagucucugggacacuuucuauccaaguggucaaaccagaaacuugagacguaugguaaaugcuuccaccuucugugccaguaccucauggcaguacuugcuuucaucuugguaauauuucucacaucuaccucuuuuuucugaaacaagauuuagcucuguuguccaggcuggagugcauuggcacaaucauucacagcucacugcagccuccaccuucugggcucaagugauccucccaccccagccucccgaguagcugggaaaacagcugcccaccaccacacccagcuaaacuuuuuaauuuuuuguagagauggggucucacucuacuaccugggcuuucucacuuggaaaauugaacuccuugaacuccugggcucaagugauccucccucuaggccucccaaagcguugggauuacagaugugaaccaccgcaccuggccucacaucuaccucuugcuucucauuuuccuuuuuaaaagugagaagagucagacuuguauagcauaaaaagcagagagcugaguauaugauuuuaguauuuuauugugagaguaguguuugugaaguagauucuaagcggauguccuuuuauuugagaaggauagagaaagaagacaucaaaccaaaccaaaagaaauaaggacauauuuaauuuuccaagugagaaaguuugacugagccauaccauggagaccugucucuggagaacuuuccucaggaagaucgcagccaguuaccauccaugcuggagggcuuaggcgugcacuucuuugaaaauuagcacauaagguucuuuccuggacucuaauuauaauucucuuucauuggauuuuagucugucuucaaguucacauacucuaguucuggacgacuaaauuuaauuugccuccagauuagaacaaaaugaaauuguugcacguaaauccucaugacuaaaauugauucgauauuugcaaauacaguuuuccaucucuaagcuuugguucccauuguucccacagucuucucccauucaccuuucucuaucuauccaaaucuuuuuuauucucugaggcagagucaaauccugcaucacacgugaaggugucucagagucuugcacuuucaaccuuguauuauacguaccugucuguauugacuuucucaugaaacuuuauguuccuuaaaggacaagacuuguuuucugcaucuuuuuauuuuucacagcaucuaguuaauaaguauuuuugauguuaauaaguauuuugaugucagugggugccaccauguugaguguauauuguguucuagaauagaugaacuaagauacuccauuugucuugcuuuugcccugguggucuuuauuuccauauucuaagcuuuucugaccaaauauuuugguuugcuauuaauauuuuaaaagaccauuacaacaguagccaagagguggaaacaaucaaaguguccaucguuggaugaauggaugaucagauuuugguacauaaacaauaauggaauauucagguaaaagaaggaaggacauuuaagugaaauaagccagucucaaaaaggcaccucuuuauaagugugauuccacuuauaagagguaucuagaguaguucauuucaugaguugccaggaacuagggugaggaggaaugggaguucuuguuuaaugaguauagauuauucauuuuuuaggaugaagagaauucuggggauggguaguaccaauggcgaauauacuuccuaucacugaacuguacacuuaaaaaugguuaaauugguccauuucauguuauauguauuuuaucacaauuaaaaaagaaaaaagaguaacuaaauggguacauacuacaacaugaauggaccuugaaaacauuauguuguuauauuguacgauuccauuuccaugaaauguccagaauaggaaaauccauagacagaaaguggauuuuuuuuggaauauauccaaagcccuugaacuguuuauuuuuaaauaguuaauuuuauguuaugugaauuucacuucaauaaguuauuuuuuggcugggugugguggcuuacaccuguaaucccagcacuuugggaggccgaagcgggcaggucacuugaugccaguaguuccagaccagccuggccaacaucgugaaaccccaucucuacuaaaaauauaaaaauuagccaagugugguagcgugcgccuguaaucccagcuacuuggaaggaugaggcaggagaaucacuugaacccaggcagcagaggcuacagugaccugagaucgugccacugcacuccagccugggugacagagcgagacucugucucaaaaaaaaaaaaaaagaaaaaaguauuuuuuuauaagucuuuuacucaguagauacucaguaaauauuuguccucuucuccguuuccuuggcguggcagucuaaugccagggccuaauuguuuuuaguaagucagucuuuauguguuugcauuugccuucuuagugccaggcacuugauaaggggaggcagguggaaggacuuuugaaagucgccuuucugguguauagaguccuaaccuggggcaccuccuuugucccuucuuuccauucagagucuacuuguuauuuaagggcuaguucaauccccaccacacacacacaugcacaguggaagugugaucuugucauuucccugcuccaaaugcugcaaagacguuugccauucaaauacuguacaguuuccuuaagguaacacauacgaucuauaccugaccccgucugugucucgugccauuccaaaccucacauucugagccauuaguaauaaagacauaaucuucagguguguuagaaacaaaguacaucugcuaugccuucuaugccuuugaacacauugcuuuguuuacugcgaguaauuuucuucaccagccguucuccggcaaaaccuaacaugucauucaagacucagcucagccaugaacuccacaaaucaaguuugccaugagguaucucccgugcacucucauauaacacuuggugcaguuuuccguuuaucuaccaggucacuuaucacauucuauccaauggcuuuucuuuuccuccauaaagcucuacgcuccuugaagaaagggauggccugccacacaacauuuagcacacauaugcggugggagguuuacacacucucacuucccaguucacuuaacuguuuguauauagacauuuggccauacuggaaauauugcauuguuuaaaaagucuugucuuccuaggaaggcuaucaauaccgugaagggaauaaaugucuuacauacuuacuuuguagcuucuguaguacaugcacaguacaauguaggaauaugguagggacucaaaaauucuuuaaaaauuuaacuuauaacacaaaaacaaauacagaaaauauagaguuucuaaauaaauguaauugguacagccauacauuaauauauuaaugcaugauauuggguauauagucugaagucuaauaaaugcauuuuaacagcuuuauugagguauaauugacauacaauaaacugcacauguuuaaagugacaauuuuauaaguuuugacuuauacaaacaccuguaggaccaccacugccaucaagauagugaacauauucaucacccccaaacauuucuccccucagacuccgcucguguuccccuauccaccaucagcuccaggcagccacucauuugccuuuuguuuuuuuuuuccagacagauuuuuuagagcaguuuuagguucacagcuaaauugagggaaaagugcagagauagcacacguaccuccugucccccacaugcagagccuuccccacugccaacaucucccaccagaguggcacauugguuacaguugaugaaccugcacugacacauuaucacccagaguccagaguuuacguuaggguucauuccugguguuguacauucuauggguuugggcaaauguauaaugucccauauccacuguuauggcaucaugcagaguaguuucacugcccuaaaaauccuccgugcccugucuauuuaucccucucucucucucucacccccggcagccacuaaucuucuuacugucucaguaguuucaccuuucccagaaugucauauaguuggaaucacacaguauauaaccuuuucagauagguuucuuucauuuaacguauauuuaggguuccuccauaucuuuucauggcuugauagcucauaucuuuuuaacguggaauaagauuccauugucuggauauaccacaguuuaauuuauuuuuguauaaauuuacagggguacaagugcaauuuuguugcaugcauagauuguguaaugguguagucagggcuuguagggugucugucacuugaauaauguacacuaugcccauuaaauaauuucucaucguccagccuccccccugcccuguugccuuuuucagucuucauuuucuaucauucugcacccuacauccaugugaaugcauuauuuggcucccaucuauaauugagaacauacagcauuugucuuucuguaucugacuuguuucacuuaagaugaugauuccacccauguuguugugaaauacaugauuucauucuuugcucuggcugaauuguauuccauuguguuuuuauaccacauuuucuuuauccaguuguccauugauuggcgcuuagguugauuccauaucuuugcuauugugaucagugcugcuauaaacauaugagugcaggcaucuuuuugauauaaugauuucuuuuccuuuggguagauacccaguacugggauugcuggaucagaugguaguucuauuuucaguucuuugagaaaucuccauacuguuuuuccauagagguuguaauaauuuacauucccaccaaccguauagaaguguucccuuuuuucugcauccucuccaacauuuguuguuuuuuuuuacuuuuuaauaguagccauucugacugauguaagauaauaucacauuguguucuuaauuugcauuucucugauuagugauguggagcauuuuuucauaugcuaguuggccauuuguaugaccucuuuugaagucugucuuuugcccacuuuuugaaguguguccuuugcucacuuuuuaaugaagucauuuuuguuauuguuguugaguuguuugcauuccuuguaaauucuggauaucagucugcuguuggaugcaucauuugcaaacuuuuucucccauucugcagguuaucuguucacucuguugauauuuugcugugcagaagcuuuuuaguuuaauuaaguuccauuuguuuauuuuugcuuuagucgucugugcuuucgaggucuuaagucaugaauucuuuuccuagaccaauguccagaagaguuuuccuagguuuucuucuaguauuuuuauaauuucaggucuuacauuucagucuuuaauccaucuugaguugauuuuuauauauggcgagagauagggguccaguuucuuuuaucugcauauggcaauccaauuuuaccagcaccuuuuauugaaaaggguauccuuuuuucauuguauguuuuugucaguuuugucaaagaucagcuggcuguaaauacguggcuuuauuuuuggguucuccauucuguuccauugaucugugucuguuuuuauacuaguaccauacucuuaugguuacuguauccuuguuguauaauuugaaguuagguaaguugaugccuccaguuuuguucuuuuuccuuaggauugcuuuggcuauucaugcucuuuuuugguuccguauacauuuuaggguaguuuuuuuaauuacgugaaaaauaacauugguauuuugguagggauugcauugaaucuauagauuguuugcaguaguguggucauuuuaacaauauuaauacuucugauucaugagcaugggauguuuuuccauuuguuuguguuauccacaauuucuuucauuaguguuuuuuguaguuuguuuguuugagacagagucucgcucugucgcccaggcuggagugcaguggcguaaucuuggcucacugcaaaccuccaucucccagguucaagcgauucuccugccucagccucccaaguagcugggaccacaggugugcgccaccacacacagcuaauuuuuuguauuuuuaguagagauaggguuucaccauguuagcuaggauggucucgaucuccugaccuugugaucugcccaccuuggccucccaaauugcugagauuacaggcgugagccacuguauccagccuguaguuuauuuuauuuauuuauuuuuuucuuaaagauaucuuucaccuccuuggcuaaauauucuccuagauauuucuuuauuuuucuucuucauuugugaagcuuaguuuugcuggauacaaaaugcuugacugacaauuauuuuguuucaggggacuacagguaaggaccccaauccuuucuggcuuuuaagguuucugcugaaaaauuuacgguuaaucugauagauuuuccuuuauagauuaccugaugcuuuuguuucauaccuuuuaagauucuuuccuucguuuugacuuuagauaaccugaugacuacguguuugugugaugaucauuuugugaugaauuucccaaguguucuuugagcuuuuuguauuuggacauuugcauaucuagcaaggaaguuuuccucaguuauucccucaaauaaguuuuccaaacuuuuagauuucucuucuuccucaggaacacuaauuauucuuaguuuugaccauuuagcauaaucccaaauuucuuggaggcuuuguucguguuuuuaaauucuuuuuucuuugucuuuguccaguuggguuaauuugaaagccuuguuuuugagcucugaaguucuuucuuuuacuuguccagucuaucguugaaacuuuccagugcauuugguauuucucuaaguguguuuuucauuuccagaaguugugauugcuuuuucuuuaugauaucuauuucucugaagaauuuuucauccauauccuauauuguuaacauuucuuuaaauugguuuucaccuuucucuuguaucuccuugaguagcuuaauaaucaaccuucugggccgggcacgguggcucaugccuguaaucccagcacuuugggaggccaaggcaggcagaucacgaggucgggagaucgagagcauccuggcugacauggugaaaccccgucucuacuaaaaaauacacaaaauuagccgggcaugguggcgggcgccuguagucccagcuacucaggagauugaggcaggagaauggcgugaacccgggagguggagcuugcagugagccaagaucgcgccacugcacuccagccugggugacagagugagacuccaucucaaaaaaaaaaaaaaaaaaaaaaaaaaucaaccuucugaauucuuuaacuggcaauucagagauuucuucuugguuuggauccauugcuagggagcuagugugaucuucugggaguguuauagaacccgguuuuuuauauugccagaauuacuuuucugguuccuuuucauuuggguagacuaguucauugggaaggucuggaacccaaggccugcuguucagauucuuuuguuccacugggugaucccuugauacaguguucucccccuucaccuagggauggggcuuccugagagccagccugcagugauuguuauuguucuucugggcuuaaccacccagcagggcuaccaggcucugggauggugcgggggaaugccugcaaagagucuugugauguggucugucuucgggucucccagcuguggauaccagcaucugcuuugguggaguuggcaggggagugauggagacucugugagaguuccugguuguagguauguuuaguaugcuggcuuucucaaaugcugguuaugccaggagugaaagugucauguggacagacucaggaccucugguuagccaggauguugcaggcaguggaauuagcuuuuguuuucuccuuccugggagcaggguuauucugucaugaguugcuguaauggccugaugugguuggccaguugguuggccucacuuucaagagaguuccagcugccauaguaguagagguaucuaagcuugccccaaguuggccaagguaaguauucugguuucucaggugauggguggggccauaaagcucccuagacuuuaugucuuuuguguucagcugccaggguagguagagaaauaccaucagcugggggcaaggucaggugggucuggguucugauucucccugggcagggcuugcugcagccaccgugguuguuggggggugguucucaggccaaugggguuuuguuccagaggggaucuuggccaccugugcuguguuauauaguuugccagggaaguuggggagagccaguagugaaaggccucauccagcucccacacaguuggcaaggcuggucucucuucugcagucccugccgcagaccuugucccaggccguaagcuuccccgcugagaaagcaagcauggcuuucaggcuuugcccuuccccaucugcccacacuguccgugguggcuucugugcucuuaucugcagcaguucccauuugcacccugccccccuaccagauucugcucaagaaaauuugcucaagaaauucugcucaagaaaauuugugcccaaaguuauuacaaauuucaguuggaagcuucuuucauccuguaaccccacccuaauuccacuggcugccuuccccaagguccccugugagauauagucagggauggcuucccugggcuugagcuggagacugggagagccuacagggcucuuccugccacugaugcugcuuuuauuuuuuguguggcucccugaaucuauuucaacucuaaguaagguuaaauccuuuucccauuaucuggauuuucagcuaccacagugaggauguguguucagaggaagguuuuccccaccucacacacugggaacucaguuuuuugccugugucucauggaauuugcaaugauaugcugcuucuuucaaaggauucgugaauucuuuguuuuccugguacauccuacaaugguucuuggagcaaaaguugauggugugagucuccgcgcacuguucuguccuuccaagugggaacugcacauuaguccugccuccugucugccgucuuccuccaauuuuuuuuuucuggcuauuguaaaugggauugccuucuugauuuccuucucagcuagauaguaguuuuuuuuuuuuuuuauauagaaaugcaacugguuuuuguacauugauuuuguauucugaaacuuuacugaauuuaucaaauccaagagcuuuuuuguggggggauccauuagguuuuucuagagauaagaucauaucaugaacgaacagggauaacuuaaccuccucuuuaccaauuugggugccuuuuguuucuuucucuugccugauuguucuggcuagaacugucaguacucuguugaauaggaguggugaaaauugacauccuugucuuuuuccaguucuuaugauuuuuggcugugguacuguuguauaugaucuuuauuauuuugaaguaugcucuuugcaugcuuaaucuguggagggcuuucgucaugaagggaugcugaaguuaucacaugcuuuuucugcaucuuuggagaugaucaugugguuuuugcccuuaauucugucagugugauauaucacauuuacugacuguguauguugaaccauccuuacacuccugguauaaaaccugccugaucaugguguauuaucuuuuugaugugcuguuggauucaguuugcuaauauuucauugagaguuuuugcaucuguguuuaucagggauauuggucuguaguguacuugucuguuuggguaucagagugauuugggccucauagaaugacuuaggaagaauucccuccgccucaguuuuugggaacaguuucaggaggauugguauuaguucuucuuuguacauuugguagaauucagcugugaauccaucugguccugggcuuuucuuuguugagagauuuuuuuaauggauucaaucuugcuacucaucauuggccugcucggguuuuuuauuucuucccgguucaaucuugagagguuguauguuucuagccaguaauuuauccauuuccucuagguuuucuauuuugugaauguauaguuguuuauaauauucucugaugaucuuuuguauuucugugguaucgguuguaauguuuacuuuuucauuucugauuuucuuuguguugucucuuuuuuuucccuuguuacucuagcaauugguuuaucaguuuuauuuauuuucucgaagaaccaacuuuucauuuuccugauccuuuguacuguuuuuugguuuuuauuuuauuguuuuuuuuuugguucugcucugaucuuuguuauuucuuuucuucuacugauuuuggauuugguuuguuacuuuuguaguuccuugagguaugacauuagguuguuaauuuguaucuuucaguaucuuucauguagucacuugaugucauaaacuucccuccuagcacuguuuuugcuguaucucgcaaguuucaguauguuguguuuccauuuucauuuguuucaaaaauuuuuuuuuuaauuucugacuuaauuuauucuuugacccaauggucauucagaggcauguuguuaauuucuguguacuuguauguuuucugaaauucuucuugguauugauuucgugauauugaugcaugaaaauuuuugauuuuuaaaaauuuguugagacuuguuuuguguuuuaacauaugguuuaucuuggagaacguuuuaugugcugaugaguagaacauaaauucugcaguugagcagaauauucuguaaauguguuuuagguccguugcaccaaguacaguguuucuuugcugauuuuuuuucucgauaagcuaugaauaggguguugaaguccaccaccauuauuucauugcugucugccucuuucuuuagcuguaguaauauuuguuuuaugaaucuuggugcuguuggcugcauguauauuuggauguauuguuauauccucuugcugaauaggucccuuuaucauuauauaaugaccuuuguugucuuuuuuuuuuuuuaacuguuuuugauuuaaagucuguuuuaucuggugucaguauaacuacuccuggucuuguuuguuuuuuuguuuguguggaauaucuuuacuuugaggcugugucuucauagguaagguggauuucuugugagcaguguaugguuggaucauguuuuucucuauccauuccaccaaucuguaucuuuuaagaggagaauuuaauccauuuauauucaagguuaauauugauaugugagguuuuguuccugucauauuuuuucauuguuuucuaguuuuguaaguucuuuguuaucuuuuucucuauuucucuuugugguuugguggaauucuguaguauugccauuggauucccuucucuuucuccuuugugugauuguuuuacuugugaguuuuauacuuucauguguuuucaugacggugaauaucuuccuuuuguuuccacauuuaggacuuugagcauuucuuacaggaucuguauaguggagacgaauucuuucagcauugcuugucugcaaaagacuuuaucucuccuucauguaugaagcuuaauuuuucugaaaauagaauucuucaauggcaggcuuuuuucuuuucuuuuugcgacagagucucacugugucucccagcuggagugcaguggcaugaucacagcucacugcaaccucuaccucccaggcucaaacaguccuuccaccucagccucccaaguagcugggacuacaggcacaugcuaccaugcccagcuaacuuuuguguuuuuuguagagauggaggucuuaccauguuguccaggcuggucucgaacuccugggcucaacccauccacccaccuugacgucccaaagugcugggauuacagguguaagccacuaugcccaggggcaggcuuuuuguuuuagugcuuugaauaugcccucucauuuuuuuucuggccuauaagauuucugcugaaaagucugccauugcucuuuucuuacugauuuuagaauucuuucacuuugacuuucgacaaucugauuauaauaugcuguggugaaguccuuugugcaguguauuuuucauggaccacuggaccuccuguauuuggaugucuaaaucucuugcuauacuugggaucuuuucaccauuuauuuuauuagauauguuuucuaaacuuuuugaucuuucuucccccucaggaaucuguacguuagguuuuuauguagucucaaacaucuccaaggcuucauucuuuuuuguuccuuuuucuuuauuuuugucugccuggauuauuucaaaagaccugucuuucacguucugagauucuuucuucuauuggucuauuguugaggcuuuugauuauauuuuauacuuccuuauauuaauuuuuuuguuucagaauuucugguuuuuuuuuuuuuuaaagacaacuauuuccuuaguaaacuucuuauucacauccuauauugauuucugaucuuuguacugguuuucagauuucucuuacaucucauugagcuuguuugaaauuaguauuuugagcuuuaaucuggcauuuugaggguuuuuuuuuuucaguuaggaucuauugcuggagaauuauuguuuuccuuugagggugucauauugccuuggcuuuuucaggccuuuuguaucuuuacauugauuucugcgcauccggagcaauaguugcugcuuauuuuuaaauuuacuuucauugggaggggacuuuuuuucuugacuaugugaccaugauguguuugggcagguagggcuguuuggcuuuguuucaggaugugcagugauaaaaacgcugcaugauuucuuuggcuauaaauagccuuugugguagcuguggguuuguugguguuauggggcgguuauugguggcagcuauugugaaguuguacuggggacuggaaugccugauggaucccuuuucagguuucauugguagcaguggugggcuaagcaugucuguucuugugccaugggacaguguauucuggcgccuguguuggcaguuccaggcuauuucuugggccucuguguagcuuuccuggaugcugguuguaguuguguaugcugaauggguaagugggcccucagcccccuuguaacccaggguggcaugggucauggugguagcagugguugugcaaugaucuucuaguuuccaagcacuuugcccuuguguuagaaguuguugcagugggcuuugcauguugaccucuaggucaguaggcgauguuuacagguuagagccagcuacaguggguacaacaggauuugugcccagccucuuuuccaugggagaaguacuugggugucucagguggcagauuggguaauggaaaacucaugagcccggaugccaugcuccaccuuggagaggcauggggaagggcccaggcagagcuggacugggcaauuguacucaggucccccauggugauuguaugcaaaagucccaacaaggguagugaggcagcccccaagccccugggaaaaugcuugggugagggguggccaccacuaugccagggucucagccuagggaaggauugacauugacagcccaagcagccacaguuguggccagcagacauggaacuugugucccucuccuauccuuguucucguggagugcucccucccuuguuccgacuguggcagcgaacccagguaucuagucaguccuagaaguuugcauccagucugccacucagcuuagggccgugggagaugccacccagcccccauccuggccucugaggcaacucuccuccugcugaggucuuaggagacagccugguuccugugccaguugggcuggaucccaggucaugcucauuucucaguucuggcugcaggaguucuuccccuacucaagccucuuuucugcaaaccccagcccaagucccccuaacuccagugguuggugcugcuaauuuccacacauuguugagcagcuaagaucaagaauggcaucuuacuguagcugccugggucugagagagcacauaggacacacccuggagcaguuucuucucaugguuuccuggcugcuccuuaaaugugauucugagauuaggagagucaaggugcucuccaauggccuggauuguacaguuucccagggaaaguggaccccagaaggacacucacuuacacucuuccauaugggggauucauuccccauuuuuggccccaggccacaugggcugccuguuuuccuucucuuuuucagaauucgacuuuuccuuuucaggaagcugcuuuugccacaguuuauccauuuaccuacugaaagacaucuugguugcuuccagauuuuggcaguugugaauaaagcuucucuauagauauucaugugcaaguuuuuguguggacaaaagauuucaacuccuugggguagauaucaaaaaacauuuuucuuggaucauaugcuaagaguauguuuaguuuucuuuuuuaaaaaaccuucucugcugcugcugagaugugaaaaagaaguaaaaauauuaagaaaugaaaaaagaaaauuuaacugucaaagugucuucuaaauugguugugucagcaaaagaaacuaucaugagagugaacagacagccuacacaaugggagaaaauuuuuucagucuaacaaaggucuaauauccagaaucuacaaggaacuuagauaaauuuacaagaaaaaaacaaaccucauuaaaaagugggcaaaggacaugaacauacaguucucaaaagaagacauuuaugugguccagaaacauaugaaaaaaagcucaacaucacugagcauuagagaaaugcaaaucagaaccacaaugagauaccauaucaugccagucagaagggcaauuauuaaaaagucaagaaacaacagaugcuggugaggugguggagaaauaggaacacuuuuacacuguuguugggaauguaaguuaguucagccauuguggaagacaguguggcgauuccccaaagaccuagaaccagaaauaccauuugacccagcagucucauuacuggguauauacccaaaggaauaaaaaucaguuauaaagauacaugcacauauauguucauugcagcacuauucacaauagcaaagacauggaaucaacccaaaugcccaucugugauagacuagauaaagaaaaugugguacauauacaccauggaauauuauacagccauaaaaaggaacaagaucauguccuuugccuggauauggauggaguuggaagccauuauccucagcaaacuaacacaggaacagaaaaccaaacaccacauguucucacuuauaagugggaacugaacaaugagaauacauggacacagggaggggaacaacacacacugggccuuggucgggggagggagagaaucagguuaaacagcuaagcauguggggucuaacaccuaggugauagauugauaggugcagcaaaccaccauagcacaugauaacaaaccugcacauccugcacauguaucccagaacuuaaaauaaaauucaauuuuugaaaagagugguuguaccauuuuacauuccugacagcauagaaugagaguuccuguugcuccacauccucaccagcauauggugucaguguucuggauuuuggccauucucauacaugugccugaccuucuuuguauaacuauaaauuaguuugcacuuccuagaauuuuauauauaugaaaucauacaauauguaccauuuaccugacuucuucuacucaucauauuuaagaugcaucugugaugauguauguaugaauaguucauuuuuuauuguugaauaguacucucuuguauguauauaucacaauuuguuuaucuguucacccauuggaagaccuuugaguuguuuacaacuuuuggguauugcaaauaaugcagcuugaacagucauaucaacauuucuguuggaugcauaucuaggaagggaagauuuaauuugcauuucccugauaacuaaugugauuauuugccauuugauaugguguggcuguguccccacccauaucucaucuugaauucccacauguugugggaggggucuggugggagguaauugaaucaugggggcaggccuuucccuugcuguuuucauaauaguaaaucucaugagaucugaugguuuuaaaaaggggguuucccugcacaagcucacauucucucuugcugcugccauguaagaagugccuuucaccuuccacuaugauugugaggccuccccagccacaugcaaccaugaguccauuaaaccuguuuuucuucccagucuugggugugucuuuagcagcagcaugaaaacagacuaauacaguaaauugguaacaguagaauggggcacugcugaaaagauaccugaaaauauggaagcgacuuuggaacuggguaacaggcacagguuggcacaguuuggagggcucagaagaagaaaggaaaauaugguaaaguuuggaacuuccuagagacuuguugaauggcuuugcccaaaaugcugauggcaauauggacaauaaaguccaggcugagguggucucagguggggaugaggaacuuguugcgaacuggagcaaagaugauuuuuuuuuaaauuuuauuauuauuauacuuuaaguuuuaggguacaugugcacaacgugcagguuuguuacauauguauacacgugccauguuggugugcugcacccauuaacucaucauuuagcauuagguauaucuccuaaugcuaucccucccccccuccucccaccccacaacaguccgaggugagugauguucccauuccuguguccauguguucucauuguucgauucccaccuaugagugagaacaugcaguguuugguuuuuuguccuugcaauaguuugcugagaaugaugguuuccaguuucauccaugucccuacaaaggacaugaacucaucauuuuuauggcugcauaguauuccaugguguauaugugccacauuuucuuaauccagucuaucguugcuggacauuuggguugguuccaagucuuugcuauugugaauagugccgcaauaaacauacgugugcaugugucuuuauagcagcaugauuuauaauccuuugaguauauacccaguaaugggauggcugggucaaaugguauuucuaguucuagaucccugaggaaucgccacacugacuuccacaacgguugacagucccaccaacaguauaaaaguguuccuauuucuccacauccucuccagcaccuguuguuuccugacuuuuaaaugaucgccauucuaacuggugugagauggugucucauugugguuuugauuugcauuucucugauggccagugaugaugagcauuuuuucauguguuuuuuggcugcauaaaugucuucuuuugagaagugucuguucauauccuuugcccacuuuuugaugggguuguuuuuuucuuguaaauuuguuugaguucauuguagauucuggauauuagcccuuugucagaugaguagguugcaaaaauuuucucccauucuguagguugccuguucacucugauggugguuucuuuugcugugcagaagcuguuuaguuuaauuagaucccauuugucaauuuuggcuuuuguugccauugcuuuugguguuuuagacaugaauuccuugcccgugccuauguccugaaugguauugccuagguuuucuucuaggguuuuuaugguuuuaggucuaacauuuaagucuuuaauccaucuugaauuaauuuuuguauaaaguguaaggaagggauccaguuucagcuuucuacauauggcuagccaguuuucccagcaccauuuauuaaauagggaauccuuuccccauuucuuguuuuugucagguuugucaaagaucagauaguuguagauaugcggcauuauuucugagggcucuguucuauuccauugaucuauaucucuguuuugguaccaguaccaugcuguuuugguuacuguagccuuguucuuguuauguuuuagcaaagagacugguggcauuuugccccugcccuagagauuuguggaacuuucaacuucagagagaugauuuagggugucuggugugagaaauuucuaagcagcaaagcauucaagaggugacuugagugcuguucaauuuuaaaacauuaaacauuuaaacauaaaacauuuaaaacauuaaggcauucaguuuuaaaaggaaaacagcauaaaaguuuggaaaauuugcagccugacaaugcaauagaaaagaagauuccauuuucuaaggagaaauucaagccagcugcagaaguuugcauaaguaaugaggagcugaauguuaaucaccaagauaauggggaaagugucuccagggcaugucagaaaccuuuacggcagccccucccaucacaggcugggagguuuaggaggaaaaagugguuucauggggcuggacccagggucccucugcuguaugcagucuagggacuuggugcccugugucccagcugcuccagccgugacuaaagggccaggguacagcuugggcuguugcuucagaggguggaagccccaagcuuuggcagcuucuaugugguguugagcguguggugcacggaagucaagaauugagguuugggaaccuccaccuagauuucagaagauguauggaaacaccuggguucccaggcagaaguuugcugcaaaggcagggcucucacggagaaccucugcuagggcaguacggaaugaaaauguggggucagagcccccacacggagucccuacuggggcacugccuaguggagcugugagaagagggccaccaucuuccagaccucaaaaugguagauccacugacagcuugcacugugugccuggaaaaccaauaccagccugugaaagcagcugggagggaggcuguacccugcaaagccacagggguggagcugcccaagaccaugggaacccacuucuugcaucaccaugaccuggaugcgagacauggagucaaaggagaucauuuuggagcuuuaagauuugacugcccugcuggauuuuggacuugucuguggccuguagcaucuuuguccuggccaauuucuccuguuuggaauggcuguauuuacccaaugccuguaucccuguugcgggaagucacggaccacgaauggagggacuggcuggagcugccgcagaggaacauaaauugugaagaucucauuuuaauauggacauuugucaguucccaaauaauacuuuuauaauuuuuuaugccugucuuuaaucucucaauccuguugucuucauaagcagacgauguaugucaccucaggaccacugugauaauuguguuaacuguacaaauugauuguaaaacguguguuugaacaauaugaaaucagugcaccuugaaaaagaauagaauaacagugauuuuuagggaacaagggaagacaaccauaaggucugacugccugcggggucgggcagaaagagccauguuuuucuucuugcagagagucaauaaauggacaugcaaauagggaagauaucgcuaaauucauuuccuagaaaggaauauugauauuaauaccuugggaaaagaaugcauuccuggggggaggucuauaaacggccgcucugggaaugacugucuuaugcgguugagauaaggacugagauaugcuguggucuccugcaguacccucaggcuuaacuaggguggggaaaaacuccgcccugguaaauuuguggucagaccaguucucugcucucgaacccuguuuucuguuguuuaagauguuuaucaagacaauaugugcaccgcugaacagacccuuaucagugguucuucuuuuucccuuuguccuguucccucagaagcaugugaucuuuguuagauccuuauuaguaguucugcuuuuugcccuuugaagcaugugaucuuuguaccuacucccuguucuuacacccccuccccuuuugaaacccuuaauaaaaacuugcugguuuugaggcucaggugggcaucacgguccuacugauaugugaugucaccccuggcggcccagcuauaaaauuccucucuuuguacugucucucucucucagcuggccuacacuuauggaaaauagaaccuacauugaaauauuggcagcagggucccccaauauauccccguuguaucuaggaaguaacuaacuugcuuuugauuuuucaggcucauaggcagaagguacuugccuugucucagaugagacuuuggacuguggacuuuugaguuaaugcugaaaugaguuaagacuuugggagacuguugggaaggcauaauugguuuugaaaugagaggacaugagauuugugaggggccaggggcagaauaauaugguuugguuguguccccacccaaauuucaucuugaauucucacaugcugugggagggauucagugggagguaauuuaaucaugggggcaggucuuucccaugcuguuguugugauggugaauaagucucacaagaucugaugguuuucaaaaggggagcuucccagcacaagcuuccauucugucuugcugccgcuaugugagaagugccuuucgcccucugccaugacugugaggccuuccuagccauauggaacugugauuccauuaaaccuguuuuucuucccagucucggguaugucuuuaucagcaucaugaaaauggaccaauacacuguugcauauuuucuuuggcaaaaugucuauuaagaucuuuuguuaauuuuaacgauuggauuuauuuucuuguuauuuaacuuugagggcuguuuacauauucuugguuaaaguucuuuaucaaaauauaugacguguaaauauuucuuccauuuaguuaccugucuuuucauucuccuaacaauaucuuugaacaagcagacauccuuaauuuugaugaagucaaauuuauuaaauuuucuuuuauggauugugcuuuugaugucauaaucuacuaaaucuuucucuaacccgggaucacaaagacuguccucuauguuuucuucuagaaguuuuauacauuuaguuucugugcuuuggcccaugacucacuuugaguuaauuuuugaauauaguaugacauauagauuggagggguuuuuuuccauacugguugccaguuauuccagcaccauugcuugaaaaguuuauucauuuuccacugcauuaccuuuggauuuucauugaaagccaauuguccacauaugugugaaugugauucuguuucugugcucucucuuuuuuuuuuuccaucagugucuuuuuuuuucuuuacaucaguacuacacugucuggauuacaauagauuggucauaaaacuugacauugguaguauaaguucuuuagguuuuuaaaaaauuguuuugugugcaugugauaugguuuggaucuauguccucacccagaucucauguucaguugugauucccaguguuggagguggggucuggugggaggugacuggauuuugggggcaguuucucaugguuuaacaccaucccccuuggugcugcugucauggcaauagugaguuauugugagaccugguugucuaaaagugucgggugccucccccaacccuuugcuccugcaccggccauguaagaugugccuguuuccccuucacuuucccccaugauugaaaguuuccuuagaccuccccagaaacugagcagaugccaguaucaugcuuccucuacagcccauggaaucaugagccaauuaaaccucuuuucuuuauaaauuacccagucugaaguauuucuuuauagcagugugagaacagacuaauaccguuuguuuguuuuggagacaaagucuuguucugucacccaggcuggaguguagugguaugauuuuaagucauuguggccacaaccucgugaugucaagugauccuccugccuaagccuccuaagaaguuaggacuacaggcauucaccacuauggccaucuaauuuuuaaauuucguguagucuuuggcucuugcuguguugcccaggcugaucucaaacuccugcuucaagugauuuucuuguuucagccucccaaagggcugggauuacuggcaugagccaccacaucugcuaggauuuugacugggauuguauugaaucuauaaaacauguuggaaaggauuaacaucuuuacaauauugagucuuuuacaugucuuuuacuuucucuuguuuguaguuuuguuuaggucuucuuuagugaacuuuguuagugucuuuuaaggaauuuguuuauuucaucuaaguugucgaguuuauuaugacauucuuuuugaugcuauuacaaguaggauuauuuuguuaauuucguuuuuggaaaguccauucuuaguguauagaaauuccacugguuuuuuauguugauuuuguaaccuguaauuuuacugaauucauuuauucuaaaaguuuuguuugauggaguccuuaagauuuucugccuguaugaucauuucaacugcauauguagauaauuuuacuuuuucucugccuauuuggauggauuuuuaaaguuuuucuaacuugauugcucuggcuaggacuucaaguaguauguugaauagcaguggcaaaagugggcauccuugccuucuuccagaucuuagaagcuuucaguuucuucccauugauuauaauguuagcuguggguuucuaaaaauaucuauugucuuggcugggugcaguggcucaugcauguaaucccagcacuuugggaggucaagguggguggauagcuugaguccaggaguucaagaccggccugggcaacaaaaugagacccugucucugcaaaaaauacaaaaauuagccuggcaugguggcaugcgccuauagucccaacuaccuggaaggcugaggugggaucauuugccaggaggcugaggcucugcacucuagccugggugacagagugagauucugucucuuaaaaaaaaaaaugucucuauuauggugagauaaauuccuucuuuaccuguuuuguugagaguuuuuaucaugaaaguauauucaauuuugucaguugcucuuuucuacaucuacugagcuaaucaugugguuuugucuuucauucugcuagugugguauaucacauugauugaccuucauauguugaaccauacuugcaucccagcaauaaauuggccccauuuggcuagggcguacgauccuauuaauguguuguugaguuagguuugcuagcuagcauuguauugaggaguuuugcaucuguguuuacugggaauacugcccuguaguuuucuuuacuuuuguugccuuuuuauuggcuuuggaaucagggcgaugcuggccuuguaaaaugagcuuggaaguuuacuuuccuuuucuguuuuuggaucaguuuaugaagaguucauauuaguuuuucuuugaauugucugguugaauuuaccuuuugaagccaucugguccugggcuuuucuuugcuggaaaguuuugauuagugauucaaucuucuuguuuauuaguuugcucagguuuucuauuucuucuaaaguuagucugggcagauuguauguuucuaggaauuuaucuguuucuuuuggguuauccaauuuguuggcauauaaugguucauaauaguuccuuaugaucuuuuuauuugugucauuuguuggaauaucucuuuuuauuucuuauuuuaguuauuucugacuucucuuugaguuagucuagcuaagguuuuuaucacuuuuaucuuuuaaaaaauccaacucuuguugauuuuucuaauguuucuauauuuucuaauucauuuauuucugcuucagucuuuauuauuuucuuucuucugcuaacuuuggguuuaguuuguucuuuucugauuccuuguucuuugagauuauuauacuucuuugguuaauuuucaucauauuugaaagauuuucagccacuauuuuuucaaauaguguuuuuucuucucuucuccuucagggacucuaaucacaaguacauaagacauuucaaauuaauucaugguucauugaugcuuuuuucauucuuauuuugcucuuuguuuuguuuuccuguugcugugucuuuaaauuuacuaaucucuucuucugcagugucuaaucugccauuaauccuaucuaguauaauuugcauaucccacaguauaauuuuccuuuguagaaggucaguuucagucuauuuucuuucauaucucuacuuagcaaguuuuaucuuuccucuagcuuuugaaauaagaaauguaguuaaaauaaccguuuuaaugucuuugcuacucauucugucaccugcuucauuucuugauuaguugcuccccacaagcauacacuggucaguugucugccagguucuuccuuugugcagcccacuggccacugugucauccuuaugcuccaagcuucgucucaugaacuuagggagauggcuggagcucuccucagcucuucucucuacacugcagucucucuuuaggugguaaacuguggcaaucauagggcccaccuuguuuguuucucaucucucagugaucacuguccuucguuuccugaugucuagggucuugaaaacuguuguuucauauacuuuguucaguauuucaguuuauaaaguugagagggaaaaucuggccucuuuuacuccauauaggcuggagccugaagucaauaaguauaucuccaauugauauaauuucaugaaaauauacuugcacaguaagacuggugaaaagguaaagucagcugggcacaguggcucacgccuguaaucccagcacuuugggagguccaggagggcggaucaucugaggucaggaguuugagaccagccuggccaacauggugaaaccccaucucuacuaaaaauacaaaaauuagccgggcgugguggugggcgccuguauucccaacuacuugggaggcugaggcaggaaaaucgcuugaacccaggagggcuuggguugcagugagcugagaucgcgcugcugcacuccagccugggcgacaagugcaaaacuccaucucaaaaaaaaaagguaaagcguuugcuucaacagcaucaucuuucauuccaccucagaaguggagccucucuuucguuuuaugaugacuuuguuuuugaaugaauaaaacaauuggcaaugagccaauuuaaauuauuccuguuuuaaaaugacuguagauuucauuauuucauacucuuugucacuuuuuuuucccaacacugucuuagcuaauauuauuucaaaaaaaugguuuagaggaagagauuugaaaacauagucuaauaaucuaaccuuugaguucagaaggaaaaaaguaugcuaauccuaauauuucagcaaagaacauuuaaucuauaaguuuuuuuuuuaaaauaacaagauguacguguucuuucugguaaucuuacauuaaaaccauggauauuuaugucagccauuuguguaaaugccaacauauauaauuuauugauaaagucauauuaaugaucccuuuaugugucaagcuuuauaaacucucucuuaacuacuuuuugcugcuuuaggaagaugaauaagcuugcuaaaaguagaaguuuacucaggugggcuaaagaacauaaauucuauugacucauauugcagguagagaaaccagcccuuucuuaaaugagauuuuauucuguauguuaauucuuuuauagguaugaauagaaaaagaucauuauucaaggaauuaugcauaaaauauuuucaguugaauucuaguugggggaggugaugugcaguuugucaugaagaauuuuuuuuauugacagauaaucuagauaaugugaaccuuaugcuuaacuacugcuuaacuuacuaagcuucuugccugguguguauuuuacuuaaucuuuuaacaaaaugaacuuccaaauggacauaagcauuuagauacuugacuaagggaguuaacaacauuugauaauuagaucuuucuaauaguaguauuuuaaaauauuugcuugcuuuuaauaguaguauuacuucuaauaguaguauuuuaaaaaauuugcuugguuuuaaaaugcuuuuaccuuuuuacggaaauagagguuuaaaacucuuuuacauuugucaaaugauugcuauuaaagcuuugucugaguauugccauuuuuucuuaauuguuggugcuuuuaauuuuaaaaguacauuuuauaaucuaauuauugccaugccagaaaccucucaggcagaauuuuagagaaguucauuuuuaagguuucuugugguccagucuuuauagaaaauuuucagaauugaagaacuguguguuggucagagugaucuguuagucaaucuaucagauuuuuaaaaauauuaaauucaacacaaugaugucuuggaacuaguuuuuaugagguaauauuugucuauuucuucggugcacuauagcaacaggcuccuggguuucuguugaugaagucaaccugaaauagccugaaaaccaaaacaucugaugauagagacuguucuuugccuagauaugucuaagucuugacccugagucucaagauaccaaguugaguccacuaagaaguucuagugaaagcacuuucccguuuugcaaaacauaccuuccauucuuaccgugaugaugcauucagcuuccugacuucucauuauaugguauugcugucacaacguaggacacaggccauguacagggcugguaggauuacccaccacagagcauauaccagugguuuccaaaguggaguuugugcauuuccuugcauucauaaaguaagucguuggacugugugaagaaacuauuagaacuugcauuuauauuuauuguuaugauuuuuaaagucuuuguuuugucuguauaugucauugaauaguauauauguagcuuauaaauaauuaaauacacauauaugggguauagaugcucaaauuuuguuuuuacugaugguaguauauguuaaaaaaaauuucaagagcagguaagacugguauagagcaucugggcaaggguuugauucugggaucucccguguccuccgucagugaacuucgugcuguguaaaauuugggugucugugucuggguuuuucuugugagaagauucauagcucucagcagauucucaaaggagucuuuggcccuaaugauaaaauuacuuaucugagaucucuggguugaagccacugaagcuuguuuugguaggacuauaucuuguuuaaagaucacuuccuaggcuaaaugaaaugguacuguauuugaaaaauaaaacuuauaauuagauauguauuccuuuuaacaaaguaaaguuuuauuaauaugaauagcugagaaacuguagccaagauuguugucaucaucucauaaccaugugugacauaugcuguguacucuucuggugucugcauuuuaaccuuuuuaaaaaagcuauuuuauuguauguuuucauuaauuaucuaccuuaaaaaaauauuuugguauauuacugucuuuuaauuucaaacacauuuguccuggguagaaguggcuacagaagagcuacuuuugagaucuccuguuuuuaugacaauguuuguauuugguuuuucuguugucucucuaagcugcuuuuguagaggcuaucuguaguagauuaugccauugcauuggagggaggauuagaguucagcucaaaggucaacugauaauguaaaauugaguauagucaaaguuauucuugagaucacccauaaaaauccuuaaaucacccuuaaaauacaagguacauaauuuuauuuauacaauuuuauagacgauuguuauuacuuauucuaauucuuuguaguuuaaauuuuauauggcccccaaaugcucuauccuuuuuuccuugaagaauguugacauucccauuaucugucucuugaccgacaccugaaugaugugauuuauuuaucugucaguggucagaaaaauccuaccauucauguauuuuuuuccaguaaauacuggaccuggccaugugcucauuuaauagaaugacuauuuaaacuauuuuuaaguaaaaauacuuuuacaaauguguauaggugaauuuaaguaacuucaaugcauauauuagaucauccuacuguauuuccugcuuugucuuuuuacccuacaagccuauaagcauuaaacucagauuaacaauuuuuaauggaaggaaauuaccuuauuuauucauuuauauuauacauauuaaguguguauaagacauuauucugggcacugggauuauaggggugaaacaaaguuccuguucuuauagaaccuacauucuaguggggaaaacaggcaauaauaagccaaaaagaaaaaaaaauagucuauguaugcugugaagacucguaauuaguauagaaggccauggaagguccugcuguuuuagguaggggagucagagguuuccuguccgaggagauggcauuugcccagagacccgacuaaagagaggggacgggcaguuccuccagagagcagcagcagaggagguguaaggauguucucaggcaucuuuuucaucgugacucuugcuuccugugaucaguuacagccguccugucucgguagagcaugcagucagccauccuccccauguaagcagcacgagugcuugauuuuuaacaucagcaugaguuccgucgaaugucgaggggcguucauucugaccucauuacucaucacuugcuagugacuguggcguguaugugaaguagguuaggucuggcuugaggcugucccacuagauaauaguuacauauuuuaaauuaggauuuauucauuagagcaucucacgucacagaagugagaaaguccauagaauucgaucuaacuuguacuuuacuuguagcacacuaaauaugucuuaaccugauuucauuaagggcuauuuuauuuauuuuuaacaggaaucacuagauuugaucuacuuggcgacuuuggaagguuuaauuggcugggaaauuucuauauuguauuauccuacaauuugcuuuuugcuauugugacaacauugugucugguccgaaaauucaccucugcaguucgagaagaacuuuucaaggcccuagguaauccugagguuuauggguauuuuuuccucuuucuacuaaauaauuuugacauuugaguuaauauuacaucuucagcuauuuaguuucccaaauuuguaaaaccuuagaggucaaauuauugauccccuacuuugugcaaaauuccuucauuaagccuuagcuuccuuaucuguaauacagugauaguaucaucuuccuguuaggguuuuugugaagaucaacggaaauaauucuguaagauccuuagcauagcgccuggcacauccuaagaacucaguaaauauuagccccuuuauuaugacgaugguggucauggugguggugaggaugauacggugugaaaagcuuaucucuugguaauaauaccuuuuaguuaaagcuuuuuugaggcuuggauuuugcaaguauuaggcuaacccauaagucucuucauuaagccagagaauaaauucaagaugaaaacguuagcauucuuggcauugauguaauagaagagaggggauuuacuguuauguguuccaagagucacauguauuguaaugguguuaaaaacggguagguuuagcuaaaggguacaaacguaaccuaugaauguauuuuuaugcuuauuuccacauuagugcuaaacauauuucaaguuuuauacuuuaaaaauaccaggacaaaguaaauuaucuugguuuggggugggaggggguuguaauuuuaugacagaagaagggaaaggcagugacuucuuguagaaaauuuuuaaaaauccugacauuagcucauuuaccugaguugacaugauuugaaugcauaugacuccauacuggggcuuuuagcuauuguaaaaggccacauacugauggauucauuaagguccaguuuucagauaacuuaaacgauaugagcagcaauaaagcuucucagaucaccaggccuuuccaaccuugauguuugagagggugaccuuugggaggcacaaaagauuucagaugagcuguccauauguauuuuacuuugaauaugcccugggaggggauggcucaucaaauauugcaaugccugacaggaaaaagucacagcucauuucagcugacacaccagauaacuuauaccuuuuaaugcuuagguuuaauaaagcuggcccaacuugaaguaggaaucaaacaguccuuuuuaucagaugucuagcauuaaaacuuaauuuuuaagccuguuauaauaucagcaagauuaguuagccaugguuucagauaaauuuccacuuuccauucgcuaaaugagaugguugcaaaugaacugccguaacuuuagcuuuugaauuagguauucuggacaucauuuugcuaagaaagccuuuauuaaaguaauaaaacauaaccugauauaaaaggccuuauaugcaugucaguuccuugaccauaagagagaguagaauuagcaagaguuguauaaaacuaccuaauagauacauuuacuuuucuuccccaguguuuuucaguauucuuuggggugugcuacggggcaauuuauacauagaaaaagagucuuauuaaguauauguaauguuugaaugaucugagaucuuaacagggauuuagcugagacuuguaauuugauuguaaaguagcuauccccuuucuuucuuuuuuuuuguagagauuuuuuccccucugcuacucugcccauugauaauaauaguauccaucucagagaauaucuagcacauaguaaacacuagaaauuuagcuguggugauggugguaauggacgggauuguuucuggaguugucugcagaagagacacaucagaacguuucagaaugcauaaccuacaugacagccaaguuuuaggcgugaacucagauaaucgauccuaaaagggugccuucauuucagcucagucaguggguaccgcagugauccucugucuucacucagucccuuuucuaacaagcuugauuuuagcacacuuccucaacuccagcagcuguggguuccuauugucauuccugggaccugaccauuuuuuguguuggauugauuucuuuuuucccuucccauucaaacauaggcucaguuuuaccuuuucuuucauuaagauaugcaggugacaggaagauuaaaauuuggagugcuauauuaguuuaugagugauguaaaacugccuaauaggucaguuaccaugugaaauuuuagggagaaaaaucuuuuccaaguaaguuguugagaugccagaaaggucugagcuucgugaaaaguauuuucucaacaucugcccuguggaagugcugcuguguggccauaggccacaugaugaucauuuggucaauaacagaccacuugccuaugugacaguggccacagcagaugaucauggagcugaaccguuucugccagcaguggcguggcggcuguuguaauguccuggcgccacgcaucagcuuuucuagguucauauguuucuagaugcacagauaugugccauggugccgcaguggcugcagcacucaggacagugacaugcugucugcuugguaacugaggagcagccggccacacccugcagccuagggauggcauggcugugcccucuggguguauagauacacucuaugauggcaucacagcgacagaaucgcucgacagcgcauuucucagaaugcauuccuguuguucggcaacaccugacuguguugcuguaugucauuguguuucauuuuuauuaaagugcuugacgcuccagugccacagaagcucuuacauuuucuucugcccuuucucccugugagagggcaauguuggucuguguaucagguauauuauguaaauaauuguuuuaugauacagagagaaauaaauguaacuuuaaaagauagugauaguuuuuuauucugugaaauaccuuuggguagugagauauuauuuauguucaguuuauucuuuugucauuucuuuauuuuuuaguaauguuuuccauucuuuucuuuuuaauuacauauuaauauuuggcuguggcuuucccuacauuuuccugcauguguguaaggggcaauuuauuuuacuuuauuuaaaauuuuuuugagacagggucuccucugucacccaggcuggagugcaguggugugaucacaucucacugcagucacaaccugcugagcucaaggaauucucccaccucagccucccagagugcugggauuauaggcaugagccacugcagccagcuaauuuuuguguuuuucaugaacaugggguuucacaauguugcccaggccugucucaaaccccucagcucaaacgauccuuccaccucggccuccugaagugcugggaugacaggcgugagccaccacgcccagccugugugugugcauuuuaaaaugcaagugggaacguaucugucucggguuagguucccugagaagcacacuucagaugggaaucugcuugccaggaagagguuuauuagccggguugggacaacggaagaggaaggggcugugcagagggaggaacugugccgugaugcagucacacuggaagccuccgcuggcccucggggauguugugacuucgauggcccuucagagcuccacugaacugagaagaagggacaggcucuuaggacccucacgugcuguccuggaaggggcaggacuuccgccuugcagcagucuucagcuuaggccauccccaaagggagguugccaguagggagaagaaaucauucauuccucaaggggaucuggccagcaccucacagcuuuccaaauaacacuuagcuuuguaaaucuccucuucucccuacccuaacccuuucccagccacucagcaauauaucauuucucaccauuuucuuaauuuuuuugcagggcuucauaaacuucacuuaccaaauacuucaagggauucagaaacagccaagccuucuguaaaugggcaucagaaagcacugugagacgcacagacggcgucuucugccaccaagagacccgagaacuccagauucacgacauuccugucccauguagaagcauuuccauucaaccguggccccucuucagaaccuagaccuaucagugccauuuuuuuuucauaaucuacgaagaacuuggcuauggcugaucuuuuuuaaauuuaacuuucugauggacccuguaguuuccaguuaagugcagauuccuuacagacauauagaacagcgcauucuucuguagacauuugcucauguugguaaauacaaucacccauaugaaaaaauuguuuucaccugauaugaaaauguuagaaaaggcaaacuccgggacuucuaaagauuuacuuaaaucccauuauguacuuuauucagaauguagaagcugacuugaaaggcauccuugguacuaagugaagcuuauucagaaaaugcauuuuucaaaugcaauggcaacugcuuguagauaucauuuuugcaguguauguuggagcuguaaugguugcaauuauguuucuuauuuccuuaaaagcaaaaagcguaguuucugauuuauguuauagaaugauacugauuagacuuugagccaaggggaaaauacuaaauucuuuuaaaccuggagccuuagagagccacaggaauaucuucuguuguacagucuaauaagcugugguaggaaguaucauguaaucacaguuuaaugacaguuuauguauauauauaauucaguauucccucugauaacauaguugccaguguuuaauacacuuguaacuuggauuuuuaccuuauaggcuauauguauacucaguuuuuuaaagcauuuuuuucagagaucacuuaauuccccaugcuucugcaaugcauauaaaaacuauaaaugccgagugguagaaacuccucuuucuucauaguccucaggcuuugguuacauuugcauaugccauuugaagccuccagcuuuuaccaguuuaacauccaaaguucacagcaucagcauucaugguguaagaacaguuuugcaguauaacacgaucugauaaucauucaguuauuaaauuguaaauaauuauugggaugguuucuuggcuuuaaguccacugaauaaaaacuaugaaauugcacucugugucaaccauccacuaggauagaauaccgaaaucugugcaugcaaaaauaggagaugggcccauuugcacacaauucguaguuaugcagucugcuauauaaauauguucacaugcacuguguguaugaaaauagauggucuguguucagacaaaaguaaaacauuuuuuucaaauuguuacauuuaaagguuuucugggagaaauuuaugaaacgcaggcugugucuauuugacaucagaaauuuccacuuuaaaccaaaauaauaagaaacuuuaaucuguauauuuacaaccuuuguugaguacacuucccccuuauuuauacgucugcauuuccuuccgagcuucacaucuuucuaaaaugcagcuugguuuuaaaauaaaagaacauucauuuugugauucuaaacaagcuucaguaaauaccaccaguauaguacuggugaauuucucagcauaaaaucgacauaccuaaaaaguuaauaaaauucagcucuuuuccaauuucauuguuaugccuauugaaguauuaauugccagguuugauuuuuagugaagcuuggaguccauacuuugagcagaccaagugaagggaagaacagaaagaaacucaggaguagaguaauaucacuucucacuuacaccacuuucaggcacauccaaagaguuccuagauacuuggaaaaugucugaaaauuuuuaaguaaaauacuaaacuuuucaguguuuagcucaacuuuuuguucauuuggaaguuucucuccauccgaggacuuaagccaguuuuggauuuguaagcccugaguacaauacacuuccuggaggcauccucacugcuguugaagcaaaggauaugcaugggguggaaggacggcuucgaaccugggacucauaugccuugagaacaaauagauuguuacagccuugggcugcugcguaaucacgguuccucgaggcucuuccugagcacaugcccaagcaucugccucuggagagacugacuccaaaugcaggugcuuccauuggagcuaggucggaggcugcuuuauaugacgaacuccagaaauggaugccagaauacggaggccaaacguucugaguccugguaaggacagucgcucuggggguccucauuuuacugcaguuccugcacgccagugaaagagaggagauagacccuggaaggcagagcugcagaugcucaucaucaggucaauucuggagcuacaguuuuguuucugacuggauagggaugcaccagugacugucacaucaagcaguccuuuuauucucucuccuuuaguaucgauuuuaaagggcauuaggcacuaugguuccagaguuucuuggggaaaacuugcagauucuuauuaauugguucugcaauacuuaaauaaauuauuuuacaauuauaaguuuucagauuauaacauuuguauuaauuuuuacugauuuuccaagauacuucuuagauuuacuauuuacguagcuuuauguacauucucuguaaaaauagaccucuaaauaugaggcuuuacaugaaauuuguacacacauacacacuaauguuagcuccuuaaauugcugcacuaaggugcugguuaguagagauggacggagccucucgcguuuugcucucagauguguuaaaggcgcacguguaccugcucucagcggcagugcggccuccccaucugcugggugcccauggcccucccugcagccucagugaugaccucgucugccagggacacagguuuucaucauuuacaggcucuuaugugcuaguuuuguugguagcacguuauuuaaugcauaaaggcagaauucuuacaaguuuuuuuuuuuaaugugaacauagaugcagcaccgacuuuuuaaacuugaaaaaacugguauaauguuaacuuuuaaaaauaacauuuggacacacuaguaauugauuuuuguuuacagauuguuuuguuuacaaauuguuagucuuuguuucuaugagauacuuuuagugugacuuuuuaaaugucuuagaaauuaaaaguuguacaaaaagugauuuca

SEQ ID NO: 191457 - RNA, 49309 nt, Homo sapiens
ggagaaaggagagaaaggaaagcgcgaggagccgccgccaccaccagcgcagcaguccuggagcugugaggagauucgggccgucacccugccuccccugcgucccgccaccggccgcuucuguccucggugagggucuguuccgagggucgggggaggucgccuagggccccgcgcgcgcccggcagacggcggaccucacccggcgccuggcaacagcgcggggggugaccggggucgccggccggggaaaggacuggacggggcgggggccguggccgggguugcggggcgaagggugggcgggguccucugggucaggucuggggccggggccggggcuggggucuggggccgcccggccgcguccuccccgcccggcguccuugccggaacgcggcccagccuccgcggcggcgguuggggguggggcccggccugggagcggccggcuggggcucggcuggggcucggcggggccggcagcgugggaggcguggagcgccuucuuuuucuaaggcucccgcacucgcgucugaaaccagaaacgggaguggcuugcggagcaggaaugccgcagccgugccgccaaguucggagggagaagaagcaggugggggaccgcaaagcccuguuucuagaacuccggacggauuguucagaaguuuguggaagagcaggcugccuuucucacucagaauguuugucugcuuugcuuugcguuaaagaaucugcaccguaguugaugcaacugaaguuuauauaagaaguuuacauuaacucuuaccuaaggaaggucagugacacacgcaguguaaacugcaaaucauauauuggcucgagaaagguuuuggcacuagcgaauuuuuuaaaggauggguuugcuagucagacguaaacuucugugcuaacuucucacguaaacggggcaggaaacagcgcaaguagaacgaucgugccaccaccgaaggggugccgccugcgagcucggaggcuucagccuguuugggaagaguaggcugagcggcgcucuuuguaguuuucaacguuuuuauugaguugcgaauuuuaguaaggauuugucgcuacaauuuaagccaaauuauugauuuaguagaaaaguuagagugaagaccgaagaaaggaaacagacguuaaccauuaaagcuugauugcugcugcuucguguuuaaccgcacuuuuccaaauaguguugcguaucagaacgauucaugauuucugaaaggaauuauaugcagccgccuuacuccuccgccaguccacccgucccgcguucucucuggguuuacuccagacuuccuuuuuuuuuuuuuccugagacggagucuguucuguugcccaggccagagugcaguggcgcgaucuccacucacugcaacuuccagcucccagguucaagcgagucuccugccucagccuccugaguagcugggguuacgggugcucgccaccauguccgacuaauuuuuguauuuuuaguagagacggggguuucaccguguuggucaggcuggucucgaacuuaugaccuaaagugaucgccugccucggccucccaaaguguugggauuagaggcgcgagccaccgcgccucgccgacuccagacuuguuuccacuccugagggccuuaagcucccuuggaguuugugcuuucacauuucuuucugccuuccgugauaaagggaugaauaguuuuuaugcacgcuucagcgagcugcggguuuuuguggauuacgcaggcugugaaauuugggaaguaaguugccuuaaguugguagauguggagauuugacaggaagugggagaacaaagggguugggaagcuuuuggaaaguguccaggcuucaucugugcuguggaaggugagaaaguugggaauuccagagggcagagcucuuaaagaauuugagaugaguucagcacucucuucaaaacaguguuuuaaaauuuauuuucuucuggauaugaaaguguuagguuugggaaguaauucuggcuguaggacaguuuuuccggaacacuagguggggaguguugaauguugugaagacuaaaauaugcauaugguauuacagugugauaccuguuacugaguggcguacauuagcuuucauuuuuaagcaagcccguaauucccuucuauuaacucuguuuuggacagugguacccgucacccucaucagucuucaaccuagauaaccuaaauccaggucugagguggggguggaauggucuguuugcaccuuuuuuuuuuuuuuuuuuuuuuuuuuuuuugagacggagucuugcucugucgcccaggccguaauuaaugcgguggcgcgaucucggcucacugcaagcuccaccucccggggucacaccauucuccugccucagccucccgaguagcugggacuucaagcuuccgccaccacagccggcuaauuuuuuuguauuuuuuuaguagagacgggguuucaccguguuagccaggauggucuugaucuccugaccucgugauccgccuccucggccucccaaagugcugggauuacaggcaugagccaccgcgcccggccuuuugugugugugugugugugugugugugugugugugugugugugugugagauggaguuuagcucuugccccugcuggaguauaauggcaccaucuuggcucacugcaacuucgccucccagguucaagcgauucuccugccucagccucccgaguagcugggauuacaggcaugcgccaccacgcccagcuaauuuuuucuauuuuuauuagagacgagguuucacuauguuguucaggcuggucucgaacuccugaccucaggugauccacccgccucggcuucgcaaagugcuggauuacaggugugagcccgcgcguccggcugucacuuuaaagaguauuauaagagggcacuucauaacuugggcagguauuuuuagucauccugaacgugucgcuguggacugggugucaccgcgggaccgcacagacaccuuacugucgucugcuguaaaggucagcuucuauauugguuaaugcuuacagauaucuguugaggaauaagagaauguaauuagccuuuguauuugugaguugacguuuugacgggauuuuuacuucuuaguauuuauuugcaucgagguuacacacuggauuaacagcguuuuuuggaaaccuuuuuaaaacuuuuucauuuccucagaaaugauucuguucaaaaugugguuugguuaaauuugugcaggaccccaccugguggugagaggcggguaacugcaggcucauuagcgaguaagaguaggaucaguggcaggauuuagcaaaugguguaguucaaggaugaauagaauuugagaauaucaaacucaaaaaaaugagguuaaugagaagaagagcaaaguuggugaaaacaagaauauguuagaaacgaugauguaggaauggaaaaacgacaacgccuaccugcagaaaagucaacuaguaaaaaugugauuuuuuuuuuuguauugauauuaaugagguguuuugucaaacaaaacccuuuauguuuuuguauggacauaaaucacuguugaccuguuucauguuccuggagauauccuacuugagaaggaauauugauugaugauuaguugacugacugauuuacuugagauggaguccuugcucugugucccaggcuggagugcaguggcgcggucuuggcucacugcacuccuggguucaagccauucuccugcuucagccugccagguagcugggaugacaggcgcgugucaccacgccuggcuaauuuuuguauuuuuaguagagacgguuucaccauguuggucaggcuggucucgaacaccugaccucaggugauccccugccuccgccucccaaagugcugggauuacaggcgugacccaccgcaccuggcugugugugugugugugugugugugugugugugugcgcgcgcgcagguggaaucacccugugugcccaggcuggucucgaacuccuggccucaagugagucuuucaucccggccugucaaagugcuagaauuacaagugugagccaggugccuggccagauuuuagauuuuuuuguuguuguugagauggaaucucauauugcccaggcuggaugcaguggcgccaucucggcucacugcaaccucugccgcacggguucaagcgauucuccugccucagccucccgaguagcugugauuacaggcaccugccacugcucccgacugauuuuuguauuuuuaguagagacggggguuucaccaucuuggccaggcuggucuugaacucuugaccucgugauccacccgccucggccucccaaaguggugggaucacaggugugagccacugcgccaggccauauuuuagaauucuuaagcuguguugcaaaauuacgugucuuuggaagggugauuuaguuuacacuacauaugauuuuucccccuuugauauuuuucuacuuaccuuuugccaccaaaggcuuaaauuaaaaguguguuuuauauuuguguugugcauauauacgugugugcucuaguugguaugcuuaugaacuguguacuaauacuuauuccucucugccaccuugagauggcauguaccacuugggugggcuuugaaucugaaguuauuuguguuuauaggaauguccaggacacagagugcuuagaaaguauugauugaauuagauucuuucuaguuuguguauguccugaugaccuuccugugauuaauaauggaauccagaauucaagaaaguuggaaaaaauaaguuucagcagcacuggagacugaguacuuaaccgaguguugcuuuguuuauuuuagagucucacacugucacccaggcuggagugcagugucgcgaucuuggcucaccgcaaccuccaccucugggguucaagcgauucuccugccucagccucccugguagcugagauuacaggcguucgccacuacaccuggcuaauuguuguauauuuaguagagaguggguuuugccauguuggccagacugguuuggaagcaggugauccaccugcuuuggccucccaaagugcugggauuacaggugugaagcaccgagccuggcccuauuuuauuauaauaauaauuuuuuuugagacagggucucacucugucacccagacuggagugcaguggcgugaucucagcucaccccagccuccgccuccuagugucaagugauucuccuaccucaggcuccggaguagcugggauuacaggcacgugccacuauccuggcuaauuuuuuuuuuuuuuuuuuuuuuuuuuugaguuucacucuuguugcccaggcuggagugcaguggugcaaucucagcucacugcaaccucugccucccagguucaagcgauucuccugccucagccucccgaguacaugggauuacaggcaugcaccacgacacccagcuaauuuuguauuuuuaguagagacaggguuuugcccuguccaacuccugaccucaggucauccgccugccuuggccucccaaaguguugggauuacaggcgugagccagcgugcuggccuaacuucuauauuuuuaguagagauaggguuucaccauguuggccaggcuggucuugaacuugugaccucaauccaccuuccucgaccuuccaaagugcugggauuacaggugugagccaccaagccuggccuauuaugauuuuuuaaugaaagggaguuaagcuuggaaguaucuaauaggugaugagugcuaguugaagaaauggucucugaucuugaguaauggggaaauaacuucuguguuuguuucagaaauauuuuaggacauacuggauaaugaaauaaguaggugaugugugugauaaggaaugaaaauucacugcuguggguuuuuuuuuuuccuaccugucuguacuuuuuuuguuuuugcuuuuuuuuuuuguuguuugagaccaagucucacucugucacuuaggcuggagugcagcggcgugaucuuggcucacugcaaccuuugccucccaggcucaagcaauucuugugcuucagccuucuuucugaguagcugggauuacagaugugcaccaccacacccagguaauuuuuuuuuuuuuuuuaagacagagucuugcucuguugcucaggcaggagugcaguggcacuaucuuggcucacugcgccugcaccucccagguucaagcaauucuccugccucaggcugccgaguagcugggacuacaggcgcucaccaccaugccuggcuaauuuuuguauuuuuaguagagaaagggguuugccauguuggccgggcuggucuugaacaccucaggugaucugcgugccucggcccuccaaagugcugggauuacaggcgugagccaccucaccuggccucagaugaauuuagaaaccacuauuuuuuuuugagauggagucuugcucuguugccccggcuggagugcuguggugugaucucagcucacugcaaacucucccggguucaagcaguucuccugccucaccuggaacuacaggcgccaccacgucugacuggguuuuguauuuuuaguagagacgggguuucaccacguuggccaugcuguucucaaacuccugaccccaggugauccaccugccauggccucccaaagugcugggauuauacgcaugagcuacccacgccuaaucuuuaugugacguguuuuuuuaaaaguccuaaacuuagaggucauugaauuuauuggagaagguuauuuuugauuaauggcgauuaggcuaauuuuuuucaugguuuuaauagagauuuuucguuuuuuuaaacuugauuuagauguauugcuuuuggaaauugcagaaauuaacaaaccgaguuuuccuaagaaauauuuuuucuuaauuucuuaauugaaaaguuuucuauggcuuccuuaauagacaguaggaccuaguuaauaguuuaaagaaguuucauaauuguuauuagaaauguuaauuaugggccgggugugguggcucacaccuguaaucccaguacuuugggaggccaagguggucagaucacaaggucaggaguuugagaccauccuggcuagcauggugaaaccccaucucuacuaaaacaauacaaaaaucagcugggcguggugacaggugccuguagucucagcuacuuagcaggcugaggcaggagaauggcgugaacgcgggaggcggagcuugcagugagccgagaucccucuacugcacucuacugcacucugccugggugacagagugagacuccgucucaaaaaaaaaaaaaaauagccaggcauugugggacacaccuguagucccagguacucgggaggcugaugcaggagaaucgcuggaaccagggagguggagguugcagugagcugagauugugcugcugcacuccagccugggcaacagagugagacucaaacucaaaaaaaaaaaaaaguuaauuuuguaguuagagaauaucuuccugcucuacgcaaauucccuuccagccugaaauuauuuguuuuuuuauuuuuuauuuaaaaaaaaauuuauuauuuuugugacagggucuugcuccguuacguaggcuggagggcauuggugcguucacgucucacuagcaucgacugccugggcucaagugauuuuccugccucagccacuuccaguagcugggacuacaggugcacacugccacacccuacugaguuuuuauauuucguagagacaagauuuugcuguguuacucagcguggucuugaacuccugagcugaagugaucccccugccucagccugccaaaguguuaggauuacaggcaugagcuacuguacccagcugugauuucuuuuaaagugcuacuuuacagcacugucacuuuuauuuuaucauuuuuaacuuuaaaguuuuuuguuuauuuuuauuuauuuuauuuuuugagaugaaguuucgcccuuguugcccaggcuagagugcaauggaguggucucggcucacugcaaccucugccuuccagguucaagugauucuccugccucagccucccaaguaacugggauuacaggcgcccgccaccacaccuggcuaguuuuuguauuuuuuguagagacaggauuucaccauguuguccagacuggucuugaauuccugaccucaggugauccacccgccucagccucccaaagugcugggauuacaggcgugagccacugcgccuggcuuaaaauuuuuauuuuuuauauauuuuguuuuuuucugagacagggccuugcccugucucuuguccaaguuggagugcagugacaugacauggcucacagcauccuugaucucuugcgcucaagugauccugccauuucagccuccugcauagcugggaguacaggcaugugccaccccacucagcuaauuuuuuuuaucuuuuuguagagauggugucuuacuguguugcccaggcuggucucaagcucuugggcucaagugauccuucugcacauuuccaagguuguuucacuccugugucuuugcugucuagaagcuuuucagugugauguaaucccacuugucuguuucggcuuuuguuccuugugcuuuugggggucauauccaaacaaagauugcugaggggccaaauuuuaaauuguguauaauuuuaaugacuucagauuuaaauagcugcauuuggcuuauggagucuuuugagcagcaugguuuuaaaaagguuuuugccaagugggguucuaauggacaccuaugcuuguagagcucugaugugagugaucugcuguagaaauuacuucuuuugauuuaguauauuauuuuaaaaugcaggugaugcacugguuucuuggugagggaagcugguuuuuccuggcugagcuucuguaggguggagggcuggaguccaggcucucgcugggcagggaaggcagcuugagugugccuuccaguccuccugagggcccacauuuuucugggaucaccuguuuucuguaaugugcauugaacacacgggccaggagaagagggaaguagaggagcuuuguccucugugcucauccucacagugcugggcgggccagaaggauucagggccaaccuuagggagaugaaggccaguuaaaauguuuuauugccacaaauggugucuuuuaagaaaugaauccauguauuuuacacuuaaaugauauuaggcuacuccgggcacacugccuaugggguagcccugcucugcaaggaguaguaaaaaaaaaaaaaaaaaaaaaguuaaagauacaacuuaguuucucugugacuagggaaaucguccaaguauguaucaaauaaugcuaauugguaccuaguuuuauaucuugauuaggcaacuuuuugcuuaaaauuguuuuggaaugcauuaguauuucuacagcuucaggcugcuuuaucaucuaauacacaguuggauauuuaauauauaguuuuaucaguuuuuuuuaaacacuguuuuugagaggucugaggaaaaaaaagauaguguuaccaaaaauacuucuauagggaaauacugauagaaauguauagguagccuugaaauucugagguuaauaaaaaaauuugaaugcagguaaccuuucauggaguuugucaaauuuuaaauugugucuuacaucagugaugacugaagcaguaaggagugagcuugcagcaaacaguggggauuguugcagcaucagcacuucagccagcucugcagguuuccuuggagacacguggauuucucuuucuagaccuucagcuauuuucuuuuuuuucuuguuuucuugagauggagucuugcucugucgcccaggcugcagugcaguggugcgaucucggcgcacugcaagcuccaccucucggguucacaccguucuccugccucagccugccaaguagcugagacuacaggcgcccgccaccacgcccggcuaauuuuuucuauuuuuaguagagacgggguuucaccguguuagcuaggauggucuugaucuccugaccucgugauucgccugccucggccucccaaagugcugggauuacaggcaugagccaccgcgcccggccagcuauuuucauuuuguuguuucuguaaugcguauuuguauuuaauuuauauucuaaauuuguuagucuuacuggcauuugaugaaaacuaaaaagguaauuuugagauuucaaguacuggugagagaaugucccauagccuugaggguuggaauuguguacauugacagcauagugccacgauacaggcuagcaugaguucuggaggcaaacuuggauucuuacuauuuuuaaagaugcagugucuuugguauguugcccagguugaacucagacuccugggcugaagccauccuccugccucagccuucugagucacugggacuuuaggugcacgugacugugcucggcucagacuuggguuuugaacuugcuggaacauugacauuuacuuaauuccuuugagcccccguuuccucaccuacaaacaguaacucacagaaugacugugauggaauacguaccuguaagaaugugugacacgugagucaguaacacauuguugccccagcuccuuucccccuuaaucggcuaauaauuaagccucaauuauuaguaaacuaauuaagcaucauaugacuugaugauuagcaugucacguuuaaaauuaccuguugucauucagguuauaagaaguuuguuuauuuauuuguuuuuuugaguuggagucucgcucugucacccuggcuggagugcaguggugugaucuugguuuacuccaaccucugccucccgggcucaagcgauucuucugccucagccucccgaguagcugggauuacaggugcacaccaccaugccuagcuaauuuuuguauuuuuaguagagaugguguuacgucauguuggucaggcuggucuugaacucuugaccucaggugauccaccuaccucagccucccaaagugcugggauuacaggcgugagccaccaugccuggccuuauuuuauuuuuuugagauggagucuugcucuguggcucaggcuggagugcaguagcgugaucuuggcucacugugaccucugccucccggguucaagcgauucuccugccucagccuccugaguagcugggauuacaggcgcccaccaccuugcccagcuaauuuuuuguauuuuuaguagagaugggguuucgccauguuggccaggcuggucuugaacuccugaccucaagugauccacccgucuuggccucccaaagugcuggaauuacaggcaugagccacugcgcccagucuuauuuuuuaauauugccauauuuuaaauaggaauggaagauuucugcaccaguccuagcguuuguggaugugcauggaacccuguuggugaaguuuucuugccuuggagaaggacccuaaacaguuuccuaaauagcucuccugucugcgcuugguugcauuccugucguuuuugauucccgcacauaucguuuggagcaucuucguaacccugccguccagucaucacucucuuaaguccaucucccuuguaguuagaaguuaucuuuccacauacuccuguugaguucacaccaccgcuuaacucuucuacuuacaguggaagaguccuaauuccuuaguuguaaaauucuucaguugcgcccuguucuuucuuguccugacucccuccccucccucuuacucccagcacccucacacugacguuccacccuacuaacuugcugcgucccacaugggcugugugcugucguuauuuugccugagcauacgcuguuacuuguguguggaauacuuuugccucuguucucugccuggggagcuuacucuuguuuuucauuucgucaguaaaaugucaguguuaauuuuuccuuuccucauggucucuauaccaucuccccagcacucugugcauauuugucuuuuuaaauuuuuuuuuauuuuuuguguagaugagggcuugcuguguuguugcucacgcuuaucuggaauuccugggcugaagcagucuuccagccucggccucccaguagugcugggauuacaggugugagacccugcaacggccaugugcauauuugucuacaugccugucuuccacuaaacuugaugacuuuuauuauuuccaaagcuagcauaguguguguuauaaauaguaaguuuguaugauuaaauucaaucagaaugacaauauucuuuuaacauuaggaaggcuuugauugguugacuaauggggccagucucacuaaaaugaaacaguugggcaaggugugacccucccuucccuugagagucucaccugcccaaagguaaugggaaggcaggaccgugaccccagguuagaaaagaccaggggacuuagcagaguuuuauuacuuuuuuuuuuugagucagagucuugcucggucacccagguuggcgugcagugguaaaaucacggcucacugcagccuagaccuccugggcucaagccauccucccaccucagccucccgaguagcugggaccaugcgcugugccaucaugccuggcuaauuauuuuauuuuuugagacggagucucacucugucauccaggcuggagugcaguggcaugaucucagcucacugcaaccuccgccucccggguucaagcaauucucaugccucagucuccugaguaacugggauuacagguucaugccaccacacccagcugauuuuuguauuuuuaguagagacgguuucgucaugucagccaggcuggucucgaacuccuggccucaggugaucuguccgccucagccucccagaguggugggauuucagacaugagccaccgcgccuggccaacgcccggcuaauuauuuuauuuuuaguagauucagagucucccuuuguuguccaggcuggucuugagcuccuuagcucaagcguucccucauucucuguccccagaacacugggauuacaggcaugaaccauugcauccugcccgaauuuuauuguuaauuguagcauccugguccauuuucccguccugaucagaaagagagcugugggucuuguuaucuuuuguugguggcaauuggacugucccuggaguaucuguguuggacugggggcacuaagacauuacgacauuggagcuugcucagaggggagggaccagguaggucaggguuucucaggaggaacugugaagaauuguaaggguauauuugccuagagacagaaaaacuugccaagauaaagcccccaaauauccaaagguaacuaugcggaagagaaauugaaccuguaucgcauaauuugaauaaggaccaaagggugaaaauuccuuggagacccccgcuccccagcauaaggaagaauuccuguaguuaacuaaaauucagggcuugacuuuggagauaaugaguuccggucacuggcguuuguucaggcagagaaagguugcacuaauuagugguuauugaaguguggaugccuuaugagucagagcuugaacuuggugauauaaagguccuuuaauaagaauuugaggaagacgcccaauauggcacuuuucucgaaguacuuggagacaacaaccuuuuuuuuuuuauuuuuuuuugagauggagucuuacucugucucccaggcuggagugcaguggugcgaucuuggcucacugcaaccaccaccucccagguucaagugagucuccugccucagccucccgagucuuagcuggcguuacagguguuagccaccagaccuggccagagacaacaacuuuuuaauucugagauucugugguagcauaugccagacauuagccagcugcuuaacuuuuguccagucuuuuuuuuuuuuuugagacagaguuucgcucuuguuggccaggcuggagugcgauggugcaaucgcggcucacugcagccuccgucucccagguucaagcaauucuccugccucagccuccugaguagcugggauuacaggaaugugccaccaugccuaguuaauuuuguauuuuuaguagagacagaguuucuccauguuggucaggcuggucucgaacucucuaccucaggugauccgccccccucagccugagccaccauaccuguccugucuuugaauacugucucacuguuuuuguucugagucuuugaaaagaauguuaaaggucaauaguaguuggaagaacuaagccugacugucucccaacucaugguuuuaccaaaaacucuauuaaaaaacuguugugggccgggcacgguggcucaugucuguaaucccagcacuuugggaggccgaggagggcggaucuacaaggucaggagaucgagaccauccuggcuggcauggugaaacccugucucuacuaaaaauacaaaaaaaaaauuggccagguguggugguggaugccuguagucccagcuccucaggaggcugaggcaggagaauggugugaacccuagagguggaguuugcagugagcugagauugugccacugcacuccagccugggugacauagugagacucugucucaaaacaacaacaacaacaacaacaacaacaaaaaaaaccacaaaacuuguuuggcuggauaugguguaugcccauaaucccagcacuuugguaggccaagguggacagaucaccugaggucaggaguuugaaaccagccuggccaacauggugaaacccugugucuacuuuaaaaaaaacccaaaaaacaaaacaaaaaaaaccacaaaaaauuagucggugugguggcacaugccuguagucccagcuagcugggaggcugaggcaggagaauugcuugaacccgggagguggggagguuucagugagucgagauugugcugcugcauuccagccugggcgucagagagcgagacacuaucucaaaaacaaacaaacaaacaaacaaaaaaacaaaacuucucaauuuaaaauauuuacuccaauuuguggcucacgccuguauucccagcacuuuaggaggcugaggugagcggauaacgaggucaggagaucgagaccauccuggccaacauggugaaacccgucccuacuaaaaauagaaaaauuagcuaggcgugguggugggcaccuguaaucccagcuacuccagaggcugagacaggaaagucgcuugaaccagggaguuggagguugcagugagccaaaauugugcuacucuacucuggcgacagagcaagacucugucucaaaauauauacauauauauguauauauauauaauuuucuuuuuuacuccaaguaagcuaggaguaucuucaguauugcugaaggcuuuauuuaaucaugcaguguguauuugaugguggauuacucucugaauauuuauucaguugaauguggaaugaggugguaugaagaugggggugggggugauuuggagguccuuugacuauuccugcuggcucccuggugaggguguggcaucucugcagaugaguucuccugacugugcucaggcggcugucugugugcccaucgcuccugccugcuuuucucuuuccuucccacuuccucauugugugagaccauccacuccguguauuacugguuccuuucuacuucaucacaagcagguagcacuuaggauauucuagauggagcucagggcuuucuucccuuggagagcaucaucuguaaacaaccauggaaguggaugucacccacuucacaggguggggaagcaaccacagugaguagguaguuuuccaaggaaccacggcuuguuuacgauaaacacccaguuccacuuccaaguuccuacgcugugaacauuacugcuucccuguacagggaaggcagggugguaaauccuugauucuuagugcuugcuggcuuuuuagagugacaugaacucaagaauuuuaaauguagguuuuaaauucaauucagucaauucacuuugaagcccacauucucguuaaggucaggaauugcccuaucaaauuuuuuuuuuuuuaauuuuuaaaauuuuucguagagacaggguuucgccguguugccaaggcuggucuugaacugcugggcucaugcaguuuguccgccucgggcuccuaaaguguugagauuacaggugugagcugccgcacccgguccaguuugguuucuguguccuuuugauguacacuucgucuuuuugaaguuuuuaaacuuuauuuugagguaguuuuagauuuacagaaaaguuguaaagauaguacagggauuuuccuguauaccauucacccaacuucccuuaaucuuucuguaacugugguaacuguggugaauuucucaaaaguaagcaguugacaccgcuacaguauuguuaaauguggacuuuauucauauuccaccuguuuuucugcuaauguccuuuuccuguucuagaaaccauccgaggaacccagauuguauuuaguugucauuuacucuuaguuacagguugucugucccguuguuuuucuugaccgggguguguguguguguguguguguguguguguguguguauguauuuuuuuuuguuuguuugugauaaguugggccugguuagugcuuggaugggagauagggucucguucuguugccugugcuggaaugccgcggugcaguccugacucacuguagccuugacaaccuuccuggcucaagugauccucccaccucagccuccugaguagcugggaugacagacacaugccaccaugcacagcuacuuaaauuuuuuuuuuguugcacagaguucucacuguguuucccaggcugaucuugaacuccugggcucaagcaguccuccugccuuggccucccaaagugcuggaauuauaggagugagccacugcgccuggccugagucugugauuuuggauagcuuuuuaaauuuucuugcuugaucuagcauuagccaguauaguaaauuuuuauuucaauuuaauucugaauugaccuguacuuuauagcugguuuuguccagggcaggaccacagauuguaucuguugugauaauaaucuacacauuuauucauuuuuguuuguuuuuuucgacuuuuuugagauggaguuuuguucuuguugcccaggcuggagugcaauggugcgaucucggcucaccgcagccuccgcuuccuggguucaagcgauucuccugccucagccucuugaguagcugggauuacaggcaugcgcuaccacgcccggcuaauuuuguauuuuuaguagagacaagguugcuccauguugaucaggcuggucucgaacucccgaccucaggugauccacccaccuuggccucccaaagugcugggauuacaggugugagccgcugugcccagcuauucauuuuuaguuuuaauuuuuuuuuuaaaaaaauuauuuucauuuuuuuggagacaggucucgcucucaccccaagcuggagugcuguggcacgcuuucgaacuggucuccaacuccugggcucaaggaguccucccacuuuggucucacaaagugccaggauuacaggugugugccaccgugcccagccaauaucugcacauuuauaagcugacaucucugagagcacagggcaggaugaaauuagaggcugcuguaggucaggguaagggauaaugaugcuggugaagauaaagaacagugaaugaauuucauuuauuucagagguagacucggcagaacuuugugauuuauuugugucugugugcugaguguagugacguuggcgaaggugaacauuucacaggcaccucggagcucaagguagaauuuacuagaaaaugaccagguauguaggagguggggaggauuaagaguuaaauuuuggucguguucuauuuaggaugucugcuggacauccaaguggcugugucaaguagucaucugucuauuugugucugaagugcccaggagaggccugagcuuggagcuuacaucugggacucauugcuaaguaaauuauauuuauguaaugggaaaggaugaaaacccacauguaggaugagaguuggccuugagccuuuagcguucccguaguuucuuuuauuuauuuauuuauuuauuuugagauggagucucacugucguccagguuggagugcaguggcgcgggcgcgaucucggcucacugcaggcuccgccucccgggguucacgccguucuccugccucaccaucccgaguagcugggacuacaggcacccgccaccucucuuggcuaauuuuuuguauuuuuaguagagauggaguuucaccguguuagccaggauggucuugaucuccugaccucgugaucugcccgccucggccucccaaaguggugggauuacaggcgugagccaccgcacccggccagcauucccgugguuucuucagcgggccaguggaggggugaaagcuggugguggaaggcagauggagagagaaguuggacaaggagagcugggaaacgucuguggguggugcuguggguuuuuuacugaccuuaaauaagagccuccaguggcaggcaguggggagcugcagcaggacugggggaugaguccaggcaaggaaguggagcggcuaaggguaagcagugcaggaggagcgcagaggugagggcauccacuccaggggguggcucucauacugccuuuaugcuuuccuuguaggguagccuucauuugguaaggaaacuagccauuugauggagugcugcaugaauaccgagugcuguuaguggaugcugcacguacaugacagagcaggcuuucagugagaguguuuuugguggugaaguaaaucacagcauuccccagcuggccacgcggcccucacccacacccacguucucaccucugugcucacugccucgggaggugucuuccucccauucccaccaccauaugcacaaacacaggcacacaagugcagauagaagaugagcuguuuggacuugcgagggcaugugugcuugguguguggcacauugaauggccucuugcuauauauagugcucagaggggaugauccagaugucuggcauggggagacugguacugagauuucugcucuuguucuguuagugagaguggauuagcagcuucccucuguuucugcuagguacugccacuggcaucacugccaaaaugccaccucagaucguuggcagcaaacuggagcuggagugaaaauaaccucacguagucacucagccaagggaaugagggagacgugaagaaacgcuggcuuuccugcugcuuguugccugcucugucuugugugcugugacugaugggcagguuuuuaguuacugaaagaagauugcgguguuccuacuuacgggagucgacuccugucuuuucucuagagacuggucggaccuguguggcuugaauccuguauguugccaugucauucuaacuaccagggaggaaaucuuucauaacuagggguuccuuaccuuguaacuuauuacaugaagucccuaauauuuuauauugauuauuuccaaauggaguggaaagaacugugcagugguauacccuuaggcacauucuccaauuaauauuuuaucuuuguuuuauuauguauccagcaaagcugauaacguuaaauuggaauaauuacaagaaaauaggaacaaguuuuuuucuaaguuguaauuuuaaaaauacugggaacaaaucuacuuaagaaaaagaacauuuugauacucuaaauuccguaucuuguaguuggcauauuaaacuuaacaccuagaaucuuugcugucauguauuugaagauguacauuucuuuucuaaguuugauguuagucauucugucgaauugauaauguaguuuauauacaucuaaauagauccugauuuccauuauaguuuuuuguuuuuuugaugaaaggacuuccauaaaaacaagaguuuuagguccagguuugguggcucaugccugcagucccagcacuuugggaggcugaggugggaagaauccuugagcccaggaguuugagaccaagaucagcaacaaagugagacccugucucaauuaaaaaaaaaaacaaaaaacaaaaaccaagaguugaaguuuccacagaugugucuuuguggcuuugugauacuguuguccuuccuuccuuccuuccuuccuuccuuccuuccuuccuuccuuccuuccguccuuccuuccguccuuccuuccguccuuccuuccuuccuuccuuccuuccuuccuuccucguuccgucgcccgggcuggaguccgguggcaugggcuggagucugguggcacgaugucagcucacugcagucucugccuccuggguucaagcaauucugcuucagccucccgaguagcugggacuacaggugugcaccacgaugccggcuaauuuuuguauuuuuaguagagacaggauuucaccauguuggccaggcugaucucgaacuccugaccucaagugauccaccucccucggccuccuaaagcgcugggauuacaggugugagccacgcgcccggcugugcagauucuugauuguuguuuuaaaagaguagguuagccagucaaauugaaagaaguaaauugguuaggaaacgucacaucuuaaagcagcagugugcguaguuccuccuugugggaccagaggcuacauccuccauuagagcuggcagaagcagaauggguuucauuguacauuuuacugcccggggaaguaacaagguugaaccacguaauccauaggggaacuuagagaaugaaucucugcugcugguuuuccaccuuccauucgguagugauacuaucuaauuaguguggucaacagggcaauauuguauuucuuugguagaggaauggaugggagcuuggaaccagaggguaaaguuaacgcuaacugcuguguagucaaaggucuuucucucuugggagaugugugggagggcuuuugcuguucccucgugugggugacagaaugguggaaggauggcuuucuauuguucccaugugaaguuaguucagggcagggacaacguguuuguccuuggagccccguggucuugcccgaugccuggcacaggaaugcauugaaugaaagagguaacugacguucccugagcacagaccgugucuaggaacacaugacagacuuugucagcuaguggucaaguggcacggagucucugccuagagucaccuguuguuuaguuuaggcuauuauuaggcuauuucagagcuuuuuuccccgucucuagaagggucuuagggcaugaaucugggaaccaguucccagacaaggucuuggcccagcaggcuagugguuagcucuaguggaaguucccucuguaggccaguaggugcuaaggugacaccaccccuuccucccucuccagacccaucccaccaccgugauuugcccauccccagcagccucaucacugaccaccuguuuuuacuugcaggacccauuccaacaaucucguaaaacaugguggauuacuaugaaguucuaggcgugcagagacaugccucacccgaggauauuaaaaaggcguaaguaguuuuauuucugugguaaugcauuuucacagugguacauugguaauugaguaguauaacuucuucuauugccuaugaaaauggcuuuuaauguaguauaccagucuuugaaugccacauaguuuaauuugacagagcaguuaacgagcauuugcagucuaggccugggcuuugcucuucauuagucagucacuugguuuauaucugaaguugaugauuguuucacugaggaugugagauaaucccaaacaucuuuuacauuggacuuugaaaauggagcugacuuggcauucuugagugccccuuuggaaggcaggggcccagaguacauagcacucaaauuuucuuguugugauuguugggcuccggccuaugccacuggagucccuucugauucauaugaaaguucgagaacugcagcgcugccugugguaccugcaucugugugaccagggccuggccauugugaggagggcaguucagccacagaaggcucucacgguaaccuuagucuguuuaauuaaugagguguuaacugugaauguagaguauacagcaaagacgucaugaaacagauuguuagauuuuaacauagcuagagagcaguuagccuggaauaguuggaaccaacuuaaaaaaauuguuaauaaauaauggagugucuauacugcuagacuuagugggucugaagauagaauuaacuuuuuugggggccaaauaguucauuuugcuuaauuuuuaaauuuuaauaaaaauacagagucucaauauguugcucaggcuggucucaaacuccugggcucaagcgauucucuugccuuggccucccagauugcugcgguuauauuugugagccacuguguguagcugagauaguucauuuuaaaaugcuaaauuacggccaggcaaguggcucacaccucuaauccuagcacuucgagaggccuaggugggagggucacuggagcccagggguuugagaccagccugggcaacaaaaugagauacugucuugaccaaaaaaaaauaguugggugugguggcacaugccuguagucccaacugcuccagaggcugaggcaggagaauugcuugagcccaggagguugaggcugcagugagcuauguucgugccacuguguuccagcuugggcaaccaagccgagacccugucucaaaaaagccaagucaggauggcugacguugccugaagguuauuugaaaccucugccgaggaaccuaguagaagcagucuacugaggagaggucaggcaggcccugaugcugucacuaguagagugagguuucccacacugugaggaagccugugcugcacacuugaggcucacacuauucuuaucaguaauguuaacagccaggcauacuugacagauuauaagacgaagacaguugggaauaccuuacuccucucgaauaaguuaauggauguauuagucuguuuuuacgcugcugauaaagacguaccugagacugggaagaaaaggagguuuaauuugacuuacaguuccacauggcuggggaggucuuacaaucauggaggagggcgaaagacacuucuuacauggcgacagcaagagaaugaggaagaagcaaaagcggaaaccccuuauaaacccaucaggucuugugaggcuuauuaucaggagaauagcacgggaaagacuaguccccaugauucaguuaccucccccugggucccucgcauaacaccugggaguucugggaguuacaacucaaguugagauuuggguggggacauagccagcccuuaucaauggauaagcauaauauguguacagugcuuucaguaaugauggaaauuacauaccuuuaugauagaggucauuagagaguagauugguuuuaguuguuucugagaacauacagguugcugagugucucuagcaugacguugaaguaggaauuuagaaaaggcuguuaccuuuaaaagcagugagauuuccugcacuccugaguguacaguuguauaaaugcugacuuuuaaaaaugagcagaaugauagcuaugggggcgugcuguuagucuaucuuguguacccuuggcuuuguguguugacaguuuuugauugaagacuuaaaggucuguggcugccaccuguucugcaucucuccugagauaccagacucuuccuggguuugagucacacaccaugggccuuccuuccuuggugcugaaguacuggugugcagguccaacagaucugaaggucaacauucaaagucauuuggcacuguuuacacuugcauaucguguuguauuacaccuugauuuuuaaauauuuuaguaguguaugacuggggcauacacaguugaaucuuguccugcauucucauccauugccaaguuuucauaugaacacuagaugauagguaguacugcacacuaaucauuuuuucucuuuugucuuuuguauggucuguuauuuuugacugaggauuucuggcacauuuaggguuauuugauccacugcuacacguuuuuuuuuuuuuuugagacggugucucgcuaugucacccaggcuggaguucaauggcgugaucucggcucacugcaaccucugccucccagguucaggcgauucuccugccuuagccucccgaguagguggaacugcaggcgccugccaugaugcccagcuaauuuuuauauuuuuaauagagacgggguuucaccauguuggccaggauggucucgaucucuugaccucgugaucugccugccucagccucccaaagugcugagauuacaggcaugagccacugcgcccggcugcuacauguuuguuuagguccacagugacauaaauuacuguuaaguauucuggacuccagcuuuaaucagauuuuaguaugguuaagccaagguuuuguugaacauguuguaaguuaaauugagccacaacagcuuuacaguaauaacuugccuaguguuaaaagcacugucagauuaguauacuagucugaaauuuugagggguaugcugcuucucuuuuuuaacguuacccuccuuuugaauauaugcugcuuagguuuugcuaauuagacuagaggauuuuuuuguauucauucauucauucauucauucauucaugcauucauguugagccggaggcucgcucugucaccuagccuggaguucaguggcacgauguuggcucacugcaaccucuuucuccuggguucaagcaauucuucugucucagccuccugaguagcugggauuacaggugcgugccuucauguccggcuuuuuguauuuuuaguagagaugggguuuugccauguuggccagguuggucucgaacuccugaccucaggugauccacccaccucggccugccagagugcugggauuacaggugugagccgcugcacccggccuuuuuuuuuguauuuaaauagcgugcaauuauuuggucaguuggaacucugcaacagaauaugaccuuggucauagaaucuuuguagaagucaguguuuuaacucuguuuagaucuugaaucuggcacagaggguguuugaaagauucugagauccuggccuguuggguggcaggugauucaccuuuggcacacagaugagcuagguaguggggcuggcugaggaaguaggguccugggaaucagaacauggaaggauaugaauggugauguuggaucuugcugcucagugacccaggccuuuuuuucccuuuuuaaaaauuuuuugagacggaguuucgcucuuguugcccaggcuggagugcaauggugcgaucucggcucaccacaaccucugccucccagguuccagugauucuccugccgcagccuccugaguagcugggauuacagucaaguaccacaaugcccggcuaauuuuguauuuuuaguagcguugggguuucuccauguuggccaggcuggucucgaacuucugaccucaggugaucugcccaccucccaaagugcugggauuacaggcaugagccaccacgccuggccuuucuccuuuacuucacauacuugcucagucuugucacugucaguccacguuguggacacugugaucuuuauuuuucuaucucuagagguucguuuguauuaugcuaucaggauuuuuauucuaaaacuuacuuuaaugaguauuuuuacaauuuuaauuuugagacagucuuguucugucgcccaggcuggacugcaguggugugaucauagcucacuguagccuugaacuccuggccucaagcaguugucacgccucagccucuggaguagcugggucuaucuguggcugcacgccacuacgccuggcuaucuggauuuuagaacuuuguguauuucauuguagaggaaagggagguuuuacaguuaaaaccaguauucaucucaccaguuggcagcucugaagccauucucgugguuaaugauguuaguuucaaaagcauaguugauuucuggauuuagaaugugaucuauauccuuuauucuuuccaagauaucggaaacuggcacugaaguggcauccagauaaaaauccugagaauaaagaagaagcagagagaaaauucaagcaaguagcggaggcauaugaagugcugucggauggugagugacagcgagcugcugaaggacccugagcgggcaugccggaaugcggaguggguguugggauccuccucaggguagcacaguauggacucaagugacuuguuuuugaugccuacuggauuuugggcccuucuaagagauuuuuacuuuucucgugaagauuugaauugauuuagguaaccacgagugcuggggagcuccagggcuucuaguaguuucuccuaggauggcuguuuuaaaagcgggacuagacauccuggguuugaggaaccugggagagaggagguugcgggacucaggucacugugcauguggcgugcuugcccccguugugugugaucauucugaccuugcucacccccacuggcuuaaacaauaccauuccaguggagucagcuuuacugcuugagaggaugucauuaguucccaaaaagaggggauggaacauacagcuaaaauuuagauuuccaguuucaggccuguuuuccccuccuaggucuggagcagagguguucuauguuacuggaagucagauccauuggccuaguucacaaaugggugaggggucagaggucagcugucgccuagaugcagucaggguuccaugggggaaguaaaggcugugcauggggccuggggugggggaacagugacagaacuggaaagccacacagugccccugucugcugcagugcuggguggccuguugugagcaaaggccgaggcuuuuccaagguuagggauggacuaacugaacccuggaagugggcacuugguuaaguguaucugcauguggucagguaauuggcccuuauuuacaacaaaaaaaauuuuuuuuuuuuuuaaagaacccaauuugaggcagagguugcagugagccgagauugcgccacugcacuccagccugggcgacagugcgagacugucuccaaaaaacaaaacaaaaccaaaccaaucagaaggaacccaguguaagcuugccaccuucaacagcuaccagcacaccaccagccuugcuuucucuggugacacuguggcccacccccuuuguuuuagaggaaauuccaaacauuuuacuucaaaaaauaugaaaagacauaaaaacaccgauauuugaagucuucuugaaauguggcauuuaaggucuugaacuguugagcuuauucauuggaaaguuuauuuuuuuuaaagagagaggaucuugcuauguuuccuagggaggccuugaacuccuggguugaggugaucguccucucuccucaaguuccaagcaccauugcgccaggcuuguucccuuagauuugugcgcugggagugacagaggagggcacaggccucaguguuaccaucuuggucuucgguccuuguuguuugugugcuaauucaguauugccagauucaggauuuuagggacuaguaacauuaggaaaagugagggccaaaaugaagcuucauauuugauagagcagcuuuaaacuaccacacugaaaagucgcuugguucuuuugggagguguaugagguguguuuuucauguccuuuuaggcagccuucagugccagcuggaguugucuucaaaacauggucauuguucuugccauggcacuggcuaccugaaacugcuugcaagugguuuguuucuaagcucguuuucccauuuuguggaaugugagauuuucuucuacuuuuuaaaaauugagaaggggucucacucuguugcccaggcuggaauguaguggcaugaucacaguucgcugcagucuugaccucccaggcucaagcgauucucccaucucggcuuccugaguaacugggaccacgggugggugccacugugcccagcuaacuuuuuuguauuguguuuaaaggugggauuuugccguguugcccaggcuggucuugaacuccugggcuuaagugauccaccuuccuugcccacgcaaaguguugggauuauaggcguuagccacugcauccagccuaugagauuuuuugaggaacgcagauggugucaugucagaaguaccagugcuucuaaugucauuguuuuuguucugggauauaaguagcauuuggaauguaagugugaagacugucaguggagaggggcacacuagccccaggccuugcauccgggugguccacuucgagggugaaugagccuguaggguguuagguuggcgccuuucuggcacaucugcuuucucccacuugccuaggcccuggcauguuuguuuucgugcugcagauaugguccucuaauuggguuuuuguaguaagauggugcacuucugugguugcaauaaucuuguacuuggucgugugauuuuaauguagcaugucugggcucugugcaguagagugaaagaaacgaucuaauggaauaaagaaaaaaauuuuuuuuugcuuuugagauggaguuuugcucguugcccaggcuugagugcaauggugcaaucugggcucacugcaacuucugccuccuggguucaagcgauucuccugcuucaguccccugaguagcugggaucacaggcaugcgccaccaugccuggcuaauuuuguauuuuuaguagagacuggguuucuccguguuggccaggcugcucucgaacuccugaccucaggugaucggcccuucucggccucugaaagugcugggauuacagguaugagcuaccucgcguggcuaagucccccccgcgccuacucuuguugcccaggcuggagugcaauggcacgaucuuggcucaccacaaacuccgccucccggguuccagcuauucucuugccucagccuccugaguagcugggauuacaagugccugccaccacgccuggcuaauuauuguauuuuuacaagagaugagguuucaccauauuggccaggcuggucucaaacuccugaccucaggugaucugcccaccuuggccucccaaaguggugggauuacaggugugagccaccaugccuggccguaaauacuuaaauauuucuaauaacuuguaaaaauucaacauacugaauuuuuuuugaauuguuuuucaggagagagguacagaaaguuuucccuguugcuuuguuuuguuuuaaagaaaagguggccauacuccuugaaauucaguuguaaaacaucgaaaacugauuuacaacuggggaaauaccuuaucuauugaauuaaggguuuaaaaggaacuuggccuuaccgacuuuucuuucaauuuuuagcuaagaaacgggacaucuaugacaaauauggcaaagaaggauuaaaugguggaggaggagguaaguacgugaguuuuuucuuugaagacaaaaggucuuggcaaguaaguugaguuuguaaaucacgagucucuuggucagagucgauuuuguaucaguaaauagagaugcaacguagaaagcgaacuaaauuggggagaggacagagaaauugauggcauuuaaaagucuuuuacgagacuagaaguauauguugauguauuuuuuauagauagaaacaauuuguaaccauacugcaauauauugugaacauauacccuuagaucagcacuugacguuaugucaaaauauccuaaggguuuaaagagcagauuuuccugaaaagcuaaaauaaugacuuugaagggcguggacuuuguccccaaaaguucccacggucacugggcugugaccagccuccccagggguguugggaaauuauugcuccaaacccacuggggccacgcggcagcuucuguggcuccaggaggccagucgucgaaguggaugcagauacucuuggucuucauaaaccuucauaacaaaucauaaaaaugguguguaauguuacauguuauaugccgaucacggauuuagagauggugaaaaguagugucgaaggggccacugcugcacucauaugccaucagcgcugggcacacucacucucugucaguacagggcucauguuuugaauuauagagaacuucagguuuaugaaauauuuuuguuuuuauuaguucaugauuuguauaauguuuugucaacaaagaauucuuugccuacaaagcaccaaaauucauaaacuaaaagcuguguuguauuugugcagguggaagucauuuugacaguccauuugaauuuggcuucacauuccguaacccagaugaugucuucagggaauuuuuugguggaagggacccauuuucauuugacuucuuugguaaguuaaucacguggguugacuugguguguguccaugacccaaaugagggcuuacuuaguauggccuuucuguugaauuaacauuguauuuuaggcugggcgcgguggcucaugccuguaaucccagcacuuugggagccugaggcgggcagaucaccugagguugggaguucaagaccagccugaccaacauggagaagccacgucucuauuaaaauacaaaauuagccgggcaugguggcgcaugccuguaaucccagcuacuugggaggcugaggcaggagaaucacuugaacccgggaggcagagguugcggugaacugagaucaugccauugcauuguugucugggcaacaagagugaaacuccugucucaaaaaaaaaaaaguuaacauuguauuuugucacgaaacuuuguguuuaaagcagcauuggacuagccugaacaacauggugaaacccugucucaacaacaacaaaaaaaauacuaaaaauuagcugagugugguggcgugugccuguggucccagcuacuugggaggcugaggugggaggauuuccuugagccugggagguugagauugggccacugcacuccagcuugggugacagagcaaggcccugucucaaaaaaauaaaacagcacaguagcuguaaaaucuuuucucuucuuccucuuugaaaauuuaaguuacagcuugaaaaauuaaaauaauaaaggguuuaauguauuuuuuucuuuguuauguauggccuuaauuaacuugcuuuugcccucagaagagacagugguaagggcaugggugcgagugucuuggaaacguuguuucccauugaacaaccaauuggugugugaauuugccacaucauauuccugguaaaaucauuaagcaccauaguacuguuggcaagaccuuucauccguaaacauugugugugaggacuguuguugagaguuugcggaaaggcaccucuagagcaagacugcggaggccuuugcugaggagagaaugguuuuguuaagggagacagugcuguuauagcugcuguuugauuguaggaaaauggauuucucaucaguggcaucucaguccugaugccugguccuaggcguugguguaugucuugggcacaguuugggucaggcacuuuuguuagcugucuccuguuagagucuucucaaccacugggacuuccugaguggugcacugggugaccugagaggucaggauuaaacauguacuccuguaguuguuuuugucuuuugacuuauugaaagggaaacacauuguauguuuaccuccuucauugccuggagcuugggugaagaaacugaacaccaccugcaacucgaggagggaaagagaagaguaguugugucuacagauaauacaggggagaaacguggagcuccugccugccgcaggcacgaagaagcauaaucacucucauaucugguaggucuugggccuuuugcauggugcaguucuucagugugucucaaauggggauucaaagagguuguucuuacaccuuauuaugggcuggcuggcuugaagagagccccuuucugagggaggaaggacagucaguggccucaagcauuuucagggaaacugaagcugagcaggcgauuuccgauuaggggaccgggagacuggcgugcucaucguuuaagugcauuugcuguaaucacugcugccaucagcagaaacagagcucaagaaagaaccauguuuacauccguccuucaucaacccucacaggcaagaaauauuucucuaagaaaaauaauuuacggauugaucucugucuuaaaaaugaccuuugcaucuugcuguagccuucagcaaacugcauuuguugcuuugcaggacagggcaguguuuggguugaaguccuguguucugaucggugauucucauggugaccaagcgaggaagaaggcccgcucuuccaacaccauggcuucucuucuggggcacacgaggugaaacgggcuguccucgugaugucugagaccgggcgucuucaacaggcccugcuuaacauuaugauuaaacagggcuuucuuaccauuauuauuaaacaggccguuucucaacauuauuauuaaauaggccccuucuuaacauuguuauuaaagaggcccuuucuucacauuauuauuaaacaggccccuucuuaacauuauuauuaaacaggccuuucauaacguuauuauuaaacgggccccuucuucacauuauuauuaaacaggccccuucuuaacauuauuauuaaacaggccuuucauaacauuauuauuaaacgagccccuucuuaacaucauuauuaaacaggccuuucauaacguuauuauuaaacgggccccuucuucacauuauuauuaaacaggccccuucucaacauuauuauuaaacaggccccuucuuaacauuauuauuaaacgggacccuucuuaagauuauuaaacgggcccuuucuuaacauuauuauuaaacaggccccuucuuaacauuauuauuaaagaggcccuuucuuaacauuauuauuaaacaggucuuucauaacguuauuauuaaacgggccccuucuuaacauuauuauuaaacaggccccuucuuaacauuauuauuaaaugggacccuucuuaagauuauuaaacgggccccuucuuaacauuauuauuaaacaggccccuucuuaacauuauuauuaaagaggcccuuucuucacauuauuauuaaacaggcccuuucuuaacauuauuauuaaaccggccuuucauuaacguuauuauuaaaugggccccuucuuaacauuauuauuaaacgggccccuucuuaacauuauuauuaaacaggccguuucucaacaugauuauuaaacaggaccuucuuaacauuauuauuaaaugggcccuuucuuaacauuaugauuaaacagguccuuucuuaacauuaugauuauuauuuuaauucaaaggggaagggucccuuagugacugaauuguagcuaauuuuuguuuuccuuggggaaaauaaucugauacaccaagccauagagcaauuacuuguaaagaagguauagagaucuaauuagaugugagugaauaagugaguuuuuaccccuaguccaaggagagaggugcuagucuuacugaagcgcuuuacuguuaaaugcuccauuuuacaugcagaccuauuuuaagaccagguacccuguguuucccaugauuaguguggcagugauacuuguucauuccguucuuauagguguucuagaugacuuccauuuucaggcucucaggauuuacacacuggggaagcugcugcuccauggcugcuauauguauguagucacugagcagccugcugacgguauguuuaauguagauggguguggaugcagagccagagggauuuccgcuuauucaugauguaguucaggggucaacacccuggucuguggccuguuacgaacuggccuguugggaacaggaggugagcggcgcgcaggcaggcaagcauuacugccugagccccaccuccuaucagcucaguggcagcauuggagucucauaagggcacaaacccuauugugaacugcacacgcgagggaccuagguugcgcauuccucaucagaauccaguaucugaaaccaucccccuaccccaacccaucacccacuguguggaagaauugucuuccaugaaaccagucccugguggcaaaaagguuggggaccgcuguugacaaaucauauuuacuagaccugguguacuuuccacgugacgaaaaaguaguuuaaaaugugcuguaagauauuuccgagcugcacuuuacauuuaucagaaugcagaaccccugcuguacuucagaccucccucaugauagguggggaagggugaaggggugccggauguuggacacaugguaugcaggucugugccugagcaccaggcagugcucacugucacacuguggccaaggagacuugggccuggggccugcgguguggaacccguccuuuacagaagaagcccucccaggagaggucgcggaggcggauucuaacaccagccuggaaggaaugcugccucugaauuggagggguacaaucaaaacugcugaggcuaggugacugucgaaauuuccagaauguggagcacaugcaaaugagcucuugucgaaauguuaauuggaaaauauuaauaggcaguggacuuauuugaauuaggaugcucucuuuauuuuauuauuagaggacccuauugcucagugaaaugauguucugagauaggaaagaaaggguaccugauaauagugccuuuugaucccauuagucacagcaggcauuacaucugggaaaagccuguggguuuaacuucacauuuuauuuauauucuuggaaaaccaaagcgaaccuuuaagguuuccagagaggccuuuuauuuuagcagugcagcaaguuuuuccuuuguaaagcaucacugugguacgaaugaugcucuguagcaauagaggaggaguccugugguauguagaaccaaggaaagcagacuucuugcaggaaaaaugagugcauugaggauaguaaccugacuuucugaccugugauuaaauuaugauaguagucagucauuuuacucucccaggguuugaggaaguggccggugaggacuuggagccuagugaggaguuaguagagcugcccaggguggaggaggccacagaggacagcccuggugaagagaacagugaggccuuggauguguugauauccagcaaggaccuggcacugucuagugaggacgaggccugcacaggauguaacuggggccugggcgagcccuucagcgaggagcuggggcucauauccagcgaggacggggccagcccuggggacguagaggagcucggcgaggagugcgaggagccgcugagugaggaggagcacagcgggccagagcuggggcgcugccggcaccaccauaaagugucaaggagcugcccgagugggacugacuuaaaacaguguaucuagaauaaaaugguuuccucuagugccuugauacuguccuuggucagacgaccucagcugccuuggagauagaacugaagaagcaagagagggagguggcagcccugaagcacaggccgggcgucucguaggcucuuucccuagaagccagagcacagacccugaagacagccuugaguuugauccguaccacaaaccgggggcuuaaacuaccaaaauguaccaucucccaguccuggaggcuggccaugugagacccagguauugcagggcugguugcuucugaggcugagaugugucccgucuugcuccaggcccuuccccagcuguucuucucccuacauuugcagacggauggcccauccgauguugacaucaucuccuuugugucugucucuguguccauuggauuuaauguuuuagagacagauuucacuguguugcuuaggcuggccuccaaccgcuaggcucaagcagucuuccuuccucagccucccaaguaacugaucacaggcaugagccacugugcccagccacaaguucccccuuuuuauaaggacaucauuuauauuggcuuagugcccacuguaaugauuucaucuuaacuugauaaucuauaaagagccuguucccaguaaggucacauucacagguacuggggauuaggacucuaauuuaaucuuuuuuggggaccaugauucaaccacuuuaacaucauauuucuaacggguagauuuuugugcuagucuuugaaauucacagccaagcagcaaauuuugaaaggugaaaggaggaggaaccuuuaaaguuagacaugugcccucaccccucgcucugagacagaguuuugcucugucacccaggcuggagugcaguggcacagucucagcuuacugcaacuuccgccucccagguucaagugauucucuugccucagccucccaaguagcugggauuucagguacccaccaccacaccuggcuaauguuuguguuuuuaguagagacggaguuucaccauguuggccaggcuagucucgaacuucugaccucaggucaucugccugccuuggccucccgaagugcugggauuacaugcgugagccaccaugccuggccaaaguuagauguguuaaugagagcuagaaguuaggggucaaguacaggcaugggaguggcacagcagauuggaucggugugugcuggugaccuggacccacuaucauuacacggcgcuacagcaguuuguuuguaaugaguguucuuugauuacuuuggacagaguucauacacaggcacaccuacacacaggucacuuagaagaaguuaaggagucuuuuuaaauacacauaaaaacaucacauacuaagccaggcauggugguguaccccuguaaugccagcuacuggggaggcugagguaggagauuccuugagcccaggaguucgaguccagcuugggaaaaauaaugagaugccaucucuaaaaauuuaagaaaaaaagguuaaaaaaugaaaccgugauguacgagacugguuuccagcuaaaguuguuggaaccauccuuguguguaauuucacauggucgugaagcagugggcagucccgcccggcauccccacgcgcucuuccucucaucuggugagaguuucuuggagaacaugccaaacucauguaugguugugugcguauuugagaacuccucguguugagauggagcuguuuuuuggaaguaucucauuuuuuuugagauggagucucacucugucgcccagcuggagugcaguggcgugaucucggcucacugcaaccuguaccucccggguucaagugauucuccugccuuagccucccaaguagcggggauuacagacaugugccaccgcgcccggcuaauuuuguauuuuuaugagagacaggguuucuucauguuggucagguuggucucgaacuccugagcucaggcgauccacccaccucggccacccagagugcugggauuacaggcaugagccaccgugccaggccguucauuucuacugaaaauuauccuggcuagugaggaugggugccauguuagugaucugcgauucuuuugugcuguuuuucaguacauacuuggucguuucaggaccuuuguuuccucugacguccucccuuaaauagggagaggaaaugguuccuggaaacggucauuuugagaauuuucugugcugugagaacugaggcucuggcuaccccucuaaaaggcuugagccaugcuguaagaguuugugggcaguguuucugugguguuuccucccuuguauuuugugguguuggucccccuaacaggucuuuguauaguguuugguucacauuguuggcaugacagucaccugagcaagacguugccugaguccuuugucaguuuggguuuucgcaucaucuguuuccagugggauuuuggucccuggucaacuuguggacaacuccagagauugagauaguugccguauccuuagugcucccagggggagauguucugggacuguaggugcaagauguaggaagagugauuuaaacuugaggcugcaggcagaccugauacuguguugggcuuugacagguuuagggaauaccaguauuuauaggcaguaugauaguguagggggacagugagguggaaggugugaugguggaggaaagaugaaucggccaucugcgaguagggcucagaaaagagccuggagccugcugcuguucuggugguuucuucccugagcaaugaggacugugguugggaagaggcccauuccuccugacgccagaguuccucaucucauguuggcucuuuuguauuugaaauagaauaauuugauugcaguguauuguggauucuuugacuucgauagauuuuuguaacuuuugggaaacagauuacucuaaccagaccugggaaguagcuagaaauuauacuuguaauaaaaaacaauuauaugggaagcugaaaauggugguguucauuuaacaaauauggcgugccugcuguuuagugccaggcacuauucuaggugcugguuuggcaguggagagaaacacugaagcccuguucucagggcgugcacuucagggcggagcuccggccguguucuucauuggcucccauugcguguuguauuccagauuccuaacaguuagguuauuugcuacuucugaaaaugugaguuguaauaaaugagugccugguuuugagaggaguugggagagcagaggaagucugucuuucaugcuugccuuuugaaucucaagcguuucucccuuuugagggcggcugucuagguuuuagcuuuggaacuugaggagagagugacauauuuuccuuuguuugaaauagccauggugcuuuuucaguuuuguuuugcugucauuuuuuuguuccagcuuuucugugcacuuggggaauugacaguggguccugaaaucaugacagcaggccucuccugggccgcggcugggagugugcugaggaagggcgagcuuagugcugcccugagaugaacgugguuggugggaaucccuucgcuucguugugaagcuguuccuguuccaucagguucucaugcuugguaaagcucagagaaaauguguggguuuaaaacauguucuccacuuccucaguguucuucaaguuuguauguggguaaauguuuguuacauguguuuuguggucaguuuucucacacuguucauuguauauauauauuuuuuggucauaaauuugugacuguucuuuagauagucaguuuaguaucuuguuaauguuaugggccccuuaaugcauuggucuuaguauuccucagggaauagcaugauauugcaaaauuuuaaagaagcucuugcuauacgaugcccagaauguugaaauggaagaagugucacugaaaagagucaaacuguaaaauauuugaagagauguauucugagccaaauauaagugaccaugcuggugacacagccucaggagucccaagaacauguguccaaguggucagggugcagcuugguuuauacauuauagggaggcaugagacaucaaucagaucauaaccuguaaucccugcacuuugggaggcugaggcggauggaucgcuugaggucaggaguuccagaccagccuggccaacauggugaaacacuaccucuacuaaaaauaaaaaaauuagccaggcgggguggcaggcaccuguaaucccagcuacuugggaggcugaggcaggagaacugcuugaccugggaggcagagguugcagugagccaagaucgcgccacuacacuccagccugggcgacagagcaagacuccgucuugggaaaacaaacaaacaaaaagaaauacauuguuuuggcccagaaaggcaggacagcucaaagcaggggggcuuccagacuguuggugaaugaaaacauuuucugguugacaauugguugaguuugucuaaagaccugggaucauagaaaaaaaauguucagguuaagauaaaagaucguggagaugaagguuccuuugaagucucauaguggcugcccuuagagacaauagaugacaaauguuuccuuuucagaccuuuaacaugugcuagacuuucaguuaaucucuucaggauugggagggucuggaagaaaaagaucuagccauguuaauaagacuguucacagaugcacauuucccccacaaaggauggcuuugcaggacaauuucaaaugguuuguagggcaugacuccccagaccccuuagguaggaauuugggcaagauaaaaaaucagaacucaguccucaagaguuaaauccuaaugcuguuucaaguaauguuuguaccucaggauacaaaguuaagguuugaagacccauuuaaagaugcuucugaagagaugagcauacauguuuugcuuugcagaaucugcaugagucuagagaaacugccacugggggagaaacguguauuacaaggaaggugcucacgacucuaacccucaccacuguggaagcuagccaguaaaaucugucaggacuggagcagucuccucccccggggugggauggugugggguggggaucacaggcccccaggugauuggucgaggcccauccacauuagggaggcaagcugcuuuaccagucuccugauccaaaugcuaaucucauccagaaucacccagaaggauguucggcucaauauuugggaacucugugcauggcccaguuaaccugaacaugaaaucaaccacauguccaucuguugucaacuuggcacccauaugcauuuccuuaacccagggcuuaaucgucaagugagggcaagaacaaggucauagccaccuaacacgauccacuaucccacagacaaccaacagugcacuagccccuugcccagcgcaggucacguucuccugugauguuuacgguucuccuugauacgggguaacuuaauaggcaauauguguguauuacauaagaggauaagagagggaagaaaacugcuaugugccuaaauauaacaugcauagauuauauaugacaaguauuggucacaaaauaaggaggaaauacuccaggcauugaugguccucguuccuguaacugguccuguggacacagccacuuucuuccacugcccauucuguggucuuguggccuucagcaggcaccucacugguugugguucuuucuggugagguaaaguaaaaaagaaguugguagcacauuugauuaacacgugucuuaagauuuauuucuaagguauaaaaguaugaucaguuguuuauaaauccaaaaguaauaauacaugcuggguuuaagauuugaaaaugggaaugaggugagaggaggaggaggucuugccccuccaccccaguuggagccccacaggaacguuguagcacgugcuguauaguugugaugcccgcggucggagccccacgggagcauuguagcacgcgcuguaugguugugcguuguagcgugcgcuguauaguugugaugcccacaggcuuccuugcauuucucuccagcucugcuagccacgaacacuucaagucugcacuucacaugcuugcuugccugugcaugguuacgcacgcucagcaacuuaguuccacguuuugggaugaguugaguucccugacguagaauugcuggguugaggguuuuuuauaauaaaaauauugguuuuauuuugggggcugaagguuuuaaaagcuuaauacauacuucuagauugcuuuucaaaacgacagaaaccagcacaugauaaguagcucuuacuugaaauaaggacuugucugaucucaaguggcaacuuuuaacuggucuuuaaauauuauaaauuuugaaauuauuuuaauguuucuuagcacuguuucuguuacaaaugagacuucauuuuuaggguaauuugugauuuuaauauuugaaauuauacgaguuaaaauucagugaauaccugaauugugaaaaauuauauuuaagcuacaaaaugucaguagagaaauaaacaagauaaagauuuuuuucauacaagaaaauggaacggaaaagcauuggccuucucauaacauaguacucagccagcuuuugagguagcuucuguagaugaugauauaauuaugaaugucauugucuuaauuuagcuuagaaugcaaaccaguuaaaaucacuugguuaguacuguuaccacugagacacggguucaagaugcauguaaaagcucagugccuuguggacaacuucuaaggguuuaguugccauggauuuaaagaaauugugacuaaaccaauguuuuagcauugauaaaugggaaauugcggaaggauguaaacguagaguuuaacucuacaacuuggcuuagggacucagguauggacagugagaauaacuugguuuagggacucagauauggacagugagacuggccacaugagugccuuucucacugucacacucuuacccagguuggagugcaguggcugucgacaggugugaucauagcucccugcagccuugaauuccugggcucaagcaguccugccucagccucccaaggaggugggacuaaagauggugugccaccacaccuggcuaauuuuuaaauuuauuguagagaaggggucuugcuauguugcccagguuggucuugaaccccugaccuccagggaucucuccugccuuggccuccucaggagcuggaacuacagauauaugcuaaugucuucaauuuauggaaaugcagaaaugccuuuuuuuuuuuuuuuuuuuuuuuugagauggacucauguucugcugcccaggcuggagugcuguggugugaucuuagcucacuguauccuccaccuccgggguucaagcaauuuucgugccucagccuccuggguggcugagacuacagaugcccaccaccacuccuggcuaacuuuuuuguauuuuuaguagagacaggguuuuaccauguuggccaggcuggucucaaacuccugaccucaagugaucugcccgccucggccucccaaaguacugggauuauagcugugagccacugcacccucccggaaaugcuuuuuaacggucaccuccuaggggagaugaagagaguuaccgcauaaucaguuuuaacuguauuuguaauguuuguuucuuuaccugggaggauauguuguagauacgugagauagaauaccuaagugacacaauggugugcaggcuauggcugcaaaguagaaaguuucuaaauagcaugcuuggauuuuuauuugaauuggaugaaguuuuuguguccuagagaaauucacaaaauguuccuaguuucagauaaaagguuaugauuuaacaucuuugcuuuuguucuuucuugucuuugaauagaacagugggggacgguaaggucuguuugcaaaguaccuaugaccaucuuacauuauuuuuauggguggggggcauugacuguggaaugugggcaguaacuugcacagucaguaaccguuugaguaacuucuuguuggcauccccauucuggcacuccuccucuaggucuccaccucacacgcugguuugugggcggaggggcagguuggugcgugggguguccgggcacuggcugugcaugccuucuuccucuucugucucuuggccaccuuuuccaaaaagucaccagugaccaauucucccaguguuucuuugggacucaaugccuugggcuuggcauuggguaaagccaacuggccaguuucauucugacgagcucuauaguaguccgguguggaccucugcccucccugcucugcggaagcuuccucagccuuugcuucucacuauuuacuauuugcggguccuggggguacccagcgucucaggguuuuggcugcccaccuguacgucgguccuuucaaacuguggucagagucaaccucaggugcugcuuuucucuagucacugcauuuuuuuuuuuuaguagagacaaagucuugcuguguuguccagccuggauucaaacuccugagcucaaggaauccucccacucagccuccagaguagcuggaucaagucacucuuguucauaaccucaguugcuucaugaaucucgauuucugcuugauuucagugcuugcuguuguauccuugugugcugcaguauuuauuguuaacauuugugacucaaauguauccacucccugcuuugguugcucuggccugcaaguaggccguacuaauucuguaguugguccuagcuugccuuugucuuuaccuugcaugcguuuaugucuuaaugcaccuauuaggauuccuugcuuuuaucacagguuucccauuuuucugaaaaaauuacaguaauuauuaacgcagaacccagguaaauuaaaaagguuuguaugcuuuaugaauuuuuaguaaguacucauugauugauaacagcaacagaggaaaacaaaacggucaguuccgaucuugauuuccaggagcacuuuguguuuccacuuggcagcgugaugcuuccucaugucggugauuuucuguugagacaucuucaagcaucaucuuacgucugcuuguuaacauuuguucagauuugauuucagcuaauccuuaaaaguuuuuugagacaucaaacuuagaauaaaaggaauuuccuuugccgagauucaucagguauuuacacuuagcuuacauggccacaccauuccucgugugugugugugugugugugugugugugugggcgcgcgcauguuaggguaauccauuuuucuguuuguuucugaauugcuuuggagaaggcaacucagacuccaaggaauacaacagcugccgugugaagcuuuucucacuuuuccaguggucguagcaggaacagcgucuugaccucacaucagugacgugaaaagagcugaguuugaagugcauauugguccuccauaaagaauguguguaugugcuguuuuuuuaauuaagucugguaauuuauuugauacaauguauuguaguuuuaguugaauuaaacuaguuaguaaaacuguuggugagguaguguuucaguuacucuguagauaagcucuuuuguuaaaaccucuuaaguuuuuuguuccugaauauguuacaaacaucuauuuucucuuacuguagcuaucacaugaggaaaaaaacuugaaaaaaagacuucauaguguguguuuauguuugauuuuagaagacccuuuugaggacuucuuugggaaucgaagggguccccgaggaagcagaagccgagggacggggucguuuuucucugcguucaguggauuuccgucuuuuggaaguggauuuucuucuuuugauacagguauuaaaucccuagguuuaaucucuguuaucuuaacagcaguuaguacuuauaaaaucauaauacucuuuuaguuagagugcuuuaaaauauguguauaccuuucguagaauagcauuguggauuugccagcuuuuuuugguauacaggucugcgcuuaaccuacauuuucuccuaaucuuccuaagaaugucgugcuuggaaaucuucuccucuuaauauaauaaucaaggccagaauguaaugaaauucuuaguuaaaaaggggcaacauauguucugcaucaguagguggaaaguaacgcaguuggaaaaucucacuaaccuucaugcugucuaaccuccuuuguaguuaaaacaaaagugcacaaauagcauccuaggagcaucccacuggauggaaucgaaggcugggccuuaccacuagcccaggccaggcucacucacuagugaagugucagccucacgcacguagcucuucauaguucaccgauggaaacaagcuuguagacuggaguaacaugaauaugcauauaucaugauaugccuguguguuuagccugaagaaucccacuuuucucugaagcucauccaguuucucuucacaaaggagcuuuuuuuuuuguuguguuuuguuuuuaaauuuaaaaagagucucacuuuagugagugccacucuuaguguaguggcacggucucagcucacugcagccucccgccuccuggguugaagugauucuugugccucagccuccugaguagcugggaucacaggugugcaccagcaggcccagcuaauuuuuguauuuuuaauggagacaggguuuuugucguguuggccaggcugguguugaacugaccucggguggauccacccgucuuggccucccaaagugcuaggauuacaggcaugagccaccacuccuggccuggagcugcuguuuugauucucucauuuuuauuuuuaagccuccacgauaagaauugggagagcuuguuauauaggguuccuucuucaucauggucagaauuuuauuuucuuugaacauugcgcucaugccaucuagguaaguagugaauucugcucgauuggaccucaguuuugaugugcuuucccucaacagauccucucauuugauaccauggaauaugcugaccacagguuaagaaagcuaguuaaaaauaccacguaaauuguccuuuuuaaaaguaaucaguggcuccuguauguguguuugugugugugugugugugugugugugugugugguggggguguaagccuucuccacuucugaggugccuuacaaaguaucacaagaauaaauacuuagcgaggcuuaauugagaccagugcaguagccaccagccacguguagcuccugagcccuggaggccuggcuacuccuaacggagaucagcaggagugugaaauagucauuggguuucaaagauggaacaugggaagcaguguaaaauaccgcaaaugauuuugauuuuuuguauuuccaauugaaauauuuuggauauacuguauuaaauaaaauacuaaaauuaaugucacuaguuucugcuuuuuagugaaaucauuagaaaagguaaacuuaacauaccugguucacauauuucuucaggacaccaccagcccuagacaguaucugcgcuuagaugauugaaucauguucagagguaugcgucauuuguguuaaugggagcauuuuggaaacaggacaaaagcucuaaccaguagaccagcuuuaauaucgaaaaauagguuugcuuuagugugacuugugaaaguuuuuaguguccacacugcgauaauauccauaauguauaauugagaaugguguucaugaacuguagaaccauaguuuuuugagacgaauacuuguauucuuucugcaauuauuuuaguuuuuuaauaauuuagauucuuauccccugugguccuguggcaaagaggagggaagccgauuagguuugcuguucugugguggugaggucacucuguuccugugggguaagaguguccaucacagucuguggaguuuacaagccacgccaaagcaaacagagcuugauaccgaggcugcucugcugguuggagcuuaauacuggucucgguuccagaauguucacauuaacacaacacgugcuucauggugccaagcagaccacccacaagcaggggcugucuuuggcaugucagaaaagcugcuugggucccgcgaagcucugcaugaggagagggggaggggagaggcugcacucucgcguugcccuagaguccccacucagggaucugagagacagucuuucccccugggcaccccagcacuucagcugaggccuugauaguugcgucguuuauuacuccucgguucuaugccuuaacauuaaauauucugcuacugaacuuucaaacucuugucuuugcauuacuaguugacauauuucuuuaagcauuuuucuuuucuguuuuccuguaggauuuacuucauuugggucacuaggucacgggggccucacuucauucucuuccacgucauuuggugguaguggcaugggcaacuucaaaucgauaucaacuucaacuaaaaugguuaauggcagaaaaaucacuacaaagagguacugugguauucugcauuuuauauuuuuaguaagcaggcguaacguuucacuggugccauguugcacgucucccagagugugaaguagagguuguuguaugcuaaaucuggcgccaugaaaaucuuuugcucuccaaauucauuaauuaaagccuuuucucuuaaauuuuacuuaacuguugaauuauuagagggaaucuuuaauguaauacaguguaauaaguuucugcagcauuguuaaaaugguaaaauggaaaaucauuaauaguaaagccuuuacuguuuuauagccucugcauguauuuagcauccgccuguacgguauuugagacacaauuuauuuugucagguuaauucuauuuuaggaaaggaagauguguuguugacagguuggcuucagccauguuuuuacagccugaaaauuacuuauauucaugguguauuucaguaauguccuuaaacaacuuaguuacccucacacaugcauuuucuuuaccagaaagguuuuuaaaugaauuuuuuuccuacagaauugucgagaacggucaagaaagaguagaaguugaagaagauggccaguuaaaguccuuaacaauaaaugguaaggagcagcugcugcgcuuggauaacaaguaauucaacgcacgcacuuaacagaaauguuaaacuauaacaagcaccauuugaggauuaacaggaacauuuuuuugaagauuucaaacgaacucgacuuucaguauaauuguaccuaaaguauuuauaaacagcucaucggagccucuauuugucauagacuuuugaguugauuguugggaccacauaauaggaccauuuuuuuuuugucuuuaaaauuguuguaaaucucuguaugcacuuugcuuuuuuauuaaacguacuccaaggugagucuugacucuuuaguguaggacaagauuguacacuaacaccagcauggaccugcuuuucauugugucugaaaugugagccacguagugucggccugcugugaaguuaacauugccaggacgauucuucuacagaaauaauuucaauuuuuuucaguauuuaguagugaaagauauuaauacauuaaugguaauacauuucugguuuaauauaaauuaaggauguuuucuaguugugcaugaaugcuggcaacuuaguaaguuuugacaauuguuuaaauauguaauguuaagcuuagguuuaaaaaaguaaagcugguaaacugggucuuugucauuugcuuuaaaaaaaaaaaaaaagaaaauaaaugcgaauguguuggugcauucuuccugagugggaucugga

SEQ ID NO: 191458 - RNA, 4828 nt, Homo sapiens
uuaaaaagaaagagaggaaaaaaaaagaaaaaaguguuuauuauaggcaacaacaccaaugggaacugguauuugucuacaccaagggagugcaauuuuucaucuuccaauggcggccucaaccuugaggcgaauccacuggcgaaagaugccuuucuaggaagcagagcucccugacugggcuaagauaguucagauugaucuuaggucaaugguaagaccuauguaguucaugaagucuuggcuuuucggcgcugggucgcccaaagcagaauggagacggauagagugguggcucccagaaucccgaagaacauaagcagugagaacgagcccugugaacaacagaccaaaaaacacccccauacaacguuacacggagggccacauccuaacaccuaguucuuuccuaauauaccuaucacuuugucuagggcaauucuauaguuuuccaccuauaggaaauuuguaucagcuccuggucuuguggcucuccuuucugagaagacuugcucuaugcauuccuuguaucccuaguuagacggccuaauuccucaccuggcgcauacacuuguauccauggaaaccaucagcacaaacacacugcaaaagaccuggaccaucagguacacaagauccauucucaggacacauuucuggaggccagagagaaauagagaacaucacuuuauccauuucauuaggcauauuucucaauuaucuguuucaacuuagauucucucaaucauugcuaggauaaaggaagaagaaagaaaauuacagauaaaaacaguaacaauaaugucaggccucugagcccaagcuaagcuaucauauccccugugaccugcacguauacauccagauggucugaagcaacugaagauccacaaaagaaaugaaaauagccuuaacugaugacauuccaccauugugauuuguuucugccccacccuaacugaucaauauacuuuguaaucucccuuacccuuaagaaguuuccuuguaaucucucccacgcuuaagaagguucuuuguaauucuccccacccuugagaauguacuuuguaagauccauccccugcccgcaaaacagcacuccuaacuccacugccuaccccaaaaccuguaagaacuaaugauaaucccaccacccuuugcugacucucuuuuuggacucagcccaccugcacccaggugaaauaaacagccuuguugcucacacaaagccuguuugguggucucuuuacacggacacacgugagacaaauaauagaguauaucuuaagaucuuuucuuucaaagggguuauagccccagaacucugaaugaaaggcgcuuaagcaacuuugucuuucugaucuaaaguggaaaauacaagggagaaaagacaauucccagaaguuuggagguaagacagcauaccuggguccccaguguuauugcaaagguucuuuugcccuugacagauuugguugucuauauaagaggugauaguauuccaggcauuaauuccuccaggacaguugacauguuguggcaguauccuauagagaaauguggucauaacaugcaaaguugcuaaacucacagcaucaucccucuuugauucucuucccauacccuuacucacagagucuggagcugaguaaagccacggaagguguuggccaagucaccuuugaggggguuugcuugcaggucucugcaaaguacacaauguuagcacuuucgcaucaaccuacauuauauuagccuuuugggugggagguaccuaacuacuuacaugaugacagugguaugugccugaugaaaguuuggaccaggguccuccagagaacaguucuggagauccagccugaggaaauaaaguaaucaauauaacuguguguuccucuuuuucuucagccacggcacaguuuguauuugacuacacaacccccuuuucagcuaauaauugaacacagcuguguucagagucacacacuaggagcugugguagacauuuuaauucugcauuauccaauagaaucgccacuugccacauguaacuacuuaaauuuaaauuaauguaccuuaggcuggguguagugacucacuccuguaaucccagcacuuuaggaggccaagcgggggaggaucacuugaaccuaggaauucaagaccagccugggcaauaugaaugagacccugacucuauagaagaaaauuaauuuaaccuaaaaauucagugucucauuugcacuagccguauuucaagugcaaauggaauaaccacguuaguagcuacuguacugguuaguacagauacggaacauuuuccuuuuuugagacagucuuacucuguugcccaagcuggagugcaguggcacgaucucggcucacugcaaccuccaucucccggguucaagcaauucuccugccucagccuccugaguagcugagauuauaggcacaugccaccacgccuggcuaauuuuuguauuuuuaguagagacgggguuucaccauguuggucaggcuggucuugaacuccugaccucgugauccgcccaucugggccucccaaagugcugggauuacaggcaugagccaccgcgccuggcucggaacauuuucauaaucacagaaaguucuauccgccagcacuguucuaaucgguuaugcaucuauugggagaaaucuguguuucuugucuacauuagugaaucucauauuaugauuuucagauccacagagggccuuuaaauuaaaaaaaaaaagucacauaaaucaaaguuuuuuuccacauguauuuucuaccacagauugguuguaaacugcuggacauuaaggaucaugccacguuauuuuuuucuucaauaucuacugcuauccauuccuuuauucuacaaauauuuacugagucccuacaaacugcaaacacugggagaauguuaaaaauauguaacacaguauuuuggccuuugaguggcuuacaauguaguuagaggaacaagagcacugcccaaaaauaaaagcacuguaaacauuaaauuacaauauaaaagaaaccacaggacaguguauaaauauauuugaguggacacuaaagauuacaggaaguuuuuaaaaaagguauuacugaaucgcuugaacccaggagguggagggcgcggugagccgagaucaugccauugcauuccagccugggcaacaagagugaaacuccgucucaaaaaaauaaauaaauaauaauuuaaaaaagguauuacucuggaacuuaguaguaguaaauauucacaaaagauguuggaauugaaggauggauauuuccuaauuugguagaggaaggcaauuucagguauggagagaggccugaacaaagguggaaugccuuugagggcaggcaaaucuggcuggugcagaccauuauggagguuugagcggacaaguaauuggaaauaauguuggaaaaguggguugggacuaguaugguacuuaaugguuugaauuuuguccugagacaaaauuuaauacuaaauauaguauuaaagcaagagagugauaauggaaaauguugguuuucuaaaagcuuaauacagagaaguauuuagguagaugaaggaaagaagagaauggaagcaaaacauaacauuuugaguuugaaguuagggugcacucaguaggaaaugcuuaauaggaagcuagagguacccguauguaccuggaguguggaaagguuaaaaaagacacuaaagagaucuaguuuugguagacaucugcgugaugauuacagcugaaaccauaauagguggauucuuuaaauaauauaaggguauaaaagcagccaggcuaaggaauggccuguauccagcaucuagggaugucuuccccucaccccaagauggugcccuucugauucaggcagcaacgggcaugcagcauuagcucucgugucguuuuacaauaaaaggccacuuuugacaaauuuugcacgcucccuggacauugggugcauaucugcagaagagaaagaaacauuagaacuccagaaagaaaagccaagaaaagaacaaacggcgaucaagaauuaacugccaguacacguuuccagaauuccucuaacacggggccgauaaauggauaaacggcucgugucccacccuuguaacaggcuaggcuaggagaugccaucucuuccuccagaguccugcgccgaaucagcucccgacacuuucaguaccagauaucgcacagggaagguccucaucucugaagaucacuauucgaacuuauuuauuaugcuuucugcagagacuucucaaucugacagcccuaguuuggcgcgguguaaaacgaccgcagguacguaaagaacucaucaagcauuacaaaaguacagcccuaccaccgcacgauauauggcguucgugcguagagagauuacacaagaggcagaggacccgucuguagaaagaacuuaaaguuauucuaaaauuaaggggcgaaaucaaguuucacaggucuuugaaagucggcaggacuggggcgccgaaggccugcacgacgugaguacuugggaacaggaccuggcugggcagggucgggaagcgucagggacgaaaucagaaccgcaggcccgccgaggagaagggggagccgcuggcgagcgcgacgcacggcuggccagcgacccugcuucagcccgaccucaaacuugcuucuguaccucggguagcgccagagcccuuuccacgcccagagcgaggagcagggcggcagcccagggcaccagggucguaagacuacccgggucgugaggcgccauuuuccguucccuuggugc

SEQ ID NO: 191459 - RNA, 28436 nt, Homo sapiens
uacgauuagguuuuggccuuuagucugaaaaaguguugauugaaaguguacaacagagagcgggugcaagcggccgagggccauggagccgccaauaaaaaagaauguccuuaaauaaaguucacagaguaaaaaccagaaccgccaguccuucccuccaacacaacagagcacaggcacagaaccggugaugagcccgaggagcagaggcggcugggaaggacagcagaggcucccggcugcaguguggagggagagcccucuuuggaaugggcggagugaagccacccagcucccccugcacaccucauacccacugcuaaggcuaaaggaaaaagacaaaacucagucucagguccggagggcucagaaaacagucuaggugggcaggggucuggaugacugcuagucucgcuuggccuucuucuucuugucgcuguugccauuuucuucagcccccucaguagagagcaccuccucuaguuuucgcuugccacucucuggcuggagcucugcuguguuucggggcuugaagcaaaugaugaugcaggucauguugucacacccuguaccauccccagaagugucuggugccaggcacugauccagcagcuaagaaagggauggggguagcucagccacaggguuugaacaccuugccaggaaucuacagucccacaagagggcuggcuugcugagucagggugguaggagaggaaugggcaagagguaucacacaacggcccaccugcuaguccauaaggcauaaggcuaagucagggaaaugacagaagguggaacuuuggagucgggguuuagcgucugucagcaauuacugauaaugcucccagauugccgacuuagcucagauuaaaagagugaacccuggcugugcagaccagacacccucucuucuccacccugguacucaccucuuccacaauggaugacaauaaccgaagcuccccauuuucaucacgcuggcugaucuuugauugaaugaaaucuacaacuuccuggcugcucaucacauuccuggggucaagaacaacagucagaaucuuccagucucacuaaggcagcguagaggaguauggacagaggugguggcccaggccaguguaaauaacuacagaaauucucagcucugccuuagucugggugcucuucacccaccaagaggccuaggucugccuaggcucuaauccuagaggugcccugaguccuauaagagaagacaugcugcagaaaggggaauuuagggcauucugccagugcucaccagaugccaucacaggcaaugaccaugaauucauggucgucagugagagucagcaccuugaugucaggaagggcugaaaucaucuguuccucagguggcagguucuuguuucucuuauagaagugguccccuggaguaaaggaaugguugaugagcaguuuggauacuucccacagacuuguguuuguggcaggucaaaccuugccauucauuucccuucuuuacaaaguuccauaaucuaguggaauggggaacugaguccuaaguccuaguuuuucuaguuucaacccugccaccagacugcugaaccuuaagaaagucacucacuggucuuuuuauuuuaagucuuuuuuguuuuuuuuuuuuugagacggaguuucacucuuguagcccaggcuggaguguaauggcacgaucucggcucacuacaaccuccgccucccggauucaagcgguucuccugccucagccuccugaguagcugggauuacaggcuugcacuaccaugcccagcuaauuuuuguauuuuuuuuuuuuuuuaguagagaugggguuucaccauguuggccaggcuggccucgaacuccugaccucaggcgauccaccagccucagccucccaaagugcugggauuacaggcgugagccaccacgcccggcacucacaggucuuuuucaucauucaaauguuacauaagauggguauaaugauaccuauguauaaugauaccucuacccaucuuaguuauuucacagaaauauaagaacagagguaguagauauuaaagugcuuugaaaggcacaagcacuaggaagauuaaaguuugcuacuagguagucugggacagagagaaagacccuagaagucuuucccaguuucuuggcccuuaccaauggcucuggagagguugaggcccccguugacucgcccauccauggugaccuugccaccagcauucuugaugcgugcuaguucuacuucauccucugguuugugaucauaggacaugucuaaagcuuugccagccucagauaccacacagcgagagucuccugcguuggcuacaaucaacugcuucccucguaucagggccaccaccgcuguuguaccacugucagagccaggcuuaagaggaagaaaaggagcaucaugggggcuucugaacaugcguuccucacugaugugcuccugaucguucaccuaugcuugcuuucacugggacccccaaaagagcuuuaacaaacaggagaagcacacauuucaucuuucuagagacagcagcacacucccucucccuuguuuuuagauaauucaaccccaaaggcuuaccaucucauuccccuugcagaauaaauccccaugacuauuacuuccauccuaaaguaucagggggauccccugucucaaaaucaaaauuaggggauucacaccugccuuguggcuuuucaagacucauugcuccccuuccccacacaccuccucuuugccuuccaucccuggcaccaucaucucuucuucuucuucuucaucguccucuucagccuccucggugucauccucaucuuccucauucucugccuccucacugcuguagccauccucuuccucgcugcauuccugccagggggaggaucccagacugcugagacugggaugauccccucccuccccacagcucauacucagaaucaagagguccugacugaacacagguccucaaaacacugaaagauacaaguauauggucaugaaaauuggggggauggaaagggcuagcaugaguacaacugacauccugaacugggcuuagcagucacuagcaaaaagcccaggacaaggcaagggcugccagccaaaaauaucuuucaggcacuguggccagaaaauaaauuuuccagagaagaaaacagucaacuagccaagguaacaacuaucuccuuguucucucucuaggagacagacucugaaaagccagaacuagaucugcuuguuauaguaccaacaaaggaagagguaaaaaggcaaaugguaccugugaugauggagcucaaugaauucaagacuaaagcuuagaauacagugggucuugggggaugaugucaaaauaggagaaggaaagagaguugaaaacuacagacggcaaccaaacaggaccucucugcaacuucagcaucugccugcccucacaggcccuuaccucacugucuuccucuucuuccuccgccucaucugacucauccucacuguccucaaagaacuuggacuuagcaacucgaggcagcuugucagaggcugaagagcaggaaggcccagccucaccagugggaaugccaggcucaccaacuuggccugccucagucccacguuccgaguuggaggaaaagccuguguaggccuuggcuguggggccauuuucuugugaaggaguuucccuaguugaguccucagguccugccuccccauugaggcccugggacccugguuccucgccugucccaccuccagauuugcuguggggagggcccuugugacaguucugcccguagcgugucagcagcucuucaauagucaugguagccucuucaugcagcagugcagccuccucauuguccacugcagggaagaggcuaaaucagagcccccaugccagacuccucaugggauccgucccucucacuaccucaacagcccuugcagccucuaacuuccccacaaccucccacucccaagguuccucucgcucaagucucagaagaacaugcccuagcuccuccuccuccacagacuucuuuugguuuuuguguuucauccccuucuuaaucaaaacaacacuaguuacuauacuuccccucugacgucucauuuuuuauuguuaaguuguaaaaacccuauucuggcugaggauccaggaagcccacaaugcuacugugaauuaggauuuaggcuuaaugauuggcuauuggggcuaauaacugcuccagucuugaggggaaaaaaaagcacauaaauacuagcaggaaccaggaagaccccaucacaaugacaaaagauaauguauauacaaugcuuacagcucagaugccacucaacgaagauaauucucucccuccuuuucauaaccacauacaaugcaggagaacaucauagguuucuuuaacauaaggacuccccaggucccuagaaagccauccuaucuuagaauugauaaguaauauuaaagaauauuucuuaaaaugcugauuuccccucaaacaagggaugccacacucaccaucaucuucaucagcuacuuuuucuuuuucaucuucauccucagugggucgcccugcaaucugugccagcucuuuaaugacuucuucaguggucaauuuggcgucaauagccaagaaggcaucuucuaaagccugaauauaagcaaaauagucuaagacuaguacaaaaugaacucccuauauacaauccugagcacaaggauggaauacaaauuaagagugugagccaccacacuaagagacacucacagauaaaaacagcucagaggccuaggaauaauaaggcaagucuaaaaggcggccaauaagcucguuuuaggaacagaauucuucaagaguaaauaagcagcagcagcuagaggacaaaaagaaaggaaaagcccaagggcuagagaacaagggaaaagccuacacaagugaggaaugggcgguguaagcagacagaccuucuguagcuugccuuccuuguaggccuucugaucuuugaugauaucaggaagauauuuggcacaguacaaggcaacuuccuccccuagaaggaaaggaaggaaggucaccuggagcacugcuccccacacauagaaagugauacaauauuuauaugccauacuggagugaaccccaaggguugaggggauaaauaucuuagcaccccugaacccuauuugaaggacacuguuuggggaaguucugauccaaaaaaauggauuucaccaucaauucucucggguauaaauaucucgucuuuucucaccuguauacuuaguucuccagugaaaaaaagauaaagaaucagcucaacuggguacacuuuuuuguuuuuuaagacaagagucuugcucuguugcccaggcuggagugcaguggcauggucuuggcucacugcaaccuccaccucccagguucaagcgauucuccugccucagccuuccgagcagcugggaccacaggcgcccaccacuacgcccagcuaauuuuuguauuuuuaguagagaugggguuucaccauauuggucaggcuggucucgaacuccugaccucgugauccacugugccgggauuacaggugugaccuaccgcgugcccagccuaaaaauuuuaaaaaauaaaaauaaaaaaagauagaggcucuuuggauuaaaacaaguccuggugagauuauaaaccaauacaguaccuacugggaaaaaagaaugacagaauacagaaaaacagcaccacgcaggaaaugauaaugagggccagacccuggaaaguaaaugaacaaagggaccuguucuugcccuggaacgucuggaauugggguccuagaauguuaccaauaugaucuguuaaaguuaccuccauguccaucguagacagaaaacauggcugucucacuguccagcucaggaauacaguugugagcauccuaggaaaagaagagcauaaucggcaugucucaaggucgaagaauauuccucaggucauagggaucaaugucaccccuuacuaaccuuucccuggcuggccuauauggccuagaaauaagaaaggaagaaggaaugauaaaauaaauacagaggaagaaaagaggagggaggcaaaggaggaaaggggaaggagaaaaggaagaaagaaucagguuacuaccucuauaauaaccucaaccuaggagauaucucaguccagauggcagaauauuuggcuacuggaaauaaaccugacccuuuuggaucuguggaagcuacgggaaaaccagaauaaaggauuuuuucuucuuuuuuuuuuugagacagagucucgcccugucacccaagcuggagugcaguggcgcgaucuuggcucacugcaaccuccgccucguggguucaagcgauucuccugccuccgccugcugaauagcugagauuacaggcaugugccaccaugcccggcuaacuuuuguauuuuuaguagagaugggguuucaccauguuggucaggcuggucucgaacuccugaccuugugaucugccugccucggccucccaaaguguuggccaggcuguacacagcuuuauuuauuuauuuauuuauuauuauuuuuugagacggagucucgcucugucgcccagccuggagggcaguggugcgaucucugcucacugcaagcuucgccucccagguucacgccauucuccugccucagccucccaaguagcugggacuacaggcacccaccaccacacccggcuaauuuuuuguauuuuuaguagagacgggguuucaccuuguuagccagaauggucucgaucuccugaucucgggauccacccgccucagucucccaaagugcugggauuacauaagugagccaccgcgcccggccuacagcauuauuuauaauaaaaaacaguugaggccaggcgugguggcucacaccuguaaucccagcacuuugggaggcuaaggccggcagaucaugaagucaagagaucaauaccauccuggccaacauggugaaaccccgucucuacuaaaaauacaaaaauuagccaggcgugguggugugcgcccguagucccagcuacucggaagggugaggcaggagaaucacuugaaccccggagguggaaguugcagugagccaagaucacaccacugcgcuccagccugggugacagagucagacuccgucucuaaauaaauaaauaaauaaaauaaaaaacaguuguaaccaucuaaauuuccaggaauagauuacaaaugguacguaacuccaguggaaauguagcuguuaaaagcaaauauauguuaauuuggaaaugaguucacaauaucuuaagugguuaaaagcaaaaaguuaaaaaaguaucuacaugugaggacggccacaguggcucacuccuguaaucccagcacuuugggaggcccaggcaggcggaucaugaggucaggagaucgagaccauccuggcuaacauggugaaaccccgucucuacuaaaaauacaaaaaauuagcuggaggugauggugggcgccuguagucccagcuacuugggaggcugaggcaggagaauggcgugaacccaggaggcagagccugcagugagccgagauugcgccacugcacuccagccagggcgacagagcaagacuccgucucaaaaaaaaaaaaaaaaaauuaucuacauguauaugugagucuggaagaucacauagcaaacaaccacagagggugagauuuggguaauaauuucuacuuuucgacauucauuuuuaaauuuuuguacaauaaaccacauuguuccauucugaauaaggacaacaaacacaccuaagaacuggccucaaguugccauucuaccauauacugcaugaucucuggucagcuaccuuauggugugccucaauuuuauccucugugauguggaauuacaauauccaccacauccacaucaucacagaacuguuguaaugaugcaaaacacauaaaagcccuuuguaaacuggaauuugcuacauaaaaauauauauauauauacacacacacauacacauauauguauauucugcucugaaauuuagcacccauuucacauuuuucuuuuuuguucuuuuucucaaagaggaccacccacaauaaagauucgucuuacaccuugaggucucaguccugagaacuaucgcacaauuacccucuccuucacuucuuggugaggcuugggaucuauauuaugauuuggaacuguuucaccuucccuaaacacuuuaauuugcccccuuuacaugucugcucauaaccuuuacccacaccuuugcuucucucuaucccuuacugagacagagccaaguauuucaacauggucucuuagaaaucuagaaaaacucacccaaccuuguauaaccccaccaacugauuuaugccugaaucagaacuacuaaguuugcuagucauaaaauguuaugagauuggcuaggugcgauggcucacaccuguaaucccagcgcucugggaagguaggcaggaggacugauugagaucaggaguuggagaccagccuaggcaacauagcaagaccccgccucuacaaaaaaauuuuaaaguuagccaggcauagcagcaugcaccugcagucaguccuaacuacucggaacacugaggcaagaggaccaccugagcccaggagguggaggcugcagaaagcuaugaugcaccacugcacuccagccugggugacagagggagaccccaucucuaaaacaaaacaaaguuauaggaucacauugacugugguaauuacuucauuucagcaucuuguuuucuuuuuuuuuugagauggagucucccaggcuggaguagaguggcgcgaucuaggcucaccauauccuccacuuuccagguucaagcaauucuccugccucagucuccugaguggcugaaauuacagugggcaccugccaccacgcccagccaauuuuuguauuuucaguagagacggggcuucaccauguugcccaggcucuucucaaacuccugagcucaagugaucugcccagcucggccucccaaaacgcugggauuacaggcgugagccauugcaacuggccaaacacagaaauuauccucucuuccuagauuaacauuuuuucuuaaacuccugaucucaaauccuucuccuucaaggucuuacuacacagagaauguaauaaccuuaacagcaauccaaauagccguuuuggcaauggcucaugcauguaaucucaacauuuugggaggucaaggcaggaggacugcuugaggccaggaguucaagccugggcaacauagugagaccucaucucaacaacaacaacaacauccguaaacagccauucugcagacuucauuuccccuagccauuaugucagauuaaacaguacaaaccaugucaguuuuuuuuuuauuuuucaauguuuauuuuagaaucacagaauacauguguaaguuuguuagaaagguauacugugugaugcugagguuugggguaugacugaacccguuucccaggugcuggguauaguaucaaauagguaguuuuucagcuguuccucugccacacaacccccacccccacccugccgcaccaccaccucuaguagacccaugucuauuguugccaucuuuacauccauguguacuugauguucagcucccacucucacugcgugagaacacgcaguauuugguuuucuguuucuguguuaguuugcuuaggauaaugcccuccagcuacauucauguuguugcaaagacauuauuucauuauuuuuaaugggugcauaguauuccaugauggcuauguaccauauuuucuuuucuuuucuaguccgccacugaugggcacaugaguugauucaauguuuuugcuauugugaauggugccacaaugaacauacagguacauauguucuuuuggcagaaugauuuauuuuccuuuggccguauauccagccaucagauugcugggucuaaugguaguuccacucuuaguucucugagaaaucuccaaacugacugugccuacgcuaaauuaauuuacaccuucaccaacaguguacaagugucugcuuuccucugcagccucaccaacguuucucauuuuuugacauuuuaacaaaagcuguucugacuggugugagaugguaucucuuugugguucuaauuugcauuugucugaugauuagaaaugggcguuuuuucauguuugugggccacauguacgucuuuugagaaguaucuguucauguccuuugcccacuuuuuaaggggguuauuugcuuuuugcuuguuagguuccuuauagauuuuggauauuagacuuuuguuggauguauacuuugugaauauuuucucccauucuauagguuguuuacccccuugauaguuucucuugcugcaugucacuuuucuugaaagaucucuuggauucuguguaguucuauaccucugacugccuguuucuacaggauguucuuuuuuucuuucuuuuuuuuuuuuuugagacagagucuagcucuguugccaggguggagugcaguggcgcgaucucggcucaucacaaccucugccucucggguucaagcaauucuccugccucagccuccugaguagcugggauaacaggcacgcgccgccacgcccagcuaauuuuuguauuuuuaguagagacgggguuucaccauguuggccaggauggucucgaucuccuggaccucgugaucugcccaccuuggccucccaaagugcugggauuacgggugugagccacugcacccggccaggauguucuuucucucuauaccucaaacuuaacacauguaaucaggaaaucagcagucugcaaaaaaaaaaaaaucaagagcuuccccuacaggucuuauuucuguaaauggaaucuuaacucucccagacaacacuuaauaccagagucaugcuuaacuuccuggcugucuuccaccauccaucacugaguccugcaugcaguccuucaucauguuguuguuccuggauuacuuuguuuuguugguuuguuuuguuuuuuuuuuuuuuuuuuuuuuuugagagagagaaugucucccugucacccaggcuggaguacaguggcaugaucucagcuuacuacaaccuccgcagcccagguucaagugauucucaugccucagccucccaaguagccgggauuacaggugugugccaccaugacuggcuaguuuuuauauuuuuaguagacacgggguuucaccauguugcccaggcuggucucaaacucccgaccucaggugauccucccgccucagccucccaaagugcugagauuuaggcaugagccacuacgccagcccacaguacauuuuuuuuuuggggggggggaggguaccaaauuuauuuauuugaaggaaugguacaaaucaaagaacuuaagugggugucuuggaacaacuuauagaaaagguaaaggaaaccccaacauacaugcgcugccuuggugacaagguaagucacccuauggcuauggggaaauuagccugaggcuuagcuuucauuaucacugucucccagggugugcuugucaaagagguauucugccacgccagauucgggcgcucccaucucgugcauguuggucacguggucacccaauucuuugauggccuucacuuguucauucagguaaugugucucaaugaagucacacaaaugggggucauuuuugucaguggccaguuugugcaguuccaguagugacugauucacauuuuuuuccaaauguaaugcaaaaugcacaauuuuuuccaaauguaauccaucgcauucagcccgcucucccaucgcauucuccccgcacagucugguuucuugauauccugaaggaagauucggccaccucguugguucuacagcuucaucaauuucucagcauguucccucuccucaugagauuggugaagaaaguauuuggcaaaguucuucaaagccacaucaucgcugucaaaguaguaagccacgcacagguaaauggaggaggcguagagcuccagguugaucuggcgguugauggcggccucugagucuuggugguaguucuggcgcaccugcgagguagacgcggucgucaugccggcgacuaaggagaggcggcggcagcggcagugguggcuacgcggcgcuggagcugcggcgggggccuuggggcaguccgagggcauggugaagaggugacggagggcuggcuaugggcggccggccggggugcaggacgagcgccggguuccguccaagcacuguugaagcaggaaaccccgaccacucucggcgaagaacgucucaacuuuuaauuaucauauuuuuuucugagaaagagucucacucugucgccaggcuggagugcaguggcgcaaucuuggcuccccgcaaccuccaucucccggguucaagcaauucuccugccucagccucccgaguagcugggaguacaggugcgugccaccacacccagcuaauuuuuuauuuuuauuuauuuauuuuuuuagagacagagucucacucugucguccaggcuggacugaagcggcgcaaucucggcucacuucaagcuccgccuuccggguucacgccauucucccgucucaaaacuccugaguaccugggacuacaggugccugccaagacgcucggcugauuuuuguauuuuuagcagagacgggguuucaccguguuagccaggauggucucaaucuccugaccucgugauccaccugccucggccucccaaagugcugggauuacaggcaugagccaccgcgcccggccuaauuuuuuauuuuuagcagagaugggguuucaccauauuggucaggcuggucucgaacuccugaccucaggugauccgccugccucggccucccaaagugcugggauuacaggugugagccaccgcacccaccaacaguaaacuuuaguaauaaaaauuaguaaacuuuuccuuucuggaguaguaauuuuuaaaaaauaaucacuauuucaucuuaccauaugcuuucaucuucaggaaacacacuauaauggcuuuaagcuguuucuuaguucauaagugauagcucagaagcaucugaauuauuuucccugaauuucacuaccuggccuagugccuacauaggcuaaaucauuucugaucauucacaugcucaagaucuucuuguggcugggcacggugaccccccuguaaucccaccacuuugggaggccgaggcaggcggaucucuaggucaagagauugagaccauccuggccaacauggugaaaccccaucucuacuaaaaauacaaaaaaauuagccaggagugguggcacgcgccuguagucccagcuacuugggaggcuaaggcagaagaaucacuugaacccgggaggcggaccaggaggcggagguugcagugagccgagaucgugccacugcacucccgccuggugacagagugagacucugucuuaaaaaaaaaaaaaaaaaaaaaaagauauucuugcaacuggaaugauauuucauuuuccaggaguuugacacaauuuaggagguuuuuccugcacacaauggccacccauuuccaauuaaacauucauaaaaacaccacaaccacccaccucacuaccucauacccauuagaauaggaacuauuaaaaauaauaauaauaaaaauaaaaccaggcacaguggcucacgccuguaaucccaacacuuugggaggccaaggcggguggaucacuuggggucaggaguuugagaucagccugaccaacauggugaaaccccguuucuacuaaaaauacaaaaaauuagcugggcgugguggugcaugccuguaaucccagcuacuugggaggcugagacaggagaaucacuacuugaaucugggaggcagagguuacaaugagccaagaccgugccauugcacuccugccugggugacagagugagacucugucucaaaaaaaaaaaaaaaaagaaagaaagaaagaaagaaaaacuuaauucuagcaccuugggaggcugaggggagcagaucacuugaggucaggaguucgggaccagccuggccaacauggcaaaaccccaugucuacuaaaaauacaaaaauaacuggguguggugguacaccuguaaucccagcuucucaggaggcuggggcaugagaaucacuugaaccugggaggcggagguugcagugagcugagaucaugccgcugcacuccagccugggcaauagagugagacucugucucaaaaacacaaaacaaaacaaacaaacaaaacugguugggcauguuggcucaugucucuaaucucauuauuuugggaggcugaggugggaggaucacuugugcucagaaguucaagaccagccuggguaacacugugagacucugucucuacgaaaaaauuuuuuaaauuagccacaagugguggugcacaccugcagucccaccuauguggaggcugagguggcaggacugcuugagcccagagguugaggcugcagugagcuaucacauugcaccacugcacuccagcaugagcaagaauaagaccgucucaaaaaaaaaaaaaaagaaaaaggaaaaaagaaaccauuaaaaaaaaacagauaauaacaacugcuagcaaggauguggagaaacugaaauucuuguguacuguugguggaaauguaaaugauacagguguugugaaaaacaacauggaggcugggcacaguggcucacgccuguaaucccagcacuuugggaggccaaggcagguggauaauuugaggucaggaguucgagaccagccuggccaacauggugaaacccagucucuaccuaaaaauacaaaaauuagccggguguuguggcgagcaccuguaaucccagcuacgugggaggccgaggcaggacaaucacuugaaccugggagguggagguugcagugagcagagauggugccacugcacuccagccugggcgacagagcaggacuccgucucaaaaaaauuuuuuuuaaauuaggcagucacuaaaagacaaauaccauaugauuccacuuacaguaugaaguaucuaaacuaaucaaauucauagagacugaaaauagaaugcuguuugccaugagcugggggaaagagaauggggacucauuuaauggguauggaguuucaguucuguaggaugaagaguucuggaaacuggguacacaacaaugugaauguauuaaauacuacucaacuguacauuaaaaaaauuuuuaaggccgggcgugguggcucaugccuguaaucccagcacuuugggaggccgaggcgggcggaucacuugaggugaggaguuagagaccagccuggucaacauggagaaaccccgucucuacuaaaaauacaaaaauuaacugggcaugguggcgcaugccuguaaucccagcuacucaggaggcugaggcaggagaaucucuugagcccagguggcagagguugcagugagccaagacugcaaucauugcacuccagcauaggugacagagcaagacuccgucuccaacaaaaaaaaaaaaagaaaagaaaugacuaagaugguaauuuuuauguuaugaaaacuuuguuucccuugaaacagaguuuugcucuuguugcccaggcuggaguacaauggcacgaucuaggcucacugcaaccucugccuccgugguucaagugauucucccuccucagccuuccaauuagcugagauuacaugcaugcaccaucaugcccagcuaauuuuguauuuuuaguagagaugggguuucuccacguugcucaggcuggucucaaacucccgaccucaggugauucacccgucuuggccccccaaagugcugggauuacaggcgugagccaccaugcccagccacaaugaaaauuuuuaaagaaaaaaaaagccaaaaacuucccacaaagaagagcccaggcucagaugccuuuauuugugaauucuaccaaacauuuacagaaaaauuaauaccaaugauucacaaacucucccaucacauagaaaagaagacaacacuucccaauucauucuaugaggccagcauuacccugauucuaaaaccagacaaagacaucacaagaaacuacagaccaauaucucuuaugaauauagacacaaaaauccucaacaaaauaguagcaaacuaaauccagcaccauauaaaaggauaauacacauugaucaaauaagacuuauacaccaaaaaaaugcaagguugguuuaacauucaaaaaaaucacuuaaugcaauauagcguaucgguagacuaaagaacaaaacccuaugaucaucacaauagguauuauaaaggcacuugacaaaauucagugcucauuaaugauaaaaagacucaaugccagucugggcaacauaguaauaagacccugucucuauaaaaaauuuuaaaaaauuagcccaguaugguggugcaugcauguaaucccagcuacuaagaaggcugaggcaggcggaucucuugaaccuaggaguucaaggcugcagugagcuaugauugagccacugugcuacagccugagggacagagcaagacugucucuaaaaaaguaauauaaaauagacucaacaaccuaggaauaaaagggaacuuccuaaaccugauagaguacaucuaugaaaaacucagucagccaggcacgguggcucaugccuguaauacucccccaguugaucuacagauucugcauaaccccuauagaaacccaggugccuuuugugcagaaauugacaaauuaauccuaaaauuuagaugaaaaacaaauuuuaaaaacauuucaaaacguacuaaaaagcuacaguaaccaagauaguguauuacuggcauagggacauguagaccaaugaaauggacuugagaguucagaaauaaaacccucacauuuacggucaauuuaucucugacaaugaugccaagauaauucaaugggggaaaagaacagugguuuaaacaaauagugcugggacaacuugauauccacacacaaaagaaugaaguuggaucacucccucauaccauucacaaaaauucacucaaaauggaucacagaaacagcuaaaacuauaaaacucuuagaagaaaaccuaagagaaaauucucgugacuuuggguuaggcaaagcuucuuaacaaaaacaaacaaacaaaauagacaaauuggacuuuaucaaaaguaaaaacuuuuguuucaaaagacaccaucaagaaagcaaaaagaggcugagugugguggcucacgucuguaauccuagcacuuugggaggcccaggcggacggaucacgaggucaagagaucgagacuauccuggccaacauggugaaaccccgucucuacuaaaaauacaaaaauuagcugcgcaugguggcaugugccuauaguccuagcuacucgggaggcugaggcaggagaauggcuugaacccgggaggcagagguugcagugagccgagaucaugccacugcacuccagccuggcaacagagcgagacuccgucucaaaaaaaaaaagaaaaaaaaagaaagaaagccagcaaaaagaaucaggguguaguggcucaugacuguaaucccagcacuuugggaggcugaggcaggcagaucaccugaggucaguaguucaagaccagccuggccaacauggugaaacccggucucuacuaaaaauaaaaaauuagcugggagugguggcacacaccugggucccagcuacucgggaggcugaagcaggauagcuugaacucaggaggcagagguugcagugaaccaagaucgcgccacuccauuccagccuggguggucagagcaagacugucccccgaccaaaacaacaacaacaacaacaacaacaaaaacaaaacaaaaaaagaaagcaaaaguccacaaaaauuggagaaaagauuugcaaaucauauaucuaacaaacuuguauccaaaacacauaaagaacucuuacacaucaaaagacaaaaagacaauccaauuaaaaauggacaaagacuuugaacagacauuucuccaaagaagauacacaaauguccaauaagcacauaaaagauguucaaacauaaggccuggcaugguggcucuagccuguaauccagcacuuugggaggcccagggaggcggauccuuugaggucaggaguucgacaccagccugaacaacaugguaaugcccugucucuacuagaaauacaaaaaauuagcugggugugguggcaugugccuguaaucccagcugcuagggaggcugaggcaggagaaucgcuugaaucuggacagagugagauucugucucaaacaaaaaguucaaacaucauuagccauuuagccaucagagaaauacaaaucaaaacuacaaugagauaccaucucacacccaccauuaguuauuauaaaaaagguggauaaguguagugaacaugugaaggaacuggcauccucauauauugcuggcaggaauguacgacgguacagcaacuuuggaaaacaguuuagcaguuucucaaaauguuaaacacguaguuaccauaugacccagcacuuccacucuuugguauauaaccaagagauaugaggacauauuuccacacaaaaauuuguacauaguaucacuauuuauaauagcaaaaaaaaaaaaaaaaaguggaaauccaaaaugucuaucaacuaaugaauggauaaacaaaaugugacaaauccauaccauggaauauuauucaaccauaaaaaagaacgaaacacugauugauucaugacacaacauugaugacccuuaaaaauauuacgcuuggccgggcguggugguucaugccuguaaucccagcacuuugggaggccgaggcaggcggauugccugagcucaggaguucgagaccgcccugggcaacacagcgaaaucucgucucuacuaaaauacacacaaaaaauuuagccgggugugaugguggguaccuguagucccagcuacucgggaggcugaggcaggagaaucgcuuuaacccagaagguggagguugcagugagcugagaucgcaucacugcacuccagccugggcgacagagggagacccuguccccaaaaauaaaaaauuaaaauuaaaaaauuaugcuuaggcacaacuaugauacaucaacugaaaaauaucaggcuggguguggugacucaugccuguaauuccagcacuuugggaggcugaggugaaaagauuccuugaggccagggguucaaggccagccuggacaacacaguaagacccugucuccaugaaaauaaaugaauaaacaacaauaauuaaaacugaccuccuggagauaagaaaaagaguuaacuaggagauaagagaaaauucaagaauuguuaagucauuaauuugagauggaguucugggucuuuugcuucccuuccaucaacuaagugaggaagguuccaacagaaacaaaugggagugccuaaaagaaaacuagcaucucuuuccugguuacacaggcaacagacuuggugaucugccugagcucugucuaucugaacagaaggagagaauuuuaaaaagugcccacuggagccugaaccauccugcugguauccauccaaaggaguccagcaguaugaggucaaggauacacagcaggugguaaaagccacagaaaagucuaaaaaccaaaaguggagaucaagucccucugggccaggccuggcuauugcugcaaacacagagauggugagugauaacuggauaugagacuggaguuuuaaagagauuucugauucuauuaagcucuguaaaauaaaaccugcaaggcacugaucuagaaagaagcaaaagaaccuugggucagcaaaauacuuauucuuaaaucuacuacaacaauguaugugugauuuuuuuaaaaagaaacuuacaggcaaagcugagggguagagggaauacuugggguggagaguaauuuacucuuccaggggccaacaagcuuuaaagucaauuucaaaaauacacaugcuuaguaaaagcauccagauauaaaagguaguguauuuagaauuccauuuauaaaauguucagaauaggcaaauucauagaggucauguaaauuaguggaugccagggguuaguggacggaagauagggagugacugguaaagaguacaggguuucuuuuugggguucuaaaacugauuguggugacaguuguacaacucuguuugaauacacuacaaaacaggcaggcacgguggcucaugccuguaaucccagcacuuugggaggcugaggcaggcagaucacuugaggccaggaguucgagaccagccugggcaacauggugaaacccuguuucuacugaaaauauaaaaauuagcugggugugguggcgugagccuguaguuccagcuacucaggaugcugaggcaagagaauucgcuugaaccugggagguggagguugcagugagcugaggcugcgucacugcacuccagccuggguaacagagcaagacccugucucgaaaaaagaaaaaaagaagaaaaaaaagaaaauauacuaaaagccacugaauuauacccuuaaaaugaaugaauuauacccuuaaacccacugaauuauacucuuaaagugaguucauauacuguaugguauaugaaccauaugugguaugaaccauacaguauaugaacucuaucucaauaaagcugauuaaaaaggaaccuguaagaaauaaauaaaauaaaaaggaaccuguauacacauuuucaaauacuaaauaugauuaaaagguguuguuuuucugcuagcauugggucaaaaaggaaaaaaaaguugauauacuucaucucugaacuagaucuagaaagaaacaaaaacaacuacacugaaaucauacucugucuacaaaaugucauuaaacaucuuaagcucaguucuaaagauuuguuuccagauaauacaaugucaagaacuacugaucagaccuguauaaauuucuauguucaaauucaagcccuuaccucucaaaauucaauucuaagacuaauaacccaauagaagauuagagguuagggaaacaguaguaacaacugcuaaggaaucagacaauagaacuuuguguaaaauauccuugaaaucuugaggaauacguucugauuguauuuuccaguugcuugagaacuuauaaggcaaugguauaaaauauaaaauaauuucuagaccaggcaugguggcucacaccuguaaucccagcacuuugggaggccgauguggguggaucacgaggucaggaaucgagaccauccuggcuaacauggugaaaccccgccucuacuaaaaacacacacaaaaaauuagccaggcgugguggcgggcgccuguaguccagcuacgcgggaggcugaggcaggagaauggcaugaacccgggaggcggagcuugcaguagcugagaccgcgcaacugcacuccagccugggugacaguguaagacuccaucucaauaaauaaauaaauaaauaaauaaauaaauaaauaaauaaauaaauaaaauaaacauaaauaaaauuccucagccugggcaacacugcaaggcccuaucucuacaaaaaaaaacuuaaaaaaaaaaaauuagccagucaugguggcaugugccuauauuaggcugaggcuggaagaccccuugagcccagaaggcuaugcagugaacuaugaucgagccacuguaaaggcagauaaguguagugaggaugugaaggaaccggcacaagaaaucccauacuccuuaccacucaagcaugggcaagagugagauccugucucaaaauaaauacauaaauaauuuaaaaaauaaaaaggccgggcacaguggcucaugccuguaauuccagcacuuugggaggcugaggcgggcagaucacuugaggccagaaguucaagaccagacucgccagcaugggaaaaccccuucucuacuaaaaauacaaaaaaguuagcugggcaugguggcgagugccuguaaucccagcuacuugggaggcugggguaggcaaauugcuagaacccaggaggcagaagcugcagugagccgagauggcaccauugcacuccagccugggcaacaagagcaaaacuccaacuuaaaaaaauaaaaagaaaauaguuucuccaugcucaugggcauacaugugauauaauucuauacuagcuuugaacugugaauggguacugcaugcuaaucaaaugcaaauaaugcguuuuuauaaaaguugcuaaccacauucuagacaaagaaauucuggccaggcgcaguagcucacgucuguaaucccagcacuuugggaggcggaggcgggcagaucaccugaggucaggaguucaagaccugccugaccaacacagagaaaccccaucucuacuaaaaauacaaaaaauaagccaagugucguggcacaugccuguaaucccagcuacucaggaggcugaggccggagaaucacuuaaacagaaaggccagugagccgagaucacaccacugcacucuagacugggugacagagacucugucuaaaaaaaaaaaagagagagagagagaaauucugaccugguuuaguaaguaaaaagcgcuuuaagcuauuggcuauugauaugagaugcuaaucugaagauaagaaaauaaauguuuuucaaccuucaaugcccuaagguagaaccccauagcauacuugugauauuucuuuuuauauuuuuuccauuaauuuaaugacugaaacaaauaugcagguauuuuaagaauuuucugcucaauacuaucuuuauagucaauucuagaugaccccuugaccacuaauaagccagcuucuacacagcaauaaauagccagccuccucaaaauuauacuauagauauugacacugccuuuaauaaaaggaaaauaugauuuauagcacaaaaaauuccuggccgggcacgguagcucacaucuguaaucccagcacuuugggaggccgaggcagguggaucacaacgucaggagucuugagaccagccuggccaacauagugaaauccugucuccacuaaaaauacaaaaaaaaauuagcuggccugguggcagacuccuguaaucccagcuauuuggaaggcugaggcaggagaaucacuugaacccaagaggcggaaguuucagugagccgagaucaagccacuacacuccagcccgggugacaaugcgagacuccguuucaaaaaaaaaaaaaauuccuaacucuccauagaaagcaguuuugucacuuccagagaaccucacaaccaaauauuaaauguacucuuguccccuuaagacuacaucaacugaugggccaggcaugguggcucacgccuguaaugccagcacuuugggaggccgaggcgggcggauuaagaggucaggaguuggagaccaacccggccaacauagugaaacccugucucuauugaaaauacaaaaaauuagccgggcaugguggcaggcgccuguaaucccagcuacucgggaagcugaggcaggagaaucgcuugaacucaggaggcagagguugcagugagccaagaucaugccauuauacuccagccugggcaacagugcaagacuccgucucggagaaaaaaaaaaaaaaaaaagacuacaucaacugaaucuauuuucagauuugacuucuuauuuagccaacaaaaacucaagggccuuaccuuauaauuuuucaggcaccccuccacaaccuaccucauuuuuuuuuuuuuuuuuuuaagauggagucucacccugucgcccaggcuggagugcaguggugcgaucucggcucacugcaaccuccgccucccagguucaagcgauucuccugccucagccuccggaguagcugggacuacaggcgugcgccaccaugcccagcuaauucuuguauuuuagaagagacaggguuucaccauauuggccagaaugaucucggucucuugaucucgugauccgcccaccucggccucccaaagugcugggauuacaggcaugagccaccgugcccagugccuaccucuuaaucccaaaguacauaccucauccacuuuuuucauggagaaaggaggaaggaggagaacaucaacuguggugguuuuuuuguuuguuuuuuugagacggagucugucacccuggcuagagugcagcggugagaucucggcucacuggccuuccuauucaagcaauucucuggccucuggcuaauuuuuguauuuucaguagagacgggguuucaccauguugacuaggcuggucucgaacugaccucaggugaucugccccccucggccucccaaacugcugggauuacaggcguuaagccaccacgacuggccugugguauuuugauuaccuuuucucaaaacacccugguugcugggcaugguggcucacagcauuuugggaggcagaggcgggccgaucaccugaggucagaaguucgagaccagccugaccaacauggagagacccccaucucuacuaaaaauacaaaauuagccaggcgugguggcacaugccuguaaucccagcuacucaggaggcugaggcaggagaaucgcuugaacccgggaggcggagguugcagugagccgagaucaugccauuguacuccagccugggcaacaagauagaaacuccgucucaaaaacaaaacaaaacaaaacaaacaacaacaacacccuggucacacaggaagagaagcuugaaacaggcagaaaguaaaaaugccagcuauugaugauugccauuuuugucucaagaguccucucuacggcuaaaucuauccaucagucagcaugucaacaaccuuuagugguaugauaaccuuaccucaaaugaagcauuaggaccaagcaaauaggguaaauaaacuuuauuaauuuuuggauuaagcccuaaagcuucagaggaaugggaguacuuuauauuuucuggaaagauaagauucagggaagaggcuagaacucauaguuauuuucuugcaauagcaaagaaacuaugcuacacuuugaagagaaaaaaagccagaaggaacacuaucaaugaagcagaauaggaucccaaacaauacucuucaagaggauuugauuaggcauauuuaacuauugauuaggcauauuuauucaaacaagggcaacuucagaaacagcacauuagcaagauuuuaauacccuaagcaguuaucucucaggaggaagauuaggauguaaggaauagucuaguaagaucucuacacacuaaaccgucccugacaaaaaaaaucauuuucuaauugaggagaaaccaaaaauaaagggaaaugcccuacagagaagcagcaaauaguauggaaucacugggcaaaccaacgugaaacacugaguagccaagcaacucaauccguaaguaaaaguagaaagaaggguaccaaagaaaugaaaaaacaacagcagagaagugaaaaauauuaaaugagaaaccuggaagaaacguuuuacugcgagauggaauauucaccucaaaucucacaacguuaacagaaaaugccauggaaauggaacuucuugacuaccuacuuuacaaaaagacuuuccuacgaaacuauacccagauuuauuuauuuauucuuuuuuuuuuuuuuuuugagacagugucucacucugucgcccaggcuggaguacaguggcacgaucuuggcucacugcaaccuccgccucugggauucaagcgauucuccugccucagccuuccaaguagcuaugauuauaggcacgcaccaccacauucagcuaauuuuuuguauuuuaauaaagacgggguuucuucauguuguccaggcuggucucgaacuccuaagcucaggcaauccgcccgccgcagccucccaaaguguuaggauuacaggcaugagccaccaugccuggccuauucauuuauuuuuugagacagcgucucgcucugucacccagauuggagugcagaggggcgaucuuggcucaaugaaggcucugccucucaggcucaaagugauuuucuaucucagccucccaaguaacugggacuacaggugggugccaccaugcccagcuaauuuuuuuguauuuuuuguagagacaggguuuuugccauguugcccaggcuggucucgaacuccugagcucaggugaucugccugccucggccucccaaaaugcugggauuacagacgugagccacugcgcccagccuagauauuucuaauagacaauuacaucuaccaaauaguuauacuguguaugguggugaaauaugaaugcuaugcuucaguuugacauagaugauuaacaaugucuagugucuucaacgaucugauccuacaaauucuuuccaccaaaacaguguccuaaccuuucugggccucaauuucuuagcuauaaaaugugggagccgcaggguguggugguucaugccuguaauccuagcacuuugggagaccgaggcaggcagaucaccuaagucaggaguucaacaccagccugacccacaugaagaaacccugucucuacuaaaaauacaaaauaagccaggcgugguggcacaugccuguaaucccaacuacuagggaggcugaggcaggagaauugcucgaaccugggaggcggagguugcggugagccgagaucgcgccauugcauuccagccugggcaacaagagcgaaauucugucucaaaaaaaaaaaaagggagccaaagcagaugagaugaacuauaggauacacuccaauccugaaauuuuauaccuaauuauaaaauuguuauuaaggucaguuaugaauauaaaauuugaaucggaaaacaaaacauuuaaguucauacugucauuccagagcuaaccacagggaggagcgagggaucugaaacaauucccaagggagacaguauuucgcuguuaccugaagcccacccgguagguggagaaacccucaauaccagacagaguauuucccuggcccuuuugccuagacuucagaaugcucuucacaaagccacgguuaacccgucuuccucccuuuccucccuaccgcaguuuucccucuucucuuuuguaguuucacaucaaguuuuaccuaauacuacuacuuuccccccaauauuuuucuuuuccccuuuuguccagaguaaaauuuucuagaaaagcccuuuguagguagguugugaugaaaaaaauugaugaaaugacuuacaaucaaagaaacuauaaacuacaauuacaggcaaaugagaauuacugauuaaguuuuagagaaauccuaagagagaaagaaaacgaagcauaauaaaaaggaaaaccuagggacugacauaauucaaguuuuccgaaguuaguaaaaggcccugaaaagagugcaaaugagugacaacuccuggaggucggguccagccucugaaauuaacaugcaagagcccaaggccaggcaaccaaaaugugaaacagacucugcccgggguuccuuucacugucaaacuccuagccaaaagaggcuucccacaucagauauuuuaaauauuaaaauuuaaaaaguuauucacaucuauucaccucucccuugaaaaacaaaugaauaaauagccccuauuugcgucuuuacucccacacuaaaccucacaccguugaugagccuggagggcuagguuggcacgagaggauggcgccaaagcucggggagagggcggucagugggcggaaggugccucuucccacauggccgagcccucgccgccacuggccaccggcacacgguccccaagcaucgggagcucccucucggcccugaccccgcggucucugucgccccgcaaacggccgcugcggccgcaggcucccaauugggacccuucccaggggaggaccccaucccccgcucucuuucuccgucagauucccgccccgcagcggccagccuaugggccccugccuccucaccuccauggagacgcgccagccuugcauggcggagaagccguagggcagcggcaggcgcggggcgccgaccccguccccggagcacuucaccguguugggcugggagagguaggcacccauggcggcggcuggccggcggccucaggugcaggaaagcugggcgcgacccgugccggagccgaagccccgggggugcgcgcggcaggagcaggccccgcggcgcgaccgacgcaaggugccggugaaaggcgcgaggccggccaggaggcgguaacgggacgggagcugugagggagcggaagcggaaacggcgccgcuccagacccc

SEQ ID NO: 191460 - RNA, 90736 nt, Homo sapiens
ggaggagguggagagugaggccgaggcguggggagcccgggaacucccuccuccugaaguaacgcgucccgggccggcucugccgucguugcugccgccgggcgccccgggacgaggagguggaggagggagagggcccgcgggccucgccuccgcccuccgccaccucgagcugcgguagcagcgacucaugagagcgcggccggaggacagguaaggacccgguggggccccgcgggcggaggguuccaccucugcccggacagggcuaggccccagcgcccggagccgccgccgccgccgccgccgcgguuccccgcccccgcgggcccgagucgggaaguugggaagaaacuucuccccucccccggaucgcccggcgggcuugucucguuccccgcgcuaccugcucgccccugacucggucucugcccuguccagaccugccgggucccgcccaaguccgaccugagguuccaggggcguggggacacuccccaccccuugucuuuggggucguguggaccgcccggcgacggggaggagagguuuauuuuugccccuacggccgaaguaggggcgagggaagcggccccuuuggguccuaaaggcugggggucuguguaucggccgacgccgguagcagcugugcggggagaggagcggguguguggggcgaguggaugagccuuucuggcuuuacuugguuugauugaaaaccgcaacauguuuaaaguuuuccuuuguuuuggguuggggguugggaaauuuaccauucagcguccacuuuuacggaaucaugccacuccgccucccguugcguucgguucccuguccacauguguuaaagaaaauugucuuaaaguguguuuuucuucuugauaauugcuuccagcuuucacuuuauugggcauggggcagagcuguuuuaagaagcucuuugaaaaucaagucugguguagggacuuuaguuuuuguuuuguaaugaguaggacuuaacaguucggauuugguugaaucauuuucugcauaauuaauugauacaggcguggaauaacauacuguauaauuauaaauuacuaaaggaaauaaugaaagucuuugguggaagcacaauuuuauguccauuuauuauguauauacguuccacggguguguguuuucacagucgauuucacaugauaugauuauaguaucuucauguauuauaacuguaagauuacagugccaaagauaccuugauaauuuuaaauauuuaaaccauccuguuacacuucuaaaguuaaauuacgcacuaaggaaaguauuacuaaauguauacacgugacugugcauuuaaggaaaagugcaugguaaaucuaauaucuuaacuaucacagugcuuggcacacgguggacaggaagcauuuugaauggucagguaauaaaggaguaucuuguauuagccaaggaucuuguaugcaucacuuacgauguucauauauuguacaguaagaaaguuuuacuuuagcaaauaauauauaugguuuuuugguuuuuguuuguuugcuuauaagugugagaccccugccacaauugacauguaaggaaaggaaguuaaauuguauuuuuauuuuuggacauuagcuaaaagucgguggagauuuuaaaugcugguugacaauucagaggguccuacauuugaaaaagacaauugccuuugaucugaaaacaaaacaguuuauauccauguuuccaggauaaaagauaaaagggcucuuaaaauauauacucuguuguaaccacuguaauguuauaauggcuuuaauuucguaguuagguuuugcugacuucauaaaccacaaaauugauuccuuucuguucaucugaaagugaaauuacagcuuugaccugucuuccuggguuagguggaauuugucuuguggucgaaguauaauauuaauacaugggcuguuuuuguguguguguuuuaguucaggaaauucacaagcugaaaaauuaaugucuaugcaaguaaaauuucuucaugguauguauugauaaaagaauaaaugugcuaaaagacuagaaguaaaccuguauaagugaaauauuaccaaccgaugguguaagacuuacuuauucaaaguugaaauuugcaucauguuagacaguaaaugauuuacuacuauggcuaguuuuucuuuacaaaaucaguguagacaucguuuauucuauuagcauuauaguaagaaagaagacuaaugccaaaacaauuuuuuaagugaugcuaagcgcuggggucacccaaacuuggguaauuaaaaaaaaaaaaaaaccugcaaggaaauucugugaacguaaaaauagaagcauagaauaccugugguucuaugaagggaaauauaugggaagagggaggagauugugauagggaccuggcuucugaaguggugacaaaguucuuuuaaccugguaggaguuaccaaggguauuggucuuaguguaauucauuaagcccuacguuugugugcagaaucuguuucuauguuuuauuuuacaugaauuuguuguuguuuuuuuaaggaauccaguguguaaugucuauauaaggugcuugguuuaagaacauaacuugguggcugacuuucgaacacuaccuaggcuauccuuugcaaauaggauuagauuuauuaaaucauaauugucauauaccagcuguauguauaacuacuuugaacacgucaggcugggcacgguggcucacaccuguaaucccagcacuuuaggaggcagagggaaggggaucacuugaggccagcaguuugagaccagccuggccaacguggugaaaccccaucucuacuaaaaaguacaaaaauuaucugggugugguggcgcgccccuguaaucccagcuaccugggaggcugaggcacgagaaucgcuugaacccgggagacagagauugcggugagcuaagauagugccagugcauugcagccugggcaacagagugagacugucuccaaaaaaaaaagucaaauacuccgaaauguacaauaauuagagaauuuuugggaaaaaauuucuaaauaaaguucuaguucguuuucuuuaauaacuuaauuguuuuaauauuuucacagaagacacagguuuuacaaaauuaaaauccgcuucggcuuguauguuguaaauaaccaauagaagauaaucaaaauguuuauugaacgaauggauacuguucugucaucaaauacucuguuuuucugaaaauuacauaacaugacaauuaaaacucaaaacucaauuacggcaucaagauccuaaguuuugacuuuuaucuauuuucgguuuucuagaacaguaauucuuuagaucaguaauuucagccuuaguuuuucuauucuuaagaaugccaugaaaucucagcauaaaauaaguuuuuguuuaaaguuuaugaagauucacagcaccugaaggaugaauauguuuugguucaaaaggcaaaugacaauaugguguuggaguuucagaaaugcagagaaucauugggucaugcuauuuuauuugcuuuauguaauggcuugcuauuuuagugguugauauuguggcuuugcauuguuguagaguugaagaagagaucucaucugugccaaauuuuuauaucacaggaacuuucagucauguuauaaaggugauguuuguggugcacgcuuuguugugugaauauuuacaggaaguuuuaguaagaucuuccauuguuuagaacccuacauggcuuaggucaccuucaguucacauuuaaacaguuuuauaauauaaguccuauagcgaggcacaacugcuuuucuuuaaaggaaauaaucuguuucuauuaaagugucuugucuuauugguaguucguguauggcuaugguaggguauguauuaucucuuuucuuccucucagcugcuccagugccacaauuaggcugaguauugcucagcugcagcugcugggugauuacuaaccauccagcuccugucuaaacucagaggcagauuuagcaaaaggagcuauaguaacaguagagggugaaagagaagagccagugcugccgccaauaucguuuucacaugucuguaugccaaggaaucguuggcugcagcagcacuacuguugucuuggaacuagcagacuugauggcaauauauccuggucugcguuggguuuaccuuuaagaucugaaagcccacuccaggaaagacagagaauccuguaauuuuagaguauagaauaauguacuguugagguacuaauggacugaguuacaagccucugugccucaacuccuuuucccccccaaaucuaggguagcaaugcccuucaguuucucuuguucaaauguacaguaagcugugagacugcagguuccuugaagcauuauacuucauuucacuuuaagcugugauucuuagaauugcuucuuuuauuguuguuuaggggaggggaguagaauugcuggcauauagguucuuuggacucuacuuucuccuaggaaguggaaggccuucaagagggauaacuucuagaauuagcuauacauugcauauccgugguggcugccugaauuuugcuaguaggaacucugcauucuuuuccuuuuguucuuucuuuaucccuggcguuugagaagauggacaucaacaguugcaaauacguuaucagcuauauauggcaauccccagacuggaagaugccauaggcaaauuuugcugcuucuaaaaugcugcucagcuuauaaauaugccaagcaaauagcagcagucgcaucuuuuguguuuuuguguuuugcuuuguuuuugagacaggaucuugcucuguugcccagacuggagugcaguggugcagucacagcucaccgcagccuugaccucuggggcccaagggauccucccacuuuagccuccugaguagcucggaccacaggugugcaccaccaugccuggcuaauuuuuuuuuuuuuuuuuugaugaaguaucacucuacugcccaggcuggugugcaauggcacgaucuuggcucacugcaaccucugccucccagguucaagugauucuccugccucagccucccgaguagcugggauugcaagcgugcaccaccacgcccggcuaauuuuuguacuuuuaguagagacaggguuucaccauguuggccagacuggagcaugccuggcuaauuuuugaauuuuuuggagagauggggucucaccguguuguccaggcuggucucaaauucuuaggcuccagcaguccaccugccugggccucccgaaaugcugggauuacaggccaccacacccagccacagcagcgucuuguccuuacuuuuaccacuacuaucuacugaaaaucuggagauauuccuuugacuuaucuugucuuuggaauuugguaguuugggguuuggcauuugggauggagauuagagaggauugagaaaaguagugcucaaacuuguauaaccagaggaaggaugagguacaguuagaccaugcauuugaacaguaagaaguacacaucauuauggcauauacuuagcaagagauugguguuaugaccucuuugugcucccacaaaacacuuaugucaaaacacaccucuccuugcacuguaauuauuucuuuccaugcuugucuguuauucuugaccuaguauucacugugucaaggaacuguuuuauagcaaucuuugagaacagcccuuagcacaauaaauacuaaauaaauucugaauuguauguagggaugugguucugggcagauuuauaugaauuacagcuauggacuuuucgcaaacaaaacaaaucuuuugaguacaccucuacuaaaauguuauaaaacuagcuuaauacuuuuucauagcucgaaguuaauucuuuagauuuuugcucucaagguuuuguucuagaaggugauuuuacaaaauagcuuaagcaguccuucaaauaugaauuuaaaggucauuuugauauuucuaauaugaacugaaaauucauuguaguugaaguuaaacuagucucuaguaagguuuauuuuaaauaaauacguuguacuauuuuagugaagaaaguccaaguuaugcugaagaaaaauccuagauuuuuaaaaaaugcauuugguaucucaucacaguagugacaaucaguauuacaauuaugacuuguucauauauaccuaggacaaaaagaaaaagaaguccugauuuucuugcaguaaugugugugaaggaaugcauaauucauagguguacuuuugcuggguuauugggggugaggacggaacaggaagugcuaggaggaaaaguacugaccccugaaacuucaagauugucugguuuucagccucuauucccagcaaaauguggauucuagguuuucuucaacugacuuaagaggauuuucacuucucuaauuuuuuaauguaacuuuucaguuucuuagcauuaaguagaaauuggggugaggugaggaaguugguggugguuguguauaaguuaauacuucacauuguuuccuggcgaauguauugacuucuaacuuuuguucugaugugauuaauauuuuacagauaaggauacuuuaaaaauaauagcagccagacauuuggaaggagcagagaaggcaauaugguguuauaaggaaaggacuggaagguagagcacuaacacuaucuagauuuuaguuucauuucugacagugaagagcuguuuagccuuggucgauucaguaaacucccuaggcguuaguuuugcaauuugaaacaaaagguaguugggccucaugguuucuaauaguuucucagcuuuauauauaaaugugugcucugccgcaguugaaguuguuacaauauagucaugcucugccuaaggaaguuucaaugauggugauccuguaagauuauaguagagcugcccuauauagguguaccauuuuuuauuuuuuuauacuguguaauuacuguaucucuucuacauuuaguuauguuuaaauacacaaauacuguuacaguugccugcaguauucuguacaguugugugcuguacagguuuguagccugagagaaauaggccauacuauauggcccaagguuguagucagcuauaccacguagguuuguguaaguacacucuagaguguucacauaaugucagaauugccuaaugaggcauuucucagaauauauguuaagugaugcaugaccguauugauaaaauuuuaaggaaauguuugagucuaaaauuuggaaucacauuagauauaaguaaagauuauaaaaaacugacccauggacuugacacggaacuuucucaagcaaauugcaguucuacuaauuaagcaaacauuuauacuacuaugcuagguuuuugguuuguguuuuuuuuuuuugagucagagucucacucugucgcccaggcuggagugcaguggcuugaucucagcucacuacaaccucagccuccuggguucaagugauucuccugccucagccucccaaguagcugggauuacaggcgugugccaccacacccggcuaauuuuuguguuuuuaguagagaaugggauuucuccauguuggucaggcuggucuccaacucccuaucucaggugauccgcccgccuuggccucccaaagugccaggcuuacaggugugagccaccucagcuggccuuuuuuuuuuuuuuuuuuuuugagacucagucucacucuauugcccaggcuggagugcaguggugcaaucucggcucacugcaaccucugccucccggguucaagcaauucucccugccucagccuccucaguagcugggauuacaggugugugccaccacacccagcuaauuuucuuauuuuuaguagagauggggguuucaccauguuggccaggcuggucucgaacuccugaccucaggugaucugccugccuuggccucccaaaguauugggauuacaggcgugagccacugugccuagcccagauuuuuucguaauaaaauuagaaaaaugacuuaauuauucuguugaaguggauaguuaugaugucaguuaacaaguaaucguggcuauuugaauaaaaacuuugcaacauuauaugagaaaaauagccacuaucaucaaaauuuacauuuaauuuuuuuaauugacaaagguauggacaacuuguucuggauauuugucuuuauacacauacaguuaauauuuagaacaagacaagcauggcauuggaaaaugguuagccuuuuaagguuuguaaaauagauuuucuaaaacaaagaaacuaaaauuacaguguucugaaaguuuguaaguugauguuuugaaaauuagaaucuguuuuuccaggaagucuuuucuguaacauaagccuuuuggccugauuucuaggcagcccguuggagucuuauaaaagccucacaaauagguaaaauaauacuuuggugguaaaauauuuucugacugauuaucaguuuuugccugguuuuuguuaacugcugagcucuuugaacaaauaaaauauuuggccuacaagugcucugauuaugaggugggugaaccuguagccuugccagucacccuccuuucccaccuuaccagcuccucacuauuuaaaaaucacuguuuugaguucccuguuaggagacucagauucucccaauaaggcauugcuauuaagcuuaauuuaaguacagaaacuucccuagguuuccccaccugcuugcuaguggcagugaaaccugccucauacucuaacccuauaggacaguaugagguauagaaaagcuucaaaagauuggggguaauaaacaaaaauaguagaaaaggguuugggaaaaugaggaguguuacaauauggaguuuguaacuucuuuaccuucucugugcuuuuuuuauuucccacccauucaccucacuuuggcauuggguagggaaagaagaaagccuguccuaugauaggugcuaugccauacuuuuauaugcauuaucacauuugacuugaaucuuugaaauguguuuccaaaauacacagaaaaauuaggaaugagauggguauuuauuuuuuguuuuugagacggagucucacucugacacccaggcuggaaugaaguggcaaaaccuuggcucacugcaacuucugccucccagguucaagugauccucccaccuuggucucugaguagcugcugggaccacaguugugagccaccaugcccagcuaauuuuuuuuuuaauuuuuaaaauucaaaauuucucaccauguugcucagacugaucuuaaacccccuaggcucaagggauccucccgccucggccucccaaagugcugggaaaacaggugugagccaccaugcccagccuguuuuuuauuuuuauuuuuuuuuagaauagagacaggguuucaccuuguugcccaggcugucucgaacuccugggcucaagcgauccacuugccucaaccucccgaagugcuaggauuauaggugugagccacugugcugggccccuugagguagguauuuauuacagauaaagaaacugagaaucagaaaguauauauaauuugcuaaggucacacaaccggcagaacugggauuuaaaccuagggcugacuacaagccuguuccauaugccauaacuuucuuaggaaugaggagcaaugauggaaagggagauuucuugucuuuuuucuucuucauuaaauaguacauuugaauugcuggcagagaauguucaauuaauacuuuuuuuuuuuuuuuuugagauggaguuucacucuuguugcccaggcuggggugcaauaguguggucuccgcucacugcaaccucugccucccagguucaagcgauucuucugccucagccuccugaguagcugggauuacaagcgugcaccaccuugccuggcuaauuuuuuguauuuuuagucaggcuggucuggaacucccgaccucaggugauccaccugccuuggccucccagagugcugggauuacaggcaugagccaccacgccuggcaauacuuucuaauuauuuuauuuucuuucuuuuuuaagagagauggucuugcuguguuugcccaggcuggagugcaguggcaugaucauagcucauuacagccucgaacuccucggcacaaguaauccuccugagcagcuaagacuacaggcuugagccacuacacccacccuagacuuuucuuuuuaauggaaguagcuuugugcugcauguuuuauaauagauaucagcuguuaauuaaggucagauauuaaauauauucauuaacugaaaaagauguguuauuacacuaacaacuguagcaaaugcugucuuuuuguaaguugggguuuguaauggaaaaugauauaguaaguccaaaacauuccucaucuuuuuauaaaauaagguguuuguuccgccagauuaacagagcauguuuucccaaucaaguuucuuuuuuuccuaaacuuaauucaucaaaagaauaaagaaacaugcaaaagaugaguuauuacacuaaacuguuucaaguguugcccuuuuauagguuuggguuugugaagucuauauauucucucucucucuguauauacacauacacacucucuauacauauauauguaguuuguacucaaaucugucuucugccucaaaagcuggaucaaauugcuacuguacaauauugccuuuauuucuacuaauuauaucauuuauuucuaggugaguuaguagaaauagauggaaggucuuuauugccugaugguucaguuaaaauuucagacguguugcagaaagauagccauuuucuaauuugcccugucaguagaauagcaguuuccuacauacaucuugguacagacucaucagccauucaaggcuauacuucuagaggaagugaggauucuuccauacuggcuuguuccucauucuuauagucuucuauacuaguuuguucauguaaaucauuuuuuugagacagggugucacucugucucccaggguggacuccaguugcacaaucacugcuaacugcagccucuucuuccugggcucaagcgauccugucaccucagccuccccaguagcugcgaccacaggugugcaccacuaugccuggcuaauuuuauuuuauuuuuauuuuuuauuuuuauauuuuuuugagauggagucucgcucuguugcccaggcuggagugcugugacgugaucucagcucacugcaaccuccaccuccuugguucaagcgauucuccugccucagccuccugaguagcugggauuacaggcacacgccaccacacccagcuaauuuuuauauuuuuaguagagacggaguuucaccaaguuggccaggauggucucgaucuccugaccucgugauccacccgccuuggccucccaaagugcugggauuacagucgugagccaccacacccagccuuuguuuuuauuuuuuccagagauggggccgagcaugauccuccccgaccuuggccucccagagugcugagauuauaggcaugagccaccaccuccagccuuguaacuauuacuguuauaugaacaucacuggaagaagagucucaucagaagcuaccaauggaaauuuuauuugccacucuuuugccacugugucaaguucuuacauuaacaauaauuuucuucaccaucuuaguagccuuuucuucuuuggcuuccuuuuauuucuccaauuguaucuaagaauguacccuuuguccucccuaauaagcuggaacauuguuuucuagcgggaauacuagcuuaauuuuuguagcauuauuaucccacaauaucuacaguacaacuccuucacauguuaacucuaacaguuuauuaagucuuuacauaaagguuggcagauagguuucgaacugcuguuguaccaacuccaaaugacuggaauggcugccacuggaauguaagcuccgugaggguagggaucuuaguuuugguuacuaaaguuguuccaagcacauagaacaaugacacauagacauuuauuaaauauuuuugauuguaggaacaugcagcagucagcuggcauguucugccuaucaugggcaugagagaaagaaguaacaaguaguucuucacuaaaagcucaugcaguaaccacaaauguuuuuuacucaagacucuuugaaguggcagacuugugcuaaacuaguaucauuaacgcucaggaugaauuucaaauaagcauucuacuugagucugauggagaaacuaagguuugaugcaguuuaauagcuuguaaauguuaaagagcaguauuuagccuaagcauauucacccacuuacaauauaggaguucuguuuuuuuauaucauauuccauaaauauauguccagcaaucauaccuucuuuuuuuuuuguuuuuuguuuuuguuuguuuguuuugagacagagucucguucuuuagcccaggcuggagggcaguggcaugaucucugccuccuggguucaagugauccucucaccucagccucccaaguagcugagauuacagguguaugccaccaugcccagcuaauuuuuguauuuguauuuguguuuuuuauuuuuaaauuaaaauuuuuuuugaaauggagucucgcucuguugcccaggcuggaaugcaguggcgcgaucucagcucacugcuaccuccaccucccagguggauucuccugccucagccuccugaguugcucauuacgggcaugcaccaccuugccuggcuacuuuuuguauuuuuaguaaagaugggauuucaccauguuggucaggcuggccucaaacuccugaccucaagugauccacccaccuuggccucccagagugcugggauuacaggcgugagccaccaugcccagccucacaaccauacuucuuaaaaacucuggcacacauuaguuccucuuauauuacauugauauaagcaagucauauggauuuaucugaguguaaggagagcuggaaaaaauaguuucuagcaggucagccaccucccagugagggcugcauaccauagaaggggagaaugaauuuugggagaacagguaauuaucucugucacagaaggggaugaaaaguaugguaguuacacaaguuagacaucuguauggaaaauaccacuugguucuacaaaugugguuagaauauuugaaagguaugggcaucgaugguaucuuaauucggguuacaguauugguauaaagcaaacugguuaguccaacggacuaacacauuuaagaaauguguuucuuaaagcagagcaucugacuaauuuaauuuuauauuugaggugguaagcuauaaagauauuugcuauuuugaacuuaauuaggaucaguaggaaaaaaagcuagugauauguaaauucuagaaagaaccuuugacgauaggagucaugucaucucggguuuauauuaaaaguagcaggaaagacaguucuggauuuuaagaugugugcacuagacuuuaggaaacauuggaaaaccaguaagagugaggcuuaaaauucuaauggacaguguacccccugaaggagugaaaagucuuaaaaugccccagacuucuuauaugaaagguuaggaagcgcacugguggagggagggggucagaguagaaaaguauuauauguccaucuacauaccacuucuagugauugagaacagauacuaauuagccauaucaaagaauuccauggugguaguagcagguagaaauuaggguggagcuaaagcggcuccccuaugcaucuucucaccauuuccccuuuucccccacccuaccccaucagucacuccaacuugggucuuaguuuuuguauuguuuuuguuuuaaugcaugcacuguaagucagaaggagaaacucauaacaaaugucaaguagaaaagaggguugugaagcucuuaggauguugucagaagaugaauaggauuuuuacaaugaccgauguuucagaaaaggaaaaacaauauugaugauucuuagagauaaauuuauagcuagaguaagaagucaugaaucuguaguucaggaaacuugaaauaauaggugacacagaacacauaguuuaucuccuuuuuaucuucucauuucugaaacaagaaguugcucuguaaauuagaaaaacuagaacaaacaaaaagaaaauagacaauacacuuaucuggcuggggagauaccaugaucaugaaggugguucucagagugaggcucauccauugcacuuugguugugcugaccccugugauuuccccaaaugcagaauuuguaguagugagggacuguguucgugcuuuccccugucauuuuuuguccuaagagaucauagugugaaguuuauauuauuaaaaacaaauaaauaauaagaaaauagaggcauguagcuuuacaugaguucaugucucuaggucuagaagaauuauaucucaagguucugaaagguauuucugauacuuccagggcccuaccaguaagagagaaaucauggagacagguagauaucuuagaagaaugauuagaugaugucuuaaaaggugaacguuaauaaaugcagacacugaaaguugccuuugauuccugacaaaauuuuuaaaguuuguuaaaaagauguuuaucauuuuuaagcaauuugaagauuauaaagaaguaauuuuuaacaguuguuuagaagugcuuuauugaacuaccuugucucgaguuugaguaaaugcugcauauaggucauugucagugguacuuucuuguguuagugaguggucagaccugauaagcuuaguuuucuucuaacaguaagguucagugauugcuuuucuaccuguguuuuuuuuugguuuuguuuuuccucuuuccauaauaaaguguucuaauggcaugauagguguugcuuuuucuuuuggugauaaacagagccagggauguuagcagguuuaaagcucuuucuauauuuucccaguuuuuuuagggggauugauagaacauuguuuuauuuuuguuauauauaugaauaaagauaucuuaaaauuauuuuaauuugcuuuuucaauugaaggcuacuaugcaucucuccuuguggugaacugcuugcucauaaucuuuaccaguuuuacuauuggguuauuugucuuuuucuuacagguuuuuagggacucuucaauauauuauagauauucuuucuuugucuuuauguugcaaagacuuuuccaugucugugcauaauguuccuucuguaacuuuuggauuuuguguuucaagaauauuuucuccacuugaagaugauguuaaaaauucuacuuacagguuuuuguuuuguuuugucuuacaagucauuuagcucuauacucuggauuuuauguauguugugagguaauuuuuuuuuccucagaugauauaccucacuacugcuaguuauuaaaucuauuuucacacugguucaaaaugccaccuuuuaguguuugcaaauucuuuuuacucuugggccuguuucugggcucuuucuuuugagggauuuaauuguuuauuuuauuuauuuauuuuaugagacagagucuuccucugucacccaggccagugcaguggugccaucuuggcucacuguaaccuccaccucccggguucaagugauucuccugccucagcaacugagacuacagaugccugccaccacgcccggcuaauuuuuguauuuuuaguagagacggguuucacuauguugggcaggcuggucuugagcuccugaccuugugaucugcccgccucggucucccaaagugcugagauuaccagcgugagccacugcacccggccuaauuguuuguuucuaugccaauaccaaauagcuugaugcuguugauuauaaccaugauaacagcaacuaauguguauugauaauugacugugugacagucccuguauaaauacuuuaacauauuuagcuaacucauuucucacagaaccuucaacaguuaaguauucuugauaucuuuauuuuuacagauaaagaaauaggcuucaagagguuaaauuuacucaaauuacacgcuaggacuguaaccuaacuuugugacuccagagccuauacccuuaaccaugaggcugugauuccuagaaggacaaauuuccuguuuuccuuuucaaaacuuucucagcuauucauaugcauuuacuuuuucaugugaacuucauugugauuuugauuuaauguuacuuagauuuauguaggaaggaugggcaucuuuguaauguaccuucuaaaaauaagugauguguuuauuuuuugagauugucuuuuauaucccaguuuuauuauauagacucugaacuuuuguuuuacuuacucauaggucuuauguguguguguguguguguguguguguguguguuuaaguucugggauacaugugcugaacgugcagguuuguuacauggguacacaugugccaugguguuuugcuucaccuaucaacccgucaucuagucuuaagccccgcaugcauuagguauuucuccuaaugcucucccuccccuuccccccacccccuaacaggccccagugugugauguuccccucccuguguccauguguucucauuguucaucucccacuuauaagugagaacauacgguguuugguuuucuguuccuguguuaguuugcugaggaugaugauuuccagcuucauccauguccuugcaaaggacaugaacucauuucuuuuuuauggcugcauaguauuccaugguguauaggugccacauuuucuuuauccagucuaucauugauggggauauggguugguuccaagucuuugcuguuguaaauagugcugcaaguuuauuuagaaauaacuucaaaguucagaaaaguugcaagaguagcacaaagaacuggauacccuccacccagauuuaccaguuguuaacauuuugucacauuuccuuuauguuucccuccuuggguauguguguauacguguccccaccaccaccauuugaaaguuaauugcaaauggcaugucucaguacccuuaaauauuucaguauguauuuccuaaaacaaggacguuuucuuauacaacugcaguacaguuacugaauucaacaaguucaacaucaguauaauacaguuaccuaauuugcaguugcggauucaguuauguuccccaaaaggguccuaacccucaguaccugugaauguggccuuauuuggaaauagcauccuuugggaggccaaggcaggcggaucacgagaucaguagauugagaccauccuggcuaaugggugaaaccuugucuauacuaaaaauacaaaaauuagccaggcaugguggcacgcgccuguaguucgagcaacuugggaggcugaggcaggagaauugcuugaacccgggaggcaagguugcagugagccgagauugcaccacugcucuccagccugggcgacagagugagacuccgucucaaaaaacaaaacaaaacaaaaaccaaaaacccacaugugaagacagacacccagagagaaugccuugugacaacagaggcagaaauuggugggaugcaccuguaagccaggagcacgaaggauugccagcuaccaucagaagcuaggaggaggcaaggaaggaugguauccagagugucagggggagcauagcccugcugacacuugaauuuuggacauccugccuccagaacuaugacauaauaaauuuguuauuuuaagccauuuuuuuucuacagcagcccuaggagggaacaauaaaggaaauguggcaaggaaaguaauacaguaguucauauauuuuuccaauuguccuaauaauauucuuuauaacaaaaauccaaaauccaaucuagaaauacauguugcauuuaauugucauguuucuuuagucuccuuuaaucugaacaguucuucaggcuuuaucuuucaugacauugauauuuuuaaaaguuagacuacugguuuuguauaguguacaucgaugaguuuuuguuugauguuuccucaugauuugauuuagauuaugaauuugaggcaggaguaccacuuaaaggcuauuauguucuucagaguacaagacaucaggaggcacgcuguguuagucuauccuacuauuggcaguauuaacuuugauuacuuaguuaagugauaucugucagguuucaucaccacaaaaugaacauauuucucuuuuuaguaaauuacagauaagguaauaguuuuugcuuccauugaugauuccuuggcugaauuaauuauugcaguaagaguuguucugggauacgugugcugaauguguagcucucuuacuccaaguuuaguaguugggauucuguaagagagaaccuuccuguccuuauuuauuuaucagagugacuuauggauuaucuuagucaacuaguuguaaucuguuagugucaccauuuuuuuuucuugaugcucagauucuguguuuggucagcaagagccucuucaaacuaguuccuauguacuuuugauagaucccuaucauuuguugaguacuacuuuauaacuauuuuugguauauuacaaaacuacuuauuucucaauauauuuuuguagcugcucuauagaaaucugugucugauagcuuuucaguuaauucucuuacuuuuuuuguauaagggaucaugcaggucagacacaguggcucacaccuguaaucccagugcuuugggagacugaggugggaagaucacuugagccuaggaguuugagaccagccugagcaauuuagugagaccccaucucugcaaaaaauuaaaaaauuaguuggguguaguggcagaugccuguagcccuagcuacucaggaggcugagaugggaggauugcuucagaccaggaguucgaagcuguagugagcgaugaucaugccacugcacuguagccugggugacagagugaaaccucauuucagguaauaauuauaauggccaggcgcgguggcucacgccuguaaucccagcacuuugggaggccgagguggguggaucacgaggucuggaguuugagaccauccuggccaacauggugaaacccugucucuacuaaaaauacaaaaaaucauccgggcaugguggcaugcgccuguagucccaccuacuugggaggcugaggcaggaguaucgcuugaacccgggagguggagguugcagugagcccagaucgcaccacugcacuccagccuggugacacagugagacucugucucaaaaaaaaaaaaaaaccaauaauaauaauaauuauaaugaaccuuaagacucuuucuauuguuugccauuaagcugugaugccaaaguugacuugaacuuuauagauauauaauaucauggaaggauuccucuauuuuuaguucaugagaguuauuaaaaaguagggguggguguugauuuaagcuuuuuccccccccuuggcuuuuauugagauaaauaacuuuucuucuuuuucuuucuuuuuuacauuuuuuuaaaaaauaaagacaaggucucucuauguugcccaggcugaucuugaacuccuggccucaagcaauccucccuucucagccuuccaaagugcugggauuacagguuugagccacugcacauggcugcugcugcugcugcuccugcugcuccuccuucauauauauaugaaugugugugcguauauauauguauguauauauauguauauauguauauacacacacacacacacacacauauacagagggagagagagagagagagagagagagagauggagucucaguguguuucugaggcuggaguauagugcuauucacaggugugacuauggcacacuacagccuugaauuccuggccuccugccucagccuccagaguagcugggacuacagaugugugcagcugcaccugacuucuuuauuuuuuauuuuauuuuuuuaacccaaauccaaaaugguaaauaugacuucuuuauuuauuuguuuguuuguuuuucgagaugaagucucacucugucauccaggcuggaguacaguggcacaaucucagcucacugcacccucugccuccuggguugaaacaauucuccugccucagccucuggaguagcugggauuacaggcaugcaccaccacacuuggcuaaacuuccuuauuuuuuaauauggugaauuaauauuauuaauagacccuaaaacuaaaccauucuugcauacugagaaaacacuauuuuuuuuaguagaaaagcauagaacagugguuaugaacacucuccaguauaauagaugagcacuugaaauguggcuaguccaaauugagauguacuguaaguguaaaauacacacccgauuucgaguagcugggcucacaggugcacgccaacacccccagcugauuuuuguauuuuuaguagaggcgggguuucaccauguuggucaggcuguucucaaacuccugaccucaaguaauccaccugccucagccucccaaagugcugggauuacagacgugagccaccacgccuggugcaguacacaccagauuuuaauaugguaaaaagaauguagaauaauucaacuauuaaauauuaauugcauguugauaacauuuuugauauaguagguuaaauaagauauuaaaauuaaucucuuucuguuuuauguuuuuaaauguggcuacuggaaaauuuaaaauugcauaugugguuuguauuugugguucacauuauauuucuauuggacaguacuguucuggagcuaaauugccugagagugucuuugaccuuagacuaguuaccuauucugugugccuuaguuuccucaucuuuaaggggugaguaaaaauaguccuuaacugaaagggugguuguaaggauuaaauguguuaguauacacaagaguacuuaggauaguauuuagcacauagcagcugccuaauguuaucuguuacuauucuuaauaagauugcaagcugcaugaugccugggacguuuuguucacuguugcaucucuacuuucuagacuuucuuuuuuuuuuuucuuuuuuuuuucuucuucaaguuucacucuuguuggccaggcuggagugcaauggcacaaucuuggcucacugcaaccuccgccuccuggacucaagcgauucuccugccucagccucccgagaagcugggauuacaaacgcgcaccaccacgcccggcuaauuuuuguauuuuuaauagagaugggguuucaccauguuggccaggcugguaucgaacucuugaccccagaugauccacccgcccuggccuuccaaaaugcugggauuauaggcuugagccacugcacccagccuagacuuuaaaaaaauauuuuuuugaauuaaugaaugaauauagagaauuucugagaaaccucgguaacaguugggaaggagcucuuuugauaaccccagauaucuguuggaaggauacuacaaccaagaaagcauccuguaauacccaugaaauacauaauauuugugcuuuucugguaguuuuuuaaaacaagauuuaaacuauuuuagugguuauugcuuuauuuaggucuccuaucuuuuaacugaguuauuuuuauuaauuuuuauuugccuaguuagccauuuuaucuaguucugaaaacuuuauuggcaggaguuauacaaaguuaucacuuucuuuucaaaucaucuguggcucuaguacccuucucauaccuaauacuguguacucucccuuuguguuucuaguuuaugaugaaaucuagugauuuaucuguuucauugauguuuauuuguaaacuauacuagauuuuuuguuauaauaagaggaaauuaaaagaaaagguaaugaauuagaaacgagaaacagaaaucucaguaugauuuacaaauaaaaauccuuuugggagguuacccccgccagcucugagacggaguuuuacucuuguugccgaggcuggaguucagugacgccaucucggcucauugcaacuuccgccucucggguucaagcaauucuccugccucagccucccaaguagcuggaguuacaggcacaugccaccacgccuggcuaauuuuuguauuuuuaguagagacaggauuucaccauguuggccaggcucaucucaaacuucugaccucaggugauccgcccaccuuggucucccaaagugcugagauuacaggcaugagccacugcacucagccgggaaucuuuuguuuauuuuauuuuauuuauuuuuaugagacggaguguugcucuuguugcccagccuggugcaauggcacaaucucagcucacugcauccucaaccucccugguucaagcaguucuccugccucagccuccaaguagcugggauuacagucaugugccaccaugccuagcuaauuuuuuguauuuaauagagacgggguuucaccacguugaucagacuggucucaaacuucugaccucaggcaaucugccugccucagccucccaaagugcugggauuacaggcuugagccacugugccuggccauuuuuuuuuuuagauuguaaauucuccuaauuuuguuugcuccuaaauuccucaacucauuuguuuauguuauuuccuuuuuaguaacagguguauaaguaucugaaauuugcucugaauacagccuuugcuguaguucauugauguagaacguuguuggguuuuuuuguuuuggggguuuuuguuuuuguuuugagacagagucuugcucucuugccuaggcugaagugcaauggcauagucaccauucauugcagccuugaccuccugagcucaagugauccuccuaccuuugccucucaaguaguugggacuacaggccuguacuaccacacuuggcuaauuuuuaaauuuucuguagagacaggauucucccuauguugcccaggcugaucuugaacuccugggcucaagccauccucccaccucagccucccaaaguguugggauuacaugcgugagucaccaugccucgcaaaguuguucuuuuauaauuguggguuuuguucucucuuugacauaaguguauugggucaugaauauuuuaauauagucaucucacuuaagaaaacuuugaaaaaauaccuuguguaccauuuccuuagguuuuauagcauauguucuguuaucaguacucaaugaaugccaaacaacaguguggaaaauuguuuccaaucagaagcaacuaaagcauguauagguaauuucauggaauuuaaaauauccauucucaaacuaauaauguuauaaaaugggggccauaauaugauaaaucuuuauauaauucaguucaacaaacuuuuuacaugcucugagcaaggaaauauuucucauacuguuuuuguuuguuugagacaaucuuuaacucugucauccaggcuggagugcaguggagagaucuugguucacugcaaccucugccuccuggguucaagugauucuccugccucagccucccaacuagcuggcacuacaggcgcacaccaccaugucuggcuaauuuuuaaaaaaauauuuuuaguagagacaggguuucaccaaauuggccaggccggucucaaacuccuggcuucaagugaucuauccaccuuggccucccaaagugccggggauuacaggcgugagccacugcaccuaucccuaauacuguuuuaagagcacaaaguaguaucaggauuacaaaaauucuuaauguuguugcauucuaaaauaguuuuccacagaauauuagugccuuucuggguggaaacuuccauacguguaugugcuaaacuuugaaaaucaaaagguuuuauuuuuuaauaaaacaaaauuuuaaauauauacacaucguuauuauguacauauuuuaaacaaugauuuuaggguugaaauaguguagccagaaguaagcccuauuucagaaauacgaaguucugguuuuaauuuuuaggucauccuaaggaaugaaaagcugaauauaaaugaucauuuuauagcccacgcuaaaaggcuccccauguaauaugaaaauagaaaggaaacaugaacuuuuuugaaucaaaaacuuuguaucucuuuuuaauauaacagcuuuauugaacuagaauaaaaccauucaugcuauuuccauauuaauuuuuuuacuucauuauuucacuccaaaaagccaaaggaggcaaguucauauaguugggagauuaaacauguaaauggaugugaagagucagaauauaaauaugaggaauggcuggaaacagucagcgugcauccugccuuucucauauacgugcuguuuuccugucucccagcguugaugccuuaccuggacauuucgaggcuaaagcaguuguugaacuccagagcauuaucaagucuucacagcuuaaaaacaggugcagauaacuaguaaauuaauuugauauaugucgaucuauggauuaauaucagucuuuuuuauccacacucucuucaauuaaaaaaguagauucaaacauuaauuuuugaucaguauuuaucauuugggucagguccuaaaugaugauggggaaaagaauugauaauucaacagaauauuuuuuuuuuuuugagacagagucucacucuguugcccaggcugaagugcaguggcgcgauuucagcucacugcaaccuccgcaucccagguuaaagugauucuucugccuuagccuccggaguagcuggaauuacaggcacgcaccagcaugcccagccaaucuuuguauuuuuaguagagaugggauuucgccauguuggccagguuggucucgaacuccugaccuucagugauccaccuggcuuggccuccgaaauugcugggauuacaggugugagccaccgcgcccagcccaacaaauuuuuuuaaauacaguauguaucagcugggcgcgguggcucaugccuguaccccagcauuuugggaggccgaggcgggcggaccaccugaggucaggaguuugagaccagccuggucaauauggugaaaccuaucucuacuaaaaauacaaaaauuagccgggcuugguggugggcaccuguagucccagcuacucuggaggcugaggcaggagaaucucuugaacccgggagguggagguugcagugagcugagauugugccacugcacuccuccagccugggccacagagcgagacucugucucaaaaaaaaaaaaaaaaaaaaaaaaaaaaaaaaaagacaguauguaucacaguuuuuuaaaaaacauaauuuuggccaucuuuucuaucaauauucauauauagucaguucucauuauuugugcuaguuauguucuauaaaauuacaaauaacuaccuaaucaaagacugaaccauuccuccuagagggaauacaggcuuagguuccuaugagcuuuuuuaaauaaaucauguaaccuuguuauauguguguuucuguucaaagaugccguauauauauuaaaauguaaauggaaugaaguccuucagaacaugcagguauauuugacuuuaugguagagauaugguccuuggagcuugaccauauaaaaacuugaugugcagcaaauccuauuuucccauacguucuuauucagguggcucuuaguuuccuauuuccaaguggaaacaauagcaguugcuaaauaaugcagaaauugauauuaucaauuguuauugccacccugaacugauaugguauuaauuuuggcaagcaggugaauucauaaauauggaauucaaaauaaugaggagcaacucuguguguguguguguguguguguguguguguguguguguguauggacuuauuaaugaugauguuuauaguaaugaauguugcaaagugccuucuaggcuaaccacaacaauagacaaagauucuauuuuagguuuccuuagcucucuugccagugucccucaaacuugacacucuuaugugaagcuccccuuccuccuacucuagggaggaagaaaaaagggaaaaagucuccauguuugauauugugacaaagaaggaagucaacccccacccccaccccaucuucuaucuuuugaguccuggugauuugaguaauuccuguguggagaccagcuuccugccaaauucucauuuagagguuauuugaagaacaauugcaucuuaggguuucuuaguuuauuuuguguugcuauaacaguaccacagauuugguaauuuauaaagaagagaaauuuacuucucacaguucuggaggcugggagguccaauaccaaagugcugacaucuggcaagggccuucuucuugcuguguuaucucaugguggaaggcaagaggcugagagaggguuagagugagggagagagagaaacucacuuuaaaaagacagugucacucuuuugcccaggcuggagugcaguggcacaauccuggcucacugcagccuugaacuccuggccucaaguguuccucccuacuucagccucccaaguagcugggacuacuggugcucaacagcgccuggcuuuuuuuuuuuuuuccuuuuguagagacaaggucucacugggcuuagacuggucuugacagacuggcuuuuauaacaaacccacucccaugauggugacauuaaccccuucagagggcacaguccucauaaccuauuuacaucuuaaagaucccaccucucaacacuguugcauuguggauuaagcuuccaacacgugaacuuugggugcauauucaaaccauagcauagaguaucaucugaacaggcuggauguaaugccaaccacagcccuacuaccagaauucagaccuuuuauagugcuucucucuccuuccagcuacuuagaacaagcuacuuagaacaagcccagcuuuacuuguuucucuuucuccccccuaacacucaguauuauacuucagaagcuugguaagaaaggggaagaugauaucucuuauugacuuguuuccuuuuaagaccuauuuagauagaugaguuaacuccauugacucaaucacuugguuuuacuuugagaguuaauaauuuccaccaguguccaacauuuuggcuucccugggccauauuggaauaagaauuaucuugggccacacauaaaauacaauaaaacuaacaauagcugaugagguuaaaaaaaaaaaaaggucugugcauaacuuuugugauauccgccaccacagauaagcaaaauaguccucacauucaaaggguuggacacucaugauccuccuaauuuaacaguuauguugcuuaguauggaagcauacugacucucugaacccuaacaguugagcaugagcaugauuguuguaguauacugauuauaagcauggguacugugguaggcagcaucuugacuccccagagauguccauguucugugaauucucggaaccuuugaauauauuagguuacaugguaaagaggaguuacaguugcagguagaguuaaaguuccugauaaacugauuuugaaauagagaguuuauccuggcuuauccagguaggcauaauagaguaacaaugguuuuuaagaguggaagagaaaagcaggaaagucaaggaaauguaacaacaaagcagcaucagaaagagacaacauuccaggccuuaaagguggaaggagucugugagccaaggaaugugggcagcccccacaagcuagaaagggcaagaacugauuuugucuuugaaucuccagaaggaaaugcagcccugcugacaccuugauuuuaguccagggacaccggcgucagacuucugaacuguaagauaaauacguuuguauuguuuuaagccacuaaauuugugguaauuuguuguagcagcaauaauuaauagacacugagcugaaauauucugaguucauucucagcuucuggcucugucacuuacuaguuuugugacauagaaccaaaaccuauuuaacgucuccagccuuaguuuccucaucuguaaaacagagauaauaacaacacauaucuucagugguuauugccuggauuaaaucaguuagugcauccaauguacacacuuagauacaucuuuauuauuuauauuuuaauauggugagcauauagaaaacuuguaaugaaaacaauaauuauucaucuuaauucuucuuaaauaugagaauaaauuagacauuuuauuuaguaacugucccauggacauuuaaaauuacaagaaaaguuuggccauauguaugacaacauguguguuaaaaugaauauuuuuuugccaguaugaaauuuggggaaauuccgucguauuaugccuguuuugcuuaauguaaggaaauggauuuuucuaauuauccucaaaacaaaaaagcuuuuaguguuuauugcauguuacaaauauuaauaacaugaaaaauuaaugagcuaggugcggugguucacaccuguaaucccagcacuuugggaggcugagccagguggaucaccugaugucaggcguucaagacuagccuggccaacauggugaaacccguuucuacuaaaaauacaaaaauuagcugggcaugguggcagcgccuguaaucccagcuacuuggguggcugaagcaggagaauugcuugaaccugggaugcaagguugcauugagcugagauugcaccauugcacuccagccugggcaacaggagugaaacucuguuucaaaaaaaaaaaaaaaagagaaaaauugauacauguagaagcuuagaaaaaucuguuggggguagggaaugggaagcagauacgcuaugagcuuacagacuucucacuuuuuucuccugguuuuuccaauucaacucaauugagcuuucagauucaauuuuguuauaacauugcauucauauuaauuccuuuagagcuauagguuaugugauuauuuuuuccguguguguguguguguguguguuuccccuacauaaccaagaagaguuuucuguucaguuuggaacaagauuuugagaagacauuuaggauguacuaguuugaguuuuuaaauguauauuugagauauuuucucaacuuucucuuugggucuguagcuaaaauaugcaguauaauguuuuauuuauuuauuuuuuaagagauggggucuagcuauuuugcccaggcagacucaaauuccugggcucaagugauccucugccuuggccuccugaguagcugggacuuacagacaugugccaccaaaccuaguggcuauauaauuuuuaaaaauauucuuaggauaucuuuacauacuuuucuuaaaaaaaaaaaaguuaaccuuuguagucuguuugcagcauuagcuauugagaucagaaauucagaaaguuagccgagcgugauggcucacgccuguaaucgcagcacuucgggaggccaagacagguggaucacuucagguuaggaguggcuaauauggcgaaacccugucucuacuaaaaauacaaaaauuagccgggcaugguggugcacaccaguaaucccaggugcuugggagccugaggcacaagaaucacuugaacccaggagguggagguugcagugagccgagauugugccgcugcacuccaaccugggugacagaacgagacucuauguaaaauucagaaaguuaaaauuagaaagaaaaaauaauccuuuuuacauguuuuauauugaugucacacauuucccauucauauaagauuuaaaaucauagauguguaacuuuaaacuugugacuaauuaauaauauauuuuuauuacagcuaauucacuuaaguaaaacaauucucuugaaauguuaauagccuuuacugaguagauggaguagugagcccuaaguauuuugauugcccagacugucucauuuucuaggaccuuuccuaucaucucaugguucaggugggaucugccauguuccaucagugacccugccucuuggcuggagagggcugacccagagggaggcggcugauccaagcugggccaggguccuuuaggaauuaggaauugauauuuuaugguuccucagccuagcucuaaaaugaaaauacuaacucugggacuauugccagccauguuuuaccuuaugaagagccgaaaaggccauugugccacaggagagaagaaugaagcacaugagcauaguagcaaagaugaaagaugaagagagacuaagauaaaacacauggagguggugaaggagagaugggagugggguggagagagggaccagguaguuggggagaggagagaaaauggggaagcaagggaagugauggaaagaccaggagaaacagagaagaaaugaaccaaauuuccagaacauggguugcugguucuaguuucucuuaugacccugaauuccaugaggcacuccgauaauguuuauaaaaaauccccuuuuugcuuaagcuaccucuagucagauucuguccuugaagccauaagucuuaaccaaggcaaacacugcugucauucggguaugugcuaugauugcuuugcauaugauaucaguuaauucuuacaaccuugcaagauagguauuauuccuccaaaaaaaaaaggaaauucagucuuaggaaagauaaaguaauuugaucaaggaucacaguagcuaauaagugacagaaccagaauugaaaugugugucugacuccaaagucaguuuguauucaugaucuguaaaaauauucauugggcaucagcuaugagccaacacuaggcuaagcuacaagagagaaauuuuucuugucucaaaguuuguagcucagagaaggauagaaauaaacaggcagugacaauucagugucauaaauggugugggggcaggaauaaaauguacugugugagcacaugggagaucaaggaagauuccuugaacguuuaagcuaagaccugaagguugaguagucacaagccaagcguaaggaaagagggagguugugccaagcguuuaugaaaacaguaugguacauuugaggaucuaaaagaaaucaagagccaagagagguaaauuaagcaaaucauacaaggcccucuuauuuuuuuuuuuuuuuuugagacagaguuucacucucgucccccaggcugcagugcaauggcgcgaucucggcucacugcaaccuccaucucccagguucaagcaauucuucugccucagccuccugaguagcugggauuauaggugccugccaccacucccaguuaauuuuuuguauuuuuaguagaaacgggguuucaccauguuggccaggcugguuucaaacuccugaccucaggugauccacccaccucgggccccaaagugcugggauugaaggcgugagccaccgccccuggccaaggucuucuauuuuauguuaaggaguuuggacuuuauauugggagaaagagggggcuggaccaucaaaggcucauaauuagacuuucuuuucuagagaacacaaacauuuuucacauuauagccaggaaggauuggagaauuaacacuguagaaggauggaagucaguuaaagaggcuuuugcaauaauccagaccguaaauaauuaguagucaagggaaguuucaagggaaguauaggcaacccuauagaacaaguaaguaguugggggagaaauggaagaauucuagagauuacagggcaguauggucagguccuggugaccaauuggccauauagggcacaggaagguaucuuaguccauuuucagaauacuugaaacuggcuaauuuauaaagaaaaggaauuuauuucuuacagaucuggaggcagagaaguccaaggucaugggguggcauaugagaagggcuuucuugcugguaggacucuugucuacagaauccuuaggugguggaggauaucacauggugagggggcugagugugcuauugugcuaagcuaagaucucucuuccucuuauaaagccaccaguuguacucccaugaugacccaugaauccauuuauccuuuaguaauccauacauggauuaauuuauuaauaaggguggaguccucaugauccaaucaccucuuaaaggccucccuuucaauacugccacacuggagauuaaguuuguguuuuuguuuuuguuuuggagacaaagucucauucugucgcccaagcuggagugcagagggcaguggcaugaucuuggcuaacugugacccccaccucccugguucaagugauucuccugccuuauccucccaaguagcaggugcgugccacagcgccuggcuaauuuuuguauuuuuaguagagacaagcuuucaccauguuggccaggcugguuucgaacuccugaccucagguaaucuacccuccucagccucccaaagugcugggauuacaggcgugagccacugcacccagccucuuuagucucucuuaaagagauuuaagaaaaaaaaaaaaaaaggacuacauacauuguuauagaaacaaguggaugauguuuuuaaaguuuaaaaccccaauuaaagaagaguacgugcagugccugaggagcauuuaauugacauaagggcuugaaagugguaucuaauuguuuacuguaauuugcuggucaaaaaucuugacaaaagacuggaaguaaggugugaaaaucugagagaauaaagauucuugagauagguauauggucagcuuauuuuuugaguugacuggauuuguagagggaaugauacauaauaguacuugauaggugccuuucugccaacaaacugccuuuaauaauugccuaagguggcugaaaguaauuaacuguuaccugggaucugcauaauucagaucuguucuguguugaauuuaauacauuuuuuaaaaaucuugaggcuuuaauuuguaaguuauuuuuguuacuauaaucuauaacaaaaaaaauuauucuauacauuucuuucuuucuuuuuuuuuuuuuuuugagacagggucucacucugucuccgaggcuggagugcaguggugcgaucauaacuuaccgcagccuugaccucccaggcucaagcuguccucccaccucagccuucugaguagccaggacuacagguguguaccaccaugcuuggcugauuuaaaaaauuuuuugccgggacgggggucuccuuuuguugcccaggcugguccugaacugcuggacucaagugauucucccaccucagccucccaaacugcugggaucagccacugcccccauccauaaaauuccuuacauauucuuuacaucaggcucuucucauggcugauccuauaucagacuucauuaaagaaacuacgagguuccaggaauuuagaaggaguuggguuacuuuaaggucaauuguuuguauaucuaaaaggcagaaaaaagaaaaagaugguaaaaaauugguaccauuaccgaccccugcaagaucaguuguccauugcuaacauuucuuuucuccuucgacucuuggaaaauggaguucuuuguuugcuuuuacaagacaaaguguaugcccuuuaguagucugcugcuuccuucucucugccuauguuuucucuuuuaugguccugccuauccuuugugcuuuaugcuuaagggaggggauuuauaaaugaaagagaaaaaucauagacuacggccuguagaacaccgugaccuauggaaauuguucauguuuuaugaaguuaagucucuaaauuuauuuuucuaggauuuccuaaagauuuaaaacuuguauguaaauuggagccaucugggcaaaaugccagacuagggcuauuccuuccaaacuagauagagcauguaaugucacaauuaguuaacuuauuagaguucauuuauaggaauaauguacauuuaauuuuuuaagagguucagaaauguguuaaaucauuugaaaauuuuuagucacuguuacuaauaauaaggcaacauugucaugcugacaggcagggugcuguuuccaaaguuaguagauugugccauagguugagcaguggauuuggcuguaaauaauguuaucauguuuguuacauuuucuaaagggcuaauauuuaauaacuuaccaaugaacaaagaaugcuauacacaaggcuucccugaagaucguauggguaguagaaagaaugcaguauagaagucagaagaccugguuccuaguuuugccuacuuuuagcccccuguccuugagcaaggcauguaauaaccucucuccauuucaguuucuucaaauguaaaauguagagauuaugccuacuuguccugguaacauauugggauuauuuugggaucaaauuaaauaauaauaacaaagagcuuugaagacauaaagcacugucaaaguguaaaauuguauuaaagcaaaauacuuuaacaguguaacacuguacaacauaauguguguguacaacauaauaauguguuaacuguuaaugauugagccagauacauuauaaacuuauuucaaauuuguuauagcuuuacuaaacaugcugcuauaaaguauguucugauauagguaauucuuuuuuuaauuuuuuuuuuuuuuuuuuuuaagccagagucucacucuguuguccaggcuggaguguaauggcgugaucucagcucauugcaaccuccgccuccuggguuagagcaaugcuccugccucagccucccaaguagcugggauuacaggcgcacaccaccaugccuggcugauuuuuguauuuuuaguagaaacaggguuucagcauguuggccaggccggucuugaacuucugaccucaagugauccgccugccucagccucccaaaguguugggauuacaggcgugagccaaugcacccggccugauauaaguaauucugauagaugaccaccuaacauaaaguugaaaauuuuucauaugacuuauggaguugauaaguuaggaaauaguuggaaaaccuacaaguauuucuagaauuuuuguuaggcuuggcuuuuuggaggagggaagaauauaaaugucuggcagguuguugaauagaauuaaucagaaucaaguuacaauucagugguuuauuuuuccaacaaaauuaaaugaaugucuuuauauacauauauaaaacaauuagugcuaaauagaaggaaauagaagauccuugagucauaggcucuguuccuuguugcuguuuuagccuccuccccuucuuguucuucuauguuguacuucaccagcaccagacuacuuacaacuuaaaaccccacuuuguucccucuuguuuaugagcuuuugcacauccugcugccucugcuucagaaauaauuucucgagcaaaagaaugaaaaaaauuaauaauugcccccugauuuuugugguuaaugucuaauuggccuuuuuguuuuucauaaccacaaauacauguuuuggaagauuaguagaugauagggaaagcguauuagaaaaguaaguuggggaaguuaaccuggaaugccugguuaaggguugagguuuuauuuuguagguuguaggaagcccuugacagguguauccaagggaguguuacagacagaguucuacuuuauaaagauuguuaggcagucaacauuuuagaaccuccuuggguuggauuggagguuaggaaucaccauauauugucagauuaugaggcagaauuguagaaacggguaugauuaggaucugaaaacagccaggcaagcauucauucauguaaaaaauauuaaugcuuuuuauguuucagacugucuucuagguucuggggauacaggaguaaaugcacuaaauccuacuccuccaauacacagaaaauuaaagaaugccuuacaagucaauaagaaaaggacagacaacccuauagaacaauggauaagugucuugaacagaccuuucacaaaagauaauguccgguaaacauauguaaaggugccacuucauuaguaauuaugaacauaaaauuaaaaucacagugagagacuccuacacacccaccaaaacagauacauuuuaaaagauuggccaggcgugguggcaugagccuguaaucccagcuacaugggaggcugaggcacgagaaucacuugaaccccagaggcagagguugcagugagccaagauugcaucacugcacuccagccugggcgacagagggagacuccaucucaaaaaaaaaaaaagaucgaguauaccaaguauugaugauguaaagcaaugguaauucucaugcuugcuggugagaguauaaacugcuauagcuacucuggaaaacuguuuagcagugcaaacacuuugacccagcaaucuauugcaagguuacauccaguagaauaugcauacaugcguaccaaggagggcucgggaauguucauugcugucauuauucuaauagcaaaaaaacuggaaacaauucauaucccuuaccuaugguauauucauauaaaagaaugcuacacagaagugaaaacaaaguacagcuguuccugauaauagagaugagucucagaagcaucguuaagugaaagaggucaaauacaaaauaaugcauuauauaugauucuauuuuuuuuuuuaauuuauuugaggcaaguucucacucugucacccaggcuggagugcaguggcacaaucacggcucacuguagccucuaucucccaggcucaagcgauccuccaaccucagccucccaagugucugggacuacagggguaugccaccauguucagccaauuuuuuuacuuuuuguagagaugaggucucauuauguugcucaggguggucucaaacuccugggcucacacaauccuccugcuuuggcuuuccaaaguguugguauuacaggugugagccacuacauccggccgugauuccauuuaugagaagccuuacaagcaggcaaaacuuaaacuguaauguuagaagucaagguaaugguuaagaggaacugagcaggguuaauagcaugagaugggcuucuugggugcugacagggugucuuggucuggguggugaguacauugguguugaguuuauguaauucauucacuuguacauuuauuuuucuuuguacuauauuucaauaacuuuuuuuaaauuugcccacauuuacaugcuguggaagagagccaccauuaucaaaaugaucacaguugcaaacauucgugcuucaaauaccagccacuauguuagguguguuuuuuauauauguauauauuuacucauuuaaucuucacaacucuaugagguuuacuuuuauauuuuacagauaaggaaacugggacacagaaagguugaguaacuuguugaaguucacccagcuaguaagugacggacucagacuuugcacccagacacucugucucugaccucuaugcucuuaacuguucugccauacauacaauaagcugggaguaugcuuggucuguuugaaggagagcaggaaggccaguguagcagaagugaggcaaguuggggcacaguaguaggaguugaaggcugcauaauagguuauuggaucuugaaggccauaguaggaacuuuggcuuugacuuuaagugcaauuggaagucuuuggguggauuauggcagaggagugauguuaaacuacugcugugagacaugccuguaaaaggugcaauggcaggaacugggagaccaguuaggcuauuagaauaauucaguauuguugaauuagugaaaggugaugugaccuagaccaggguagcagugggagguggagagaaguugucagauacugaauguauuuugagaauagggccgggggguuacugaggaguuuaagggugugaaauagguaauaagggugacuucagaguuugggccugaaaaacuagaagaauggcguuaacauuuaucgaguuggggaagauugcaggaggagcugcuuuggggaggaagauuagguuucuuggaaauguuaaauuugaaauccuuuuagacguccaagugaagguauugcguagacaguuaaaagugaguuggagugagaaguccagaaguccguaaagauacaaaccugguaaucaucaauuugcaggugguauuuaaagauauaagacugggugauaucaccaaaggaaugaauguaaauggagaagucuuuucggcaacaguccaguguguagaugucagggagaugaggaacaguuagcaaaggagacugagaaggagcagccaguaagacggggggaaaccaagaggguaaugucuuacaaagcagaugggaaggccaggcgccguggcuuaagcccguaaucccagcacuuugggaggccaaggcggguggaucacaaggucaggaguuugagaccagccuggccaagauggugaaaccccgucucuacugaaaaauacaaaaauuagccgggcaagauggugggcgcauguaauuccagcuacucgggaggcugaggcaggagaauugcucaaacccaggagguggagguugcagugagccgagaucacaccacugcacucuagccugggcgacagagcaagauuccgucucaaaaaaaaaaagggaaaaguguuuuaaggaagagagagagagaaccucaguuuuuuucuuauuuuuuucuuuuauuagucagcauuggaucagauuguauuuuaagugaaugcgagaaacauaggaaaguuggaacaaaguuugcuaaaagaaguggguuauguggaaagaaaagaagcaggaaaguuauuauacaauggacaggauuaugaaagucuagagguuuuaaaagagaagagaaugccugaccaucuuaaauaccugguagcauuucuuggugucugucuuuccucacugucuuaccagccuuuuaauucguacaggauuuugaaucgaaacaugacugucaugguucaaguuuuugaauacacugauuuaccuucuuuuagggggugacaagacaaccauauaagaaauaggaaaggggcuguuuuacuucucugcuccugagaacuugccccaucagcaaagcccuuuugguuccacucugccuucucuugcccguuauccaggaagaugaaaguaguucagguaugaggagggaacaaaguaaagcugucuguacugaccugacuccucccucugguaauggcaggugacuuaguagagcuggaucagcauuaaacauuaaucuuccagauuuuugacuucaucucuauuaaagaaaaaucuaauguggaaauuuguuucaauuugaaaaguuauuacuuucagugcauuuugcuaaaauguguauuucuacuagcuauuaaagcaagaucaaucuaggagaccuuauguuaagaagagauugugcuaaagaggccagucaucauaguaccuucuaguccacagccucuuaaggaaaccauaggaccagccuauagccaaaccauaacuggucagcagguuagugcaguuagauagcaguuuauauuauuuugcuuuuacucuuggccaugcaaaugcaaacucagaaacaggcaauuaaagugcuguggaagauagagggaaccuggagcagaccacaaaugaauaaaaauuaugaguaaguagaaauuaugagguagagaauagguaugucaguagagaguaaaguaguuagccagaaacaucagaaauacagaaauagagaugcuggccgggcguggugccucauacuuguaaucccagcacuuugagaggccgaggcagguggaucaccugaggucaggaguuugagaccagccugaccaacauggugaaacucugucucuacuaaaaauacaaaauuagcugggcaugguggcgugugccuguaaucccagcuacucaggaggcugaggcaggagaauugcuugaacccaggaggcggagguugcagugagccgagaucgcaccauugcacucuagccugggugacaagagugagacucuaucucaaaaaaaaagaaaaaagaaauagagaugcuuaauccacauuaugguagggaagcgauaaguucuggaaaacaaagcaauguuuaccuaguaucaagaccugcauucaaacuugaacaugcaggccgggugcgguggcucaugccuguaaucccagcacuuugggaggccgaagugggaggaucacuugagguugggaguuugagaccagccugaccaacauggagaaacgcugucuguacugaaaauacaaaauuagcuggauguggugggugcaugccuauaaucccagcuauuugggaggcugaggcaggagcaucacuugaacccaggaggcagagguugccgugagccgagaucguggcauugcacuccagccugggcaacaagagugaaauuccaugucaaaaaaaaaacuugaacaugcuuuugugguguacgaucagacugucuuguaauuucugauuuuuaugugaaauucuugccucuuccuuauuaacauuuuuaucuuuacaauaaaaucccuucuucaguccaaaagagcccaacguuaagcugaguauaaauguuuagacuuaccaagcagauacauaaggaaauacuuuuuaacauuuuuucuuccaggccaggugugguagcucacaccuguaaucccagggaaggccgaaguguggggaucccugugcccagccugggcaacaugacaaagcccuaucucuacaaaaauguacaaaaauuagccaggcaucauggccugcaccuguggucccagcuacuagagaggcugaggugggaggauaguuugagaccgggaggucuaggcuucagugagucgugaucgcgccacugcacuccagccugugugacaaagugaaaccccaucacaaaaaaguuuucuuucuugaaauguaaaagaaaaaugccacggagugguuuaacagauuacaauaaaacacuuaaaauguuaauuuauuugaaggugauuuuuaaggaauaaauauuuuaucuguuauaauaaaaaguuaaacacaaguucauuuaagaaauaauacccucugcacucaaaugaauuuuuuuuuuuuuugagacaaaguuuugcucuuauuccccaggcuguaguguaguggugcaaucuuggcucacugcaaccuccgccuccuagguucaaaugagucucaugccucagcuucccagguagcugggauuacaggcaugcaccaccaugcccagcuuauuuuuguauuuuuaguagagacgagguuucgccauguuggucaggcuggucuugaacuccugagaccucaagugaucugccugccugggccucccaaagugcuggaauuacaggcaugagccaccaugcccagccaucacuugaaugauuauuaacaccggggaaugaaauguuuuucuagguuuuaacuuuucagauuuuuuuuuuuuuuugagaugggauaucucuucauugcccagagcagagugcggugguaccuacugucacugccuaacagucacugcccucaagcuguucucccaccucagccuuccaaaguguugggauuaaaggcaugagccaccacucuggcaacuuuucagaauuuucaagugaccaugauggaguuuaccaucugucaacccccacaccuccacaaacacacaaaaaccuugaaaaucuggacaaaauaaugaaacaauggguuuuagacuuuggacaacagcagugcaggacugugaucccuaaaagaagggaaacaaacaaagugagcuuuacaggcacccacccacccuggcuuuuugccuggggcacauucuaaauuguagaucugggacagggaaucuugagcaaagaacaagaugaagagauagagaucagaauuuauggaagcugaggcagcaagaaguuguagggcaaaguucagcaggaaggacacuuugucaaaauuaaugcuauccauagaagucucugacuuuuugcugaauucuagaaugaacauacauggaguaaaacuguaaagccagacaaagagcaaccagauugaugugaacugacagacaucagaggucacagagggcugggaagcauuugagguuuuacuagcuagaggggaaaguccuuguugaucacucacauugaaggacgaaauaauaccaaucuuaaaaacucuuaaaaaaaaaaaaaaaaagauaaaagggccgggcgcaguggcucacagcaccuguaaucccagcacuuugggaggccgaggcaggcagaucacgacgucaggagaucaagacaauccuggcuaacauggugaaacccugucucuacuaaaaauacaaaaauuaacugggugugguggcgcgugccuguacugccagcuacuugggaggcugaggcaggagaaucccuugaacccaggaggcagagauugcaguugcagugagccgggaucacgccacugcacucccagucugggcgauagagcaagacuccgucucaaaaaaaaaaaaagaacaggaagagaauacuucccaauucauuuugugaggccaacauccugauaccaaaagcaaacacagaaauuacaggaaaauacuacuaaagaacaaugugguucuugaccauagacaaaaauauuuagcaaaauauuagcuuucaggaauauauaaaaggguaauauaccaugaccaauuggguuuuaucucaagaaugcaaaggucccaagguuuacuuaacagucaauaaucaauuaguaaaauucacuacaucaauugaauaaaggaaaaaaaccuauaugauaaucuaaguacauguagaaaagcuuuugacaaaauucacucauuuaugauaaaaacugucagcaaacaagggaacuuugcuuggccuuaugaaguucugcuauaauacaaaaauccuacagcuaauaucauacauaauagugauggacuaaauacuuuccucuuaagauugagaaccaaggcauagauauucucuccucacuuguguucgacauugcacuggagguacuagucagugaauaagguaagcagggaaaaagacguauguaggagaguaaagagcaagacaguguuuauuuguacacaugaucuugaguguagaaaauacuguagaaccuauaaaaguacuagaaaucauaagaguuuaguacagucacaagaacguaauauacaaauauacuuuguauacagauuuacuuacggucgcacgucacuuuaaagacaggaauauguucugacauugugucaucaggcgauuucaucauugugugaacaucaugcagugugcuuacauaaaccuagaugguacagccuauuauaccuauauaccuauauaccuaggcuauaugguauagccuauggcuccuaggcuacaaacaugucacuauacugaaugcuguaggcaguuguaacacaaugguaaguauuuguguaucuaaacauaucuagggccaggcacaguggcucaugccuguaucccagcacuucgggaggcugaggcagguggaucacuggaggucaggaguucaagaccagcccagccaacauggggaaacccugucucuacuaaaaauacaaaaauuagccaggcgugguggcagaugccuguaauccgagcuacucgggaggcugaggcacgagaaucucuugaaccugggaagcggagguugcagugagccgagaucacaccacugcacuccaggcugggugacagagcaagacccugucucaaaaauaaauaaauaaauaaauaaauaacauaucuaaacauagaaaagguaugguaaaaauacaguauuauaaucuuacgggaccaccgucauauauguggucccuccuugaccaaaauguuacgcugcacaugaugguauauguuagugaugaagaguuggaaauagaaauaaaguaguaacauuuauaauggcauaaaccauagugucuagagauaagcuguacaaaaauuggacaagaccuguacacugaaaacuauaaaacacugcugggaaaagucuguaaaugcccaaauaaauaaaauaccacauucauggaucaagcggaagucaguauucuuaaaauaucauuucuccccagauugaucuauagauuaagaauaaucccagucagaaucccagcaggcauuuuuguggagauucuaaaauuuguaugauuaaaauuuguagagauuuuaaaauuuguauggaaaugcaaagacccucaugcaugguuuggcaggucuuagcaagccaacugccugcuuuuggaaaugguuuuuuaacauugccacacuuaguguguugugcguauugucugagccugcuuuugcaguaaaccagcagaguugaguaguuguuacagacaccauaugguccacaaagcuuaaaauauuuuacagaauaaauuugcugacccugcccuagaguauuuaaagcaauuuugaaaaagaugaaaaaggcugggcacaguggcucaugccuguaauuccaucacuuugggaggccgaggcgguuggaucacuugaggucaggaguuugagaccagccuggccaacauggugaaaccccaucucuacuaaaaauacaaaaauuagccaguuguuguggugcacgucuguaaucccagcuacuugggaagcugaggcaggagaaucacuugaacccaggagauggagguugcagugaaccgagaucgugccccuguacuccagccuaggcacagagcgagacucugacucaaaaaauaaauaaaaaugaaaaaacuggaggcuuuauauuauauaauuucaagacacaguaaagcuacaguaaugacgacuaucgucauugacaugagaauagauauguaggacaaugggaaaaauagggaaugaaagcagaccuacacacauacaugguuaauugcuuuuugacaaagguaacaagguaauucagugggaaauggauagguuuuucaacaaauuguacuaggagaacuagauaucgaguuuuaaaaaauugaacauggggccgggcauuguggcuuaugucuguaaucccaucacuuugggaggcugaggcaggcgaauugcuugagcucacgaguuccagaacagccuggacaacauagugaaacucuguccuuacaaaaaaauacaaaaaugagccaggcgugguggugcucgccuauagucccagcugcucagaaggcugagauaagaggaugucuugagccuggaaggggaagguuucagugacccauuaucaugucacuguacuccagccagaguagccagaccuugucucaaaaaaaauuuuuuuugaauguaagacuauuauaauauauucaaaaauuagcuuaaaauggcuugauaggccugacuuacagaagaguucagacuuacagaagaguucagacuuacagaugaacauguagaaaaucuucuggugaagaauuuuccggacacauaaaacauaaaccauaaaaauaaaaaauuuuaauugaacuuaaaauuuaaaagcauguucaaggauacuguuauggaaaugcaaaggcaaccuaugaacugggagaaauaucacaguuuaguauaaacaucugacagagaacuagauuccagaauauauaaagaauauaauaguguuagaguaguaaauauucuuguuuccagaacauaacagaaagaagacagcccaauuaaaaauuugauuugaacagacacuuuaguuuaaaaacugauuugaacagucacgucaccaaaguagagaugggaagcaaauaagcacaugagaacaugcucaaaauaagguguagucauuagggaaauguaaaaaccacaaagggauaucacuacauaccaauuagaaugagaaauuagaauguuuugauucuagaaugaaguugaugauuaucuuuucuauguuuuuguauuuauggaaguauuccuaacucuaaugguugcuuccuauuagaguugggaauacuuccauaaauacgaaaacauagaaaagauaaucaucuuucacuaaucauguagugcuaucccuuugcgguuuuaacuuacauuuaauuagcaguuuuuaaaaguguuaauaacaagucuuaaggauguggagcaagucauuugaucuaggcaucaucgaugauaacaucuauggaaagaaaauagaauauuucugucuuguauuccucuuuacaaguggggaaaacuuccuggaagcccaugcucauggcucaacuagccaacuggcaauagagauaagaccguguaaguggcuuaaauaaaucaauauuuacuacguagggcuggauaggcacugagccuccccugaaggacuuggcaaacguaagaaggaucaacaaaaucacaguucuuuuuaucaaagaagaggaagaauggcuguugacuaaccaaguggcaacuguauuugauuacacuaauacugugaaguagaggaucagugaaguagacaaagaaaugauaggaaacaucuugauaaugcauguguucccaacuuaugaagauauuccaaagauuaccucauuucauggcucacuuauuauucuucaacuuacugcaaucucgcuuuugucuucaugauguuaagaaaugcucuugguaaagucaccagugagcuccaaauuacuaaucagcuggccuuuaaaaaaaucauuuuaagugccacuugacuugauuuugucuuuaacacuauuagccauuuucuuccugaaagucuguuuauucccacuuauuuuacuccuuauuaaaaaguguuaaauuggccgggugcgguggcucacgccuguaaucccagcacuuugagaggccagggugggugggucacaaggucaggcguucgagaccagacuggccaauaaggugaaaccgugucucuacuaaaaauacaaaaaauuagcuggguguggugguacacgccuguaaucccagcuacuggggagggugaggcaggagaaucgcuugaaccggggagcgggagguugcacugagccaagaucacgccacuacacuccagccugggcgacagagcgagacuccgucucaaaaaaaaaaaaaaaaaguguuaaauuauaaaauacuucaaacaaaaauaauuuauccacauuuaacacacuaacauuuucucuguuugcuucauguuucauauaaugaaaaaauugcuacagauauauauauauauauauauauauauauauauauauauauauauaguuguaacucuuucccaaaccuguccagugucuugaaguugaugauuaucuuuucguaucuauggagguauucccaacucuaaugguugcuuccuaauuucucucccugucuuaugcuuguauguagguguccuccaacauuguguuaauucuuuugauuuccucuaaagcuguacauuauuugagaguucuguuaucuuuaaaagauucagauaagccgggcgagguggcucacgccuguaaucucagcccuuugggaggcuaaggcggacggaucacaaggucaggaguuugagacuagucuggccaacauagugaaacccggucucuacuaaaaauacacaaaaaauuagccgggugugguggugugcaccuguaaucccagcuacucgggaggcugaggcaggagaaucgcaugaacccaggaggcggagguuacagugagucgagaucgcgccacugcacuccagccugggugacagaacgagacuccgucucaaaaaaaagagagaaaaaagaaagauucagauaaauuaugaaacuauuuuuguuuaaucuaucucuggcuuccaucuuuuucugagcuuuaaacauauuauuaaucccccaccagacuucacagcaugaaccuaaaacgaaccaucugaaacugguccaaaaaaucuuuuccucuguccucuaccuuaauuaugguguuacucuccacuugguuaaaacuagaaacuuuggccaggcacgguggcucacgccuguaaucccagcacuuugggaggccaaggcagguggaucacuugaggucaggaguucgagaccagccugacaaacauggugauacucugucucuacuaaaaauacaaaauuagccgggcaugguggcacaugccuauaaucccagcuacuugggaggcugagucaggagaaucacuugaauccaggaggcagagguuguagugugccgggauuguaccauugugcucuagccuaggcaacaagagugagacucagucucaaaaaaaauaaaaaacuggaaacuuuuggagucagccaacccuuaauacacguauaguaaguacuuuaaaagguucaauaaauacugaagaaugaaugacuuuuucuuuuuuuuuuuuuuugagagggagucucgcucugucgcccaggcuggagugcaguggugugaucucggcucacugcaagcuccgccucccggguucaugccauucuccugccucagccucccgaguagcugggacuacagugcccgccaccacaccccgcugauuuuuucuauuuuuuguagaaacggguuuucgcccuguuagccaggauggucucgaucuccugaccucaugaucugcccgccucggccucccaaagugcugggauuacagaugugagccacugcgccuggccucgacuuuuucuuaaugucuccucuuuccauauuuaacugacaaccuugauuauuauacuuauacacuucucauuucccccauuaucacuggccccacacuguuccagcucgucuuuuuuuuuuuuuuuuuuuuuugaagacaggaucuccucugucauccaggauggagugcaguggcacgaucacagcucacugcagccuugaccucccugggcucaggugaucuucccaccucaaccucccaaguagcuagaacuauagggaugugccaccacacaccacaacuggguaauuuuuuguauuuuuuguagagacgggguucugccaugacgcccaggcugcucucaaauuucuaggcucaagcaaucuuuccaccucagcuucccaaaaugcugagauuacagacaugagccgccacaccuggcugcuuuugccuuuucucacaugggucaguuggaauaguuuuauaacuugucuaacugcugucauuuuuucuucuuucuaggcuguauaauucauccuuuugucauaguuauuauaaaacacauaucuucugcuauuccucaaaacaaaaauucuggauuccuaaugcucccuggagaaagucuaaaaguuauugcauaacaaauaaucuucuauauuaaaucuccucuagcugccuguccuacccagcucacaaacagccccucacacucuuggaacagagaaauuuucuguuccuaaaaugaaccaugcuguuucaagcaucugagccauucuguacacuuuucauucuuccuggaauauccuuuucuuucccccaagucuccaacucuucaagaccaagcucagauaccacuuccuuugcaaaacuuuuuuuccuaagugcuuuaagcagagcugauaacauuuguuguauuuccaugguauuuuguacauaccuccacucuaacauuuugucacacucuagcauuuuucacauuguacaguguuguauuuguuucauacauuugugaccuuuuaaugaaaagggaccauuuauuguccucccagcuccuuuuacagugucuaauauacaauauuuuuaguuuuugguuuuauuuugauagcuuuugagguacaagugguguucgguuaaauggaugaauuauguaguggugaauucugagguuuuggugcacccgucaccggaguaguguacguuguacccaguauauaguuuuuuuuaaucccauaauguauguuauuaaugaauauauaagucaguagcuuggaacuuggaagagacuuuuccauauaaauguuuuauuuuuuuauuuugggggauuuuucuuguuugguuuauuguuuguuuuuucuuuccaucuuuuauuuuagauucaaggggugcacgugcagguuuguuacauggguaaauuguguguugugggguuuggccuacagauaaauuuuguuacccagguaaucaguguaauauccaacagguagguuuccauauaaauguuuuaaaugauguuacauuucuuuuuucuuuuuuuugagauggaguuucgcucuuguugcccaggcuggagugcaaugacgcaaucucggcucaccgcagccucugccuccuggguucaagcgauucuccugccucagccuccugaguagcugagauuacaggcaugggccaccacgcccagcuaauuuuguauuuuuaguagagacaggguuucuccacauuggucaggcuggucucaaacucccaaucucaggugauccgcccacccuggccucccaaagugcugggauuacaggcaugcaccaccacgcccagcuaauuuuguauuuuuaguagagacaggguuucuccacauuggucaggcuggucucaaacucccgaccucaggugauccucccaucuuggccucccaaaguucugggauuacaggcaugagccacgaugcccagccaugauguuaacguuucuaagacaacccauaaaaaucaguuuaacucauauugcaccugaaauuuacuuaaaaaugugaaucacguaugacauuaguaauauuucaaaaugagaugagcagcaaugauggguccuaugcauugauacuggggugcugguggaauuggacugaaauuaaugggcuauccuagaguuauuggaaagauaagugcguagaugugugaggcauuaggcucaauacucuggauuaagaaaaugaggcuggaggacagguuaagcauaguaauggaagacuugauagggugaggagaaaaggugugacuuuugagggaagaggacuuuaagaugguuauggguaaaggaggugaggaugaggaauuaagcugggaauggaaacugagguaguugggcaauuauaggagccucuguugugaauugacaugguauuuccgaguuggccuccuaucagaauuuaaauuacaguauuacuggguuucccccauaauuuuuccuccuucauacaacugcuguucuuucaaaguauaauuuauguaauaauuaaugcuguuuucuugauauuuagacuuuggaugcagguaauuuuguaaauuccuuguaccgacuuuuaagauuuuuacaguuaaacuuuuuuuuuuuuuuuuuaaacggcaaagaacagugcuuggcccugacagaaagugggguggggaacaguagaccuuucccccucccaguuuuuacauauuuuguggauauauauugauuguuacaauuuugccuucaggcuuaaguauauugagucaaaaucuuccagucugguaaccacaaaagguaucuucuuauaaugugcauuucuuggaagacugggaagguuggaugcauuuucauauguuaauuggccuuuccuguguugugaauugucucuugauagguuuucauguuuuucuguuggacuuuuucuuuucaugcauaagaguugucuguauuaagagugucaaccagauuccacauguguacauuuauuauauauugagagaacaagaaagcaugagcaaguacaaagauauuuuagcuucucuuaaacuucuguccccaccccugccccucucaauguggaaguuacuuuauacuuuaaaagacuuuuccaacuuuagauuaugaaacuacuuaccuuuaauuuuuucuaauacuuuuagaagcaacugccuuuuauauauuuagcuuauaauuccuuuacaauauuuucacuuuagucaucccucaagauccaugggaaauuguagagccuucuagaaccuccuguggauaccaaaauccccagaugcucaaguccaugauauaaaauggcauguauuuguauauaaccugugcacaaaucccccauaugcgguuuuuugggguuuuuguuguuguuguuguuguuuguuuguuuuuuuuagacagaaucucacucuuucacccaggcuggagugcaguggcauaaucuugacuuacugcaaccuccgccucccagauucaagcgauucuucugccucagccucccgaguagcggggacuacaggugcgcaccaccacacguggcuaacuuuuguauuuuuaguagaggcaggguuucaccauguuggccaggcuggucucaaacuccugaccucaggugauccacccgccuugucccugcaaagugcugggaugacaggugugagccacugugcccagucccccuguaugcuuuaaauugucuccagauugcacuauucacaauaacaaagacuuggaaccaacccagaugucccucagugauagacuggauuaagaaaauguggcacauauacaccauggaauacuaugcagccauaaaaaaggaugaguucacguccuuuguagggacauggaugaagcuggaaggcaucauucugagcaaacuaucacaaggacagaaaaccaaacacugcauguucucacucauaggugggaauugaacaaugagaacacuuggacacaggaaggggaacaucauacaccggggcuugucgugggguggggggaggggggaaggauagcauuaggagauauaccuaauguaaaugacgaguuaaugggugcagcacaccaacauggcacauguauacauauguaaccugcacguugugcacauguacccuacaaccuuagaguauaauaauaauaaaagaaaaaaagaaauaaauaaauugucuccagauuacuuauaauaccuaauacaguguaaauaguuauuguacuauguuguuuagggaauaaugacaaggaaaaaaagucuguacguuauuuaguacagacacaauuuuuuucugaaacuuuugaaucuuggcugaauccauggaugcagaacucauagauacaaaagaccguauauuaaguuuccagauccgguuauggguuuuuguuguuuguuuuuugagacggaguuucguucuugucgcccaggcuggagugcaauggcacaaucuuggcucacugcaaccuccgccuccuggguucaagcaauucuccugcgccagccucccaaguagcuggaauuacaggcgcccgccaccucgcccagcuaauuuuuguauuuuuaauagagacggaguuucaccauguuggccaggcuggucucaaacuucugaccucaggcuguccacccauuuuggccucccaaaguguugggauuacaggcgugagccaccgcgccuagccccgguuauauuuugaugcuuauaguuaacucacaucuuuagaauauaccaauuuaagagagugaucuaaaacccaauucugagguucugagacugcuucuauuuuaauauauguagcuacauuuuaaauuauuauuauacagcugagguuguaaauguuuagucuuucagaauuuaugaggcggccaacacucaccuacuuccuuuugaaugucauagaaagggaaaaacuauacaaauaagaaugaccuuugaaaguuaagugaauuaaugaauucuauauuagugcuucuguagacagugaauagaauaaugcagauuuuguaauguuaguaaaccuauaugauagauaauacgguagguaagcgaugaguaaagcacaacucuuguuuugaaggaguguauugccauuaauuuggggguagguugggauuugaccaguaaauuaaaaaugguauauaaaauggaauaaagugagccucauaagaaaaucuccccaaagguauauuguggguuuuaagagaaaagauauuuuacugauuauaaggaaagccugaauggaaaaguaacauuugugaugaccaucagugaaaggauaggauuuuagcagguagagagguggggagaauacuuggaacagagacaauuuuagaagggggaaaaagaaacccaaaaugggaaagcacagggcauaugcacuggggaaacaagauuugugugugugugagcguaaguaugaggacaguaggaaauaaaguuggaaagguuggaaagauagauugggguuaaauuuggugagcguuagggguguuuccauugacagggaagggaaaagguauagaucuacuuuguccuguaugauagccacuagccauauacaacucuugagcccuugaaaugucucuaguccaguugagauguacuucaaguacaaaauacacaucagauuuuuaaggcucaguaugaaaaaauaaaaugucauuaaaauguuuauaucgguuacauguugaaauaaauguuuuuuauauacuggguuaaauaaaauacuaaaguuaauuuuaccuguuucuuuguauuuuuuuaauauggcuacacuaaauuagaaaauuuaaaauuauguggcucacauuugugacuuagauuauauuucuguugacauaguccugguauagacagaauacaacaguauuugcuaguacccauugugugccagauugucuagaauuuguaauaaaguuaauccucauaguaaaccuuaugagguagguuuuucucuuuuuuuucuauuuuguuuucuuucuuuuucuuuuuuuuuuaacagauaauuuuaucacccagaugcuuuuuuauuuuuuauuuuuuuugagacagagucuuacucugucacccaggcuggagugcacuggcacgaugucagcuuacugcaaccucuuccuccuggguucaagugauucucaugccucagccucccuaguagcugggauuacaggugugcaccaccacgcccagcuaauuuuuguauuuuuaucagagacaagaguuucacuguguuggccagguuggucuugaacuccugaccucaagugaucgguccgccuaggcaucccaaagugcuacaauuacaggugugagccacugcgccuggccccccagauacuuuuucuuucuuuuuuuuuuuuuuuugagacggagucucgcucugucgcccaggcuggagugcaguggcgcgaucucugcucacugcaagcuccgccucccggguucacgccauucuccugccucagccucccgaguagcugggacuacaggcgcccaccaccacgcccggcuaauuuuuugcauuuuuaguagaggcgggguuucaccguguuagccaggauggucucaaucuccugaccucgugauccgcccgccuuggccucccaaagugcugggauuacaggcgugagccacugcgcccagcgauacuuuuucaaguaacuggagugcauagagguuaagcaacauacccugaaaucacuccacuacuaaguaggaagccaggauucaaauuuaggccucucuggcuucagagcccaugguuuuuucccaauauacuguggcauguugucauuggacuauuaaaggugauugaguuggagaaugaagcgauuggaguagggcuuuugcaaauuguaauaaagauaaaugaggggaagagaccucguuuucagcuuucuauuuuuuguuuuguuuauguuccuuuuugcagggauggcauaugcuuuucuuaaaaugauuuuuugaacccugucuuuuugaaguauccuguguguuaacugacucucaaaauauuuuauugucucuguagauuugauaaugggcugcauuaaaaguaaagaaaacaaaaguccagccauuaaauacagaccugaaaauacuccagagccugucaguacaagugugagccauuauggagcagaacccacuacagugucaccauguccgucaucuucagcaaagggaacagcaguuaauuucagcagucuuuccaugacaccauuuggaggauccucagggguaacgccuuuuggaggugcaucuuccucauuuucaguggugccaaguucauauccugcugguuuaacaggugagauuuaaauggacaauuauguugucuguuugagaacaucaccuuggguaauauauacuuaaggcuugucugccuuuaagaaagauaucuuacuugaggacuuuucaaauaauuguaugugaaaaucagucucuaacauaaaaauuaguuuuauuguauacauggguaugguucuggaaaauugguaguaaccugauggugauuauguacuggaucaugucauuaauuauuuuauuaacucauuauucaaauaguuauugagcccccccccacuguaggcaccgggaacauaaagauuaaaaacauauaccuuucccucaagaauuugacaacuucucaggauuguaaaguacuuugcaguauuaaagucuuauagugguuacuuaauagauguuaauuaaaugacaguagaguagcgauaauacagaauuucucccagaugcugcugauuuaaaaaagaaaaauccuaaagcucagacaguuuaaaauuuucccccaagucacagauaguaaguaggagagcucagauuuauuguccuauuccagaacuccaauuauuacauuauuauauccuuuuagagaauagcaagaagugauuguugacaaccuuucguggagacagaaggcucuuaaaaaaauagauucaaacaauuuuaaaagagagaaaaugagcucuuuuguaaagggucccguaucaggaugcuuuuucacugaaguaacaaaguauagcuggcuuaaaaagguagagugaguuucaggauuccuugauagagcaguuccauggugucaucaaggacucagauuucuuuaucucuauucugcagcccuugggagugucugcuuuauccuuaggcuuggcaaaacagcugccagcaucaaaucaagcaauauauguccucauuaacagccagugggugcaaaagauaaauccccacuacaagcauagacugacuauacauuugucucuucagucuguuccaacuggaccaaaaacaauagccaggccaggcgcaguggcucacaccuguaauccuagcauuuugggaggcugaggcaggcagauugccugagcucaggaguuugagaccagccugggcaacauggcaaaacacugucucaacuaaaaauacaaaaaaaauuagccaggugugguguugcgcaccuguagucccagcuacucgggaggcugaggcacgaguagugcuugaacccaggaggcagagauugcagugagccaagauugcgccacugcauuccagccuaggugacagagcgagacucugucuccaaaaaaaaaaaaaaggcaauggccagaggacugccauacacugauucuguuagacuucauuuagggaguuaugcauguuaagucaauuacagucuuaauuccagcccccuaauucugaauacuucaguaguagauggccaugagggcauuucuaagucuuuagcaaaaguuuacuuuuagaguuauguuugggaaagauaguaaucuaaaaugguugaauauugauacuuaaagacacacuuuaguuaccuaaagcaauuuacuuauaugaaauauucuauuagggguauucauuuauuaacucaguguacacucagugucuguguaucagguauggagaggugagcaagacaaaguuucuguucugauggagcuuacauuauagaggguuggacaauaauuaaugaauaaacagcuaaacaggauggaugauuaaugauccuuaaaugcuaugaaggaacuaacuagaaugauggugaaggcccugcaguuaaucagggaaagcuaucucaagaagaaaucauuugagcugagauuuuuuuuuuuuuuuuuuggaguuggagucucucucugucacccaggcuggagugcaguggcgcagucuuggcucacugcaaccuucugccucccagguucaagccauucucuugccuuagccucccgaguagcugagauaacaagaaacaaacaccacggcacccggcuaauuuuuuuuguacuuuaguagagacgggguuucaccacguuggccaggcuggucuuaaacuccugauuuaggggaugugccugccuuggccucccaaagugcugggauuacaugcgugagccaccgcacccagccuugagcugauauuugauaagugagaaugacccaccuaugugcaauccugggaaagagcuuucuagagagaggaaauaacaaaugcaacauuuaggagauacagagagacuuggaaguuuugaguauuaguguggagacuaguauaaacagaggggagaauuguauuauaugggauugaagaguuaggagaccacgauuacucaggaccccacagacucugguagcgaguuuagguuuuauucaaagcuaggaagaaacugcugaagagauuaaguaaaggauuugauugaauuuucuuuugagaaaaacugacucugacaucuguguggggaauggaugguagagaagcaguauagaagcagaugagacuggcacucucaguaguccacccagucccugugagaaaugacaaggacuuggguuaggguagcagcaguggaaauggaaaguaaauaguauuuuagagguaaaacugauagcacuaguaauggacucggcuugaguaccugauuagaugguagggccauuuacuuagauaggaaagacuuggguauguaaauauagguuagaggagaaaaaucaagagcuuuguuuuguaauaaauuuuaaaugcuuauuagacauucaaguaaagaugucagccgggcaggguggcucacaccuuuaauucuagcacuuugggaggccgacucagguagaucacuugaggucaggaguuugagaccagccuggccaacauggugaaaccccaucucuacaaaaaauacaaaaauuagcugggcguggaggugcacgccuguaaucccagcuacucaggacgcugaggcaggagaauagcuugaacccaggaggugagguuguggugagcccagaucguaccacugcacucuagccugggcaacagagcaagacuccgucucaaaaaagaaaaaauuuuuuuuugaucugacaagucagugggauuauguugaguagaguauauacauauucaaauuaaaaauauguuggcuaaaggauacaaaauuuagauaggaggaguaaguucaagagaucuauuguagaacacaguuaauaacaauauauuguauucuugaaaauuacuaacaaaauuuuaaguguucucaccacaaaaaugauaugugaugcaaugcauacguuaauuagcucuacuuagccauuccacaauguauauauauuucaaagcaucauguuguaugcaauaaauauauacaguuuuuuaaaagaauauuaauauauuauggaguuuuuaaccugaauaccugccuugaauaauuuuaacacugagaugucaugcauauuguauacaucuguuuuauuauuuguuuuguuugcaaauaauaguuuggcuguucaguaugcuaaucucuuuaagcaucugcacauaaugcuaaauaugacaguuuuugaauuuauacuuuauaauucauaucauccauaccauuuuauuuuauuuauuuuuuugauacagagucuugcugugucacccaggcuacagugcaguggcauaaucucggcucauggcaaccuccacuuccggguuucaagcgauucuccugucucaaccucccaaguagcugagauuacaggcaugcgccaccaugccuggcuaauuuuuguauuuuuaguacagacaggguuucgcccuguugaccaggcuggucucgaacuccuggccucaagugauuugcccaccucggccucccaaagugcugagauuacagacgugaaccacugugaccgucugauaccauuuaagacaaaacaugacauuuuuaucuuuaaguguuaaauauguaauaauuuugcuaaaacuaguaaauuaguuauuacugguaaugauuagaugcaauuguucauucauuauuuauaugaagaacacugccccacuaguuuguaguagucaucaauccuuuuucugucaaauaauugauuugaaauuugacugcauuuccaagccugagauguugcuacagugagucaaaauuaaauuuguuggcugggcacaguggcucacgucuguaaucccagcacuuugggaggucaaggcaggcgaaucacuuggggccaggaguucaaaaccaaccuggcuaacccagugaaacccugucucuacuaaaaauacaaaaaaauuaacuagguguggcggcacaugccuguaaucccagcuacuugggaagcugaggcaugagaaucacuugaaccuaggaggcagagguuacagcaagccaaaaucacaccacugcacuccagccugggugacagagugagacuuugucucaaaaagaaacaaaauuaaauuuguuucuccaagucuacagaguuuuauaauuuguagaauacaguaguuuuauggaaggucuucggagaguuuaagacuaguuauugcuaccaguuauugaguuauugucccagaacauaaaauauggucaugucucucuacuuuaaaauucuucaguaguuccaacuucuaaaaauaguuucuggagacuacagaaaaaacuauccuuaagcuuuuuuuuuuuuggcuggcaauaguucuuuuuuucuguuuuguuaaguuagcuacauaauuuaccuuggucuuuuuucccucugauaggugguguuacuauauuuguggccuuauaugauuaugaagcuagaacuacagaagaccuuucauuuaagaagggugaaagauuucaaauaauuaacaauacguaagugucaugaauauuuugugagagaaauacugacagaaaucuggucuuuacacaggaaccacugagcugguugaugauccagagaugagagagguagggcaugggcugcccacuguguuuaacgaugcauuggcuucuauagaugcauguugcaacacugcugcuguagccagaaguuauuacuucuacaauuugugcugcugugguucugccauaaacaguagagauuuaagaaugaagaguuacugaggggaguacaugcaaguguauuauuuuuuuaaaaaacuuuauaaagagaguuugaugcuccuauuuuucuaaguaccagaugguguaaagaucuugucucauucuauuaaaaaaaaaggagggggagaaaguuggguaaggaacccaucuacuuuccaauugaugaaauuaaguuguguuuuuccuuuugugacagacuuuuugucuagagguacacuguagaaaauuugaugcucguuguagaaaguagaucgaauaauuucauuagcaagcauaaugaccacuuuguaacuucucaaaauauauauuuauggucugcuuccagucguauuuucuuccauccauguucccaucugcuaccaguuauuguuccggaacauaaaauauggucauauccuucuacuuuuaaaauauucaguaccuaccacuugccaucaagauaaaaggaaaacgacaaugauaacaacaaucauucauugagaauuuacuaugugcuucuccccucuucuaacucuaauacccagacauacugaauuacuugcaauuuucugaguacgcuggaguuucuuauacucucaugcuuucacacauacuguuucuuuuuucuggaaugugauuucucaucuuuccauuucuuuccuuuauuuagcuaauccuacucacccuucaaaauauaguuaauauguccuuucucaagaugccuuuccuuaacauucuuccuccccugccuggcccaguccuuauccccugcuggauuaaguaucucucuuagguguuuacauagcacccuaugcaaaccucaaucauagcugucaucacauuuugaauuacaauuugucacuugcuuguuauucuuuuagaccaaugguucucaaccugggacagaaucacccaggggauauuuggcaguaucuggagacauuuuugguugucacaguuggggugcugccgcugucuucuagugaguaguggccagggauauugguaaauaucuuaaaacgcacacagcagccucccacaacaaagaaugaucaaguccaaggugucaauagugcugaaguuggaaaacccagcucuagacugugaauuccuugaagucaaggacugucuuuuuacuuuuauuuccagcacacucuaaagucugucacuuaauagguauucaguaaauguuagagugaaucaaugaaugcuuagcaggaucaaauacaagguuuuugguuuguguaucugaaagugcuuaguauauaugaggaaccacaaaccaaguguaugaguuucuaaauauuugaauuauuaagggauuuuucauucauuuucuagagagcaaauuuaucuaggcauuuauaacauuuuaauuuagacagugccuuuucaguuuuuaucuuuggugaagcaaaacaugaauuuaaucuuuaguaacaaaucccauaucuaucuuccuauuuaaagacuaauuguauuuggucuuuucacauuaauuuugaaaaaaugacggcuuauguguuauaaaccacauguaguucucauguucugaauuaucauuuaauuuuggucuuacuggaauauuucuagauaacuuuuuuuuuuuuuuuuugagacggagucuugcucugucgccaggcuggagugcaguggcgcaaucucggcucacugcaagcucugcccccuggguucaugccauucuccugccuaagccucccgaguagcugggacuacaggcgcccgccaccacgucuggcuaauuuuuuuuguuuuuuuuuuaguagagacgggguuucaccguguuagccaggauggucucgaucuccugaccuugugauccgccugccucggucucccaaagugcugggauuacaggcgugagccaccgcgcccagccuucuagauaacauuuuuauaaguaugcauuauucuagaaauucaggggguuuuuuuguuuugcuuuuguuuuuuugagauggaguuuugcucuugucacccaggcuggagugcaauggcaugaucuuggcugacugcaaacucugccucccagguucaagcgauucuccugccucagucuccugaguaacugggauuacaggcacacgccaccacucccaccuaauuuuuguauuuuuaguagggacaggguuucauucaccauguuggccaggcuggucacgaacuccugaccucagguaaucugcccaccccggccucccaaaguacugggauugcaggcguaagccaccgcgcccggccagaaaugcaguuuuuuuggguuuuuguuuuguuuuguuucuuuguuuuuuuuagauggagucucgcucuguagcccaggcuggaguccaguggcaugaucucggcucacugcaaccuccaccucccagguucaagcgauucuacugacuuagccucccaaguagcugggacuacaggugcaugccgcugcaucuagcuaauuuuuguguuuuuaguagagaccagguuucaccauguugaccagacuggucuugaacucuggaccucaggugaucugccugccucagccucccaaagugcugggauuacaggcuugagccacuacgccuggcccagaaauucaguuuuuaacuuuguugcucauuguuaauugucuggcuacaggaauguuagagcauugugauuuuuuuuuuuaucuaaaaugaguaaaaaagaguauuacaauuuuauguacuauaaagagaaaagcauuugucaguaaagaaugaacuacugauagacaugcuauaaccuagaugaaccuuuaaaaaauuaugccaaguaaaagaagucaauuacaaaagaccacauaaaugcacauauuuucauuuauauaaggugcaugcagugggcauauccauagagacagaaagcugauuagugguugacagugguuggagguaguugggggugcagagugacugcuaauggguacagaguuucuuuugggggugaugaaaauauucuaaaauugauugugauaaugguuguacaacucuguaaauauauuaaaaacuagugaauuguacaucuuaagugggggaauuuuauggcaugcaaauuacaccuuaaagcuuuaaaaaaaaaaaaaagaaaagaauacugaguaauuugaaagauuuaccucccaaauuguuuuauucacuaucgucugucuuagguugaaagaauuguguuaaaaaaagaaaucuuauaacuaaguguguaggauuuugaggcuuuauuuggagcagaaguaugcaauugugcuuccuuuaauucauguaaccuauuuuuuaauaucauucuuugaguuuaauucuucauccaaugaaugcauaaauaaaaaaugaaaguaauacccuuuguuuacuucagauacaagauagcacugcaauauauuguaccuugggcaauagucuaccuugcggugauugcuguuuuauguguugcagggaaggagauuggugggaagcaagaucaaucgcuacaggaaagaaugguuauaucccgagcaauuauguagcgccugcagauuccauucaggcagaagaguauggcacuacuucauauuuuauuaauuauuuugauuuuugaaauguuuuaaugcacauucuacuuagccacaacuuuacacacacagaauuauauaccagucuuaauacagcuuauguaucauauuaauagauguuacuuaaaaauuaauaacuaaugucauacuauucacuuagaguaggaucauaaacgaaucugcaucagucauauuuccuuaugccuagucucucucuuuuauguuuucacuuaaauauguaucuauaagccuuuugcauauuuuucagacugucucacuucaaaaauuugccuucugauuauccucauucccugccuugacuuauuuuuuaacuuacagcuuauauaugaggguguguugauagggauggguauauugguauauauaugcaucccauauuuaugaugccaagacuuacauucuucuuuuuuuugagacagggucuuggcucugucgcccaggcuagagugcaguggcgugaucucggcucacugcaaccucuaccucccaggcucaagcaauucuccugccucagccucccaaguagcugggacuacaggcaugcaccaccacgcccagcuaauuuuuguauuuuuaguagagacgggguuucgccuauuggccaggcuggucucaaacuccugaccucaagugauccacccgccucagccuuccaaagugcuaggaucacaggcgugagccauugugccuggcccaaagacuuacauucuuuaagguuuuacuauuuuugaaauauuucagagauuuauuaucauuuuaugauuauaaaaguaauaugcccaugaaagaauauuacuuucaguuaguuuuauaugacuguuaaugucuucauuuaagcacuugcauuguaguuauguaggaaaguauccuucucuuuuagcaaguacacacugaaguauuugaggcacuaauucagcauguuugcaacuuacaauuaguuaagaaaaaauacauguguauauauauacaugcacacacauacauauguagagagggagagaguaugacaaagcaaaauguuagccauuggggaaccuaguuguaggguuuauuguaggguguaugggaguucuguguccuauuuuugcaacuuuuaaaaaguaaaaauucaccuucagugacacacuacuuuuagguuaaaccaguuuaucugggauucauaaacgcuacuuuauuuucauguuauaacacuuaacaccguaccuuguauaugauaggugcucuaucaauguuuguuugcuuuuauuaaugauuuguaaugugucucaauaacucuuuguucuacuauggugcuucuuacuuuuuguuuuguccuuuugucuuucuucucauuuucugugagcucuuccauagcagacacugucauuuuauucacaaaaccuuauuaaauuaaacccacacauauuuagaguuacuaauaauuuggguaugauaugccugugucuuacugaaugcagaugaugaugcuguuaccagggaaccacuucuauucuuccugucauagucuuaauauuuccauuugucacugacagaaagggucuguuauuuugcugccuuucccucucuacuguuccugugacugucagguggaguuuugagagacacauugaguaguuaauauauagaaauacuguaagaguauauucuaacaguaauauuugugauauuacuauuuaaucaauaaaacucuuacauuuuccuguauuuugagccauguucucuagcuauucuuugucguccaaaccuaucccaguccauucuuacugacacuucuguauaauuuuucugaaccucauacuuuucaauucaaaacacuuaauuuuuuuccagaugguauuuuggcaaaauggggagaaaagaugcugaaagauuacuuuugaauccuggaaaucaacgagguauuuucuuaguaagagagagugaaacaacuaaagguaugaauauuguuauauuaguauaaguauaaaauuucuuggggcaguauuuugagaaagauauagugaaaguauuuauuuuucacccaggugcuuauucccuuucuauucgugauugggaugagauaaggggugacaaugugaaacacuacaaaauuaggaaacuugacaaugguggauacuauaucacaaccagagcacaauuugauacucugcagaaauuggugaaacacuacacagguaugugaauauuucaaagguaaaaauuauuucuucauauucuaguuuaugaggacaaaauccauauccucauuucucuuaagauuuaacacacuuauuuacacauaauacaugcccaauaaaugucuguuguauucuaaagggaggaacagguaauacuuaguacuugcauugugcuacucagauaaugugcuaauagacucucaucauuuggguccuuauaucuuacuggcauaguauuuacauuggaguucauuucaccacauguaccuuaugaaaauaaaccuaaaagcaaauauuuaugggcacuuaguaaguaaaacuaaacauuggguaacagaaaaagcuaugucagaaggauuaccuuccucugcaugggcuggaucgcauaagcuuuccuaaaguauaaauccagugaaauuuggucugacgaugcauuuuucuuauccuagaaaauuaaccuauagcaauuauagacauuuuugucuuucaaggaccucugaagguauuuaauauuagaaucuucugucucaaaauuuuucauuaccaauuuggcauaugaaugcaccugaaagucuuuacaugauuaauacuaggagaggggauguuuccaugguaaugucuucaaugacagcuagcugcaaacugagucuaucaagucagccagcaaucuugacauugaucaagcauguuaccaagcaguggcaucacuuguaauugccuuugucacaaugugaauuuaugugguuauuuuagugagaauaggagagaacaugucucauuuauaauaagaaagauuguauaagcagaauucauaagucaagcuguuaugaaucuaggguucccugacuuugugucucccuuauuuaaaaaaaucagucuccuguuaggcauguggauugugccuuuaaucccaacuacugaugcaggaggaucacuugaggccaggaguucaagaacagccugggcaacauagcaagaccucaucucuuaaaaaaaaaaaaaaaaaaaaaaaaaaggccaggcgugguggcucacuccuguaaucccaccacuuugggaggccgaaacagacagaucacuugaggucaggaguuugagaccagccugggcaacauggcaaaacccuaucuauuaaaauauaaaaaaauuuagccaggcgugguggcaugcaccuguaggcucagcuacuugggaggcugaggcaggagaaucacuugaaccugggagguggaaguugcagugagcugagaccacaccacugcacuccauccugggcgacagagugagacuccaucucaaaaaaaaaaaaagaaaaaaucuccuaaaugauccuaaaugaacuuuuuccuugauuuuuugguaugccucuuacaaauuaguggcuauuagauaauaacauuuaaugauaacauucucuuugagaauuaauaaaacccaguguacaaaggcagaacuuuggaagcagacagaccuagauuugaaucccaucucuaccauuuacuaacugcagggccuuaggggaaaguugcguauguuuucaaagcuucauuuauauaugagauacuugugaagugcuaauuuagcacaauaguggaacauacuaaguauuuaguaaauaauaacuuaaaaaaauauauauuuuaaguuauacuaaguauuuaguaaauauacuaacauaucuacuauauauuaguauauacauacuaaguaguaaauacaauauauuuacuauauauuaguauauacauacuaaguaguaaguaauaacauguauauauauauauauuuuuuuuuuuuucgagucagaaucucacugugucacccaggcuagagugcaguggcgcaauuuuggcucacugcaaccucugccuccuggguucaugcgauccaucugccucagcuuccuuaguagcugagacuacaggcaugcaccaccaugcccggcuaacuuuuguauuuuuaguagagacaguguuucacuguauuggccaggcuagucucgaacuccugaccucgugauucaucugccucaaccucccaaagugcugggauuacagacgugagacaccuugcccggccuuaaaaauaaauuuuacaaaauguuucacuuauguauauuucauguuuugcugcuuauggacaacucccuuuuuguuuugugcuuuuagaguaaaacucgaaaggacuucuguuuuuguuuuucuacaguuuaaacuuaaaacauugauacacuauaugccccuuaauuuuuguaauugauauuacaguauaguuuauucauuuaucuagaacaugcugaugguuuaugccacaaguugacaacuguguguccaacugugaaaccucagacucaaggucuagcaaaagaugcuugggaaaucccucgagaaucuuugcgacuagagguuaaacuaggacaaggauguuucggcgaaguguggauggguaagaagccugaauuuuuguuuucugucauuguuuagcuguggauuaaagugcaacaauuuaugauaaaauauguuucaauauuuaagagaagugcuguucacugaaguuuggucuaaaauccuuuaaaauauaaauuccuaaaauguguuauuucuuuaggaacauggaauggaaccacgaaaguagcaaucaaaacacuaaaaccagguacaaugaugccagaagcuuuccuucaagaagcucagauaaugaaaaaauuaagacaugauaaacuuguuccacuauaugcuguuguuucugaagaaccaauuuacauugucacugaauuuaugucaaaagguauguauuaguaucuccuuagguauuuguguugauaauguuuuuaagagucuugauuuguaugcauauagacuuauacuguuuucuaauuuaagauuuuuauguagacauauuuggauagaagaaaccugacacuuuguuuaauggaauagugauuauccaguuauuccagaggauaguaugacguuuaaaaggaaaaguaggcaggcugaauuaauuuugaaauuaaguuugacuaaaacaaauggaaaagcuagaaaggugaaaaauagaaaguguuuguacacauuuaauuaaaaugauaaaaucagaaagauacuuacauuuuuaguacuaaagcaaagaaauaagguaaaguuaaaaugaauuaguuuucucauuuuaauauaaacauaauuccuauauucaggacuucuaggaacuuuuuuccccacugcuuucuuuuuuuuuuuuuuuuuaaauagagacuggggucucaacuauguugcccaggcuggucuugaacuccuggccucaggcaguccucccuuuuuggccucccaaagugcugguauuaccagcaugagccacugugccuggccuccccacuaccuucaauggaaguuucuucauuuuccuuaacucuagaccacaagaugggaucuucaguaacaggguuaguuagggggaggauaaagagaagauugauacucuuuccucuuuuucccugugcagaugguacuuagaggaacuaguaagucagcagauaagcugacaggccugauuuuuauguguuugauuucaucugcuuuauuauuauuuuuacucuugaaccaauaauauacaguagucacuaauuaugucacccucuccaguggugugucuuggucaaugauguaguuccaucuaguggugacaaggacaacuacaaguuacauauuugcuguaggaaaauuuuuccccucaaaaggggacugaaaccaaaaguuaagaaauuauacagccuauuaauugauagccagaacacaccuaaagacccaaagcaccuggcgcucuuuggaaggaaugucuacugcaaacaguugccaaauaugacauuuuuuuguuuguuugcuuguuuguuuguuguuuuuguuuuuuugugagguggggccucacucuaucccccaggguggagugcagucacauuucucugcagcuuggaccucccugggcucaagcgauccucucaucucagccuccugaguagcugggauuacaggugcaugccaccacacauagauaauuuguguauuuuucuacagaugggauuucacccuguuucccaggcuaguuuggaacuccugggaucaagcaaucagccugccuuggccucccaaagugcugggauuacaggugugagccaccacacccagcccaaauaugcccuuucaaagaguauauuagaugaaccagaggggaagggagggccaggcaugguggcugaccugagcaacauggugaaaccccaucucuacaaaaacuaaaaaaauuagcaggacgugguugcacacacauguauucccuacucaggaggcugaggcaugaggauugcuugagcccaggagguuaaggccauagugagcugugauugugccacugcacucccaucuggggugaaaaaaugagacugucucaaaaaagaaaaaaaaaaaaaggagaaaaggacagggaagauguuuaaaucaagauauuggaagcaggccaggcacagugguucaugccuccaaucccagcgcuuugggaggccgaggcaggcagaucacuugaggucaggaguucgaucccagccuggccaacauagcgaaaccccgucucugcuaaaaauacaaaaaacagcugggcgugguggcuugugccuguaguuccagcugcucgggaggcugaggcacgagaauggcuugagcuagggaggcagagguugcagugagccaagaugacaccgcugcacuccagccugggugacugagugagacuccguuucaaauaaauaaagacuuuaacaauuaaaaaagauauuggaacauaagaaauauaaugaagguaaggcuaauagcccauuuagcucuguauauuaauuuuaagaauuauuuaauugggagaacaugguaaaauucuguguugucagaccacuggguacaauuauuuccaggcgggagagauuuagaauacaagauaacaaaaguccuuucuauuuuuaaaacucuuuaauuccucauuuugguauucacuuagcacuugucccuuuauaaucuguccaaacucauugucccaugcacuccagcauaaacccacuguucugcucuuuguuuucaugauuuuuucauguuuucucuuugaccuggaauuuggucucccuagcucuggaccaguccaccaacuacacuuccccgauccaguuuauggucaggcauuccauuuaguugucauuucuauuuagucuccuuuaaucuagagccauuccucaaccuuccucugucuuccauagcauuguuacuucugaagagaauagaccacuuuuauguuuuaaaugugccuuaauuugguuuugugugauguuuucucuugauuauaagccuuaacaaauaauagugaagccguaaucagacuucuagccuuuuucuuugcuguuauucauaguacuuuguaguuuucagagagagagcuuggucacagcaguaguuccacagcgacucauuuagcuaccuauauuuaguuuuaaccacacccaagauauuccuaguugucugaauucuugauucagauuuacuuaaaaauauguaaguauuuaauacuacuuuuugaaucagaauugggauauugaucaaagcgaggaaaaaaugccucuugucagguaaaguuaaugcauuuucuuuuuuugcauguguuaucagaaguuuucaaaauuucagcuuagagaccucuucuaggaccuagauaauuauuuggaaacugcaaaacugcacaaaauuuaaaaaaaaugaaaagcuaagaaguuuuguguugugauuugggguggaggaguauucauuucaauccuaauauaagauuugcuuauuuuuuaugaauaucuugcugucuguuacaggaagcuuauuagauuuccuuaaggaaggagauggaaaguauuugaagcuuccacagcugguugauauggcugcucagguaucuguauauauacauguauccauuugaauuaaaaguguaaauuaaaauguggaauaaucuuaccagaauauuauaguauguguagugaaauggugggauuuuauuuuuauuuuuuauuuuuuagagacagcgucucauucugucacccaggguggaaugcaguggugcacugauagcuccgugcuugaagagccuugaauucuugggcucuagcaauccucucgccucagccuccuggguagcuaggacugcaggcacaggccaccauucccagcuaauuuaaaaaauuauuuuuuuuguagacacagggaucucucuguguugcuuaggcuagucucaaaguccuuggcucaaaggauccucccaccucagccucccaaaguauugggauuaccuggccaauaauggaauuuuagaacuggcaggaacgucagagauaauccaaugugagcucuuaaugauacagauuaaugaaguaucaaaagaugagagguaucuaaaauucacaaaacuuguuaguaacagaacgaguauuagaaccagcuaucuaacucuuaguccagugguguccuguaucauacgguuucuuagaaaauagauguuuccaggccaggugcgguggcucacgcuuguaaucugagcacuuugagaggccgaggugggugggucacuugaggucaggaguucgagaccagccuggccaacauggugaaacucugucucuacuaaaaauacugaaaauuagccaggcgugguggcgggcgccuguaaucccagcuacucaggaggcugaggcaggagaaucgcuugaacccgggaggcggagguuggagugagccaagaucucgccauugcacuccagccugagcaacaagagcgagacuccaucucaagaaaauagauguuuccacaaauguaaagucuauauguauuuauauuucaacagauaauuuuaagaaaauuaaaauggaugagggcuguuccaaagaaaauauuaguaaucuaaaguguaugcugaauuuuuuuuuuuuuuuuuuuuuugagaugggagucucgcucugucacccaggcuggaaugcaguggugcaaucucggcucacugcaagcuccaucucccagguucacacaauucucccgccucagccucccgaguaacugggacuacaggcgcccaccaccacccccagccaaucuuuuguauuuuuaguagggacgggguuucaccguguucgccaggauggucuugaucuccugaccucgugaucugcccgccucggccucccaaagugcugggauuacaggcgugagccacugcaccuggccugaauuuguuauuuacuauaguccaacacaagaauuaagaugguauauauacaguuuaaaaugggacuuuuuuacucuucugacuuuuuguuuuaaauauauagugaaaacuguuaaaaguuucucuucagauaugugguagguauuugagaggccuuauuauuggcuuugguugacaugcugguuuuggaaucuuaccuccuagccuccaaauguccacagaaucugacaauucagaaaagcuuuauacugagaaacuauacauaggcaacaggcauaugccacgccaguucaugcuucugaguuagacacucuaugguaggggagguuggcaauccauuuuuguuuuuuaaaaaaaaaaaaaaauuagguuuugugagccacauccaaucugucauacuuuuuucuuuuuacaacccuuuaaaaauguaaaaaccaggcugugcgagauggcuccuauaaucucgcuuugcggggccugggcaacauagugaaaccccaucucuacaaaaaaauacaaacauuagcuggguguggugucgcaugccuaagucccagcuacucacuaggcugaggugggaaaauugcuugagcccagaagauagagauugcagugagccacgauugcaccacugcacgccaaccugcgugacagagugagaccccgucucagucaaucaaucaaaauguaaaaaacaguuuuaguucucuggcugugcaaaaacaggcugcaggccacuuuuggccuacaagcuguaguuugggaaccuauaccuugugguuaauaccuuuaucaccaugucaucuuagguugugccugauagagaccuugaugagcuuguauccagagguacuaaauuaccuugugauuuaccucuucuccuaaccacagacacaagaagacauuaggaggguuaaucuuggucuucagaguaauguuagguuuuauuuuuuuugaggcugagucucgcucuguuucccaggcuggagugcaguggcacaaucuuggcucacugcaaccuuugccuccuggguucaagugauuuuccugccucagccucccaaguagcugggacuacagguaugugccaccacacccagcuaauguuuguauuuuuaauagagacaggguuucaccguguuggccaggcugaucucgaacucaugaccucaaaugauccaccugccucggccucccaaauuaaugggauuauaggugugggccaccgcacccagccaguguuagauuuuugaaaucugaauuuagccugcauuuuuauuauguuuucugguuuuccuguuaucuucuagacuauacccuguuaccaucaucuccuucuaaaauaauaugauuuucagugacacaauuugauauuaaccauaauugucuucucucugcuucccuuuguaucguaugucuuguguuuuuuguuuuucucuuuccaagauugcugaugguauggcauauauugaaagaaugaacuauauucaccgagaucuucgggcugcuaauauucuuguaggagaaaaucuugugugcaaaauagcagacuuugguuuagcaagguuaauugaagacaaugaauacacagcaagacaagguaaaauuacuuuuacauaaaagcuuguaauguguuguguguuuugcuuaacucucuugacuauacaggguuuuccagaauaagaauuguuuuagcuucccucagaagagucauagagacauugauuucauucauaaaaucauguacugcuguggcuuucugauaguuauuuccuccaagaaagaacuugacuagguauccuuugcauuauacauagagcaaguaguagccucuuuacacuucuuuugacaugacaacaaauauauuuuaauuucuuuccuagaaaggccagagguucucagucagaggagauauugcccuguaccgccacucaccaggggacaucugacaaugucuacagacuuuuuuggugguuacaaccugggggcuacugcuugacaucuaguggguagaggccagguauacugcugaaccuccuacaguguacagaaaugugcaggcaaacccccccuuccccccacaacagaauuaucaggcccaaaaugguagcggugcugagauugagaaacccugcuuuagacauagugcuuucuuucaaccuccauacuucuguacaguuaccuccaucuggaaugccuuccuaucuguaauguuuguuguuguuguuguuuuucgagauagggucucccucuguugcucaggcuagaguauaguggcgugauuucagcccacugcagccuugaccuccuggggcucaggugauccucccaccucagccuccugaguagcuggaacuacaggugcacacuaccacgccugacuaauucuuuguauuuuuuguagagacgaaguuuugccauguugcccaagcuggucucgaacuucugggcucaagcaguccuccugccuuggcuucccaaagugcuaaaauggcaggcgugagacaccaugcccggccuguaaucuuuacaugugaaaauccuaaccauucuuuagggccuaauuuagcugccacuuuuuuuuucaauaguuuuugggaaacuaguucuuuaguggugauuucagugcacccaucacccaagcaucuugcacuguacccaauauguagguuuuuuuguuuguuuuuuugagacggagucucacucuguugcccagcccaggcuggaguguagcggcacgaucucggcucacugcaacuuccgccucccagauucaagcgauucuccugccccagccucccgaguagcugggauuacaggcucguaccaccacacccagcuaauuuuuguauuuucaguagagacgggguuucaccuccaacauguagucuuuuauccaccccccaaccuuucccccuuacuccccaaaguccauuauauuacucuuaugccuuuguguccucauagcuuagccccacuuuuaagugagaccauacaauauuugguuuuccaucccugaguuacuucacuuagaauaauggccucuagcucuaaguuucugcaaaagacauuauuucauuccuuuuuacggcugaguaguauaccaugguguauauaugccacauuuuuuuuuauccacucauuggucaauggucauuuagauuggcuccauaucugcaauugcgaauugugcugcuauaaacauuuguggauguaucuuuuucauauaaugauuuuuuuuuuuuugcuuugagacacagucucaaucuguugcccaggcuggagugcagugguacaaucucagcucacugcaaccuccaccucccagguucaaaugauucuccugccucagccuccccuguagcugggauuacaggcaccugccaccaggcccggcuaauuuuuguauuuuaguagagacacgguuucaccauguuggccacgcuggucucaaacuccugaccucaggugauccacacgccuuggcuucccaaagcgcugggauuacaggcgugagccaccacaccuggcugauuucauuuccuuugggaagauacccaguaguggguuugcuggauugaaugguaguucugcuuuucguucuuuaaggaguuuccauacuguuuuccauagugguuguacuaauuuacauucccaccaucaguggaaaaauguucccuuuucaccacauccacaccaacaucuauuguuuuuuuuuuuuacuuauucauuauggccauucuuacaggaguaagguagugucucacuguaguuuuaauuugcauuucccugaugauuagugauguuguauguuguaguugcuccugguuuuuuuuguuuuguuuuguuuuugagauggagucucacucugucacccaggcuggagugcaguggcgcgaucuuggcucacugcaagcucugccucccggguucucgccauucugccuaagccucccgaguagcugggacuacaggugccugccaccaagcucggcuaauuuuuuuuuuuguauuuuuaguagugacgggguuuuaccguauuagccaggauggucucaaucuccugaccucaugauccgcccaccucggccucccaaagugcugggaauacaggcgugagccaccgcgccuggccaaguuuugcuuuuuugcccagacuggagugaaguggcaugaucuuggcucacugcaaccucugccccccagguucaagcaauucuccugccucagccucccgaguagcugggauuacaggcaugcaccaccacaccuggcuaaguuuuguauuuuugguacagacaggguuucaccguguuggccaggcuggucuugaacuccugaccuuaggugaucugcccaccucggccucucaaauugcugggauuauaggcgugagccacugugcccaaccaccugccacuuuuuaaauaaaacauuuuguaauggugccaaggaaaauugaucaucuguuugucuaaauaucuaaagaacucuguuuuaaaacacuaucuacaaacacauauaaauaacuuaaagaauguaagacaccuauaauauuauuucugcaauaaguuuauaaacuucaugaaagccaugcuuuuuuuuuuuuuuuuuuuuuuuuuuuugagacggagucucacucuguugcccaggcuggagugcaguggcgcaaucucagcucacugcaagcuccgccuccuggguucacaccauucuccugccucagccucccgaguagcugggacuacaggcuccugccaccucgcccagcuaauuuuuuguauuuuugguagagacgggguuucaccauguuagccaggauggucucaaucuccugaccucaugauccacucaccucggccucccaaaaugcugggauuacaggcuugagccaccgcgcccggccgaaagccaugcuuuuuagguuuccauagugauuagcauaaugcccuccacaaaaaagauauacaguaaguauuugaguuaauuaacauggacuuuuaaaaguaguacaauaaaauuuuccagaaugauauaaaaaguaggaaaacccauaaacauuauaacucaauagaauauucacucaucaaccaauaguuaacuacagcuauuaggugccagacuguacuuaaaaguuacacauauuauaacauguaucuuuggcuuacuagagcuucaaccucuauuuucuuaaauuguuuucuguucccacagccaacuuauuuuuuauaucaucagcugucuaaucaggaagaaaugugauuuauuucaauaugaauuuuaaaaauuaaagaauuuuuaucccauguaucuuguacauuuaaagaauugacacugaugacuacaguagagauauugacagaacauuagcccugcauaugcuauguuuacacaaauagauuuuuaaaaaacaauuaagcaagauggucaacauuauuuuaggugcaaaauuuccaaucaaauggacagcuccugaagcugcacuguauggucgguuuacaauaaagucugaugucuggucauuuggaauucugcaaacagaacuaguaacaaagggccgagugccauauccagguaagcuugcauuuuauagcucuugguuaucucaugaguggcuuuaucaggaguuuauuaggaacagaauuguaagcggggaaaaggccuuuauuucuucucauagucccccugccucucccucuccccacuccuucccuuuacuguggcauuggauggguaacuguggcauuggacggguaagucagugaaagccacgauccuugacagggugagcacaugagauaggccccacauucaccucagcuuucucaggacauuuuccaaaggggccucuuacuguucucucagauaauaaacauaucuuaaauauccuggcucauccacccuauacccuaaauaacuguucuuucccaguagugugauugguguuuuguuuuuuuuuuuuuuuuuuuuuuaaacacagucuugcucugucacccaggcuggagugcagugguacagucuggcucacugcaaccugucucccggguucaagcaauucuccugccucagccucccaaguagcugggauuacaggcacccaccaccacacccagcuaauuuuuuguauuuuuaguagagaugggguuuugccauguuggcuaagcuggucucgaacuccugaccucaggugauccaccugccuaggccucccaaagugcugggauuacaggcgugagccaccgugcccaucaugguauauuuuuuuaaauauguacuugccuuguuuucuucaguagauuauuuugagauucuuuucuuguuuuauuucucuaaccuauuuauaaaccagcacuuuaauaaauauaucugccauuaauaaagaggaaaaaugaaaguguuucccuuucaaaauuaagagacuuuuuuuuuuuuuuuuuuuuugaaauggagucucgcucugucgcccaggcuggagugcaguggcacgaucucagcucacugcagccuccaccucccagcuucacgccauucuccugccucagccucccgaguagcuaggacuauaggcacccgccaccacgcccagcuaauuuuuuguauuuuuaguagagacgggguuucaccguguuaaccaggauggucucgaucuccugaccuugugaucugcccgccucggccucccagaaugcugggauuacaggcgugagccaccgugccuggccucaaaauuaagagauuuauauaguuucuagggggaaggagaaauuuuagcucacuugaaauucagcgaucaguauuacuuuaguuuguuacuucuaaacucuuguacugaaguauccuaauguugagagugaaagcauauaaaauuuaaucuuuaggaaaaacuguuuugcuaaucuuauggguuuugcauguuaucuaacauauuccucuucccuacaguucccuccagcuguagaucuaaugccaucaaauuuuaucacccacuuugucugguugcuguuauucacugauaccauucaaguuauucucauuuaaugacucaccauuguccucuccaacaaaacuccucuccugucuuaacucauugucaucuuaauacacauggugaugauucuucuauuacccuggucucuuguagcuugaacucuucuccuguguaaucuugucuuucacucuaccuuagccagucuuuccaucuucauaccuuaaaccuuaauguuaccaauaacugcaacccuuucaaaaucuauuucaugcaucuacuuucugaccaccacuugccaucuuuccagauaacucccuccaccccaacccuagcaauuucuugaugcuaccaggaucuuuacuccacuguuucugccaccuuuuccugcuucucacccccuucaugaaacaauucuacuccuuaaauucccuagugaagcaguauaaucacuccuuugcugauuucacccuucucugauuucaucaucauugcuuagcaaaaucaccacauuaaauaaauccaacucugccuacaccacacuugcagacagggcuagaaaaaaaccacacagccaugcaacauagugucacuuuaaauguauaaccaugaggaacuuucaguuuuagcuaugauggagaggcuaauauccaacuuauuauagcacuguaaacaacuacaaaaguuaaauaaaauauguaaaagaacugauaggacauugcaucaaggaagcccauuuauauuggcuuuucugaaggcauuuucuaaaauagcacagggcaguaaaacccagacagaaagcauaagucuuauuaagcaaaugaggcagagauccuagugcugggaucugaaggacagggucccagagaaggaaccauagggaaagaacucuaaaauucugcuuuaaaauuccaguugggcguggugacucacuccuauaaucccagcacuuugggaggcuaagguggguggaucgcuugagcccaggaauuugaagcugcagugagcuaugauugcgccacugcacuccagccugggcaacagagcaagacccugucucaaaaaaaaaaaaaaaaaaauccucuuggguccuuggucaguucuaaucugcacauacacagggagagucucugggagaccuaacagaaaauagccacuaggaggcuggggagucgagcagaguucagaggcuacagagugcugaggaguucuugcccagccaaacuggauagauguuggagaauacgcuaggcuuuuuguugagaccccagaaaguccauacccuaggagaaagggcaaaacugagcaaaacuaagcccuaacaacuaggugaucugcugguaaauuccaaauggaauuaaacugaacauccuucagaaaaagauaacaugauccagauaaucuacaguguaugauucaaaaugucuagcacaaaauaaaaaguuacuagauauaugaagaagggaagagaugacugauuaucaagaguucaaaaucuggcugggcgcuguggcucacgccuguaaucccaacacauugggaagccaaggcggguggaucacaaggucaggaguuugagaccagccuggccaagaugguaaaaccccaucucugcuaaaaauacaaaaauuagccagccaugguggcgggcgccuguaaucccagcuacucgggaggcugaggcaggagaaucgcuugaacccaggagguggagguugcagugagcugagauugcgccgcugcacucuggccugggugacagagcgagacucugucucaaaaaaaaaaaaaaaaaaaaaaaaaguucaaaaucaauaggagcagacucugagauaauccaaaucuuggaguuagcaaaagacuucaaaauagcaauauauggaauguuaaaauagaagaaaaguuuugcaaaauaaugaaaaacuggagaauuugagcagaauuggaaucuauuaaaaaaaaaagaaucaaauggaaauuguauuuauuuauuuauuuauuuucuuuugggacagagucucgcucugucucccaggcuggaguacaguggcacgaucuugguucacugcagccuccgccucccagguuccagcgauucuccugccucagccucccaaguagcugagauuacaggcgugagccaccccgccuggcccucaaauggaaauuuuagaacuguaaaacauuauaucaaauuaaguacucacuagaugggcauaauagaagacaagauuaguggauucagacacauuaacaaaguauccaagguaaugcauagauaaaagcuaauggggaagaaagcagaacagaauguaugaaaccaguggggcauagugaaaaggucuaauuuguggagucccagaagcagaagagagaaaaaaaugaaacaguaacaacauuuuuaaaaaguaauggcuaaaaaucuucuaaauaugauaaaacaaaauacuagcccacagauuaagugaaccucaaacaagaaaauuaaacucagugaaauucaagcaaacauaucauggucaaauuacaaaaaucaaagccaaacagccauaaggagguggugcagauugagcauuccuaauucaaaaauccgaaaugcagcugggcgcaguggcucaggccuguaaucccaguacuuugggaggucgaggccaguggaucacgaggucagggguuugagaccauccuggccaauguagugaaaccccaucucuacuaaaaauacaaaaauuagcugggcaugguggcacacaccuguaguaccagcuacuuggaggcugaggcaggagaaucacuugaaccugggaggcagagguugcaaugagccaagauugcacuacugcacuccagcuugggcaacagagcaagacuucaucucaaagagaaaaaaaaccgaaaugcuccaaaauccaaaacuuuuugagcauugacauaacaacacaaauggaaaauuccacacccguccucaugugacaggucacagucaaaauaccaucaaaauuuuguuuugugcagaaaauuauuuuuaaaauuauguaaaauuaccuucaggcuauauguauaagguguauaugaaacauaaaugaauuuuuuuuuuuuugagacagggucucugucacccaggcuggagugcaguggcacaaucagggcucacugcagccucuaccucccugggcucaggugauccucccaccucagccucccaaguagcugagaccacaggugugugccauccaccuagcuaauuuuuguagagacagggucucaccauguugcccaggauggucucaaaauccuaggcucaagcgauuugccugcccuguccucccaaagugccgggauuacaggugcgagccaccgugccuggcucauaaauguauuuuguguuuagacuugggucccaucccuuaagauaucucauuauguauaugcaaauauuccaaaauccaaaaaaauccaaaaucggaaacacuucuggucccaaacauuucagauaagggauacucagccuauauauuaucuacgcaggaacaacagucagacagcuaacuuuuccucagauauggaagccagggaagagugaaauuaugccuuuaaagugcuuuggggaaaacugcugaucuaaaacaccaacaauaaaaaaucuuaccgaauuuauaauguauauaaaaauagacugugacaguaacacaaaggguagagggggucagggaauaagagguaaaccguucuaaguuuggaacagguaaaaguacuuauuuugaguaacauacaauaaaccaaggaagcauauuguagucucaaugauaacuacuaaaauaacaagagaagacaaaaagccaacagaggagagaaaaaauugaacauugaaaaaugcuuguuuaaucaaauuaaaaagcaagagaggagaaacgaacagauggaacaaagaucaggaugguagaauuaaacccaacuacauccauaauuaaaugacauuuagguacacuaaacauuccaauaaaaaaagauaagacuggauuuuaaacacauacacaaauacuauaaugguauuuauaagauacauacuuuaagguauuuuaggagacugaaauuaaaaggauggaaaaguuauacucugcaaauccuaacugaagaaagccuagauagcaguagacuuuaaggcaagaaauaguacuagggacaaaaagggacguuucauaauaauaaaagggucaguucaacagggaaacaaaaauccaaaaugagcuauguaacuacauagcuucaaaaugcauaaaaauuuauaugaucaggauauucuaguuaauuauucagaugauaaucagaauauaaacgauuuguagauuacccaucuuuaaagaagaaaaagagauacuuuaucauucauugucuuucuuugacgauuuuaagaggauuuggaaagaacuuuccacauguagcguggaccgauccauugccuacuguucuuacagcagauuguccauuucaaagcaacagcgccuguuuacucaucuuauuuggggauaguaauaaaccuugguaaaugcuaacagguaugaaauccuuacauuuauugacaguaugcuaaguauuuaccaugugaauuuuuuuuuuuuuuuuuuuuuuuuuuuuuuuuuugagacaagagucuugcuuugucacccaggcuggagugcaguggugcaaucucugcucacugcaaccuccgccucccagguucaagugauucuccugccucagccucccgaguagcugggauuacaggugugugcccaccaugcccaguuaguuuuuauauuuuuaguagagaggggguuucgccauguuggccaggcuggucucaaacuccugaccucaggugauccgcccacucagccucccaaagugcugggauuacagaugugaaccaccaugcccagcuggcaucaaauaauuuaauaguucuaauuaucagaaaauucugaagagugaaguuguuuuuguuuuuguguuuuugagauggagucccacucugucacccaggcuggagugcaguggugcgaucucagcucacugcaaccuccaccucccagguucaagcgauucuccugccucagccucccaaguagcugggacuacagaugcccaccaccacgcccagcuaauuuuuuguauuuuuaguagagacggggcuucaccauguuggccaggauggucucaaucucuugaccucgugaucugccugccucggccucccaaagugcugggauuacaggcaugagccaccgcacccggccuuugagugaaguuuugaaugaaagcuuauugguaauuagaaguuauuuucauagguuccggcuuauuuggauugcuuaauccuaacagucaauuaaaauaauaagcauaaaauaaaagaacacagaauggaaaagaaguucaauuauaguaagcccucacugaauauuaauucccuuacuccuuuucuccuucacccaacaacuucuaguuguauuuccacuguuaguaaaauguacuggauuucacuuccccaccccgcgagauggagucucgcucugucacccaggcuggagugcuauggcgcaaucucggcucacugcaaccuccgccucccguucaagugauucucccaccucagcuucccaaguagcugggauuacaggcaccugccaucaugccuggcucauuuuuguaguuuguagagucgugguuucaccauguuggcaaggcuggucuugaacuccugaccucagaugaucacccgccuuggccucccaaagcgccaggauuacagacgagagccacugugcccggccagauuucacuuaugaagaugacaguaccuaguuagaugaaaagcucagaaaacuuccuuuuaaguauugaguuucaaaguaaugucauguagaguuuuuuuuaauaguuuaaaaaauguauuuugagaaaucacuuauuccucaaaaaaauaacuaaaaaucuaaauaguaaugauuuaaccccauuacauuuucuuuagagaaucauagacuauuuuaaauaucauuccugauugguugauaaaguuuccaagagauacaagggauggccugacuugcaggcagggaaggaaggugaugcgggagauaggacgugaggugagguugcuggcuuagugagacacuaucaggaagaauuuggaaaaggaggcauuuugcuguccugugauaagauggggugaacugcugaucaggggguugaggaaggggggauuacaaaggaauacaagaaaggaacuauguguaauaucuugaagaaagucaaacagguaauauuagauaaggaaacuuucacagaaguaauucaauauaaaguuauguaguugguauauuuggcaaaaccaagacuagaacuuucuucugaauuccuguuuuaaaguucuuucagacaggaucuugccaccauuccucaguaacccaaguuuggucauuguuaaauguuaauauuagaaaguaccaguaccucauaguagcacccuaaauucuuauuaaucaaaugggguuggcuuuugaagacauuaguauuaaaaauaagauauaagauggaaugaaaaauuagacauguuaaaacauagauuagcauuuucuaagcucuucuugauauucucauguuuaaaauuuauuuuguugcuuuguuaaaagaauuguuucacuaaauaauauacuuugaaugaguuaguggcuaggggguuuguuauguuuuccuagugguaguuaggaccauuguucuuuaauguuuuaaucuuguguauuagguauggugaaccgugaaguauuagaacaaguggagcgaggauacaggaugccgugcccucagggcuguccagaaucccuccaugaauugaugaaucuguguuggaagaaggacccugaugaaagaccaacauuugaauauauucaguccuucuuggaagacuacuucacugcuacagagccacaguaccagccaggagaaaauuuauaauucaaguagccuauuuuauaugcacaaaucugccaaaauauaaagaacuuguguagauuuucuacaggaaucaaaagaagaaaaucuucuuuacucugcauguuuuuaaugguaaacuggaaucccagauaugguugcacaaaaccacuuuuuuuuccccaaguauuaaacucuaauguaccaaugaugaauuuaucagcguauuucaggguccaaacaaaauagagcuaagauacugaugacagugugggugacagcaugguaaugaaggacagugaggcuccugcuuauuuauaaaucauuuccuuucuuuuuuuccccaaagucagaauugcucaaagaaaauuauuuauuguuacagauaaaacuugagagauaaaaagcuauaccauaauaaaaucuaaaauuaaggaauaucaugggaccaaauaauuccauuccaguuuuuuaaaguuucuugcauuuauuauucucaaaaguuuuuucuaaguuaaacagucaguaugcaaucuuaauauaugcuuucuuuugcauggacaugggccagguuuuucaaaaggaauauaaacaggaucucaaacuugauuaaauguuagaccacagaaguggaauuugaaaguauaaugcaguacauuaauauucauguucauggaacugaaagaauaagaacuuuuucacuucaguccuuuucugaagaguuugacuuagaauaaugaagguaacuagaaagugaguuaaucuuguaugagguugcauugauuuuuuaaggcaauauauaauugaaacuacuguccaaucaaaggggaaauguuuugaucuuuagauagcaugcaaaguaagacccagcauuuuaaaagcccuuuuuaaaaacuagacuucguacugugaguauugcuuauauguccuuauggggaugggugccacaaauagaaaauaugaccagaucagggacuugaaugcacuuuugcucauggugaauauagaugaacagagaggaaaauguauuuaaaagaaauacgagaaaagaaagugaaaguuuuacaaguuagagggauggaagguaauguuuaauguugaugucauggagugacagaauggcuuugcuggcacucagagcuccucacuuagcuauauucugagacuuugaagaguuauaaaguauaacuauaaaacuaauuuuucuuacacacuaaauggguauuuguucaaaauaaugaaguuauggcuucacauucauugcagugggauaugguuuuuauguaaaacauuuuuagaacuccaguuuucaaaucauguuugaaucuacauucacuuuuuuuuguuuucuuuuuugagacggagucucgcucugucgcccaggcuggagugcaguggcgcgaucucggcucacugcaagcucugccucccagguucacaccauucuccugccucagccucccgaguagcugggacuacaggugcccaccaccacgccuggcuaguuuuuuguauuuuuaguagagacgcaguuucaccguguuagccaggauagucucgaucuccugaccuugugaucugcccgccucggccucccaaagugcugggauuacaggcgugagccaccgcgcccagccuacauucacuucuaaagucuauguaaugguggucauuuuuucccuuuuagaauacauuaaaugguugauuuggggaggaaaacuuauucugaauauuaacgguggugaaaaggggacaguuuuuacccuaaagugcaaaagugaaacauacaaaauaagacuaauuuuuaagaguaacucaguaauuucaaaauacagauuugaauagcagcauuagugguuugagugucuagcaaaggaaaaauugaugaauaaaaugaaggucugguguauauguuuuaaaauacucucauauagucacacuuuaaauuaagccuuauauuaggccccucuauuuucaggauauaauucuuaacuaucauuauuuaccugauuuuaaucaucagauucgaaauucugugccauggcauauauguucaaauucaaaccauuuuuaaaaugugaagauggacuucaugcaaguuggcagugguucugguacuaaaaauugugguuguuuuuucuguuuacguaaccugcuuaguauugacacucucuaccaagagggucuuccuaagaagagugcugucauuauuuccucuuaucaacaacuugugacaugagauuuuuuaagggcuuuaugugaacuaugauauuguaauuuuucuaagcauauucaaaagggugacaaaauuacguuuauguacuaaaucuaaucaggaaaguaaggcaggaaaaguugaugguauucauuagguuuuaacugaauggagcaguuccuuauauaauaacaauuguauaguagggauaaaacacuaacuuaauguguauucauuuuaaauuguucuguauuuuuaaauugccaagaaaaacaacuuuguaaauuuggagauauuuuccaacagcuuuucgucuucagugucuuaauguggaaguuaacccuuaccaaaaaaggaaguuggcaaaaacagccuucuagcacacuuuuuuaaaugaauaaugguagccuaaacuuaauauuuuuauaaaguauuguaauauuguuuuguggauaauugaaauaaaaaguucucauugaaugcaccuauuaaucguuuuaguugcuauucauauucucauucguuuuuuaaaaacugauauauucugaauuuauucuuccauugagaaaaaaauguucaguuacuuguaacuacugagcagaauuuaaucaauccuuuauuaaauucagaacauuauugaa

SEQ ID NO: 191461 - RNA, 50254 nt, Homo sapiens
cccgcccgcuaauguuuuggccgcuucaagauggcggugcaggagucggcggcucaguuguccaugacccugaagguccaggaguacccgacccucaaggugggcgccugcgccgcgcaggcugagggcagcgaaggcgucuccagccagugcccucgggccgcgaggggccgccccgggagggccagcggcgagggcggcgggagcugggcgcggccucgcggggccgugcgggcuucucaggggcgcccgguccgcgccgggcagguguggcgggggcggcggcuuuggcccugccaggcgcccgacuguggccccucugcuugaagagcugcgugagccgagccagcgacgacucuggcagcgcuaaggguggcgaauuuggggcugggguggaagccggaguuugcggggcguggggucucuggcgcccaggcagacggagugcgcggcgugcccagccagugcccggccgcccucccgggagcccagggcugggaggugccggcugcgccggucgcuaguuaggaacuguagggagaaaccucacggccugauggcacccagcgaccuuuuugaugggcgucaccaaaccugaaauacagcucuugccguccggcugccgguugcgugaccuuggguggucaccuagccacgucgcacuucuuagaaugaaauuugugcuccuaguagaaggagccgauacuuguucuuuaccuaguuaguagaggauuugauaugaagcaccugggaaggaauuccuuaaaagaucaaggucauagcuuuccuagagcugcggcugagcuucgugguucuguguugccuuccuggagagcugcguaguuucucucuccucccagagcgcccugguguucacguccgucugaggacggacgguguggcgacagguguggaggaugcaguauggccagguugcugugcguucccccagccccagggcaguucagcgaagggcugaagagcacaggcugugagccauccugcuggggugugaaucaggcuucucuguauucguccuuacugggagacaucagggcccgguuggugacuguuuauucuugucagguuuaagcagugguagcgccugugucaccucagggugaaaugagugaccacguauuguuucaaacagugccuagcauucauuaaaaggucccugcuacaguuagcgcugcugaagucaggcuguacccugcuguagcuggucuucauaggaaagcagaagcaagcuucuccuccucuuuauuaacuagcgguuuauuucauauuuuuaaaaagaaacgggguuucacuguugccuagggugguuuuggauuccaggacuuaagcgauccuccugccuuuugaccucccaaagcgcugggcugacaggugugagccacgcgcccgccacacuaaugguuucgcagugggguuucauggugcuuguguguccagcacuucuuuugaucaaggaagggagggcaauguugcugacguuaccaaaggucuagccucuugcuagaucccuccaagauguaggugguugguuuuuaauacucagugacauugguggaucucuguugguuuagagauggagacccugcagcugagagaagucuauacaaggacauuguggugauauuaguagggaguccuaaccacugaccacuuugucucacgcagugcaccuccaggccugucauuucagcuaacacacaagaagguuugaagaucagaaccguggugguuugucacuucugguacuggcuggugaaugugggaaacacuagauaggaaaaguuuccagaaauccuuucauuguguauugaaggaacuaggaagggagauggaaggucuccggaaaggauucuucuucaggucuucugcuguuuuguaaucgugaauguaauuuguauuccagagugauugcauagcuucugauuaaaauagucaugcagauagucauacagguaaagaaauauuauagugucauaauuucucuguugacacuugugucacuacugaguuaaaacuuuuuuucauagaaguuuucaggagugauuccuaguggauaauggagguguuuugcugggaaacuagggauccuugauuuagaagcauuuauugguauagaacuaaacagaacaugcugagcucacagcucaagagcugcacucuucaguuuccaggaggggccagugcagaugucagagaagggaccgagggcugcaggaccgggguuguggaaggugggggguggauguucugcuucucuagucugagagcaaguccuccugcagggugguagcagcuggcaugcucuggacuggaucuucaccugguaauaguuaaacugcuuuccugccaugugaguccuccacagacucacaggggauuccuuucucuucagagggcuugguagcccuagguggguuucagcaguaacacuugggaugucugcuuccucacagcgucagggcggcugguggggcuccugggugccuggcagguacuuauuuuucuauuuuccuggugaagugggaagagaauggaacagacgugaauugcugcagccaacacgcacugaccuugggcaccucugucgucaugagcuucuauuuccaccaaagggguggaccggccugcgaacguuugggcuggaggagccuuugucgguggugggggcugugcagucuaggaugucuagcagcaucccuggugucugccugccagaugccaagagcaugcccccaaaaugucuucagacauugcuagaugugcccugggggcaugcacacaccccugagaauugcugggcuggauccugcuuuaagggacuuguuucuuccucuuaccaaacggagguguggcucaugaggacucagccuugcguccuggcuguggcugugucuuuuugcugucaaaugcugugaacgccguccgguguagggugguggguaaugccuugugggggaggggaaagaugaauaacucaccaucuuuuuuuuuuuuuuuuuucuuuuuugagacggagucucacucuguugcccaggcuggagcgcgguggcacaaucucagcucacugcaaccucugccucccagauucaagcaauucuccuaccucagccucccgaguagcugagauuacaggcacccgccaccaugcccagcuaauuuuuuguauuuuuuaguagagacgugguuucuccauguuguccagcuggucuugaacuccugaccucaggaauucaccaucuuucaauucaacaugcauaguucaccaucuugaauuggaagcccuugcuuucauuauuuuguaaaagguuuuuuuuuuucugauuauaaaaguaauuugaugaguugggugcgguggugugcgccuguagucccagcuaauugggaggcugaggcgagaggaucacuugagccaggagauccaggcuguggugaaccgagauugcaccacugcccuccagccugggugacagagugagacccugucucaaauaauaaauaaauaaaaguaauuuguuuuuucuucaaguuacccugcugcacagagagaacuucauuaacauuuugguguauuuacuccuacuauuucccuucagauagccgaagaaaaauaauaguuuagagaauuucacaugggugucugcacagcccagggcgggaagugguguucaucaccuggagacccuggucuggaccuggcuccucucugugaaccccaccugggcccaccucuccucuccuggagccccagcaaggguucccagcuccagugaguccucucacacccaagguggugaugcuguccucuccccagaggacaggcugagaaacaccgggcuugugguugcauucucaggugucugaauucucuacaggaagauuugcauguucugccuuugguuugaugacagucugguugcccaggcauggcccugaugccucacagccugggucugugccugugguagggaguucgggugccagcugugugcugaaguuguaacugcuccugcgccuuuuguaguuuucuucacuccaucuuggcuggauuugggaggaucauguguucucgagugugagaaacacaggcaaccacgaagcguuugacuuacugacacacacauuggguuggacccuggugaugccgugucugaggagucuuaggccgggucuccaccucuucuguggccggcuuuuucgauguacuuuaucugcaguaacgucacagcccuccagaauccgcccggucucuagagcacaguggaaauuccuucugcccagaagagccauggucugcccuuuguggcucccagcuccacuccccucgccucucccaccguuugcuggugguuuggcccugggcuggcuuccgcggccuccgcgcuggcacaggucuucccucccaggccugggccuuuccagcugguugggcaaggcugagauaaggauguagacuugaauucacugcuagcugggggguugguuuuguuuuuguuuuuuuaaguauuauuuuuuuaacacauuucaagucaagaaagugcuuuuuaaugccugauucaccguaauggcugggcuagguuggaggcaguacugacgugaggccuggagcggcccugggaccuaagcaaggcaccgccgccgggcugcagagcagggcugcaggugcacuuagcuucucccauaccccccuccgcagcaguggucugagagccuccaucggccagguacggucaggcccugcacagucaggcccugggcuagcaugauggggagacaagugaggccccugucuacgcuccggugggagggaggcaucagcacaagcacacacagacaucucagauccuuuaaagacgcugaugagguugaggugauguuggacaguggcaggggacggggguggggccgggggcaggggcaggggcaggggcggggguggggaugagcuuccuccagugaaugcgauauugugagcugguuggcggagcuaaguuuuggggugaggcucuguggaccguguugaaguccuggccggcucucaccccaguaggcacacaggcacacagcaccauuggggugauguggcugggggugucccagagcugugcagggagggucucacagugagacugggugcugggcagugacucggucuguggguacaggggucagcagaaugggaagcaagcccaaggagacacauuggcaccagaaugaagacaaggccggccggugccuguagcaugugacugccccgucugcagagaggcugugcugcgagccccacccucugggggcuucaggccgaguggggaugucugggugcugacccaggcaucgcaaagcacacuuccugccgggguaacugcugaugauuuuuaggucuguuauuucagaaucguuauagcuaggggccauuauuuugaaaaccugaacaaaaagaauuauucacuguguuaauaccacauuuagugacuguugagcugaauguggcugagcagaagaaagcaccugcugugcugauggcugacuguggacccggaccgggacccugagugcugccccacucgagggaggggcccagagcagccuccuuccucuccucccaggcgagccuuucauaccuguccuucucucagacuuucccuccuacuucaugcucgcccaugccugucacgcagacccugccugaccugcaccugcucccacacccgugguggaugagccccaucacccguaccuguaccccccucacccgcuccuguacccccucacccgcuccuauacccccucacccacaccuguaccccccucacccgcuccuguacccccucacccgcgccugugcccccucacccgugccucugccccccucacccgcgccugugccccccuccccagcgccugugcccccucacccacgccugugcccuccucacccaugccggugcccaccacaccugcgccuuugccccuucaccugugucugcaccgcccucaccugugcugccuucaccugcacccccucacccacaccugugccacccucgcccgcaccugugccccccucacccacgucugcacugcccucaccugugcugcccucaccugugccccccaccugugccugugccccccucaccugcuccucccucaccugcuccucccucaccugcuccugcaccaccuucacgugcgccccccaccuacaucugcaccucaccuaugcuacccucaccugugcccccccacccgcaccugugccccccucacccacgucugcacugcccucaccugugcugcccucaccugugccccccaccugugccugugccccccucaccugcuccucccucaccugcuccucccucaccugcuccugcaccaccuucacgugcgccccccaccuacaucugcaccucaccuaugcuacccucaccugugcccccccacccgcaccugugccccccucaccugugccugugcagccgucacccaugccauuccucaccuguaccccucacccaugccugugccguuccucacccgugccugugccccccucacccgugccugugccucccucacuugcgcugugccccccucaccugugcugugcccuuugccuuguggcugcuccugcacuugguucucucucuguuggucgguuuucccauuggcugugcagcucccuggugugcacguggcucugagucuuccucucgugaaaaccccuuccuugcccccguccuccuccagcuacuacucccugucucugccccuucaugucucucuuccuguuuuaccuaaaucagauuuuugccccccaacacuccacccagauguuccucuugaggacaggaugaugcuccugaaagcggucaguccacagcggaccccacugccucgagacgcucccaucacucggcucccgugacaccauccucugggcucuccccaccccucgcugcauguccucacuugccuaugcugucuucucuagucuuggaggccuuuuguuuuaugucaccagccagcccuccagagguuguguggcuucacagacggucuccaagcuccuguccccacacugcugcccuccccaggccucucucccugaggccaucccguguagucaccucccggagcucucuucgcaugucuggaaggcaguucaaagauacgauaccaggcgcaaaaccaaaugccgcaucucggccuuggggccccagacgagccccagaccugccuuacuaagccacccuucccaagucaguugacagcgaugucccccggcacuuguucagugacagccgagaacucggagguuuucucgauuucuguuucucacguuuauccuugaguccacgauggcugcuggggcugcggccuucgcggccaggaggaggguaagggggaaucagugccgcccugcguggccagcucccugcgugggggccuuaguggacauccucccaagcguuuacacuucagcucauuccccagagcacggggcuggccauuucuagcuuuggaggagccugaaaaaguacgugcguauguguguguguauacauacauauagagagagagcacgcgcuugagugugggcucauugcugcccuaaauaaaauuaggaugugguuccuuuugcccuuugucccuugccugccugguuuccuuugcagcacucgucacagucugacgcggucgccugcaucucucugugcuuugguugggcgucuccuuuagagcgucugcucugcgagggcacgggccguccuuugucgucguucacgucacacccacgagugccuggcacaggagucagucaauggcuguuggccgaaccaauuucucccccgucugucugggaaauuccuaaacuucgcaucucacuuuuguccacuugccgcauucuagaguaugucuuggucucauggccugugcucucaucuggcuguggucagccucuugcguuuccuuucucccuugccuccaccccucgcgauguagccccauccccugcccuucucugcuucccauuguucuagaacauuccagcauggaaaccccgcugugcaaggccccugcacuggccacagaagccgcaccuaucugcugaggaacccgguugcugccuggagugggugucgaguacugccuggcagcauagccaugcuucuugaggcauuuuagcacccuguaccccagguacuguuccauaugccccuccuucuccaugagccccccaugccugccccguccuugugcucugcccgcggcuuggcccugucugucgccugccugcuugugcucacuguuuccuuucuuuuacuggagauaugucauuugugccccgcccaaggccagccuuuguucaugcaccagacccccugccccaucccugugaccugaagaggcaugugccgucuucugguuauccacgaagaggcacacgcgccgucuucugguuauccacgaagaggcacacgcgccgucuucugguuauccacgaagaggcacacgcgccgucuucugguuaacugugugcgggacccacagguccccucugucugagccagcccugccuuggggucucuggaauugcuucucaucugguuuuacccccaucacagugcuauagucagggcaccagguaaccccaagacacugcugagacccaugauggauucuugcugcccaucucgaccucucacagggcuggaacacagcucacccccucgggcuccuagagcgccauccucgcguuuccccccgggcucaguccuuggcccuggguguugcugugagcaccgcugccuuggugcucucacagggucuaguggacugauaggacccucuguguauacugaugacucccaggcagguaucuucccaaccccagagcccuguauccaguagccuguaaaacauacccacuuggcaaggcacuuuggcauuaaaauuauuauuauuaaaauuauuauuauuuuuagagaugggaucucacucuggcacccaggcgggagugcaguggcaugaucacagcucacuucagccuugaccuccugggcucaggugaucuuccugccucagccucccggguaacugggaccacgggcgccugcuuccgugucuggcuaauuuuuuuauuuguagagauagguucuagcuccguugucuaggcuggucuccaucucuugggcucaagcauuccucccuccugggcguccaaaaguguuggaauaacaggugugagccaccaugcccagcuccuuggcauauuuagaucugagcuuaucaucuuaacaccugcugcccaaaccaauucuaccagucucccuucucuucgggaagggcagccccuccaucucccuuggucaggccagaaccuucagguuggccuugaugccucuguugucacagcucaugcccagcccgucugccccuccacccuggcgucaggacaugcccaggcccagcugcugcugcucuucccaccucugccccugcggcucaagucgcaucucucucuggaauauugaauagccuucuggcugcuccugcucugcucaugcccaccccggcugccccagcgccagauccugucgucuuuuuguucuaggaguuuccugaccuggggaugaaggccagggucguuacaguggcucccaggcccuuugcccuguagggugcugggcccaguggccuuucugccgccauucagccaggccagcaugccgagcccaggguuuuacugccaccuuccucugucuggagcgcuccuuccacagauguccauggucccauguccucaccuucaaucuuugccaacguccguggucccauguccucaccuccuucaaucuucgcugagcugucagcuugugaagcuucucugacuccacuguugaaacugcagccccagcaucucccacuucugcccuuuucccucgugagucgugaccgcugucucacauaacgguauuuugcuuguuucugaccacugggauuauaagcucuuuugaaggauagagaagaaauaaauucuccaauuaacaaaugaacaaaauaauauuaaauauuauuuuggcaauucugucuaaagcaguaagaauugaaauagaaguaaauguaaccauugagaaagucagcacaauaacggggcauacaguaagugcacgaaacccagucgccacccucuauaucaccgccagccaguuagaacacaucccauucaccauaacccaaagcagcagagacagacgauccaacagcauccuuagcaggcagccugacugccacggagcuguuucaggaaaggcccgaaggaagauuggcacuagcagaggaugccguguuucugcaugaaaaccguaaugauaucauauuguucuuuuuguguuugauaaauauuucuuauuuauaaugaaagggacaccaagaagggcugggccuugccagacaccacagccagguauguaacugccaaaguugugaccuuguggcagaacagcuggcucccuuugaaauacuuuauggaaaggugagagaggaagcucugcugauguugugauuaugaacugacacuccugcccgcuugcagucucuguuguuuggucagggagugaccuggggaugagggcacuggaccgcguggggcacggccccggcucuuccgugcugccggcuuccgaggcuggggcugcguggcgugcgugugugccgcugccgcaggucgcauacccuuuccaagacggaccaguggcuuuaaaagguuccugcaaggaaguggcuggcuaaggcugggccuaacugggcgugcacacaacagggagcgcagagcucagggccgacagcacucuugccacugcgagcuuuguagggcgcaacaucaaucugguuacauccccucagaaguugacuggaagugucauuuuuucaagaagccucuuaggggauucgaagcguuuuuccuuggugagccucccucaggguaugugcugugcuuggggagauuagcucaggauggcaggaagccaccgugauuacaugccccgcaccagaacaugagacuggccccuccaggacggagagggauguaaacugccacccagggcuuaauccagcacuucuggcccugugaugagcuucgugaucaauauuuagaaaccucuucugguuaauugcaaaagacaaagagccucaugcauuggggaaauucuuccuucccgugcuggugaaaacaugaugaugacacacugaaaugcguugcguuuugucagcaaauucugucagaagcacggcaaacgcuggagaagguuugaggaagcgcauccugaagcugauggcaccgugugggggcagcgggcgggcaggugcagacguuucacgcaugucuccacucacacugcuugccacauucuguuucagugacgaaaucagggaggauuacugcugugagucaccaaaggggaagauguacuggaggagauguaauuuaacauucgcuaaguagagaaaucccgugaacauaaaaagcuguaaugcaacaaauuacuuaggaaaaauuggggagaugugauaaauaaaaguuuaauucuuugguauaaccagaaaagauagaaccagaauuuaaaagcaaauaccaagccaggcacagcggcucaugccuguaaucccagcacuuugggaggcugaggcaggaguaucacuugagccaggagcucaaggcugcagugagccaugauugugucccugcacuccagccugagcagcagagugacgcccuauaugaaugaaugaauaaguaagugaauaaguaaaaauaaauaagcacuggacaagggacacagacaaaauguguagaaggaaaaaaguguuagguugaaucauauacaguuguuauuuuuguaaguuaaaagugaugaccgaauagaccuauaacaggugaaguuacuacaaaaaaccucacaaagaaaagccugagaccagaugguuucacugaugaauucuguuaaacauuuaaagaaggauuuauaccaacucuucuaaaaacaguuaaggagggauuacaucccaccuccuucuaugaggccaguauaacuuugauauaaccuugaaccagacaaagacaucacaagaaaaccauagaccauuguuccagaugagagaaaauagaugccaaaauauucaacaaaaucuuagaaaacuaagaaaaucuaagaaaacaaaauauagaaaggauuaugugucaggacuaaguaggauuucccccagaaaugcaaaguugguucaacgugugaaaaucaaugucguguaucauauuaauagaaugaaggacaacaaccacauaaucaucucaauagaugcaacaaaaguacuuuacacugugagaaaucaguguuugcuguuuaaguugcccagucugugauauuuuuguuacagcagccugagcugacuaagacagcugcucagaacagggagaaaauguuugccagucauauaucuguuaaggguuuaguauucagaauagguuaggaacucuucuaguucauuaauacaaaggcaaaagaaaacuuguuuuuuugaguuggauucucacucugucaccaggcuggagugcaguacaguggcgccaucucggcucacugcaagcuccgcuucccggguucacgccauucuuuugcuucagccucccaaguagcugggacuacaggcaccugccaccaugcccggcuaauuuuuuuguauuuuuaguagagacgggguuucacuguguuagccagguuggucucgaucuccugaccucgugauccgcccgccucagccucccaaagugcugggauuauaggcgugagccaccgcgcccagccaagaaaacauuuuuuaaaugagcacacaauuuuagcaaacuucugcaaagauauacaaauggccacuaagcacaucauuaauccuuagggaaauacaaaccaaaaccacagugaggugcugcuuccuaccccaccagaagggcuguagcaaaaacaauggcgaguuguugggugugaauguggggaauugaaauccucauacgcagccaccucggaaaacaaccuggccguucuucaggugacacacggaguuaccauaggaccuggcagcuccccuccucagcuuauccccaagaccaguagaaacucuuaagaaugucauccucgggccgggugugguggcucaugccuguaaucccagcacuuugggaggcuggggcggguggaucaugagcucaggagauugagaccguccuggccaacauggugaaaccccgucucuacuaaaaauacaaaaaaaaaaaaaaaaaaaaaaagccggucaugguggcgugcaccuguagucccagcuacuugggaggcugaggcaggaggaucacuuaaaccggggaggcagagguuacagugagcugagaucgcacuacugcacuccagccugggcgacagugagacucugucucaaaaaaaaaaaagaaugucauguccuucucgauagcagccaaagguccaucaguugugaauuccuaaacaaauagguauacgaauaccacggaagaccauucagccaugaagaggaguggagcgucgcuguaugccacaucacaggugaaccugguaaacaugcuaagugagaaaagccagauacaaaaguccacaucacgugugauuccauuuauauggaauugguuggugguugauugccugggucugaggggacuacagcggguuccuuuuuuggagugaugaaaaucuagaaguagagugguuuguacaaccuugugcuuauucuaaaaacuacuaaauuguacauauuaaaggggugaauuuuacggccugugaauuguaucaguaaaaauugguaaaauuaaaaaugacauugggauuuuuuguaugauucagcuuaauagacaacugaagagcaugcuugcacagugccggcagggcagggggguccggcagggcagggugggggucgggcagggcagggggguccggcagggcagggugggggucgggcagggcagggggcguccgugguguguagcucugcacacaggagucgggaguuuuuaguccagguccauagaaguagaauaccuggguugaagggugaggcccagguucuguagcucccgucaaaccccacgcacccuccucccccugucagucguguggcuccaguuuccuucaccucaccaguguguuuucugugagccgcauguggcuguugagcacuugagauguugcugguccaaaucgucgugugcugucaauguaaaguaugcccuagcuuucaaagguuuaguacaaagaggguaaagaauguaaaauaucuaaugauuauuuauuguuuguuuauuuuguauuuuuuuuuguagagacgggggugucucuauguugcccaggcuggucuccaacuccuggccucaagcaguccucccaccuuagccucccaaagcacggggauuccagauaggagucaccaugcuuggcccugaaaauuacuuauuuauuuauuugagacggagucucgcacugucgcccaggcuggagugcaguggcguggucucugcucacugcaagcuccgccucuuggguuuacaccauucuccugccucagccucccgaguaguugggacuacaggcacccgccaccacgccuggcuaauuuuuuuguauuuuuaguacagacgggggcaucguguuggccaggauggucuccaucuccugaccucaugauccacccaccucggccucccaaagugcugggauuacaggcaugaaccaccacgcccggccccugguaauuuauguuaaguguuuaaaugaacauauucgggauaaauuggguuaaauaaaauauauuaaaacacauuucauguguuucuuuguacuauggcuacuagaaaauuugaaacucuacaaaugugucucacgcuauacucuauugaauuugaaacuauacaaaugugucucacgcuauacucuacugaaugguacugcuuuguggcuuuauccuuuuuuuaucugcuucgguuucucagagauguuuuaaaaacaaaaaaguuguacugauguuucugucuuuccauagccauccagauuuaugaugauuauuaauaccguggacuucucuucaccaucuuauuuugcuuucuauuucccaugcuuuugucuucauuuuuucauuuuuuuuuugguggaucguuaagguuuucuuuguuccaguuaauuuccucuugcgguuugcccaguucacagccaugcuccacuuguggcaaaucaaaaaggucuccacacauugccagguguccccuggggagcaaguggucccuguggaaagccgcugcacuaggugagcccggcccuggugagggugccuugugaguggagccugcuugugcugcugugccccgcugcuuccaggcggcgcggcccuccgucugauugcuggaggacucuucgguguggacacaccgugguuuguuuacccauccuggucaauggacaauuggaacuguggugaacaagcauuccugcaccuguauguggauauuguauguccauuuuucuugggaguggaauggcugagucaucugguaggugucuuuaccuuuuaaagaacuaagcgcuuuuuccagaaggaucaucagaacugcugccagcaagaguccagguaucccggcuccaccagcaugugguggcggccucuugacuuggaacuguucuucugggugccgggguucuccagagaaacagagccaguggcacccacaugugugugugcgcacgcgugugugggagugugcgugcgugcacgugcgcacgcgugcguguaaggagcugugucacaaagaauuggcuggugcaguuaucaaagcuaagucccgagccggagacccaggagagcugaaauguaguuccagucucagucucaaggccugagaaccaagagggcugacaguagcaguuuuaacccggaagcugucgggcgggcgggagauccaagaagagccaggguuuuaguccaagugcaaaggccagaaaagaccaugccccgcccacaggaggaauuccuucuuacccagccuugccuuucccuucagguccucagcagauugggcagggccccuccccaacggggaaggcugugggcuuuccucaguuuacccauucagauauuaaucccaucccagaaugcucucacagucacacccagaauaauacuuggccaaauguuuguuggggaaccuggcagcgucaaauggacccauaaaauucaccaucgcgcuuuccgcuguggucuaauuugcauuucccugaugacucaugauguugcacgucuuccuggagauuaccugcccuucauagaacuucucugugauguuccuguucaaaccuuuuccccauuaaaaaaaugggauugcuaaccgggcgagguggcaggcaccuguaguccuagcuacucaggaggcugaggcaggacaaucacuugaucccgggaggcggagguugcagugagccgagaucacgcuauugcacuccagccugggugauggagugagacugugucucaagaaaaaagaaaagaaaaguggguuggggggcuugcuugucguaauacugaggcugcaggaguuggcuguauuccagauggaagcccuuugucagcugugcugugaaggccuucucccaguccauggcucguguucuuaacuuucuuacauuguuuucugaagagcagaaguuuuaauuuugauaagguucagaggauggauuuuucuuuuacaguugguacauuuuguauccuucuaagaaauuguugccugucucaaggaugcaaagauuuucucccuuguuuccuucuaaggaguuucacaguuugagcuuuuguguuuagguccgugauccauucggaggcacuuuucaugggaugugagguuuggguugagggccaucccuucccuguccuggcuguugcagagacuguccuucgccucaguugccuuggccccuuggcuguauguaaauggacccugccugugggucuuuuucuggguuccccacccuguauugaccccugcauccauuccuagaccagugcuguacuggcuucagcacucuagcuuuaugagaagucuggcagucaggugccauuuaucaaaauucauuagaauuuuuguuaacauuuuuuaauuuaaaaagauacuguuauauauguauacaauuugccaucaaccauuuuauacagcaaccacuuuauccauuuauagcguagacaccguuccguaagcacacaguacagucauaccaucuauaucaccaugacccucucaucuugcaaaccggaaacuccauagccauugaacaaaacugccuccuccccaccccagccccugggauccaccauucugcuuuaugugucuaagaguuggacugugugagauaccucauacaagcagaguuagcagauuugucuuuucaugguugacuuauuucacuuagcauaaugucuucaagguucacccauguuacagugagugagaggauugccuucuuuuaaaaggcugaauacuguuccacuguguauuguguuacuuguccccagggggacggaacucauaauauauagagguagaugaggggauuuauuggggaacuggcuugugugauuacagaggcugagucccgcagcagaccugcaccccagagacccugggaagcuggugcguggcucaguccaaagccaaaggccugagaacccuggggggaugcugguguaagucccaacauccaaaggccagagacccuggaguucugaugccaaagggcaggaucccagcuccaggagggacaggaaauugcuuauccucugacuuucuuguucugucugggccccagcggacuggauggcaccaccuaccuggaggacaucuucccacucacccaccagucuccucuggaaacacccgcacaggcacacccagaaguaaugcuucacagguucucuagguaucccaaaucccaucaaguugaugccugaaaugaaccauuaccugugcagauacggucaugugucacuuacauggaaaaacucucagaaaugcaucguuaggcgacuuugcggugugaacaucguggaaugaacuaacaggagccagaugguguggcugcugcacgcccgcaccgugguacagccuguggcuccugggcugcaaaccuguacagcaugucacugcacugaauacugcaggcagcuguuccacggugguguuuugcauggaacacaucgaaacauagaaaaggugcagugagaaugcaguauccuaaucuuaaugggaccacuaucaccugcacggucuguuguugaccaaaaugucguuauguggugugugacugccacguuuucuuucuucauuccccuggugauggacauguggguggcuucugccucguggcugccaugaacacaggugugcagauaccuccugggacccugccuucaguucucguggccuacuggggacucaggagccuugugccuaacguucugaggaauugccucgcugcucuacacgcugcgccgggcacguucccuggcacugcacgcgugucccgcugcuccgcuuccugccguggcauagcuuucgguguugagugaucgccguccuaacgggcacgaggugaugccucacgucugcacuugugucuccugagcagugguuggucguguggagcaucuugucaugugccgcuuggccauugguuuaucuucucuguacaagugucuaaguccuucacccauuuuaaaauuggauauuuccuuugguuguggaguuguaggcguuuuuaaaagugcauucuggauaguagcuccauaugcagaucccuggguugcagcuauuuuuucccauuuuuuacucuguugguuuuuccugcucugcaguuuuuaaguuugauguagucccauuugucucuuucuguugccugugcuauuaggaaucuauuuuuaaugcuuugccccuuuucacuguucuuccuaugauacggucugugagguugccuguccucauuugggcgagcuguaucuucugcgggcucaucucugcagugcuguuucuugugucuuagaaucugcuggccccucucugcauugcuguuucuugugucuuacauugucuuuguccacggauuuauuguguuugaucacuaagcaauauuucugaguaguuuuucugccaggaagguuugugugugcucagcuuucagcccuugcguaucugaaaguaacuucaguuuguccucauucuugagugauaauuuggcucgaguuagagucuuuagcauuucugaaauuccacucacucggucaccaaaugcccuuuaaggagccugugaaggggcucuugcuaaccagccagcccaggccaguggaggggagcuuuuagggcccggagucacgugcugagucccccggaagaggaggcggugcuuuccggggcuggccuggcuccucuggggggcguggauguggggaggagcugcugucugggucagcagcugcccugcuggagggagagggggugcugcgcucauccccugaacucagauuggauagccccgggccagcgcuggaggaggagcagaggcagggaggugggaggagcgugcgcagaggcgugggaggccugaggaguaagcggcuggauguggacccugagagccacuggcagggagguggggucuuccaguugugaagacaccguggccccggugagccccuccccggccuccuucaugccugcguucugcguaaccguggcgcguucugggcagggccuuuucccuugcacugggagcaaaggguuccugucugcagcacaccagcugcccggagcucugcccugugccugagcagcgucagcaccgcggugaggcggacggcccggcagggguuggaaaguccagaaaggccccguucccgcguagaacuugaaugcagcuaagggacguccagagaggccuuuccuuuucugguggcggucuggaaugugcuggugugcggaugcuguguggguuccuccgcgcgagcgagggugguugugccgcuuugucuaauggucuaauggcgaagacuuucuguccugcucuugugaggcgccugcacaggcagagcaaagacugaguauaugccuugcguccuuuagaaauuccaccucguggcaggacacacucagauagggucuccagugggagaguccugcaggccggugucgggcuguggugucagggccucgggggggccuuccccagugggucucguugagcucgcuugcacuggucagguauuuauggagagcugaagugcugucugcugugacuucccauccacuagauguagagcagacgaaaagaaucuuucccgucuuuccuaagcagugccgaauccuugggagaaaucuugaaggcaggcaguguggaugaugggaccccaggcugcguggcaccagcaagcuugguuccagaugccacacacggugccuggcuucgaguccgucuccuguugucacugcuuugugaguugguuaagcguguugugucuugauagcuucccugcccuccuucucaacauccugacucauuugcucaccagcaagggugaguccugcucgguagcagacggugaugcuggcugccauuugcaaagccuccuguguggcugucugguguggacgagagcgugugcacccugucacccgcgguggguccacgucggcgcugggggaugucugaguggagggcagcuggggccaggccgaguggggaguggcagccgggggaacgggcucagggccggccuugccacccgccuccugccccugcuuucggggggaaagugagucuagggaagagcccugcuguguggcuccuuccucggcugaggccaguccugucucuguugcccuggcugucccuacuucugggaagcccaagcgcugagcugcguccaggucucccucacugcagcccugccuuccucacguggccucacggcuaagcacaguggcugacacgaggucgaggcgugcccagggccgggggagcaggcgguacccgagagucuguccucccaugguugggcacggcuggagaggaggcgagguggagcgcuuguucuggcacagcugcgacggcagaguugggcccacugcucuugggcggcagcacggccguguugcugaugcgcuguguggugagcugccggccaccagugcagccaggaccgcaggugguguuuccugcgggagcccggccacggaggccggggagcgcuggggcgugauucugucgugccgcuuucaaaccguagagcacaggaaacgggcggagaagaacucagcagcgcuucucucagagggacagaaaacuaacaacgacuuuaagauucuccuugauuggcuuauuuccacagggaauggaugguucuuacgacuggggaaggcaaacgcugucacacaggagaggugugggucgugcacuuguggcuucccgugcgugugugaggcuugcugugcccaaccccagcccguguggagcccacgccccaugcacccuugucccugcccggccuggccucgugugguggcgccugcagccgcagcagccuggcugaucaccggccaggccuguguuuuaccgucugauagccucacaccccggucacuccucuccuguuuggaaauuucuuuaacuguucguuauucuggaugaacuuugggauuauuuugucaacauacacguacaauguuuuuggcaaaaauugggguugcuucucauccagggauguggaguggcucuccguucagcagggcuuuugugggucuugguugagguuuagaguagauacuuuugagaccaugaaccuucugagacuucugccucuacaagugccaugaggagaccugguguguccuggguguggggcugguggggcucacaccaggggagcagaucccucaccauccuccuuccucuccaggugcccuacgagacgcugaacaaacgcuuucgcgccgcucagaagaacauugaccgggagaccagccacgucaccauggugguggccgagcuggagaagacguugagcggcugccccgccguggacuccguggucagccugcuggacggcgugguggagaagcucagcguccucaagaggaagguuggucccgccuggcggucccucuucagucuggggcauggacaccccuuuugucucgaaaaugaguccuaagacaggcaagcugcaaugaugggaacgcgggaggugcgguugggggcccccuucccugcugucugccuucuggggccacugucggcugagcaggccagcuuccuguuccuguagggaccguguugucuugcuccaggaguguccagaguccaggccacagggagaccaggauguauagcagguugauugauuuuuuuuuuuuuuuuuuuuuuuugagacagagucccacugugucauucaggcuggaguucaguggugcgaucucagcucacugcagccuccaccuccgggguucaggcgauucuccugccucagccucacgaguagcugggacuacaggcgcccaccaccacgcccgucuaauuuuuguauuguuaguagagacaggguuucaccauguuagccaggcuggucucgaacuccugaccucaggugauucaccugccuuggccucccaaagcugaaauuacagguguaagccacugcacgcggccugaucgauuauuuuuagauggaauuucaccuccaaggagcauguggaguuccuugucacugggauugguggacaggggccuugggacuaaucuggcccacugaagacacccagaaagugggaugagauaucuugaaacgucgcacugaaaauacccaauaaaccaugaaaccgaaaggaaucgccaggccagaaccggagggcaggggucagaggugagcagcaagagacugcuguuguccccuggaguguuggccaggccagauggaggugaggaccgaugacccaagccuuggaaaguggggcccaguggagagaaggugggaccccacgguacuacagcucagcgugggguguaccagaaguggacuggcguugacacagcauugcagccuacguucagaggacugggaugauuggagacccucagccuucacuccggugagguggucccggcugguggugccuuccagcuccgggcagagucaauucagauucuuucuuggggaggauaccuucaauaugggcauaagaugauucuuagauucucaguuuucaaguacaacguccagcacagagacagccugggcaacagugagacccugucucaagacaccacgauggacuggagacccagcaggcaguagacagagggcugcacggacugcaggugcaggggcugccaggugccacaccuuacugugcuuaaagaacagaagcaggcugggcgcgguggcucacaccuggaaagcacuguggaaagcugaggcagcagaaucacuugagcgcaggaguuugagaccagccugggcagcacagggagaccccaucuccacaaaacauuaaaaauagccaagcguacuggugcccuccuguagccccagcagauacucaggaggcugaggcagaaggauugcuugagcccaggaggucaaggcugcagugagccacgaucaugccacugcacucuagcugggcgacagcgagacccuaucucaaaaaaaaguuugaaagucucugcagggaacagacaguauaaaaagugauuuaaggcuggacacuguggcucacuuuggaagggcgaggcagguagauugcuugagcccaggaguuugagaucagccugggcaacauggcaaaaccccaucucuacaaaaaauagccaggcguggugacacacaccuguagucucagcuaauugggaggcugaggcaggagaaucgcuugagcccaggaggucgagguuguagugagcagagauugugucacuguacuccagacugggcaacagagugagacacugucuuaaaaaagugauugggcaggcacaguggcucacgccugcaaucccagcacuuugggaggccaaggcaggcggaucaccugaggucaggaauucaagaccagccuggccaacauggcgaaaccccgucucuauuaaaaauacaaaaaaauuagccgggcaugguguacgccuguggucccagcuacucgggaggcugaggcaggagaaucacuugaacccaggagcuggagguugcagugagcugagaucgcaccacugcacuucagccugcacagagacucugucuccaaaaaaaaaaaaaaauucagaauuuaaaagggacuaaaauuucaagaaaugggaaauauaauaaccaaaaaugaaaaacucaacauuugccuauaacaguuuaacaguuaacagacaaagcuaaagacagaauuagugaacuggagggugaucgagaauggagcacagagacugaaaaaucaaaguggcugcgagaguaaagcauggaauagagcagaaaccuguggcauguuucaccagagcccaccaguggguggggacagagauggugcggggagagugaccaagguuucagaacugaugaguaccaccaggucagaauccgacacagaguaagugaaaauaaaccgacaugggauuuucccgugguggaacugaagaaaacagagacaaagaaauauuugaaaagcuccugagggcaaaagaugacuuccaaaggggcaacagacagccggacagcugauuucugcacagcaguuggaagccaaaauugguagaaugugcugaaagaagccagcccggauccuggaucuguccaguagucagucgccgugugugcugucaaauuuuuagcgaagaauucaguuccucaguugcaccacugcccuuaaguguguggcagccacgugggcugguggcagcuguguugggcagcacaggccuggaacguuucuaucuagcccgauucauuuuuaacaaaauugacuuuaagaaaaaaaguauugcaaaagauuuuuuuaaagucaccuuauaaugauaaacaguuuaaccagaaaggcauagcaaauuugaaauuguaugcaucuggcaacauggcuucaggguauauuaauauaaagccagaaauagcagagagaagcugcagauccagggugguggauuuucacugccuccgucugcagcucuugggccaggcacaccugccuagcggacucgguagagcacgguuuuuuuucugucccguaaucccugcuuuucuccuugugaguguuguggauuggggcagccuggccucccuuggugcagggcugcggggcaucccuguccugaacgugccucuguuguguguggcucaggcgguggaauccauccaggccgaggacgagagcgccaagcugugcaagcgccggaucgagcaccucaaagagcauagcagcgaccagcccgcggcggccagcguguggaagaggaagcgcauggaucgcaugaugguggagcaccugcugcguugcggcuacuacaacacggcugucaagcuggcgcgccagagcggcaucgaggugggugcccgccagacgcaggcacagcgccccagcuggccccaggccuauggccagccgcccuguggcaugucccccggcaugccugugucccuacaugcuuguguuccccuccccccacccccguaugcuuguguuccccuccccccacccccgugugcguguguccccccuccagugugugugugugucccccuccccgugugcgugucccccuccccccaugugcauguccccaccccugugugcguguguccccuucccgugugugugcccccccccccccaaugugcguguuucucccccaccccgugugugugucugcgcuguggugagggccuccuccccagcugagaggcccugacccuuuguggaaacgcaccugggacuuagccuucugaaggcaggaagucagugucuaagcggcucuccagguucuucucauuucccuguggugucugcacacauccugcuuaggauuuucccgcccgauaccuguaccccggguuuugcgcugacacaugcuccauugcuuccucgugagagcuuugccuuuaucucaggcggggugcguuuuccguguuuucuguggcacccuguagaaacacguggcacccuugcccucuguggcuacagcugagcagacgcugggcggugcugcccucuggcaccuuugggccagguuagcuggggcggccucucugccaucgggcaguuguccacugcugugggggcccauggcaguuggagccucccagaccagcacuugggcccgucgcccuugccccuguccagauccugcugugggagcacagccucaccugacucggguuaagguggcguccguguuccauuugacugagaugacaacacuugagaaccucucaggcaggacuugugcgagaggauugugccccauggcccugucccgggcccagccuccccaugcccagccaugcgccuggccccacaggccucccucccaugcugcucccugccacggcuccucagcccaccuccucccugcuucugucuaaccaggggucuucucucuuuccacggcuuaaaucccacccacauguguguggcucccaccuggggcaucaugggccucagcccuggcugaauucaaccccagcacaaggcucccuucccagccuuggaggcggccucacauugugcaguccaaggccucgggugcccauggggccacacucacgcccccaugcagccaucugcacgcccugcuggcuugcagccucccccacacuccugucacgcuccugcccagcuccccagccuugcggcacuccagacucacccccaggcccacccggccccacacuccagacucaccugcaggcccaccacggccccacacucuagacucacccccaggcccaccccggcccccacacuccagacucaccugcaggcccacccggucccacacuccagacucacccccaggcccaccccggcccccacacuccacacucaccugcaggcccacccggucccacacuccagacucacccgcaggcccaccccagcccccacacuccagacucaccugcaggcccaccccagcccccacacuccagacucacccgcaggcucaccccagcccccacacuccagacucacccgcaggcccaccccagcccccacacuccagacucaccugcaggcccacccggccccacacuccagacucacccgcaggccccacacucuggacucaucugcaggccccacacuccggacucaucugcaggccccacacuccggacucacccgcagacccaccuggccccacccucuugcuggcucuuguccucggcauuugucccgcaccucguucaccuucucucagaugcugcccuggguggagcggcacccucccacccaugccuucuccccacugcugcacagccucccugcuugugugugugugugguguccguccugcccuccaggaggggaguggcgagcagcugcccagugggcagggugagcgagugaguccucguguccuggaggcccucaucugcccagaccugcacagcacuguugcucucggcaccgcugggguauggcgucucgguucacaagcgugaaugugaugugucacagcugugccaugaguugaucugccagauggcaaagugcacugauccucugcggugaccggggcuggugccccugggugcccugcagucuuguugaguuuccgaagucuccaggucaugacucgcagccacuccagugugcacccaacauucucaucgcuggacggggucgucugugaugccucugccgugcugcccacugggcugcuguggcccccaucuggugccauuuuuccuccaccugggugucagggaagggcauucucaccugcaccugcccaggcucaugugacggacagugggccagcacauguccgcuccggugcccugucccacaugccuuucccacccacccgccucccuggccccgugugcccggcuucccccaaugcacaggcccucgcuccgugcugcccacauguccuggcugccuggggcggccccccguguguucauagaugaccuagccauccucuccuaaacgcccagcacacuguccuugggacccauggggugugaccaagcaaccuggcgguggcugcugaagcaugagcugugggugccccuggccccagggaaugugcgcuguguugggggagagagacgugaagugaaagaaggggguccuguggugggcacaggccacgcguuccacagaagugcguagagcaggguggauaugggagugcugaugauucuaaggccaguuggaguaggccucagcagggugagacgggcuacacucaagguguuggggugcccugagcaugucuguccaaaagagggccuggagcugcuguguggaagaaggcgggcguguggagcccaugaggacuggguugcgggggagggguucuuucugcugagaugcuccggagggcguugagcugaggaaucgcuuuugaccacaggugaccauggcacuaggaagcccuggggaaggugcugcuguggccgagggggagcugccagguuguggaaauguaaaccccggcugcgcuggucagaccuggacuuccuguagggggcgccauggaauucccacgugggaccccaguuuccuaccugugcaccaaaauuccugugcaccaaaauuggagacgugacaaacuuaggaaaauaaccucaugcucuggauuggagcaaggucccagacaauacaggacaggaagcugcugccaagggaaggccacccaggaacaggacaggaagcugcugcccagggaaggccacacaggaacaggacaggaagccugcugccgagggaaggcugcccaggaggggcagaacagaguccucaguguggcuggugcugugcgccugccugugcugccuuaggcuggacgcagggcucucaacccguaauccuagcacucugggaggcugaggcgagcggaucuguugagcccaggaguuugagaccagccugggcagcaaagugagaacccuucucuacaaauuuuuuuucaaauuagcugggaguguuggugggugccuggggucccagcuacucuggaggcugcagugggaggaucacuugagcccaggagguggaggcugcagugagccaagauugcaccacugcacuccagccugggcaacaggacaacacccugucucaaaacaaacaaaagucagcaugagcauuucgugugagacagaaaaccaguucacuuagaugguuucuaguuucaguugacguacgagccugcugccagcuggccucacaucuuucaugugacucucacaaccggagacccggacauuggagaaacccucaguaagagagauccaacuggguucagaccccgaggcuguguugacgggacaugaggcaggauauagaccaggagccaccuccugaaauuuagagcaaaacuacaaaacaaggccuuugggagaccagggugggagcaucacuugagcccaggaauuugaggcaacagugagccaugaucucaccacuguauuccauccagucuggacaagagagcgagacccugucucaaaaaaaaaaaaaugguuuuucaaguugcaaaacaaaguaagacuuugugggagacccaacauucgccugcccugaaggggcuucagaaaagaaaucaucaaagcaaacaugcaagaaaacacuaugaaggggcuccagaaaagaaucaucaaagcaaacaugcaagaaaacgcuaugaaggggcuucagaaaagaaucaucaaagcaaacauucaagaaaacgcuaugaaggggcuucagaaaagaaucaucaaagcaaacaugcaagaaaacgcuaugaaggggcuccagaaaagaaaucaucaaagcaaacaugcaaggaaacgcuaugaaggggcuucagaaaagaaaucaucaaagcaaacaugcaagaaaacgcuaugaaggggcuucagaaaagaaucaucaaagcaaacaugcaagaaaacacuaugaaggggcuucagaaaucaucagaacaaacgugcaagaaaacacuaugaaggggcuucagaaaagaaaucaaagcaaacgugcaagaaaacucuaugacggggcuucagaaaagaaaucaaagcaaacgugcaagaaaaugcuaugaaggggcuucagaaaagaaaucaucaaagcaaacaugcaagaaaaugcuaugaaggggcuucagaaaagaaucaucaacaugcaggaaaacgcugugaaggggcuuuagaaagaaauuaucaaagcaaauaugcaagaaaacgcuaugaaggggcuucagaaaagaaaucaucaaagcaaacaugcaagaaaacgcuaugaaggggcuucagaaaagaaaucaucaaagcaaaccugcaagaaaaugcuaugaaggggcuucagaaaagaaaucaaagcaaacgugcaagaaaacgcuauggaggggcaucagaaaagaaauaaucaaagcaaacgugcaagaagacacuaugaagggguuucagaaaagaaaucaucaacaugaacaugcaagaagacgcuaugaaggggcuucagaaaagaaaucaucaaagcgaacaugcaagaaaacgcuaugaaggggcuucagaaaagaaaucaucaaagcaaacaugcaagaggccgggcacgguggcucacgccuguaaucccagcacucugggaggccaaggugggcagaucacgaguucaggagaucgagaccauccuggcuaacacggugaaacccugucucuacuaaaaauacaaaaauuuagccgggcgugguggcaggcgccuguagucccagcuacccgggaggccaaggcaggagaauggugugaacccaggaggcggagcuugcagugaguggagauugcgccacugcacuccagccugggcggcagagcgagacuccgucucaaaaaaacaaacaaaagcacacaugcaagaaaaugcuuugaaggggcuucagaaaagaauaaucaacaugcaagaaaacgcuaugaaggggcuucagaaaagaaaucaucaaagcaaaugugcaagaaaacgcuaugaaggggcuucagaaaagaaaucaucaaagcaaacgugcaagaaaacgcuaugaaggggcuuuaaaaaagauaucaucaaagcaaacaugcaagaaaacgcuaugaagggguuucagaaacgagaaaccguuaaagaaaagaugcaaggaaacaacacugugagggguuucagaaaagagaaaucaucaaagcaaacaugcaagaaaaugcuaugaagggguuucagaaacaagaaaucaugaaagaaaaggugcaagaaaacaacguuaugagggguuucagaaaagaguaaucaucaaagaaaacagcgcaucugugaggccggugguccagacguggggcugugggacccaaguggugaacuguggccucauccugggccguuggguccugggcuaugugcaggcggaggugccguccuuggucccacuggggaaggucgggagucauugcugcugaggaccaccugagcgcuugccccaagccuugccgugccugguggagucccguaccagcugcuguccugccccugccagagaccauggguuccacugcuaggcacugagcacccacccccugugcccggccacuagcggagacuugaugcuaagccuggguuacucuguuuuuuuuguuguuuuuuuuuuuuuucuuugcuuucauauaaaucauugguuguaacuaccgcgauauuagccauaauguguuuauguauuauuuagcauguuauuauuugcuuacuguugauuuugaaaugagggggcugcccagggagggccuguagaugugcuggggggcuguggggaguggagacagggccgccuggcauguggccuggcccugccugcaugugugucucagcagcuccucuccauggacagguggggccagccuggcucccuugcccggcuauggcugcugucuacgugagcguccgaccuuuugguccuugggggcuguucuguuccuaggaucucagagcggcccugaguaguccacgagugcagacccacaguguggacuggagaugcaucucgagugguggccggugcugggccugccucauggaggcuggggugugggaggguggcaugggggccuugagccagcacauucugaucaggugcugcuuccuuccucuaaggaccuagugaauauugagauguuccugacggccaaagagguggaggagucccuggagaggcgugagacggccaccugccuggccuggugccaugacaacaagucccggcuccggaagaugaaggugcacggacucccagguuggggugggagugggucggggccgaggcugcgccaccugcccuggagccagcacccccuugccuggugguucacaguaguuugguuuugguuuguaagguggggguuggguuugggaguuuuuuugguggcuguguuacacuuuuaggcuaaaaucuggaaaagugcaccucauuuggcauuacaguuuguguacagcuggcaugaggcucagaaggaguggguuacaggaggcugaccaugugcacacagaguguuggggcugcugggcuuagagccuggagacaggucaguccugcuccauggggguacuccaugggcucccugugcucagucauagacacagaaaagcugguugggaagucauucuccaucugcgaggcugcagagcucugggcugugauauuguuaaugaauacccacuuuuuuuuuuuuuuuuuuuuuuuuuuuuuugagacggagucucgcuuugucgccaggguggagugcaguggcacgaucuuggcucacuugccuccgguguucaagcgauucucuugccuuggccuccugaguagcugggauuauaggcaugcgccaccaugcccggcuaauuuuuguauuuuuaguagacaugggauuucaccacguuggccaggauggucuugaucuccugaccuugugauccaccugccucaaccucccaaagugcugggauuacaggcgugagccaccgugcccggccgaguaccgacuuuuguagagaccaaaagaagcuuaagaaauggacuccuaaaggacaaaauuuaaaccugcuuauuaaaaggcauugucacccuaggggcuugcagaaauguuuuaacuuauguuaacacuucugccuccauuagcaaaacuuuucugucuucuaaacugagcgcugcuuuaaccucacccuggcugaguuuggcagggugcacgcaguuaccagccaggagugacacacugccacucagggccgccaaaacaagcacgaagcaaagacgggacgaaaaaguagagcggcuaguagcuccccuaaagagaguuuggaccuugguauggaaacccuaaaaggaaagccagaauugguauguaaccugcggccccacuacacagugccagccccacacucccucccagagagccggcacacaccucacagugggaacucugccagggcuguuuccuguggaugucagagggaagauagguucuuggugcugccaggauauuccugcaagcccuaauuaccugccggacaguguugcuggaggguguuggaggcuugccacgagcacacgaccugucugaagcugcuguggggacaggcagggccaggacucggggcccugaaugcaugccugggggacgagugugccugguguuggaugaaguugagauuggaugccugguggaugagcgugccugguguuggauaaguugagauugggugagcaugccuuguguuggaugaguugagauuggaugagcgugcuugguguuggaugaaguugagauuggaugccugguggaucagugugucugguguuggauggaguugagauuggaugccugguggaugagugugccugguauuggaugaaguugagauuggaugccugguggaugaguaugucugguguuggaugaaguugagauuggaugccuggucaaugagugugccuggcguuggaugaguugagauuggaugccugguggaugagcgugucugguguuggaugaguugagauuggaugccugguggaugagugugucugguguuggaugaaguugagauugguuuggaugaaguugagauuggaugccugguggacgagugugucugguguuggaugaaguugagguuggaugccugguggaugagugugucugguguuggaugaaguugagauugguguuggaugaaguugagauuggaugccugguggaugaccgugccugguguuggauaaaguugagauuggaugcuugguggaugagcgugccugguguuggaugaguugagauuggaugagcgugccugguguuggaugaguugagguuggaugagugugccugguguuggaugaguugagauuggaugagcgugccugguguuggaugaguugagauuggaugccugguggaugagugugucugguguuggaugaaguugagauuggaugccugguggaugagugugucugguguuggaugaaguugagauuggaugccugguggaugagugugucugguguuggauaaaguugagauugguguuggaugauuugagauuggaugccugguggaugagcgugccugguguuggaugaguugagauuggaugagcgugccugguguuggaugaguugagauuggaugagcgugccugguguuggaugaguugagauuggaugagcgugccugguguuggaugaagucgagacuggacggggccugaauccauauuuagaugcuguccagaaaugcgcccugaagacuccaaaugacacgaaaacaugcccgguacgagaugcggccgagccaguugggguacacggcugucugugcagucugcucacaugugcacgcacgccaggggguguguggggaggcaaggaggagccagacugugcucuaacgggucccugggaccagcugugagaaccuagaugggaaaagaaacuugagacccaaguuugaccuggcugagagauggauuucacaggcaugggugggugaguggcccugaaggccccugaagcagugauuuguuugcugcacgucugugcgaaagccacacggagccaucagugugggcgccugucgcagggcgggcacagccuuguuggcgcuccacgccguaugggacaguguagacucgguguuuuagauuugggucugaauaccuaaguuucacgacauagacacacuuacauauuaguggaccaauugaaaguaaccuacuagagcaaaagguguuauugaaaagcagguuugaggugucuauugugugaagcgguaaccuagagugggcccagaguccugcucuucuagagcacccccucggcagcugcguccugccuuuagacagagccccggcacucgccugcucuagacacggcagccaucaggcagccccugggaggcagguggggcccugguggggagccucuaucucuucccgcuggcccuucccuuccucuccugccaggcuggcucugaagggagcggagugcugaccgaagucugccugcugauuagugggguggggacucgggacccugggaugacuuugugccucucggcugauuuguaccaagccuggcacuccccacccagagccugugccacugcuggggucagagacaguccuccugccccagcuuggagcaagccugugaguucugcguccagccuguugacccgucugucuagggacacagggugaugaggggcugaggguacagggcagaggcagcagggcagggaccugagccccucugagccccuggaaggcagguggcccccgggggucugggcagcccaguccuccccacacccacgcggagccacugcugugggugcuaugcgugucggggcagcaaggcuggcaggcggggugggcuggagcacagguggcuccucagaaagcucaguggggaaagcucugggaagcggaagugaugagcuucaacuuaaaugcagugguccgggguggauucaucugccacguggaguuucuguucaugccguccugagagccaggccaugugaacccagagugacacgcggccccagcccaagacucgcuccguggugcccacgccuauauccuguuuccggggugaagcccugagaauguccugaaaccacacggaagaucuuacgguuuagacggacaugucacuuccguagaauccgcgucucaucuuggaugacugcggucaauguugccgcugcccccaccccagccacaagucucggcccacguuggacugagguugcugagauuucagauugaggguugggcuucccuuaggugcacgugagaggcucauaggcagacacaugugggacuugguccugcaggagcuucccccacccccgccccugccucaggcauagugccuucagccagcagccccaacucggccucucuccgucuucuacacauccuggaagcgcccucccuucacgcgagccgccccuuggccucacagccaccuaggaccucaguguccccugggccaggccuccauuccaugugccacccgccuggggccucggcaccggccccggcuucugcccgccauguucucgccaggugucugugcggucccccguccauaaccucggugcaggcgcuccccgcccuaccgaccuggguccugccugcugcaagcuugcuucucugccucaugccccugugaggcaccagccagcaaccccacauguggucccugucuccuccccgcccugccgaccuggguccugccugcuccaagcuugcuucucugccucaugccccugugaggcaccagccagcagccccacauguggucccugucuccuccccacccggggcaucagcgccucgggacaggacuugcccacguucucccagaacagccccggguucaagccagcacccagucuacauucgggauaguuggguccagaggcccggugggaguguagaggaagcaguggccucagggcgggacccaggaagcugcuuuguccuugcagagggguuggugccuuugcuccagcagcugcaccugcugcucugcccucccagcugugcuccuggaagcgcccugagcgcccuggccuucggguugaaaugcugggcggcugcacgccccaccgcagcugcaggagcagggggcgggacucacauucagaacccaguguucccuggaaagucugcugcagguuaaaguggcagcuucagccucagcccugccuuccccgugccugugagagagggguucagagcuuugguuguggggucugcugguggacaugcgggugcggcacccgggcaccugggcucugugggaugugcugucuaagcccucgucuugucuuugcccucagagcugccuggaguucagccucagaauccaggaguucauugaacucauccggcagaauaagagacuggacgcugugagguaggcauugcggacgugcgucuccucgagggagggcaggauguucggcugcggccccugccagcccucccugucguggucuggguccugggacguccccugggucguccccugggucuugagucugaccccugccugcucagguggcugcuucucccacuguuccugaaugggacuuggggagugaggccuggagccuggcagggcccccgccaagguguggccccaggugggcauccagacccccguggcugccaggggaaccagcuuugaggucccgaccguccacguaaaacacguggaucaggcucccggcacccccuuuccacauuggaaagugccgccagccucaguagaugggagugucucugacgugugguccucagguagcuccaagcguccugagcuugggaaugucccucacagucaucggggaauguugacagcgugugaugagggcacuucuggguucuccggccugucuccgacccaagggcggcgugcagugagcugaggccagcggcgcccugguggucaggccugagaaggggaugcuggcugucacuguggcucagcccaguuggggugcacggcgucugcaaaggaagagaggcuguccgcuggcuucccgcuggcuccccagagugggcaucgucaggcagcaguggucccuggccugggcagugucggccaguucaugcucaccccgucucggggcagggcugcuccuugagugcuaggucgucucacucacuuucauggagguuccugagcggccaagccuugcggugacgcuugaguugcuguguggggugugugggccuggcuggcccucagcucccgggcgagugcccagcagguguguuugccaggagggggcaccuguccaugcccacagaaacccgaccgcgacuccauauccaccugcagugggccggguggccgaguguuccacagaaggcccauuuggagaagugggcgucucacgaugaggugcugagggugguccccaagacgcacggcagaaccgcggcaagucccugcccuugcguggacccuggagaggcccgggguccugcuccggcuccugaugcugaccugggcgcaugguggcaggucaggccucgucuucacgcacgagggagccaggccugcaacgaggucccuucugugccugagagggcuaaagcggggaucucgggacccgggccaguggagaguggcgugugagcauugcggggacacggccaggggcccccugucaagaggaggggcucccgcucugcucuggccuccguguggccucggugccugugucgcuggccucuguccggcggcagucugcuuccaucccgagucagccuccgucuccuugagggccccggccacugucagcccuggagucugaaaacaaaacguguccaucccggagucccuccgucacagaugucuucaucuagguggcagcugguuccgcauagggucuguugaccuguuacccccacuccgcauagggucuauuugccuguguuacccuggcuccguguagggucuguuuaccuguguuccccccgcuccgcguagggucucuuugccuguguuccccccgcuccguguagggucucuuugccuuguucccccugcucuggguagaaucugcccuagagacucgcggggccuccaccucauaaugucugagccgagcucagagcugugcccucugcggccucgucuguugcaggggagcaggcaggucccaggaagugcguguccuuccucccgcaagcagacacgugcugccucgaagccucagcagccagccgggcaggcauggcaaacaacaccccagugucucgggggcaggcgcagugugagcuacauccucugcuggggccgucuugggagugguucuccaggugccagggccuggucagggaaguccggccucagcucagcguggcccuggagccacccacaaggcacacgggagcugggcugggguggcagguggggcaucggcaggacguuuguggggugagggagugcggguguuuggcugggagcccagaggguguuguguaucacucacugaggcuggacaagagggaaggcggagaagccuggccacaugucuccugagggcuccaggcagggcccucucaccugcugccagggucccagcccgcaggagcuucccguccaccucugaacucacgguccacauggcgcuggagcgucgggcaccaucuacagggcuugaggccagcagccuagccucuggguccacuggggcaggcaaggugaguccugcugucuguggagccagcgugcugggccgggcagggggccucguuggcugggguggcugcagcuccgcccugccuggggcauuuguggguuuuugcgaaaugcaaaaguaugagcugcuagugauuaacuuuuaacgccuuuaauuuuuaguaaaugaguaagugaaucccugaccccaggcggcugggaccuggccuguacuucaugggcuuugugugagcagcuccgugccgucugucgcacacccacaccucagccuggccaggcacaguuuaggaauuuugucuucuggguguuucucucucucucucuuuccguguguguguguguguguuuugagguugaguuuugcucuguugccuggcacaaucucagcucaccgcaaccuccgccucccggguucaagugauuguccugccucagccucugaguagcugggauuacaggcgcccaccaccacgcccggcuaauuuuuguauuuuuaguagagaugggguuucaccauguuggccaggcuggucucaaacuccugaccuugugauccgcccaccuuggccucccaaagugcugggauuacaggcgugagccaccgugccuggcccguguguuuauauuuuuaaagaaaaauggaaguuuuuguguuucuuauguuagcugcauuuaguuuguuaaaagucacgguuuuguuuccccuguguccuguggaugcauaccgugcuguucuccccggaccugcucugagggccccacaucucggcugcaguucucuguguguuggggcugaaugcuggcaucaaacgaucugaaaagagucagccgccacuguuagguuuucuguuucugucuuggggucaggauuuguggaucagggaccuggggugcgaggugaggcagcuuguuaggcggaugaugucugucugggguuugauugauggugagauaagacgcguaaaccaggucaugcaaaugagaucuuguagaugucaaccacggagauuaaauuuccucucuucagcagcucugggaggaggugagaugcccguuggccguguucugugcacgucuuggcgugugacgaagggugacuugucuccagagauggaaugaggggguuggguggggcuccuccuggacucagacccacgcccacccacacgcuccaaggagggggaugcaugggcacuggaaucucggauggccguccccagccccugcacacgcacccugcggggucagccguguggacucacccccgacucccagucccuguaugcacccugcggggucggccguguggauucacccccgacucccaggcccugcacaggcccuggggcgucagccauguggacuccccaggcugggucccaagcguggacgccccccacucccugcugccccgggcucuccugguggugcuuccaacacgugguccccgugcuauccaucaaggggcugcugggccaccuccuacacuaacuccagucucugcgagacacugcaucuucuccaaggccaccgugagcgccuggcaccuccucagcccuguguuccuugguacaugccuuguucuggacagcacagggcugacucacacaugggacuugaggccccugguucugugcauuggggucgcuuuggcagaggggcccugagggcugagaacguggggugcacaggggcccgugugagggucaggacaugggggugcaggcccucaggacagccagagggacagugacccugugugugggggggggcaugagaaugggggcccugggggugagcaggugcccgcuggucagcuugaaagggaucuguuauguucugcuuugguuucuugguugcccagccuuagacuggagugggguucuggccuggaguaggccugugugcaucccgcagaguuggcucaggaaagaucguggcugcaugugguguguggcacgcucagggcugagagggcugggccggaucugcagggaguccagccugugggcugagggaggcuguucuucggaagguugugcugggcgucacugccaaacagcaaggacugcaguugagaagacuacacguucuugguccgcuggggccacgggguccgugggggcgagcaucuggggagagugggaauccucaggguuuggguuccuuguaaaccagaaucgcuuuggagagcccucgggggcaggugccauuugcaguucugguguuuuccguggguugucuguguggcuugggugcccugguccccuggaggaaggagugucugguagcugcuccuccagccucuggugagccgcaccucccgccaucccagccccacccagcaggucggcuuggagugaggcgauuacuuuguaccuagacucugacauaaaagcuguuagcucagauuuuucaacuuaaaaaugcaggccgggugcagcggcucaugccuauaaucccagcacuuugggaggccggggcaggaagauggcuugagcccaggaguuggagaccagccugggcaacacagcgagaaucugucucuaacaagauguuuuuuacauuagcuagguguggugcugcacaucugcggucucagcuucucgggaagaucgccugagccugagaguucgaggcuacagugagcugugacugugccacugcacugcagccugggugacagagugaaacccugucucuaaaaguuaaaauuaaaacgcaaacuuaaaugugccaaaauguuguuuuuuagacaugcaagaaagcacuucagccaagcagaagggagccagcuggacgaggugcgccaggccaugggcaugcuggccuucccgcccgacacgcacaucuccccguacaagguagggcgugcgucccuggggucggugucaugcugggguggggauccagggugugucucuggucuguagcugcuuccacacguggggcgggacgugagggccccaucccagccacacagccuguccagccugccaagacaagcuuuucuuguuugacucccauuuugcucauaagaaauuugaaucagggcugugugugguggcucaccccuggaaucccagcacuuugggaggcugaggugggaggacugcuugagcccagggguuugagaacagccuggggaacauagugagaccccaccucuacaaaaaaaauuuuuuugaaaauuagcugggcauaguagcaccugccuauaguccagcuacccaggaggcugaggugggaggaucacuugagcccauaagguugaggcugcagugagccaagauugugccacugcacuccagcuggggugacagagcaggaccuugucuccaaaaaaaaaaaaagcaguugagaaagguucaggaagccuuucagccuggagcguucagccggggcccagcuuccuugccugucccccugguucuccuuucucuacagccccugagucaggaguuaggcugcaccgucuuccgugguucuuucucuugcugacgcuuuguauuuuaucuguaaauauuggagccuccgacucuccgcggucacugggguaggguuggggguucugccaucacuaaccaggcacccugugcucagaccuggccccaacccagcagcuggcugcuccugggugaguggcuccacucugcacccgugcccaccccugcacccaccccaugcccaccgugugcucacccccuugcccacccccaugcccgugcucaccucugcacccaccccaugcccacccccaugcccaccugugcucacccccaugcccacucccgugcccaugugcccaccccugcacccaccccaugcccaccgugugcucaccccccugcccacccccaugcccgugcucaccucugcacccaccccaugcccacccccaugcccaccugugcucacccccaugcccacucccgugcccaugugcccaccccugcacccacccccaugcccgugugcucaccccugcacccaucccaugccuaccgugcucacccccaugcccaccccaugcccaccaugugcucaccccugcacccacccccaugcccgugugcucaccccugcacccaucccaugccuaccgugcucacccccaugcccaccccaugcccaccaugugcucaccccugcauccacccccaugcccaccccugugcucaucacacugggaacaguuucaguuccuggaaaagggggaagcagauaaaaccuccuggaguugacaguuuguucucugagccuggcaccagucucugucagaggccgggguguuucccggcagcccccaccugccacccuguagggacugcaaagcccugggcagucccagaccugcugccuucugaaagcugcuggaagcucagccugaauucuccugguucucaggcguuuggggcaucucauaauaaaucaucauuaggucacgaggaucuucagggguggggucugagcuucccagacugugaguuggcaccuuguuucucucgcuugcucuggagaggauuuuguuagaaaugcaggaaaggcugacccauacagggggcugagacuucgggccuaggccggguggagcaugcaccucucaccggacgcagcccugcagugugguaaagagggaggcaggcagugccagccccaaggcucaucuguugccagauucagggggcacaaccgugucucguggcaggaaaaugggccccguugccaugggucaggcaagaaacagaaggaagcauuuuguucagagaauggcagaagccaccagaagcccagaggcaaccaguccuggggagugaggaugccaggagcuguucuucucagugaggaccuucuggacugugggcuuccucccuuguagacuuugauuuuuagacaaaaaugagauuuaaaacagccuuuaaaaauguuggaguuaagugugguguuuacccuaaacugagacugagaagcuuacagagacugaugggugacguccccugaugaccaccuccccucccuccagguguggccgucuccccccaagcuagagacugagcggccuuucuggguugaugugaagguuuuucucuccugugcucacacacgcucucucucuuaagucuaaaccugagguuauuuagggacagacauucaucagguuuaauuuucuguucugugaugcuuuaaccuaacauggaccgguuguuuuccauuucauacaugauuucucugaaguaagaguuuuuacaccuaaugcucugaggugcacucugcacugagcuguccuuccagcugugugagucuauuuuuugucacagugcacagguugcacacauuccagaucauucaaguugauucacaagugaguguagcagaguuaagucagcaccagcccuguggcauguugaaaucagaguuaagucagcacuggccccacaguguguugaaaucagaguuaagucagcacuggccccacaguguguugaaaucacagaguuaagucagcacuggccccauggcguguugaaaccacagaguuaagucagcacuggccccacaguguguugaaaucacagaguuaagucagcacuggccccauggcguguugaaaccacagaguuaagucagcucuggcccccacaguguguugaaaucacagaguuaagucagcacuggccccauggcguguugaaaccacagaguuaagucagcacuggccccacaguguguugaaaucacagaguuaagucaacaccugcccugcaguguguugaaaucacagaguuaagucagcaccugcccugcaguguguugaaaucacagaguuaagucagcaccugcccugcaguguguugaaaucagaguuaagucagcaccugcccugcaguguguugaaaucacagaguuaagucagcaccugcccugcaguguguugaaaucacagaguuaagucagcaccugcccugcaguguguugaaaucagaguuaagucagcaccugcccugcaguguguugaaaucacagaguuaagucagcaccugcccugcaguguguugaaaucacagaguuaagucagcaccugcccugcaguguguugaaaucagaguuaagucagcacucaucccgcagcauguugaaaucagggaguuagaucagcacuggccuugcagcauguugaaaucagagaguuccagcacucgucccgcagaguguugaaaucagaguuaagucagcccuuguccugcagguguugaaaucagagcguuaagucagcacuggccucacagcguguugaaaucagagacuuaagucagaacuggccccacaguauuuugaaaucagagaagucagcacucccccgacaguguguugaaaucagaguuaagucagcacucaccccacagcauguugaaaucggaguuaagucagcacucaccccacagcauguuaaaaucagaguuaagucagcacucaucccacaguguguugaaaucagaguuaagucagcacuugucccgcagcauguugaaaucagaguuaaguucauacuggccucgcaguguguugaaaucagagaguuaagucagcacugacccuguagcauguugaaaucagaguuaagucagcacucaucccgcagcauguugaaaucauaguuaagucagcacucaucccacuguguguaucagucaacacuugagggaguuaugcuuugugcugacccuuagugcaaagugugugggucacugggggauggcugugggccgauggcaccugcuucaccaugguccacguuuuuaagcugucccaggagcuucccugggagcauccccaggacccucugcucucugucuuccaggaccuucuggacccugcacgguggcggaugcugauccagcaguuccgguacgacaacuaccgacuacaccagcugggaaacaauucuguguucacccucacccugcaggcuggccucucagccaucaagacaccguauccuaccucccgugcgcagugcgguuuggccugggguuggcaucuuuggucauauuuuaacacgcugacccugcaccuugccacucuuguccucccaccacagacagccccgagcucccgugugcugcacuugcguggugucuggauggucgggguggggccguguugaggggccucggaugcgucgugcagccuucacucugggaaguggcgcgcuuccucucucaucaucucagaggccgccaugggcauugaucuaaaagcccgauuuugauguguucuggcagccggcagauuaccauucagaauaguuuucccgugugauuaccaagaaccuugccugugacugacucugucccgccugugacugacucugucccaccugugaccgacucugucugccugugacucugucccugccugugacugacuccauccugccugugacucugucccaccugcgacucacugaguuccugccugugacucacucggcucccgccugcaacggacuuggucccugccugcgacucacuguggcccugccugugacugagucugucccguuugugacugauuccuuccugugacugacucugucccaccugcaacugacuucuuccugccugugacagacucugccccugccugcgacugagucugucccuuccugcaacugaguccaucccgccugugacucuguccucgccugugacugacucugccccugcccugugacugucucaccugugacugacuccguccugccugugacucagccucuuacugacucuaccccugccugugacugacucugcccucuccugugacugacucuguccccaccugugacugacucuguccccaccugugacugacuguccuccugcaacugacucuguccccgccuaugaaugucuuucaugugaccugccucaggcccagagggcagugaguguuucgcgauugcugcugguaccuggcugugccgggguaugaaugagacucaggcccccucccuuguccccucuuuguggaacucugggcgagagggcuggcgugcuugcccacugccuguuccuaggugccagcagaacgucccugcuggguggcucuuguccugccuggagagguugcguggccggggagagggcggcgggcgacggagccacucugugccugugguccuggugcuggaggccggggugagaaggcgcaggcuucuugucuccaccgaggccucaguggggcuguuuagcugucgagugcagcacuuccugugccucgaaagacagccccguguagucagcauggcgcccacauagccagaagggcacgcagcccagggcagaguggccacagggggcugggcucaccccggcugcccugaguggcccccaacccuuccuugacccgaugcucagacagugcuacaaggaggacggcagcuccaagagcccugacugcccugugugcagccgcucccugaacaagcuggcgcagccccugcccauggcccacugugccaacucccgccuggucugcaagauuucuggcgacgugaugaacgagaacaauccgcccaugaugcugcccaacggcuacgucuacggcuacaaugugaggggggcagggcaggggggccaggcuggcacgcaucgccaucgggacagggcugugugggacgggcagggcaggggggccaggcuggcacgcaucgccaucgggacagggcugugugggacgggcagggcggggggccaggcuggcacgcgucgccaucgggacagggcuguguggggcgggcagggcagcggggccaggcuggcacacgucgccauugggacagggcuguccucucgccccacccugccuuagcuucguucgaaauggaugaaggggugggaaggacaggcgagguggccccgggauuucuuuggcaggugugccuucgggaaggaacuuugccugagaggaugagucauucccuggugguucauuguggggauuuuccauggaaauccguguguacguuguagucgcuugccuuaaugcauucccgguuuuauuuuucagucucugcuuucuauccgucaagaugauaaagucgugugcccgagaaccaaagaagucuuccacuucucacaagccgagaagguguacaucauguaggccccacgucgugaagcgcacgccucggggacgggcugcagugggcggggaggccacgccuuccuccugucccacgcuccagccugccgcggcguuucuguuucuugcgaccaaagauccgugagcaacgauaaauacucuuaggaagagagaaaauaagguuucauaaguuuguacuugaaaacauuuggauugguaggauuuuguaacacgucaaccauuugaugcuucugaaaaguacuuucaacuugcgaaggaaacucuucuuuaaagacugaccuaaacaccgagggaaacuuaagaacguuuaaaauauaggaguccgugauuucccuguguuuucaguuucuuuccuucugugaacgaugagacuuggagaacgggcugguccuucaccacuuccuguuggcccuggccuggccggggaagguggcagcggcaccggacugaccugcagugacccgcgaugccgcgccacgagggacacuuauggcuucauucgagagcugcugccaaaacgccuggcgccgccaccgucgggggcuggcuucgaggacgcccgccugccucgcgggucguguccgcgggacuguguucguacgugcauaguuucgauaucacaucgcggggcuguguucguagcugcgucguuucgauaucacacccucugugugccgccuuacuuccugcuucgagaauguauaacguggaaauccacgggaccaaauuucugcagaggccuugccggaugguuccauaacuguagagucuaauugcuauccauuacagaaauuaaucguucaguugaaagaaguacugaugacuuuucaaaacaaaugaaccaccguagcugacagagaaccguaucguagagguuuguaguuagugcuuauuuuugcauguugauguugacuagcuaauaaacuguaaauguaaaccaugcgaauaaaaugguuuucuauuucuca

SEQ ID NO: 191462 - RNA, 44111 nt, Homo sapiens
gguucgguggcgcgagaggcggggagucgccgugguaaacggggccuuggggcgucccgaaggggacccagacgcgggaggccagacuuccccggcgacccgaggaggggacuugcggcggauuccgaagccgcuuuuucugcguagccuggggguguaaaucgccgagauucuccuguguggagaaggcgccggugcccgcccgcugcugccggacucuagaggggugucuuuuuccguuaaucugagcgcagucgcggagccccuguuucccacgcagccuguguuaaguggccucgugaguuuucgcgcggcauccuuggugccucuucuuugaagcuaaguuuccauaacucuaaagcacuuuucguuuuaaacucaaaccagacucacacuugauguuucuaugaucaucuaucucccaguacggauggaugaguuuggcuucaagaaugugcucguggcuggugccaagggagugaguuuucucuguugcuuguucaguccauuacagaucgaacuccuuguuccacucuuuccccuuucucacuacugcacuugacuagucuuaaaacgaaacagaaaaggaaaagaaugugcuuccguuucacaauauuuaagaaauuuaaccugaacauauugaugcugcuuuaaacacccuccugucgccugaccuucucccucaucagagugggugcuagaagggaagugcacccuugcacccugaagguaggcugggaaacgguuuugauuuauuugaagcucuucaauauuaccccaaaauggaaacugacauuguuuagaaacagugacuuuucuuuaaauuggguuaguuagcgcaggaaaacuaggugguaguucuuucagacaauuguaguuuucccucguccggcgccauugucccgccuccuugaguccuccuugugcgcuggguacuggcaguccugauccccuucuguggcuugauaguugauuccccgugcugucccgugaacuuagagcuuuugauucugcagcuuugucccucuguuguguucuguguugcgacuuugagggucacacucacugaggccuugguaauugucccgccccuuuggaugcguccuuauguuucuuagauugcacguggggaccacagaacguuuuuguuaccacuugaaguauauaagagaaaaugccaaaguaauuuuuucuuuuuuuuuuuagugcaugcauuucuaguuauagagguaguugcucuauagugaggccuuucuaguuauagagguaguugcucacaugcaaugaugugcacaggaaacagaaauaggaagaggcucuaauccgagagaguacacauuuuuagcugguagauaaaagaacuaagaaaacagguauuuuucaccggugcauugggaacagggaaaauguuuuucuaaaaaaggaaauuaaggcuaggcgcgguggcucacaccuguaaucccagcacuuugagaggccgaggcgggcagaucacgaggucaggagaucgagaccauccuggccaacauggugaaaccccgucucuacuaaaaauagaaaaauuaacugggugugguggugcgugccuguaaucccagcuacucgggaggcugaggcaggagaaucauuugaacccaggaggcggagguugcagugagccaagauggcgccacugcacgccaccgugaugacagagccagacucugucucaaaaaaaaaaaaaaaaaggaaauuaaaaauuuuuauauaaacucuuuuggcauuuucugcaaugauauuaaagaaaaauugaauuucacaaucuguuaagcauuuguuauuaagugguuauaauuugaaaaugugugucagggacucaggaacucucacauguguuauguaguuuaaucugauuccuuggagccucaugaagugggugguuucuucucauuuucaguuuccaaggaacccaggccuggagaggcgguuacuuguccaggugaaguuccuuggccuggcuagugagugggcccaacuggugucugaacccggggcuuugugcagcuguccagagcucaccuuguguucuuuaccucacaaugaaauuacuuggugcaguuuaucuuuuuccauguggugauauggugcagccuguucucaccaguggagugguuacaaugauaaucuucauuuuacgauuugaauuucuuggccaggcuugguggcucacaccuguaaccccagcauuuuggaaggcugaggcaggaggaucacuugagcccaggaguuggagaccagccugggcaacauagugagacccccauuucuacaaaaaauaaaaauaaaaaaugagcuggguaugguggugugcaccuguaguccuggcuacuugggaggcugaggugggaggauugcuucagccagggagguggaggcugcagugagccuaggcaacagagagaggcuucaugucaaaaaaaaaaaaaaaagauuugaguuucuucuccuuuguuggguugcaaaaggaacacuucgaaugugguuucagugcacuuaaaaauagcgaguucagccgggcgugguggcucacaccuguaaucccagcacuuugggaggcugagacacggggagaaacccaucgaccuuguggggcuggacccuacaagguggguaggucaccugaggucaagaguugaagagcagcuuggccaacauggcgaaaccccgucucuacuaaaaaauacaaaaaauagcuggaugugguggcgggugccugcaauccccgcuacuugggaggcugacgugggagaaucacuugaacucgggaggcugagguugcagugagcugagaucgcgccguugcacuucagccugggcagcaacagcgaaacuucaucucaaaaaaaaaaucgaguugcuagacacuauaccuucugcccucacacaugcaggaccuccuguaugacuagcaucccccaccggaguaguacguuugcuacaguugaugaaccuacauggacacaugcuuauuauccaaaguccauaguugacaucagguuucacucuugguguuguagucuauggauuuagacaaauguguaaugaccuuugucaaccauuauaguaucaugcagaauaauuucacugccuuaaaaaucugugcccugccucaccucucucuaccccuggccccuggcagccacgguuuuuuuuuuguuuguuuuuuuaaauagucuccacaguuaaccuuuuccagaaugccauaugguaggaauuauacaauacguagccguuucagacccguuucuuucacuuagugacaugcauuuaaauaucuucuguauuuuuuggugguuucauagcucauuucuuuuuagugcuaaauaauauuacacugucuggauguaccacacuuuaucugcucaccuacaggaaaucuugguuguuuccaaguuuuggcacuuauggauacagcugcuaugggcaucugugugcagguuuuguguggacauaaguuuuuaguuccuuugggugaauaccaaggagcaggauugcuggaucauguacacaguugcuccauauccuccucagcacuuggguguugucaguguucuggauuuuggacauucuaauugguguguagugguaccuuguguguagugguguguuuuuuuuuuuuuuuuuuuuuuuuuugagacggaguuucacucucguugcccaggcuggagugcaauggugcgaucucggcucaccgaaaccuccgccuccugguuucaaaugauucuccugccucagccucccgaguagcugggauuacaggcaugugccaccaugcccggcuaauuuuguauuuuuaguagagacgggguuucuccacguuggccaggcuggucuugaacccugaccucaggugauccaccugccucggccucccaaaaugcugggauuacaggugugagccaccgugcccggacuuuuuuuuuuuuuucugagacggagucuugcccugucgcucaggcuggagcgcaauggugcgaucuuggcucacugcaacugccgccucauccucccgaguagcugcgcuuacaggcgccugccaucaugcccagcuaaauuuuguauuuuuaguagagaugggguuucgaugugugggccaggcuggucucgaacuccugaucucaggugauccacccgccucggucucccaaagugcugggauuauaggcgugagccaccacacccggccccaguuggugaggggucugugaaagucuuugccccaauuuuuucuuuaguuggguuggguucuuuuuuuuuuuuuuuuuuuuaauggaguuucccucuuguugccuagccuggagugcaguggugcuaucuuggcucacugcaaccuccgccuccuggguucaagggauucuccugccucagccucccgaguagcugggauuacaggugcgugccaccacgccaggcuaauuuuuguaguuuuaguagagaugggguuucaccacauuggccaggcuggucucgaacuccugaccucaguugauccacccgccuuggccucccaaagugggauuacaggcaugaaccacugcaccuggccuuuuuuuuuuuuuuuuuuuuggagacauggucucacccugucaccuaggcuggagugcaguggcaugaucuuggcucacugcaaccucagcuccuggguucaagugauucuucuacuucgaccuccugaguagcugggauuacaggugugugcccacacgcccggcuaauuuuuguaguuuuuugguagagaugggguuucaccauguuggccaggcugggguuguuuucuuauuguugaauuuuaaaauaucuuuuuauauuuuggauaaugguucuuugucaaauaagucuuuugcaaauauuuucuuucagucuggaacuguuuuuuauucucuugacagugucuuuugcagagcagauauuuuuaauuuuaaugaaguucaacauaacaauucuuucuuuuauggaucgugccuucaguguuguaucucagaagucaucgccaaacccaaagucaucuauauuuuucucuuguguuaucuaucuaguaggauuuuuauaguuuugccuuuuacuuuaggucugugauccauuuugaguuaguuuucaugaaggggguccauacacuccaugucuuuuuuuugagauggagucuugcuuuguugcccaggcuguagugcaguggugugaucucagcucauugcaaccuuugccucccggguucaagugauucuccugccucagccucccgaguagcugggauuacagauguacgccaccacgccuggcuaauuuuuauaguuuuaguagaggugggguuuaacuauguuggccagacugcucuugaacucuugaccucaaaugauccacccaccucgggcucccaaagugcuaggauuacaggcgugggccaccgcacccggccucaugucuuuuuuucuuguggaugucuaguuuuucagcagcacuuguugaaaagacucucuguucucuauuguauuaccauugcuccuuggucaaagaucagugacugugugguucuauaucugggcucucuguucugccuguuccauugauacaauugucuguucuuuugcccaucccacacugucuuuuuauuuugagacagggucuugcucugucacccagguuggagugcagcagugcaaucauggaucauugcauccuccaccucucgggcugaagcagugcucccaccucugccuucuaaguagcuaggauuguagucacgcagguaauuuuaaaauuuuauguagagauggagucuugcuauguugcccaggcuggucuugaacuccugggcccaagccuuccacaguacagggauuacaguugugagccgcugugccugggcacacacggucuugaugacagcaauuuuauaauaagucuuagaguugaauagugucaguccuccaacuuuguucuucuccuguaauaucaugugggcuauucuggguuguuugccucucuguauaaacuuuauuuauuuauuuuuugagauggagucucacucugucacccaggcuggggcgcaguggugcaaucucagcucauugcgaccucugccucccggauucaagcaaaccuccugcuucggccuccugaguagcugggauuauaggcgccugcuaccacgcucggcuaauuuuuguauuuuuaguagagaugggguuucaccauguuggccaggcuggucucagggugaguucucuugccaucugaagggaggacacggccacuguaucccucugcagugagacagcguguugacagcucuucccucucugugugaauggagagccagagugagcaacaucagaggaaaccuccagugugaaagcagaagccaggaaaagcagagaagacuaagggagcugagauacagagugcagggaccagaaaaaguaauuuaaaaccccccaugaaaagcagcccuguauauguaggcuuagagauaagcgugaagacaggucccgacaugggcauuuggagaagaggagggagcccuugggggugaagcauacacacgucauuggaaggguuggaggagcggaggauagauccuagaacagcggcaacagcagcaagcgugggacacggaguccaggaacagacggagaugcagaccaggguggggugcagagugcgccaugagccaggcuggaaggacguggucucuggaccaaggaagaccuugcuugaggcgccuugagcauuuucuaaaguuggggcgagagaagacccugaaagcugagcaggcauccugggagugggcuucuuacagaaguggaggagagaagagguguggucuucacgugccccccuucucaggaagcugcaagaugagggggaggggugccccgagugggcuagagcacagccccgccagugcugagcacaaggugggacuccaggagcaaaagggcugaagguguccugaugucuuugaccaaagggcuuauuccuaggagguuuauaaaucugcuggggagauuggggcaagaguuuauacuaggcagaaacuuugcacuuguaaaaaggaaggaauuaugaacuuuggagaacagaccccacuguguggccuaacuggaaacacuauagugacgugauaaugucagcgaugacuugacaaaauguucacacggccguauugggaggugugggguggggcuguguuggcaaagagauacaccgugacgugccuucaagccagcagaugaugcucagaggggcgcgcugcggcacaguccaggagcagcagugucugcgggcugugugcauggguguaguaaguacccaaggacagggcugaagggguggaaguggccacuguggaguggcaggggugaggccucugcacguuugggaguagcucaguauugguuuguaagccagcacccugugugugucgccguggugaaauaaaauacagcuuguuuuagggguugagugagguccggccccaacagucacauguugaaguccugaccccccccaguacuucagaaugugcacuuacuuggaaauaggguuguugcagauguaaugaguuaagauggggucacacuggagcaugguggguccugccccaaaaugacugauauccuuauaaaauggggagacuugcacacaggcacacgcagggagaaugcggugggaagacuggagugaugccagagccgggagggaggccugaucagucccuccccagagccuucagaggggcauggcccugcuggcgucuugguccuggacucccagccuccaaggacggcuggccagugcguuucuguccuaagccaccacuuugugauucuugguuauaggaagcuaauucauggcucuacaaaugcuguaucugacugcauguggaucgaauuaaauuaaaacacagaaaaaucgaaccugcuuuggugccuuuuuggaggauggaguccuggagaaugagaguggccagagccgccagccgagggcauuuugccgcugucccgugaggcggccaucugagcugaggcacugccuguggugggggcucgucccugcugcccccguggagcuccagcucuggguuugacccuccuaggggucugcagggcacugguguggccagauccuggggagcgaggggagaagaugggggaguuggaggaccagggugaggauuuuggccucuguccuaagggcugaggaggcuguuucugggggccagagcauugugaucugcuuuccgcugaggucgggccaaggguugcccaguguaugggaaugaguguaggcugcugcgguccuccagaccuugaggaucaggcuugagcugggugcagagguggaacgagaggcagggaaaccuccugggguugucggcuaagucaccagugcaguuacaaggaagggauuuacggugcaguuacaaggagccuuugggagcgaggacggcgacuuaaugccagaaaaguggaagugaguucguuguagccguccucugaagugagcccacuuaguguggggagaaggcaucaccugggcucagggcagugcucgugggcuugggagggaccacuuccuguuuggaggggccggcgccgagagguccuggaguaggggcaagggaugccugaugccggcugugcuucccggagcucaggugguauguccucuuuguucuugcugggucccacuccucaccuguugguggcagggacagugaguucuggcagcgggagccagguuucucucacuucccacgucucuucuacaucuaccuggaacccagaggucucuucccacuuguccuggccuuugucuccuuuuccgggacccucuuguuuagcuuucaguccuggcuucaaugucacugccuuagaggggccucucugaucgccccucgaaaaggcuguccugccauggugggguccuacggcauccuucucacugccaccauccgucacuguuucuguaucucugggcuuucccagcuccggcaggggcuuccucugguccugaacugcuccuuccccagacuucccucacgcagacuggagacuggccucagaacugccaagggggagggacuugcuguccaucaugccucgugacuggugcugcauccucauggcucaguuucuuguaaggggagacgggccugacauuguguguguggaaucgcaucccccaggagguuauguucaagucugcaccccuaauacuugcaaaugugacuuuauuuagaaauagggucuuugcagaugcuauuguaauuuuuuuuuuuuuuugagacagagucucacucuguugcccaagcuggagugcaguggcaugaucucggcucacugcaaccuccgccuccuggguucaagcaauucuccugccucagccucccaaguagcugggaccacaggcacgugccaccacacccagcuaauuuuuuauauuuuuaguagagacaggauuucaccguguuagccaggauggccucgauuuccugaccuugugauuugccugccucggccuccuaaagugcugggauuacaggcgugagccaccgcgcccggccagaugcuuuugcaauuaauguacauuaagaugaagucauaugauuagagucggcucuaacccaaucauugguguccuuauaagaagagauagcgauacagagacucuguggcgcuggggagaaggccgcauggugacagaggcagagauugcagugguacagcuauaagccaggaacugccgaggacucccagagccccuggaaacuggagagaguccuggaacagguucccccucagccuccagaaggaggcaccuguugauaccucaguuuuggacuuccggccuccagaacugugagaguaaacuuuuguuguuugaagcccacucaguuaugggagauuguuauaacggcccugcuggcaucuuggaagccaacacacgugucggugaugaccugacuaacgccuuccuuccugcaggaaaugcauguuccacacgagggucucuucccugcccagcacucacaauccccgucgucuccugggcucccagcagggagcugcuuuuggcaguaggcguggucccucccgcgcugcaugcgccucccgcgugccagagcugcugccuugacacugcugggugcuccgcauuggcgcugcuggacacuugcccuggcuggugcuuggcgggcacacuuuaucugauuuuuuuuugaaacggagucucgcucggucaccacacuggagugcaguggugugauuucggcucacugcaaccucugccccacccgguucaagugauucuccugccucagccuccugaguagcugggacuacaggugugcgccaucacacccagcuaauuuuuauauuuuuaauagagaugggguuucaccauguuggcccagguuggucucgaucuccugaccuccugaucuacccuccucggccucccaaggugcugggauuacaggcaugagccaccgcgcccagccugucugauguuuuaaagucugugaguuaugagcgugugacucuugcacacacgucaucguuucucugucgagggcgugcagacccuccaggcguucacaucacacgugaccacaggcaguagucacagccaggaguguggcaucaguguggcauggugcuggcaucugacggugcugaggcagauuugggacauguccucccugccguuuuucugacccagggucacgugcugcauugggacccccuccagucugggcagggccucgucgagcucuuucuugacuccaugcuucugaagaucucuggcuggucauuuuguagaguuggccuguuuugagauugucugacauuucuucagaauuaaauaaucagguuccaggccaggcgugguggugauacauaccuguaaucccagcacugugggaggcugagguggguggaucaccugaggucaggaguuugagaccagccuggccaacauggcgaaaugcugucuuuacuacaaauacaaaaauuagcugggugugguagugugugccuguaaucccggcuacuuggcagucugaggcaggagaaucgcuugaacccgggaggcggagguugcagugagccgagaucacaccacugcacuccagccugggcgauggagaaagacucugccucaaaaaaaaaaaaaaaaaaaaaaaaaaaaggaaauucagguuccuguguuuguguccugggcaccucacaggaggcucucgggguguucacauugaucgcuggguucaggugccuuccgggcaaaccugcuguuacuguuuuuccuugguggcugccgagcaucuuuuggggaucacucugaggcugugagcucuguuucucgccauacguucucugcggguccagcaucauggaugcaucuugccugagacuguuguguugggacauuggucaaguggugauuuuaaagcauuucccucauucucucugcacucacuaguggcuccccaccaccccgugaggaggcgcuucccgccacccccaccucaccuggguccauggguuccuggguuccugauuccuggguucguggguucguggguuccuggguuccuggguccaugggucuauggguuccuggguuuguggguccauggguucauggguuccugggucuguggguggcugguuccuggguuugugggucugugggucccuggguccgugcguuccuggguucauggguuccuggaucuguggguuccugguuccuggguccguggguccguggguucuuggguuccugggucuguggguaccugggucuuugggucccuaggucccuggguuccuggaucuguggguuccuggguucguggguucguggguucugggucuguggguccauggguuccuggguucugagguucauggguuccugggugccuguguucacugcugcucgcuuugcucugugucacaggcaggcugcuggggagccauccucacuuccuguaccucaacaggcuccagcucuuuucccugccccagcccugaaaucagccguuucuauacagacugugaggccuguuuuuaaaauaaaauccuaguuauuauuuuuucaaguuauaguguggcugcuguugccuuucuaggguugugugugugcuuugugcaaucaggaggguuuggaaggugggugugcagccccucguggugcacggugugaagggagcuggccccucaccuugcaggagugguuggugggauuagggagggaggcuggcuugucagccauagagccccauccugugagggcucugaggcugggagagaggugaguccgggccguggcugugagcugguggcucugacgcugggacagaggugagucccggcuguggcuguggcugugagcugguggcucugacgcugggacagaggugaguccgggccguggcuguggcugugagcugggggcucugacgcugggacagaggugagucccggcuguggcuguggcugugagcugguggcucugacgcugggacagaggugaguccgggccguggcugugagcugguggcucugacgcugggacagaggugaguccgggccguggcugugagcugggggcucugacgcugggacagaggugaguccgggccguggcuguggcugugagcugguggcucugacgcugggacagaggugaguccgggcuguggcuguggcugugagcugggggcucugacggugggacagaggugaguccgggcuguggcugugagcugguggcucugacgcugggacagaggugaguccgggccauggcuguggcugugagcugguggcucugacgcugggacagaggugaguccgggccguggcuguggcugugagcugguggcucugacgcugggacagaggugaguccgggccguggcugugagcuguuggcucugacgcugggacagaggugaguccgggccguggcuguggcugugagcugggggcucugacgcugggacagaggugagucccggcuguggcugugagcugggggcucugacgcugggacagaggugagucugggcuguggcugugagcuggcaccccaguuacuggugguuuuuccccagcugacaucgaccagcguggggugugcaguguggcuggcucugauuugugcuccuuaguuugagacaauuugaauggagccacugcuguggagaggccuccuucugaagcaucacaagugggcccggcugacccuagcccagugcacgacaccccucuuggagucugggguucuuggcugugggcuggagaugacagugguggcugccgaggguggugggaguggucagugcugagcacgcgauuucagauccagugagccaggcgggcacagccuuuagcugaugugguguguccccuggccuggaacagccccauggguggguggcacccgucaggaccugugcacagacccugccuggguuuggucugcccaguccccuggaccuggcagcagcggggcugugccuggugacgggaaggcucugagccaggcuggguggcccacugugcgcgucgcugcuguguuggugguggcgccuuugcccuggcccucauucaggaagaugcuggcuuuugggcucuagggaagugcauguugguuucugucgagagcgguuguguguguacauuuuaagcguggaacgcagguaucgaaccguguugaaaccuuuccagcauuggcagaagugugcgugugagucuccuuugcccuuuuacuuuacuggcagguguagugaacuuggaugccgccugccuuccuagcauggcccacguggccgggcgguccuucugauggggcggcucacguggcucccacgugccaggcuuuuggggcagaugcuccugagcggugcugccuacggguugccuucauuggugguggugaggccugggcuuuggcguccuguccgcccuuaauccuugccuaggagcagucugugggccccagaagacuggccggaaacugaagccgggcggcagcugaggacgcacacccuggagguuguguggacguuccgucacugcugucuuaauucccaggcacucuucuuuuucucuggaaguuccuuuuugaggguguccugguguucauggaggugccguaucacuccgagggcagagggcugcugcugaggaaggccuugcccucucaccuagcacucuucuccaaguugcugguuuugcuuguuugcaccuugucuguuuuggccucuguugggucugaacuagguguccuuggcagcugcucacacccaacagugggacccugagaagggucaaagccggggcaguuuggggacacgcugggugcagggccaccuugcugggcaccucggcugguuggugucuguugggagcagcccuggggccgccccgcagccucugccugcaguacagacggaucugcccacuccugaggcuggagagcucagagccugaaagacccccugagcccucgcccuuccuccgccggccccuugcugucagcacgccaggugcagacccuggcaggcuuccugugccccagcuucaguguggagcgcuugccuagcuggcuggcaugggagcgggagggguguuuggccacuuggagcagaaggggguggguagucagaguuucuguguuccuggcuugauauuggcuuuccagcagcuucccagcuuccagaauguccuugccaucaucucccauccuguuuccucuuuuuuggagcagaggccugggguggccuaucuucuucuuucaguugaggcuuccggggcgggugggucuaaugugugucuuugccuuuagccagaagaccaccgugauuagauuuuccagaagagaacucgcgugguaguuuugaaaaugggaggguguuugugaggugggauaucagaaauacuuuauacagaggggacccaacauguagcagaaacaucaacaaaaugguuuugcguauaaucacaugaugauuucucucuucugagaaacaggcacaaauccugaagagcccgugggcguggacugcucaucuguaaagaaaguggagacaugaccuugagauuuggcugacccagcaaugcuggggccuucgcaagucugauguuccaggacuccagugccuguugguguggacggaggacacggggccccgaccauggucacacucaucacugagaagcugcagagccagagccuggacgaccucaccugcaaggcggaggcuggcccgguaagcagcugcagguggcaccaggcugggugccccucccccgugcugucacaggggaauggccacacugggagguggaggugagggcuaaguucucaggggccuggggggcccugcugggccagggaugggggugucuggugcacaugugggccccagagcccaucaguguaaucacagcggauuuucaccaucauugaaaaaaaaauagacuuauuaaaaaugccagcugggcgugguggcucaugccuguaaucccagcacuuugggaggccaaggcggucagaucacuugaggucaggaguucguaaccagccuggccaacauguugaaaccccgucucuacuaaaaauacaaaaauuagccgggcacgguagcaggcgccuguagucccagcugcucgggaggcugaggcaggagaauggcaugcacccgggaggcggagcuugcagugagccgagaucgcuccacugcacuccagccugggacagagcgagacuccgucucaaaaaaaaaaagagccuugacuugcuauuuaaaaaaauagaguuuuacugaaaggcugacuuacacacagaagcuggagccccaagcgcaggugugccuguuaccauccaaucaagcagcagacugcaccccgccaggcucccugucccuccccuccuagccgcgccucccaagggagccucugucuuggauuugaucaccacguuagcuuccugcgggcagcuugauuuuccuacagucauggugaagugaacuuuggaugugccaccuucaggacccccccgcccuaguuagauggcagauccagaaggagguggcugaugucuagccuggagggucuugccaggcccucagagccagcaggggugcuuggagcgccugccuauccugggccuggcuuggcuguggcucuggagacgugggcacguugcauuuguagccccuugcguguuacggaaaugagagggugaagggaaagcugugggucucgggccuuuggacugggcacgugugacccaucuucaccgcaggggguuccagugagggucugaggguccaagcugaagccucuccucccgagagcuggcgaguguggguguugggcugugggagguggcauguggccugaaccuucgcaagcacugcuuguggggccuggcacucagggccgcugugacugaggugaccguggcagcgcuggcuguguccuguaauuaguacguuuccggcugucaguccacggguggagguggccgaggcggggaaggcagugcuugccugaugucucagugccuugcuggcugcagagccauguucuuuccagaugcuguggccgguucucauuuuuucuuuuuuuuucuggagacagagucuugcuuugucauccaugcuggaguguaguggcaccaucucagcucacugcaaccuccgucucccggguucaagugauucucgugccucagccucccgaguagcuaacguuacaggcacacgccaccacacccggcuaaauuuuguauuuuuuuuuuuuuugagauggagucuugcucugucgcccaggcuggagugcaauggcacaaucucggcucacugcaaccuccaccucccagguucaagcaauucucccgccucagccuccugaguagcuaggauuacaggugcacgccaccaggccuggcuaauuuuuguauuuuuaguagagacaggguuucaccauguuggucaggcuggucucaagcuccugaccucaugaucugccugccucggccucccaaaguccugggauuacaggcgugagccaccacacccagccuaaauuuuguauuuuuaguagagacgggguuucaccauguuggccauguuggcgaggcuggucagugauccgcccaccucagccuugcagaguguugggauuacaggcgugagccacugcgccuggccccauuuuuccuuuugauuaaauggagaaaacauuuuuaaggugucucuaaccaagaccaaaggauacagagcggcacaugccuaucagauggcugugugccucugaggacauuuuuggcaaguggacgucagccagggcgugcgcagcuuuccagggagguggcuacgcagcaugccugccgggccugggaggugucuggacggauguccugguguggggugacccacgggcccccacgaccucugugcuuuagguggccacucuucaccucuuuuuuuuucagcuuuuauuuuagauacagggggguacaggugcagguuuuauuuuagauacagggggugcaggugcagguuuuauuuuagauacagggggugcaggugcagguuuuauuuuagauacagggggugcaggugcagguuuuauuuuagauacagggggugcagguuuuauuuuagauacagggugugcaggugcaggcuuuauuuuagauacagggggugcaggugcagguuuuauuuuagauacagggugugcaggugcagguuuuauuuuagauacagggggugcaggugcagguuuuauuuuagauacaggggugcaggugcagguuuuauuuuagauacagggggugcaggugcagguuuuauuuuagauacagggggugcaggugcagauuuuauuuuagauacagggggugcaggugcagguuuuauuuuagauacagggggugcaggugcagguuuuauuuuagauaugggggugcaggugcagguuuuauuuuagauacagggggugcaggugcagguuugucacuuggcuauauugcacucggguugugagcacaguacccaguagguagcucuucagccccugccuccucccucccucccauucuucaucucuuuguggagcacuuguccauugacagagaaggcagcauaggcaguuccuugguaggccucggccuugggacaggagcccugggagcccuacagggugaguggucacggggguuccaucacagccugcuccugcuccugcugacccugccggcucuguuaguggccagccagggccacuguugagucuguugcugucgaagaugguuuuucccaaugacuccuguuuucuuaaaacacggccugugaauauggcggugguuucuaucugaaaaaggaggacaaaccuuuuuaucccuaaauguaagucuuuuuacuuuuuuuuuuuuuuugagauggagucuugcccuguugccgaggcuggagugcaguggagugaucgcacgucauugcaacuccgcuuccagggcucaagcgauucucucgccucagccucccgaguagcugggacuacaggggugugccaccaugcccaaccuauuuuuuaauuuuuuuuuuuaaagugauggagucuugcucugucacccaggcuggagugcaguggugcagucucggcucacugcaaccucugccucccgcauucaagcaauucucuugccucagucuccugaguaggugggacuacaggcaugcgccaccacgcccggcuaauuuuuuuuguauuuuuaauagagaugggguuucaccauguuggccaggcuggucuugaacuccugaccucaagugauccacccaccucagccucccaaagugcugggauuacaggcaugagccaccaugcccagccuuuaucaggauuuuuuaaaaaauuauuuuucauuuauuuauuuauuuuaucuuuuagacaagagucucacucuguugcccaggcuggaaugcaguggugcgauccuggcucacuguaacccccgccuccuggguucaagcgauuccccugccucagccuccucaguaguugggauuacaggcacaugccaccaagcccagcuaauuuuuguauuuuuaguagagacaggguuucaccauguuggucaggcuggucuugaacuccuaaccucaggugauccacccgcuucaggcucccaaagugcugggauuacaggccugagccaccgugccuggccaggauuuuuaaucuguguaauucggacagugugauugccuguguugaggaaacccaguuacucagugauagauuguuuacacgugagaccagcucucccaugucaacugaauaucuaaacacaaguuacuucuaacauucaaggaaacaagucaguauuuuaaauagccaauucauuguauaaaaauagaaacugauguuuucaaaggugacuuaaaauaguauuuuuaugaaaaauaaguguagacaguucuagagaguagcaacucguacauucauguaugagguucuguguggaaguaugucuucauacauacccauggcccggccucagugagcaagcgaggcgggcgcuguuagcucagggcuccuuguuugaucugcgccuuuacccagucccuuccugccaugauuucauagcgcauucuagacauacuuucucuguaaauaucucacucuguaucuccaaaagauaaagacuuuaagacacaugaccagaaugucauuuucacaccuaaaacucucagagauuccuuaauaucucuauccggucagcauucaaacuucuccaauugucugaguuuaagaauuuguucagggaguccagauucagggugucucaugucccuuuuccccauagggugcuccuuggagcuuguguguugaggacccagcugcuugucccggaguguccaggcugcaugccccggcugccgccucgugcgcuccccucccauguguguucugggaguugcugguuggagugagcacugcccugccccuuaugguuuccucuaguugcacauagauuuuuaaacugaaauuaaaguugauuuagcuuuuuuuuuuuuuuuuuaaagacagggucucacuaauuugugaauguuuuugguagagacggggucuugcuguguugcccaggcuagucucuaacuccuggccucaagugacccuccuuaugcggccucccaaagugcugagauugcaggugugagccacugcgcccagccuacaguuaaaguggaacccacauaaugcuguuucucacuuguaccagaaacacuucuagugcucacugucucuggguggcugguggcugccgugguggacagccuguuggcugucccucaccacagaauguucucgcaggcagugcugugaggcucgaagcucgaucagguucguguuugagagaccaccauuugcucauccguuccucuguuuuuggaccuuugggugguugccauauuuuagcuauuagggauaaugcagcugugaacauucaugugugaguuucuguguggaaguuucauguaugaguuucuguguggaaguaggucuucauuucuuuugggugcaaaccuagucgugggauugccaggucauauggugauucuauguuuaacauuuugaggaacugccaaacuguuuuccacagugucuguaccauguuccguucugcagcaauguaugagaguucuaauuucuccaacucuuuuuuucuugaggcagagucuggcucuuucgcccaggcuggagugcaguggcgcgaucucggcucacucugccucccagguucacgccauucucacgccucagccucccaaguagcugggacuacaggcgcaugccaccacucccagcuaauuuuuuguauuuuuuuuuuaguagagccgggguuucaccguguuggcaaggauggucucaaucuccugaccucgugauccgccugccucggccccccagaguggugggauuacaggcaugagccacugugccuggcccuaauuucuccaacucucaucaacgcguguuauuguccauuuuuuugauaaaagccaccugcauggguguggagugguaucucauugugguucugauuuucauuucccuaugguuagcuauguugagcauauuuucaugugcucauuggccauuuguaucucuucuuuugagaaauaucuaaugaaaucccauuuuuacuuuaaaauuggguuauuucucuuuuuauuuuugaguuguaagaacccuuuuuuuuuuuuuuuuugagacagggccuugcuuuguugcccaggcuggagugcagggucucaaucacugcucacugcagccucgaccuccugggcucaagugauccuccucccucagccuucugaguagcuaggacuacagacaugugugaccacacccagcuuuuuuuuuuuuuuuuuuuuuuuugugauggaaucuugcccuuguugcuaaggcuggagugcaguggugcgaucuuggcucacugcaaccuccaccuccuggguucgagagagucuucugccucagccuccugaguagcugggauuacaggcauccaccaucacgcccggcuaauuuuuauauuuuuaguagagauggaauuucaccauguuggccaggcuggucuugaacuccugacuuugugauccgccugccuuggccucccaaaaugcugggauuacagguuacagccaccacgcccaccccacacccagcuauuuuuuaaaaauuuauaucuuuuagaaagggggucucacuguguuucccaggcugguuuccaccucuugugcucaauggguccucccgccucagccucccaaaaugcagggauuacaggugugagccaugacaccuggccaguaagaguucuuuaugguuucuucccccguucugucauucugucaucucgagagugguguguaaauggagugacacagugcacaagcauuuggguucugccuuuccaucagcaugcuucccuggagauccguccggcgguuccucugcgccaccaagaggugcuccguggcauggaggugcacucuguguaaccauguggaggaaugcugcguccuaaugcaaaucaugacgugauuuuuaggguuguguccucaugggggaccuacacagacgaccaguaaccacaggcaugaggcggugggaggggagugggcacgggugccucgcugagcugccggagcagcaaagaggguuggagguguaaugguggcugagugcuggaagaugggcggggucuuaauguuggggugggcaaaggccauuggggccacagggagggggacguggauggguggguggggccagcaucucacugugcucuggcuggggcuuccccagagagcccgggacagcagccaggaggcgguagggccugaaggucacgugugaaggucauucagcgcguuggggcgucugugcugcacuggcugugcuggguuagcaauauggugcucacuuccugcagggaggcgggugggaagcaggugacugaggagucgcgauagugcaucaggaaaaaaguagagcccaaggggugcugggaguuuacauagggcgccgggcugugaccuccggguggagcuggaaggugggugaugagccauauggacaucuggggagucagccagguggagguucccauggccgugggagccugugagggugggagccugggggcacaggcaucugggaucugacucucaggaguccagagggcagaguagagggccgcggcagccaggaccagagcagcaguucccgggcugaggggcggagagcagggagagcugagaaugucaggguaggggagagaggaggcggugugauggggcugugcugggggcuguaggcgcagggaagcucacugugccgcuggccuggcgggcacgguauggguggguggcgggcugugguguccuccagcccugugcagcugugcagauacaggcugggauugauugguagagagcugguuuuuaaaaaacuuuuaguuuuuuuuuuuuugagauggagucuggcucugucacccaggcuggagugcagaggcgugaucuccgcucacugcaagcucugccucacgccauucuccugccucggccuccugaguagcugggacuacaggcacucgccaccacgccuggcuaauuuuuuuguauuuuuaguagagaugggguuucaccguguuagccaggauggucucgaucuccugaucuugucaccugccugugucggccucccaaagagcugggauuacaggcgugagccaccgugcccagccuaaaaacuuuuagguuuuuaaagacagggucuugcuguguugcccaggcuggagcgcagugcacucagucguucgcugcagccuuggccucccuagcccaagcaauccucccaccucagccucuugaguagcuggaaugacaggcucaugccaucauaucugcuuuuuuuuuuguagagaccagguuucccuguguugcccaggcuguucucaaacuccugggcucaagugaucuucccaccucagcccccacagugcugggauuucccggauuucccuguguccggcccugaaguacagauuucguuuuuuucuucuuuuucugcacggagucuugcucuuguugcccaggcuggagugcaguggugugaucucggcucacugcagccucugccucccggguucacgcgauuccccugccucagccucccaaguagcugggauuacaggcacccaccaccacacccagcuaauuuuuguauuuuuaguaaagacaggguuucaccauguuggccacgcuggucucaaacuccugagcucaagcgauccucccgccgugcugggauucaggugugugcccccgugcccagcccugaaguccagauuuccuuaggcuuaaggguugcauguucacauuccccgaaacccauauguugaaguccucacccucaaggugacgggaugaauauuuggagguggggccucugggaggugcuuaggucauggcggcagugcccucaugaauggaauuaagugcgcauaugugagaggcaucagagaggaagccagccccuucgaccaugcauagauacaaccggaagagccgucugugaaccaggagguggccuuaccagacacugaaucugccugucccuugaucuuggacuucugccuccaggacugugaggaauaaguguuuuugacaagcccccugccugagccugugggaccuggcugcccagccuuuccugucucccggggacccuggcucuguuugucugcugcacccacaucccacacggccagugccacugggaguagcugcugcccccggcgugucuuugcauagagguggucacauuugggaccgugcgggccuguggcuccuucaagcugcccgugagagccaucugugccggcugggaaaguccuuuccuugcuagacguuuuuccguggcagcgucgagcugggugcuguucauguggccccggggaacgggugcugugcggaacaggaggagagcgagguccuggugcuugcugcggggaggcccggggcugggaggaucgacagcaacaagggucccuguggcgugaaagccuucaaguccuuuagcagagcugccucuccucucuuccaucggacccgggucccggggugggagaaccuggaggucgugugguucccgggcccgcaccaggcccuguccucaugguguggccgggugcucacagcuccacaccgccgugcuggcugaggugggaccccguguguaggcggccugucuuuuuucggggucacaaacccaacuuuuaacuuauucccuuuacaggaagcagugaaggauuuccuuuuaauuuuaucguguuuggaaauguuaucauaggacgugaugccaugggcuuaggcguuaacugagagguucugagguguggcagaggagccccacaacucuaaggcaaaaaagcagaggggcugcugugcccggacccugcgggacagccguguccuugucacaggguggccuucuguguucucacagacgaggaagcucugggagguuagggagcuugccgggcacccggcaggaccccccuccugugccccauccucugcagggcccugugucccgccugcacgggccagugcguggaagcagacacauuaauggccuccaagccgugaccugccaagcagcucccugacacuucaugggguagggaagagagcccuguggcauuucccuuagugcccucccuauagacccuccagcugccaccacgcccuguggcuuuccugcuuccagggagggagacccugcccucuggacgucucccuggaccagcaccacacuccagagccuggcuuaggcgcucaggucccgugucugagcuguugcaggugggaaagggccccuugggucuuggcugaaguucuugcugaaaaguaaguaaguggugagguuugcaaagacggcugcagcugaggcugccgaaaggcaggagggccugagcuucaggagcagggacaggaugcaugccuguggcuuggaauaaaaaugucugaggccgggcgugguggcucacaccuguaauuccagcacuuugugaggcugaggcgggaagaucacgaggugaagagaucgagaccauccuggcugacacggugaaacccugucucuacgaaaaauauauuuaaaaaaacaaaauuagcugggcgugguggcagcuuucuguagucccagcuacucgggaggcugagacaggagaauggcgugaacccgggaggcagagcuuguaguaagcagagauagcaccacugcacuccagucugagcaacagagcgagacucugucucaaaaacagacaaaaaaaaagucugcuuaguguuaacagcucuuuuaaaaacagaaaaaauuuuuuaaaaaauuuaaaaauguccguuuacagccgggcgugguggcucaugccuguaauuccagcacuuuaggaggcugaggcgggcggaucacgaggucaggagauggagaccguccuggcuaacacggugaaacccugucucuacuaaaaauacaaaaaaaauuaaccgggcgugguggugggcgccuguagucccagcuacuugggaggcugaggcaggagaauggcgugaacccgagaggcggagcuugcagugagccgagaucgcgccacugcacuccagccugggugacugugcgagacuccaucuaaaaaaauaaaaaauuguccauuuacucaguugaauuuuguuagguuuuaauaaaacugugcuuauuuuaaucacuagaaagaaaacacuggggaaagguagaacgugcugcagugaugaaaaugggggauauuauugccgaauucucacgugucagucacaguauugaaacuucucuuuccugucaguugcaguauucugcggaaacccugaacaagagcggucgucuguucccuuuggagcucaacggugagcacuuuaggagcuguggccggaggccugagcagggcugggacugggcuccugggcugggaggguccuggacgcagaacaugagccggaucugcagaagcccaggaagguguucgugugcccugcacuggggcgugggguggucccugcugccguccuccaacggcugggcccguggucaagaguggucugugagcaggacggcucguguagggugcgggcccagccaggucucucccuccucagcugguggggcccaggggucugcugcgcccuuucuggaaggugcaaggcccacccuguggccacgaaaagaagaggacggcguggcuggcagggcuuguagcgucagcuggagcgugccauggcauacugggcggcccacccacuguccgugcaguggaggguguggcugugccugguucacccgcaggugggcccuucauugauggagagcaggugccccgaguauggaggcuggcugguguucacgggccagguaacccuggggucccagguccucccccagcgaaggucccaggggcaucucccucuguuggcccugcuuaccugacugugacacgcccagcgcccugugucacgcagagugggcccguuaggaggcucaccuugcugagcgccagaugaccaaagugaagguguuuuaccagauucuuucaugaguagauggaaguagcaugugugaggccccagcuggccagagccccacccccugccgggccuguggugcgauguccucaccucagccuccugggguucauccugcacacggggucagaccagccaccuccauccuggcucagagccccgcagcgcuuccuacacuccucacccagccggccgcucucccugccuacaccuccacgucuccuccccacagcccccaucucucucccagucaccccaaggucaucccagggccuuuccccagaggcaggucucacagccuccacuccaaguuccucagcuggacagugacugcacaagccacugggcagacuccaugccaggcccaugcaccuggccuugcucuccaggcuucuccgaaccagcaggcagugggcuggggagcgcguuagacaggcaaccccaggacaguugugcaggaagugagacuugggaaggggcuccaggccuggaccugguggcucugagguuugugaggaguuucuggggcucagacucucccugaagaccguggcagcaggugugacccuguguugcccauguuacuaagggaccugagcugcuuuaagaaggggcccuggagaguccuggccgggguagccgcacauccuugagaugccuggucacagagggagaggggcauuuugaggaugcgggaagaauguuuuagcaaagcugucgggagagcagagccgugcgguuguucucagggaggcaccgguggggaggcugacaccuccuucagacacgguguccccuuuaagaagugagccgagccccgcagcuaacccagcaagggcaggcggggcugguguccacugugcgccacggacaucuuggagaagcacgcccagggguggcggcgaugggguugugcccuugacagcucugccaggcuguuugccgggauggaugucgccugcccuguggcucaccugucucuuccccugccucuuugugucuuuuuuuguagaccagagucccuggaaggucuucaguggaggaccgcccgucagaagccaggcagccacgggcccugauuucuccuuccugccgggccugucugcugccgcucacaccaugggucuucaguggcagccacaguccccgcgcccaggcgcaggccugggugcagccagcaccguggaccccagugaaagcacaggcucguccacggccccaccgaccaagcggcauugccgguccuugucagaacccgaggagcuugugcgcugccggucccccuggcgccccggcagcuccaaggucuggacuccagucuccaagaggcggugcgacagcggcgggagugccacgcggcagggaagccccggcgccguccugccgaggagugcuguguggucgaccggucccaccucgcccgccacgccccggccguccuccgccagcggcggcuucguggacagcagcgagggcagugcgggcucaggcccgcucugguguuccgcggaguccugcuugcccuccacgaggcgccgcccgucccucucacaggagcgacucgcgggugcgggcacuccccugcccugggccagcagcagccccacguccacgccugcgcugggcgggcgccgugggcugcuccggugccgcucacagccuugcgugcucagugggaagaggagccggcgcaaacggaggcgugaggaggacgccagguggacacgcccauccuuggacuuccugaaaaugacccaggugaggcuuucuuauuuccaggggcucagaggggcguagaucuggacagggcggugcuggggugaggcuggcugauucucuggauguggcuguuagcauccggcuggucuucucugggcugggaggaaaggagugaggagagccaucuggagugcgugggagcgaucgggggccuguccuggugucagagcacccagcucaccccgccugcucccgcagaggcagagccccacacacggcccaggguggccggccaggcuugcagugaggccugggggaggcagcagaacggagcuguggguuucuggccuggcugagccgccccccgccucagcugcuggggaguccccugacuuuuucuggugauggcucaggaaguaacaagcuguccugggagccccauucgaggcagagcccgggguccucucuugugggagcuggugggugugcauguugcagcucagagcccagcagcgccugugcgcuuugggacuguacaggcaccuccugcagaaacugucuggauguaggagagagccuucacccacuugaagauucucagugccacccaccucuccacacccccgucacaggccgugguuggcacagaguuaaggaaggaaacaggacugaggaggcuuucccaggucuugcucuguguuacuaagggagugcauucaccagagaccucugggggcccggcagcgcucggggagggagauggcagagccgugacagaguagggugggcugugugcacacucacugggucaucugugucggggaagcuuugggcaguggcagaaauuaacaggacuucccgaugccaacugaguaccagccagggccgaguggggcuguggcuaggguggggcgggaucagugucagccugucuccucaaugaccuguggccuuggcagcccccugaacucucauccccagccccauccuccgggccacaggcuugcccaugcccugccucugggggcuguagauguggguggagcuguccauaguguggcugcacugucuugcucgggugggcugggccugggcauccuguggggacagugacuggagaaggggcacagauggcccagguccuccucgaccuggccacagcccagagcuggagagcaguguggccggcgugccaggugggaucccccaggguccuccaggacgcuaguccuaggccacgcugagggcaccgugagcuuugccucuucugaucagugggcucuccaguugauucuuccggggggcuugaggugaguugaaaacccagacuucccugcuaugaaacuuuucugcagagagcaggguuuagagaaggcucugaucuuuugcuaugagaugggcugaccuggggaagccaguaaaugcuggaaagcugguggcaagcuuuggacauagcacaagcaggcugucccugcuugccagggcuuggggugugcauggcgugggugucaggccccacggggaccaggagggaugggagcagaggagggagcugccggcucagcacguuguggggcggggaaugauggugccagcgacguauugaugaccagacaacaguccuaauguagagcggcccuggguuucucagaugccuugggagacagaccaggugguugggugaguuggugaucgaggcugcauggggcucaguguggacaugggguacccccgguagagugugagguguggguagaggcaaggacucgccagacccaggaccagggcucauggacacccgggugugugguguguuggggagaugggugggagaagggcagggcugccgucaaaugcugugugguguguguguggcacacgugcuaugugcugugugguguguguagugugugcucugugugguguauguggugugugauguguaugugacgucuaugggugguguguggucuauguguuguguguguguaguguguguggugugugaugugugugugggauguguguuguguguaugugguguaguguaugcguggucugugugguaugugugugguggggguguguguggugagugcugucugguguguaguguguggugucugugguaugugugguguuugguguguggugugugugcugugugguguguagcguguggugugugguggguaguauguggugugugugugacgugugugguguguuuggugugugcugugugguguguagucuguguguggugugugugugcaguguguggucucugguagugugugugguguguguucugugugugguguguggucugugguauguguggugugguguauaugugguguauuggauaugucuggugggugugucugguguguguguguguggugagugauguguggugugugugauguguggccuguguguggugugugugugguaaugugugguguggccuguguguaugguagaguauaugguguguggaaugugugguguguuugugacgugugugguaugugugaugugugucgugugugugggguggguggugugugugugaugugugguguguauguggcgugugugugucugguguguguggugugcaugugauguguguuguguguguugugcgugugacgugugguguguguauagcguguguguauggugugugugacgugugugguguuuguguguguguggcaugugugugucugguguaugcggugucuggcgugugguguguguggugugugugcgacuagugugugugguguguguggcaugugugguguguguggcguguaugguguguguggcguguggggugugugugugacguguggugugugugguguaugagguguguguggcgugugugugucugguguguaugguaugugugaugugugugugacugguguaugugguguguguguggcgugugugguguguguguggcguguguggugugugugugacguguguggugugugugugaggugugcguguggugugugcgugcauggugugugugugugucugaugcauaggugggugccugguuucucucugggaggagaaacccccgcugugugggaacuggagccgugaccccuaggacuggggcugcgcggggcauccaucccucagauccaugcagccccggcuuugggucccuugcugagccugcgugucccuguccccggcuuugggucccuugcugagccugugugucccuguccccagcuuugggucccuugcugagccugcgugucccuguccaugcaagcgcuggucacccaggcuggugucccguccucuggauguuucugugauucaguccuccuuccucuugaccccgguuauucugccucaggccuugauacccucuucggcuacugagacaucauccuaguuggcuuuguugccucuaaucuccaucuuuuuuuuuuuuuuuaagacagaauuucgcucuuuuugcccaggcuggaaugcaguggcacgaucuccggucacugcaaccuccacuucccggacucaagcaauucuccugccucagccucccgaguagcugggguugcaggcaugcaccaccacgcuuggcuaauauuuguauuuuuaauagagauaggauuuuaccauguuguccaggcuggucuugaacuucugaccucaggugauccgccugccucggccucccaaauugcugggauuacagaugugagccaccgugcccggcccucucuuaauuuuuuuuuuuuuuuuucgagauggagucucgcucugucccaggcuggugagcaauggaacaauggugugaucuuggcucacugcaaccucugccuccuggguccaagggauucuccugccucagcuucccgaguagcugggauuauaggugcccaccaucacgcccagcuaauuuuuguauuuuuaguacagacgggguuucaccacguuggccaggcuggucucgaacuccucaccucgugauccacccgccucggccucccaaagugcugggauuacaggcgugagccacugcaucuagccagcucaaucuugauaucaaugcccgagugaauucucugcaaugaagaugcgugagcacuguccuaguccucuucuugggacaagcaagccugaauccagcagcuucaaacuucacaccuguguuaaaaaaaaaacaaaacccgccggguguacuggcucacgccuguaaucccagcaccuugggaggcugaggcggguggaucauuugaggucaggaguucgagaccagccuggccaacauggugaaaccccgccucuacuaaaaauacaaaaauuugcugggcaugauggugggcgccuguaguccuagcuacuugggaggcugagucaggagaaucgcuugaaccuggaggcggagguugcggugaacugagaucacgccacugcacuccagccugggcgacagagugagacucugucucaaaacaaaaacaaaaacaacagaaaaaaccaaaaucaaaaccaaaaaccaccacgccugugccaccucacagucaaacaccacaccugugccaccucacagucaaacaccacgccuaugccaccucacaaacaccacaccugugccaccucacagucaaacaccacgccugugccaccucacagucaaacacuaugccugugccaccucacaaacaccacgccugugccaccucacagucaaacgccacgccuuugccaccucacagucaaacgccacgccugugccaccucacagucaaaugucacgccugugccaccucacagucaaacgccacgccugugccaccucacaaacaccacgccugugccaccucacagucaaacaccaugacugugccaccucacagucaaacgccacgccugugccaccucacaaacaccacgccugugccaccucacagucaaacgccacgccugugccaccucacagucaaacgccacgccugugccaccucacagucaaacgccacgccugugccaccucacagucaaacgccacgccugugccaccucacagucaaacgccacgccugugccaccucacagucaaacgccacgccugugccaccucacaaacaccacgccugugccaccucacugucaaacaccacaccugagccaccucacaaacaccaugccugagccaccucaggggucccggaggccgauggggaggcucugcucaggccuccuuggagcucagucagccagguugugguuaccuggaggcuugacuggggcugcaggaccugcuucuaaguucacccauguggcuuuuggcaggaggccucauuucuuugccacaugggccucccugaggggcagccugaguguguucacgauguggcagcuugauuucccauaaugagugaccccagugggcaugagcgggccccacagagcccugugugaccugguccucaccagcugagauuucgucugcuccuuaacucugucuagcccuuacucagugggaggaggaucgggcuccacuuuuugaagggagugauuucaaaaccgcucuucuccguaaggagugucggucagaaacggugcuuguggaaugguguuagcauugaugcuggcucuggugccucccaccccuugugcuggacuuugguuggccacagacagguagggggcuuacagagaggauaggcaggugcagagcuuucuuuguucccuuguuuccuucuuucuuucucuuuccuuuucuuuccuccccuccucuuccccuuccccuucccuuucccuuuccccuuccccuuccccuucccuuucccuuuccccuucccuuuccccuucccuuuccccuuccccuuccccuuccucuucccuuucccuuucuguuuugcucuuguugcccacgcuggacugcaguggcaugaucucagcucagugcaaccucugccucccagauuccagagauucuccugcgucagcuucccaagugucugggauuguaggcgcccaccaccacaccuggcuaauuuuuguauuuuuaguagagaugggguuucaccauauuggccaggcuggucuugaacucuuggccucagguaauccgccugccuuggccucacaaagugcugggauuacaggcgugagccaccacucccggcuugccccguuuucuucagugacuuuguuaaugagccagaacagugaugugggugcugcacaccccauucugcuccugggacucaaccucaccugaaauaaaagcuuuucguuuauuugcuucaugugggggccagguaauaccugcccgcccugaagugugcauugccuuaaauucagccgcuuuggucugcuugcucacgagugucuucagugugaccguagucaucgcuuucugguaaaaagguuuguggggagagggccucaucaaaugucaggaaagccccugaggagacaggcagugucuucaggggccacgucugcaaacccagagcccuccugaccgcggcugcagaggacagugccaagacuccugaggggccagggcugccugcucucccucuuuccagcucuuugcucaucccacccaaaaacuggcucccaccuuucucugugucccucaucugccgucugugugccccucucccugucagccaaccagucuucacccacacccaccuaccccugccugcaccgcaucaccugaauauguggcaccuuuggugaacacuuggcccccagccuggguuaccugucaguuccugguuuuguuuuguuuuuuggagacagggucucucucucuguugcccuggcuggaguguagugguauaaucacagcucacugcagucuccaucuccuggacccaggugauccucccaccucagccuccuaaguagcugggaccacaggugcacacuccugugcccagcuaauauucucaauuuuuuaagagacagagccuuacuauguuguccaaguuggucucaaauuccugggcucaagccaucuuccugccucaccucccaaagugcugggauugcaggcgugcgccaccaggcccaggcuuugccacuuccuguuugugucaagcuccucuccaccucagggccaaaaagaaaugcucugauuuuccucuacaacuuuuauaauuguguguuaccggacaauuaguccugacucugggugggcacacacacauacccaccaugcacacucacccccacgcuuaugugcacacucaggugcacacucccacucaugugcacacucccacucaugugcaccgcugcaugcucacgcucgcucacauccgcaccccggcugugcugugcuugcaccuggcggacucgguaugcgcagcccagcucuaguccggcgucccuggcguguguugugcagucugcgugcgcaacuguguucacccugcagggcuccuaugucggggcuuaucagugggaccguucggcgaucauccucaaccccccgccacccccugcugucugcucugagucuaggcucacaccagcuuccccaggugucagagggcugcucucugagcagggugcaggggcacugccuucccugccuuucccuuggaaacagugcauguuuuccuaggaaaacauuuaggauuuucugcuuuuuuuuuuuuuuucccgagauggagucucgcucugucacccgggcuggagugcaauggugccaucucggcuaacugcaaccucugccucccagguucaagcgauucucugccucagucuccugaguagcugggauuacaggugccugccaccaugccuggcuaauuuuuuguauuuuuaguagagaggggguuucacuauguuggccaugcuggucucgaacucuagaccucaggaaauccacccaccucagccucccaaagugcugggauuacaggcauaagccaccaugcccggcuuuuacuggcgaagcuacuuuuucuguuuuuauuggcaaagcuauguuucaaaguugaaauuaaaauaugaccauugaaaauaugcacaucaguuaugguuccagcagaguguggaagcagcugcugguuucuauaaaagcgugugcuuuuagggcuuugaaaagcuuuugccacguagagaaggcgcucagcugccucuggagagaccgaggcugcugcagagaaagaaacagcuuccuauguggcccugcagcugggucacccagagccugaggaguucuucagacaggcaggcagcuuuggggccagcaguuacaucaugggcuagaaccuaaggacaagcuagaggugcauguggccguguucacaccuucaggcccgcugcguuuuuggaggucuuggguuuagugagcagauggugccuuccgcggccucagucacgagagcgcaaggcuuguccuccaugggggggccucugcugcaccugcugagcuguuuucucugugccuccugggugaaaauugaaaaaccaaaagcuuugagcagcuccugguaccaagaaaaggacugacuuaguuuguuuuugcugcuguaacaaaauacccccgacgacgucacuuauaaauaagagaaauguauuucucaagaguucugggcugggcacaguggcucacgccuguaaucccagcacuuugggaggccgaggugggcagaucaugaggucaggagaucgagaccauccuggcuaacacagugaaacccugucucuacuaaaaauacaaaaaauuagccggcaugguggcggacgccuguauucccagcuacuugggaggcugaggcaggagaauggccugaacccgggaggcggagguugcagugagccgagaccgcgccacugcacuccaaccugggcgacagagcaagacuccgucucaaaaaaaaaaaaagaguucuggaggcugggagcccaagacccaggccccagcaagucugguguauggugagagccugcccucugcuuccaagauggccucuuguggcuguguccucaccuggcggaggagauagaggacgcggaggacugaggcugguucccuccagcccuuuaugaggcucucgugucuugugcaggcccgcaggaccugaucaacucccaacaccaugguagagauuuggagguauacguucaaacuguagcagggaccaucaagaacauggaauguuugagacggcgcagaccgaaaaucuggaauuuguagcugcugauuuuucuugcuuguuuucucagaccuucucuccaggagccaugcccaggguggucagagguggugagugagguggcagaagcgagugcugggcagggggcgcacugcugggcacucacuccauaccuccugaugggcacuggcugucccaucccccuugggaugaggagccggugccaucaguggcugcacggucagggcggagaguccccuccuucugccucuguguggagggcuggggagacagggaggaucuuuguucuccagcuuccuggcuuuguaaggcugugugccccucacagcccgagcagguugucugagcagggcucacucagccaguuuuuucaugugccgucggccagcuccccugucuagaaugcuccaguccguacuuuccuaauaacccucucuucugcaggguugggagggcgcucaccagaggcaacaaggggucuagggucccggugcuucucacacuggccuccucgccugacacacgcacggagcuugcucuggccaucucugucccugccugugccauggacaucccugcgcccugugggccucuguggcuuggccggccugugccucccuguggcaggagggaggugcuuggcucugcuuggcugccuguuucaacaugcacugugcugcgcuccaggcacugccaggcccuuggggagcaccccccacccuugacugcugccuggcccugcugcagagcggcccacggccagggccgccuuggcugugaggggacccugugagccccucccacaugguggauggagcuugcgcuuucucaagagaguaaacccguguuuuaguuugacaaaagccagaggcuuuggcaaggggcagguacagauguggcugagacagggcccuggacguuugcugagugacgucaggucagcucguaggaggcuucccugaccuuccagggucucaccggcuuccgguagcugaguuaacccaccucaggugcuggaggcccuccagcugucagcugggguccgugcaccccccagacugccuggagggcuucgcacacaguuugaaaggccucugcgcuuuggagcccaauuuggaacuugaaggcuugaccuuuguguuuuggacaacuguuuuguguuuaaccucagauggaagugaccauccaaccagagugaugguagcaggagcugggacggagccccggggcuggcgcccagggacagggggcgcgaggcggauggguggcgcaguccaggccagcaucggccccgugggccucgguuuccaccgucucuacagcguggguggccccuucaguuccguguggccuucgcuagcgcuguugggcgcugagcuguacagcugccgugucugugggcagaaguuuuuucuccugcaccgacugugucguccagaggcguucagagccugcuguuuucacgcucuagccgcacagcugugcccgcgagugcgagucccgcguccgaggccucggcgugagcuuacagcaucugucggguccgagcagucaguccagagggucgacucugaaugaaaacaaaacgccgugguuugaaauggaaggaaaccuggccccugaaggugcguagcguccccgccaccccggugcguguguagugcagccugguggugcuguggauuggaggccauccugugugggcagcacggcagccagagucugcaaggucacgggugacaccagaccgagcuggugagacccggaccuccacgccauccagcaggggcccagcagaccagccacauccucaugccgggccuggggcuuguacggacaagugauguccaugggcaaauucacuuugauuugaaugaaaaauaaguuaugcaucccuauuuugugaccaaaacauguggccaguuguaucuuuaaagauuugaguggggcugggcgugguggcucaugcuuguaaucccagcacuuugggaggcugaggcgggaggauuguuugagcccaggaguuugagaccagccuggucaacaaagcgagaccccaucgcuacagaaaauacaaaaauuagaccggcaugaugguauguaccuguugucucagccacuugagaggcugaggugggagaauugcuugagcccgggaggucgaggcugcagugagcuaugauugcaccucugcacuccagccugggaaacagagcaagacccugucucaaaaaaaaaaaaaaaaauuauucuuuagaauuuuacuucucagugauucacuuuuuauaguagaaccacaaagacagaaaauaugucaauucgucuuuugucuauuuauuuauuuuuuugagacagagucucacucugucucccaggcuggagugcaguggcccaaucucggcucacugcaagcuccgccucccggguucacgccauucuccugccucagccucccgaguagcugggacuacaggcgcccgccaccacgccugguuaauuuuuuguauuuuuaguagagacggggcuucaccguguuagccaggauggucuugaucuccugaccucgugauccgcccgccccggccucccaaagugcugggauuacaggugugagccaccaugccuggcgucaauuugucuuuuagagcccaauaauauccuuagaaaaaaggagcucuguccccgagggccaugugcuuuuauaaaaaucagucgcuggaaguguuuccaggaaguguuugagguucccgucugugggguguuuccuugcucuggacgaaggugauuuggggaguuucuuggguccuguggaauuggugagcuugugcucuaggucauaacuuuagguggccgagggugcugugucaguguggccuugucaucggcaucauggcgccccugugcccugcaggcguggccaguggcacccacgugcccucacaagccugagccacgaggugaggcgucugaagccagcgugguguggucgaggaggggagccuugacccugaggaggccuggaggugacccggcagguggggcuggguaggaaggcugcucccaguggcaguggacgaguggcauggacggcgcugggcaccacagacgggggacuugaggcaaggacugggagguggcggggggugggggcccgggagugcugaggggcuggugcccuggucguggccauggacucgugccccagcuggacacaccugcugggucucagggcccuggagacgcccaagagagcacgccuggguggauggagacuguuugcagcucagagugcucugguuggggggugcagccuggggggacccccuauuccuaacaggccuugggaagggaggcuacugagugagauauagccggggggcagagugagaagggggugguggcggcaccuccggagggcagagggagggccggagccuggcacucagggaccugcuguggacaggccugggcguggcauggggguacuggaagcuacucgccugggaugagggcgggccuugcccaggggagaccccugugugugcaccuguuugucgcacguauuuugagaugagaaggauuugcauguguuucuauuagaguaacuauuaggggaggaggugcaaggacagagaaggugggagcugcgucuggugggccccugaggacaccgacgaggugggguuccaggggccuuaugggggcagguggaggagagacagagccaccacagggccucagagguggcugugaggugcuugcugagagcggcccuggguggggcuguugucagaaguggaggcacaaggcacccucucuggacaggccaccugccaaggacaagacugggauaaggcugucaccugugagcccugggcaucuuggggcuugcuuaggugucaggugcccaccaaccugguccguugggucugggcagggccaggcugugcgucucugcccacaccagcugggcgggggcugaggagagcugaggggccagcugguugggcuggggcgggcaugggcagggucugagaaaggggcucugagagcuguggcugguguacaggggaccaaggccccugcuuuguguggucuuggggauggccagagccccagcacaccgagcccucgauggguuggugggaugcugccuccugugugaucugcuagaaaugcuuuaagcccguaucuuuucuauugcagacuuuaaaaaauucaaaaagccuuugcucccucaauuacgaagaugacgaugaggaugacaccccagugaagacgguucuguccuccccaugugacucccggggccucccuggcaucaccaugccuggcugcagccagaggggccucaggaccagcccuguccaccccaaccugugggccucuagggagucggugaccagugauggcucccgcaggagcagcggggacccccgugauggggacagugucggggaggagggcgucuucccccgggcccgcugggagcuggaccuggagcagaucgagaacaacugaggcuggugggggcuggucggggccauggcugccgccugcaccugcccuggggcacagaguagguuuccugugagcuggucggggccacggcccggcaccugcccuggggcacagaguagguuuccugugagcuggucggggccacggcugccgccggcaccugcccuggggcacagaguagguuuccugugagcuggucggggccacggcugccgccggcaccugcccuggggcacagaguagguuuccugugagcuggucggggccacggcugccaccggcaccugcccuggggcacagaguagguuuccugugagcuggucggggccacggcugccgccugcacugcccuggggcacagacuagguuuccugugagcuggucggggccauggcugcugccugcaccugccccagggcacagaguagguuuccugugagcuggucggggccauggcugccgccugcaccugccccggggcacagaguagguuuccugugagcuggucggggccauggcugccaccggcaccugcccuggggcacagaguagguuuccugugaguuggucggggccacggcugccgccugcacugcccuggggcacagacuagguuucaugugagcuggucggggccauggcugcugccggcaccugcccuggggcacagaguagguuucguguugcuuggaacauuaaggcguaauuuugauucaguuuuuccuaaagaagcauuuugcauuuuuauggcuuuugcaguucgggagaaagcuucucuauuuuggaugcauuucagaagggcguucuauuaaacaugaaucugcaaacagauuaacaugcgucuguguuccccacgaaaggccugcugugcagggcgccuugugugcuuuaguugcuaggaaaccccgggcguugguggucagagucccacuggccccgugugucccccccucccgacgggucacggugcuuggggcuugcgcaugggcaucugugcccaugaaccuugucacccacgugccagugaaccgccagcuuguggccgccugguuuuccaccgguggcagugauggccuuuggggcagaccaaggugccaugagucccugcuucccguggccugggagggcccuugcaccuucaggugggguguagugccagaccucugggaaggcuguccugccggcagcacccgucagcacccacucugugaauuuaauacaaggccuuugcuuugugcauacgacuucugauuaauuuucguuuccaccaucugaagugggccuggcugcgccucaggccucuggucucuggcucagaaccagacaaggcaagggauuuccuguuuuucauucuugcacuuuuaauaaaaucguagggguuucgaguuugcgauagcaaaagaaaacauuaa

SEQ ID NO: 191463 - RNA, 26522 nt, Homo sapiens
uaugguggcuuucuuuagaaaagcucgacuuuaaugguucagauaguuuuacaaugaaaauagguacccaaagacugucuuaaauguccacaacuauacaaaagaugaauacaaaacucccaggcaggcacaggcaggggacaaggcccaccgucucccacgcucugguguggucgggugucccugccgcacccccaguaccaccgugccaccuugguccccucaacccuggggguaggagggcacugccccagcgagggaaaauagaaaagauuuuaaaaaguaagagucuaacaggcagagcugucacuaaaauuaggaaguuguaacuuuuuugguuaauuuacuuacuacauucaaaaauguaacguugaguccaaaaagugucuuaaaucacacaaaaaagaacccauauuaaaauuuuaaaaauaagccccaaauaccccagagaaaugcauccagaacuuaaaacaggcugggucagcagcagggcggcggccgggggaccucgggggccagguguccgccauccgguuacuuuaagcuggcaaagccaucgucccguggacccccacaagugacggccagcugugaggcaggugguucuaggacacauuggucaugggcuuguacuucuugaagcgcguccacuggcccguggcauaguucaucucaaacacuguguccaccagcaugguugugcuacccuggccguccgccuugggcagguccuccgugugcucgcucagcuugaucuggaucacgucccccugcuccuggcacggguucucugcagagagcaggagcugcugggugggugucugggggcacccgcccccaacccggcccggugcacccccaggcccugccuuaugaacauaccucgggagccggccaugaagcccaggaugagggccuucucgggccgcgugacuuuguuggccgucuugaacaucuccugggcagcgaacaucugcucucucuacagcggggagaggggugugggugccagggccccgccaggaccaccuccugcaucccccugcaggcaccguggcacccccacgcuaggggagguggccagggccguaccaccuaccugguggccugugggcccuaccaguguacaccuaccgugagggacagguucuucuuaggcugcugcugagcaggggccugggucugcggggccaccauggcaaccgggggugucugagugguaggggcgacagccggagguguggugggugucagaggcgaggugggcgccgcaggcguggguguggcagggcucaggccgcuguuguacaugggcgcccgcugcuugaacugcgcuggcaacguggggcucggggcgcugggcuccucuggugggcggcuggcuucccgggaagauggggcugcaaguagaccggggccuggugagggggcuggacccccacccuguucccaaacccuagugcuccuggaggugacaggcucagcuccccuucucuguccugcuacccucugacaagaacucccuguggcccccagccaaggcacaggccccagaagccccagccagaggaacaaggccaguggucucaggccuuuccagacucgcagauaagaugucuggacucuggccagcugcuggccugcagcagguccccauaccguaggcacugcugggaagacaggaaggcuguauccucaagccccuugggcccaggaccuggccugaggugcugugagccuggcagugcccuccgucugggaggggauggcucucagcuccccucccgccuacccagcaacaagagcugggucaccuggcagaaaacccuuucgaacccaauccccuuccugccguguccccuggggccgcugccugucugugcccaggacgggcaggguggggcaaagcagcugguuuaugucuuggagcucaagcugaacagcggggcaucugcccccagcagauucuggcugaggcagaagggggacaacagagaugcaggagugagaaccgcagcccuggcagcgcccgugggcaaggucauguccuggcaggcagcuuggcugguuccaggcuggggccagcagacucaccugggggcgucucggagcuggggauguaggaggaggcgggaaccacgcugggcguggagggaagguagcucguggagggcagcgcaggcucauuguucagggacccaaguuucuggaacacagaguuuaagguuccuuccagaagaggccaugcuuccggcaugugcuaacacauggcccgacccggagcuccacugccacaggcuguggccccccgagcuagagcaggaaggcgggggccacucucccgagcucccugggcuagacaacgggaccccuggccccuggcgccccagcagaguuggggacugagccgcuccuguguaggagaggggagggguugaggagcccaaacagcccaucuugagcacagaaggagcgaugcuuuuucuuaccacgaagcguugauauaaaggaagaugcucauguuaagaaacacagaacacgcagcggcgggaagaaaggagcuuauuauccugaagugaccccacaguguggccuccuccaggcccuggccucagacgacccacugcagccucugugcaccugccgcgccccguggcugccucccacccgcaggcagggccuggucuccgggacacugaggccucugaccacccagcacccccacaggccuguccugcacccauucacggccacgugcaaggcuuaggucccaccagcccugccugacgggacacugaggcacaggguugaggaggacuccccuggcagccccuccagcaagcguggggcagguucccgcuccaagccugagucagaugcccaugucagggcacggcccacacugccucucauguacauauacguauauauacauaaauacagacugcacacauauguacauacauauauauauucuccgacagagcacacuaguggccacaaucggaacaaaaggggcacccgcaguggugccagacauggggugcagccccgagcccuaccugcguggacaccaggccggcugcguaguccgggguggcguucuccaccaccguuuccuccuuggccggcuucuccaccaccuccgcaucuguggacaaaacaggaguccucgccagugcccgggcgcgucugcagugucagcucagggcagcggcagggaaucaaacagcuucccaggggaggccaccaaggagcgaggagaaaagcaggcacccacccacggagagcagccucacggggcacagcccugcccgccgagcgugggcacaacccaccccaacugggcagggcccgcagggacccccauugccgccgacacgcaggccccaacccccaccgagagucuuccuucuccgcuucgccucucggccagcgccaaccauauccagcucagagauguccagcagcugccaagacaagcacagcccugccuuagugacggcaccagggcgcaacgggccccggggugccacaggagcugggggacgggccuaccuucacaccucguuccuuccgcagcagcguccuggaaggcgggauggggguccgguucccuguggggcugaagacgcugggcgccguggggcuucugaagggcgccugcuucgggaugccuuugaguggggcuggaggacggcaacagucagggcgccagcagcagugaccggcaaacgucccccaccccgagcucagaacgucccacccucuucuaggcuagcgccgcagaggggaagggccaaaccccuggcgggcagcgggcaggacccccaggaucccggaccucaaggagcaggggaacgccuggagccacgaccucacacuuugccaagacaccaaacaaagacagcggcaccccagcccagccacaggaucucaccagguggagucucucaccaguguggcgggggcugagcucugccuccuuccugugccuccaccggcaggggcaugaagccaggcgccugggcuugagggccgcccucccaagccuucuccccguccccugaggacacuccugaggccuaccuacgcuguuacccaccagcgcccacacgcacccuccaaggcgugcguggcucucauggugccaggcccggagagaggacgcccgggggauggugccaucagcacaccgggccaggcuggacacacugcucaacggcuggcccacccucccugggccagcaggugcagcccuggcccugggaugccugguggggguggaaagacaagggucugcuccaggcgggguagaggagagcaagguggaaccucggcugcggugggcaggaacaugacccagggacggccccccacacagcgacaauagucagcagacccaagaugccuucuacuaggucccaugugaacacugugggauuaugggagcccaaauaaacuaagccaggcuggucugggagcugcauggagagcgccuguaaggcugcccuuucagccccacccaucugcaaguuuacccagcugucucagcacaggacgacacccguccugcccucuggcccccaggucacuauccagcacccucuggggugaguaugcccugccaugguucccaggggcacgccgucuuccugugaucagggugcauccugcuuaagcucacgcccagcccugagagcacaaaucaggaagggcagauggaggggugcggggggcacagccccacgggcagcugagcacggucacguccuccccgcggagccgcccagggacacucggaacccaagagcagcacuuggggccgaaagcccgagcugggaaggccgagagccaccggugccaacagcagaggagcaggggccagcacuguccucagaucccggccuuccugucuccaugcccagcgguguccucagaucccggccuuccugucuccgugcccagcacuguccucagaucccggcccuccugucuccgugcccacacauccucccagggagcuccccaaggggagaagccggugaaauugccccagugccuucgcuuucccacgggcucccaacacugcugccugaagaccauucacaggcaccaccuccccaacagggagcgggucuccaggugaagcccuuagcucugccccaaaagcaaggcucacggcaccagggugggggccuuacuggugguguccaucuuccgcagcagcccccggcccuuggcguggaagggcaccccggcgcuccgcuucaacugcugggcggucuccguggcuggaaggaagaggucacauaugucagggauccucagagcgagagcccuuggcccuuguaaaaacaucucugucaaguggauucauccgacggccugagccgugaacgcugcauucucucuaaaugagcagcuguuccgagccgggccugacaccagcucgcacuuuacaacgagucagaaacucacucaggugagcaaguuucgggagcuggguggcuguggcugcaccucccaggaccccauggcaggggggaggcagccgaggaggagcugagggaccucaugagcccucuccaucgacccgggccucccccuggcccagugguagcaccguccucgcugagggucagcaggcacggucuagauacaaaaauaugaggaagaaacaaacgaagagauauuccugacuugguucaguguggcugaagggucaggggacaccgagugcccaaagcagacccuguggccacugcuggccuccaaaggggguggggcccaaggggccagcagaguccuuccugggcuacccagugggcccggggcugcacggagccucccggacagcgcugggcccuggcugcugcccguuccagccaagauccaugcacagcugcugucagccuuuuauuuggauucucuggaaacgggguauugauguacauuauaaauauuaauuccauaaccauucaaaauaaaacgauguuauugaaaucuuugucgugcuuugggaaaacguuaacugaaaugauuaaauaucuuucaaguggaauugagaucacccgccacuccagaaggcagcaacgugagaguaaggaacgugccccuccagccauucacccuggcacccaccgugcccaacagcgugacucagcuggcacagaguucauuuggucacagagauuagagaugccuucaccuaaaauucugaaguugguggguuuuuuuuuuuuuuuugagauguuguuucgcucuuguugcccaggcuggagugcaguggggcaaucuuggcucacugcaaccuccgccucccagguucaagugauucucuugccucagccucccaagcaacugggauuacaggcaugcaccaccacagccagcuaauuuuuguauuuuuaguagagacgggguuucaccaugugggccaggcuggucucgaucuccugaccucaggugaucugcuggccucagccucccaaagugcuggguuuacaggugugagccaccaugcccagccuaaauucugaaguuuuuaaagcauguuuucagaacauaaaguuuaauauagugauaaacuucuaacaaaaaacuuuaugcagaacuuuaucuucuuuuucuugagacagggucucacucucucccaggcuggaguguaguggugugaucacagcucacugcagccucaaccucgugggcucaggugauccuccuaccucagccuuccgaguagcugggagcacaggcacgcaccaccaugcccggcuaauguuuugguacuuuugguagagaugggguuucuuggcuggucucaaacuccugggcucaaacgacccaccugccccagccucccaacaggugugagccaccaugccuggcccagaacgccaccuugaaggggcagucuugguaccuuagaaccuaagaaaccuaugacuggaaacuacaaagacaaugcccgauggcggccgcggccacucacacuucugcagcagcuccgcccgcagcguggcgcucuuggguuuccgcuuuaacugaaaaugcuucaccgggggagugaggggucccgcgagggucgucagggcguuuuuguucaaguacuggcacuccaguggcagcauggcagacgcuucacacucacccacugccgguaagaaccacaugaaguuaggggcgcccaggccgcagaccucccggcugagaggagcuggcggcugcccagccccacacccuccucaguuaggguuaggucaugggagcuucggcuguccccugagguccucgagacugacuccccacggcuccagcagaacacccaggagcauuugcagaacaggaaugccugagaggcgggcaugccuugagagggcuguaaacuggaaaccucuggcaccgcggacaccaagaaccacaggcggacauagauacagugauuccuggagggcuccagacacuuguagaacaugaaauguuaacagaucccacccccacguaagaaggacccccgaucuguggcuucucucuucccguccccgaggguagccaggcugguggucucuccuggaacccuggcccucauccaaacugcccacauccauuuccucagccugugugcucacccacgguucagaucccagaaacugccccacgagggacaggcgaccucccaccugaacuggcuacgugccccaccuggagaaaaagcacaggcaggcacaugagaguucaccggccucagccuuccugcccgcgggacacuccugagacacgaacggguggggugggguggaccuguccagaccacugcuccagaggcaucuguguggugugugugaccucacagguggggagaggugccacuugcagggggguggccagcagggccccugcaggagugugcagccucgaugucuccaucccacaacccugucucucugggugcugcccuugaaggagcuggggcacaacguuugggcucugaggagccaguuccaauuguccaaagcaggagagaaacucagaaaagcacaagcaucaagcaucccaucaagacauguucuucaaauccaucuacaaauaguuguuucuuuuaagagauacauucucacccuguuacccaggcuggagugcaguggcgcgaucauggcucacugcagccuuggccucccaggcucaagugauccuccugacucagccucccaaguaccugggaggacaggcaugugccaucacgcccaccuaauuuuuauuuuuuguacaaauggguucuugcuauguuucccaggcuggucucgaacuccugggcucaagcaaucuggccaucucagccucccaaagugcugggguuacaggagugagccacggagcccagccuugugaauauuuucuaagugacuuucaguucacauuuaaacaacuaaaucguugauauuuucaacaugcauuucugagcauguacucugggccagggaaugcucugggcccuagaaccuaggaucuacagauaccaccugaaugggcagagccccuacccucacggagccgaccagagagagacggcgaguggcgugacacagccucccacugacaccgcagcagugaggauggggccugugggcuguuuggaguuuguuuucaaagauggcaaaagccaggcagcagcuuacgggggaggauggugcauauacaguuaauauucuagggaccaggacacacggaaaaacguaaaggucuaaaaaucaaauucauuucagaaaaaaauuuuucaagaaagauccauuucccuccacccaacaugaauuaaagcagcacaacauacccuuuucucuaaguucucccaaaauauccugaacguugggauucugcuccuccagcuccagguuaagcgagccuguguccggaaaggacuucaagaugucggcgaccaugagcacccagggguccgagucgaggcuggcgagcuggaugaucuccauuagggcgcccuucaucugcaaaauaggaugcugccggcgccaccaugccccugcccacuuccaagcccacucccugcugagcuuccggaugggcacugggcaguggccgggcucucuggcaguugcccccaacacuuccuccugagggcuccccuuccucugagccccccgccucaccccagggccaccuugcuucccugagcagcacagccucugccagguugcaaggccccggcauccggugcccucccagcagccucccaccucccagcagcacccaguccacugggccuacucuuccaccggugcgcagaugcaagaaaaccugaagggugagaagccggggccaccacugcucccgcagaaagccugcgggugggaaauccuggggaugaggggcguagagcaggcaggugcccggcacagcagagcgcaggagcaggguggagucaccugccgcgggggugugugccugggcagcaggggguggggccugggaccuggggcagcacccgugacagcugagcuggugccuagucaccaucuaggcagggacggcugccucugggucuggacggcgcugggaguuggcgcucguggagccuggagguggccccgggaucuggagugaggccagggccuuggggaggccaugggcgacgugcguggaggaagcaggcgcaccccgugcucccucaauaccugggaggccagauccauccacaccagggccugcuucggccacauaaacccccucccacgaggaaacgcagagagccaggccauggcgugccugugccucugccaugcgcccacugggcugcucacagugugagacagcugggcuggcuggcgcugggggugaacaacagcgcccugcccuguccagacgccggggcugaaaccccagccccaggccuuccugacacccacucccugcgucaggcgccagagacccguccuacgagggcugcggccaucacguccccgcgagcgccgccuccugguggccucugagugggaggaccuuccagcgcuucccucacuguccucaugggcuuccugcccugagggaaguuggcucgaagggcagagaucagaggucgugccaggggagccugccugcugccaagccccucugcaucugcccugcaggacacccagcugcccucaggagucaagaaccccccgcguggcccagccccuucuguuccuugggcaaccagggagggugucgccccggccgcugacccugcgccccgggcccucacucccgacgcccgcccgagcugagugcgcgaugcggcagaagaugcuacguggcugcaggaagcgcugcgcacacgcugccucuggcagccgcacagcccggcuguuuccagccagugcggccucuccacagcagccccagggaaacccuacgccugccaagaggcaagcgcgcggcauuuuauaaaaaugguaaggauaaaaaaagucggggauguuaauuuaaaacaaaaaggaccacuguuguggagucaauguuuucucuccagaacgcgcauguugaagccuggcucgcucuacuggggcuucuuguaggaaaacgcuuggcuuucccgggcgcgguagcucaugucuguagaccccgcacuucggccggcagaggcgggcggcucacgaggucaggaguuggggaccagacugacccacauggggaaacccugucucuacuaaaaauacaaaauuagccgggcgugguagcgcauuccuguaaucccagcuacuugggaggcugaggcaggggaaucgcuugaacccaggaggcggagguugcgugagcugagaucgcaccauugcacuccaaccugggcaacaagagcgaaacuccaucucaaaaaaaaaaaagaaagaaagaaagaaaaagaaaagaaagaaagaaaaaagaaaaugcuuggcuuacacacaacagaaauuuacuucucacgguucuggaggugggaauccaagaucaauuaaggcgcugguggauuccccgccuggugggggccccuuccagcuucauggaaggugccuuuugcugguggaaggugggaacgagcuccccugggccuuuuuuuuuuuuuuuuuuugagacagagucucgcuguugucgucgcccgggcuggagugcaauggcaggaucucggcucacugcaaccuccgccuucccagguccagcgauucuccugccucaugcucccacagugcugggaauccaggcgccaccaccacgcccggcccaggccuaccuuguaaggucuguaauucuuagagagcaggggcccuaacucauuucuguacucuucacugaauaaacuaucacaucauuaaaaugucucuuccucuucccugguauaaagaacugcuguuuacuaagcuuuucagaggaauagggccggguauaguggcucacgccugugguuccagcuacucgggaggcugaggcaggaggaucacuugagcccagggguucaaggcugcagugaacaaagauggcacuacuccacuccagccugagcaacagagcaagauuucauuucuuaaaaaaauuaaaaauuggcugggcacgguggcucacgucuguaaucccagcacucugggaggcuagggcggguggaucacuugaggucaggaguucgagaucagccuguccaacauggcgaaaccccaucucuacugaaaauacaaaaauuagccaggcaugguggugcacuccuguaaucccagcuacuggggaaggugaggcaggagaauugcuugaacuugggaggcagagauucuggugagccaagauggcgccacuguacuccagccugggcaacagagcaagagucugucaaaaaaaaaaaagccgggcaugguggcucacaccuguaauccuagcauuuugggaggcugaggugggcggaucacaaggucaggagauugagaccauccuggcuaacacagugaaacccugccucuacuaaaaauacaaaaaauuaggcgggcgugguggugggcaccuguagucccagcuacuugggaggcugaggcaggagaauggcgugaacccgggagguggagcuugcagugagccgagauugcgugccccagccugggcaacagagugagacuccgucucaaaaaaaaaaaaaaaaauuaaaaauaaaaagacacauuacaaaaccagugaacugguuguagaauuucauucagaaacacaaguuguagcagaugccaugcauaagguuaaccuuaugugucaacuugacugggccauggggcaccuggacaguuagucccucaugauuccaggugugucugugaggauguuucuacauaagacuaacaucugaauuguacugagugaggcgagggcccucccuacugcugagugggucucauccaaucaacugaaaaccaaagcagaacaaaaaugcugaguaaggggaacuccugccuguuugagcuggaagauuggucuuuuccagccuucagacucuggcugaaacaucagcucuuccugggucuugagucucagggcuuacaucacuggcucuccuggugugugugcauguaugugucuauauacccucuugguucuguuucucuggagaacccugacugauacacuguggaacacauccagcccagucaucuagucacccuguaucuaugguccuauguagaaaaguuuaauuuucagaaugauaucccuaagauaccagaccccuaaauaaaugaaggaagaaaacuaagauaaauuagaaugucuuauaaaccuuuuuuuaaauaccaagaaaauaaaaauauuuuucagaaaaguaaaugacccagaauggccuaguccuuucacaauccaguuaaaugaggucuuuaucacaauuucuuguaauacauaaagacaaaguccaagaaacauacauauaaaauaaagcugguacauuuauauuaauguuagauggaagcagauuuuaagaacaaaacauuacuaaauacagagaaucucuauguaaagauccaagguugagcucacaugguaacuauaacaacuauacacuuggaugcaccuaauaacacagccccaaaauauauacagcauaagcugagaaggaggaacagacaaacccauaauccuaacggggagaucaacaaauccucuucucacugauuuuuuuuuuuuuuuuuaaaccaagcugcacgugccuguaguucuagauacuugggaggcugaggaauuugaguccagcccgggcaacauaguaagaccccacaccuuuaaaacaaaaaacaguuaagaauagaauagauuuguacaacaugauuauacaaauuggccuaaugaacauccacugagcaauggauuucaaaacuagaguacauaugauucgcaagcuuacuggcaacauuuacaaaaacugaccauacauuuugccauuaagcagaucuuaaauuucaaacgacuaaaauaaaccauauucucugacaagagcucaauacagcuagaaauuaauaauaaaaacaaaacuaucuuccccuccaauguagggaaauuaugaaacauuucuaaauuacacagggaucagugaagaacuuacugaaauuaaaaaauagugugacgauacaguucugugacuaucaaaacuugugggaugcggcuuacacuguaauuagaagagaauuuauggacauacgcacauacacacacgaaaagaagccugagauuggcauccaucuuuaaaacuuagaaaaagagcaacaaaguaaguacaaagacaggagaaagaaaauuagugaaacagaaauccaaguucaacaaagccagaagcugguaguuugaaaauucuuauaaaaucaacaaacaucuggugagauggaucaagggggaaaaaauaagaaauaaucacuauacaugcuucugacauuuaaaaagaagauguuugagcuggucauauuggcucaugccuguaaucccagcaauuuggucaaccaaggcauguggaucacuugaggucaggagcuugagaccagacuggccaacguggcaaaaaccugucucuacuaaaaauacaaaaauuagccgggaaugguggcacacgccugugaucccagcuacucagaaggcugaggcacgauaaucacuugagucuggaagguggagguugcagugagccaagauugcaccauugcacuccagccucgaugacagaaggguauuugagacacucucucuacaaaaaauuuaaaaaaaaagaaaaguaggcagguaugguggugcaugccugcagucuuagcugcucaggaaggugaggcaggagaucacuugagcuuaggaguuuaagguuacagugaguuaugaucacaucacugccacuccagccugagugacagugacacuaugcauuaaaacaaacaaaaaaaacaaaacccauaaaaacaaaaaucaauacugaaaaauccucccacaaaguaaauuucagguccagaaggcuucauuaccaaguucuaccaaauauuuaggaagaaaucacuccauuaguaaacaaacuuuccaaagaaaaagaaaagaccagauacauuacaaauccuuuuuuaaggguagcauaaccccaauaccaaaauccaacaaagacagucuggguaaguaaaacuacaggucaaucucacccaagaacaaagauauaguacaaaauuccuauacaaaacaucaggaugauauaaucuaacaacauaaaaugaccaauuuagguuuaccgcaggaaugcaagguugguuuauaauuaaagcuauuuuguuaauguggugaauuacaugucaauagauauuuaagcauuugauaaaauuuaaaguuccuuugugcucacacccacuaggaucgcuauaucaaaaagauaacaaauguuggcaaggaugugagagacugaacacucgaaaaucacuauggagaaaguaagaugguguagccacuauggaaaauaguuuggcaauuucucaaaauguuaaauauagaauaaccugggcagcccagacaagugguuuccccccacugaagcacacucccuccaucaugggacaaagugcuucauuaaauggguccugcucccuaugucacccaacuaggugagacccuccaacagggguugucagacacccuauacagcagugacccuacuggcaucagguuggugccccucgagaucagaggucccagaagaaggagcaggcacccaucuuugcuguucugcagccuccuuuagugacaccuccaggcaugggagugaaucagaugaauauggccugaagugaacccccagcaaacugcagcagcccuacagaagagggacaugacuacggcaaggaaaacaaacgagcagaaaacgacaacagcaucaacaacaacaacaacaaccacaacaaaagcccccauccaagggucagcagccucaaagacugaaacuagacaaacucacgaagaugagaaagaaucaacgaaaaaaugcugaaaaccccaaaggccagagugccucuucuccuccaaaugaucacaaugucucuccaaaaagggcgcagaacuagacggaggauuggauggacgagcugacagaaguaggcuucagaagauggguaauaaaaaaaaaaacaaugaugaacuaaaggagcauguucuaucccaaugcaaagaagcuaagaaccuugauaaaaggucagaggaauugcuaacuagaauaaccgguuuagagaggaacauaaaugaccugaugaagcugaaaaacacagcaccagaaccucaugagucauccgcaaguauuaacagccgaauccacaaagcggaacaaaggauaucagaguuugaacaccaccuuacugaaauaagacaugcagacaacaauagagagaaaagaaugaaaaggaacgaacaaagccuccaaaaaacacgggauuucauaaaaagaccaaaccuacuacugacuggaguaccagaaggagacggggagaauggaaacaagcuggaaaacacacuuaaggauauuauccagaacuuccucaaccuagagacaggccaacaugcaaauuugggaaauacagagaaccccacuaagacacuccaugagaagaucaaccccaagacacauaaucaucaaauucuccaaggucgaaaugaaggaaaaacuguucagagcagccagagagaaaggccaggucaccuacaaagggaagcccaucagacuaacuaauggcagaccucugcagaaacucuacaagccagaagaguuugggggccaauauucaacauucuuaaagaaaagaauuuucaacccagaauuuaauauccagccaaacuaagcuucauaagugaaggagaaauaaaaucuuuuucagacaagcaaaugcugagggauuuuguuaccaccagccccgccccggaagaacucuggaaagaagcacuaaauauggaaagaaaaaccaguacgagccacugaaaaaacacaccaaaauauagagaccaaugacauuacaaagaaacugcaucuagugugcaaaauaaccagauaccaucaugauuacaggaccgaauucacacauaacaauauuaaccuucaauguaaaugggcugaaugccccaauuaaaagacacagacuggcaaauuggauaaggagucaagacccauuggugugcuguaugcagaagacucaucuuacacgcaaagacacacacaggcucagaauaacgggauggaggaaacuucaagcaaauggaaagcaaacaaaaagacagggguugcaauccuaguuucugacaaaacagacuuuaaaccaacaaagaucaaagaagacaagaaggguauuacacaaugguaaagggaacaauucgacaagagcuaacuauccuaaauauauaugcacccaauacaggagcacccagauucauaaaacaaguuccuacagaccuacaacgagacuuagacucccacacaauaauagggggagacuuuaacaccccacugucaauauuagaucaacgagacagaaaacuaacaaggauauucaggauuugaacucaacucuggaucaaguggaccuaguagacaucuacagaacucucuaccucaaaucaacagaauauacauucuucucagugcuacguggcacuuacucuaaaaucgaccauguaauuaacuggaagucagcaaaugcaaaagaacugaaaucauaacagucucucagaccacagugcaaauuagaacucaagauuaagaaacucacucaaaaccacacaauuucauggaaauugaacaaccugcuccugaaugacuccuggacaaauaaugaaauuaaggcagaaaucaagaauuucuuugaaaccaaugagaacaaagagacaauguagcagaaucucugggacacagcuaaagcaguguuaagagggaaauuuauagcauuaaaugcccauaucagaaagcuagaaagaucucaauuaaaagacccagagauguaauuaacaucacaauuaaaagacccagagaggcaagagagcaaacuaaccccaaagcuaacagaaaacaagaaauaacuaagaucagacaagaauuaaaggacauagagacacgaaaaacccucccccccaaaaaauaucaacaaauccaggagcugguuuugugaaaaaauuaacaaaauagacagaaugcuagcuagacuaauaaagaagagagagaagaaucaaauagacaccaaauaauaauaaugauaauaauaaagaugcuaucacaacugaccccacagaaauacaaacuaccaucagagaauacuauaaacaccucuacacaaauaaacuagaaaaucuagaagaaauggauaaauuccugggugcauacacccucccaagacuaaaccaggaagaagucgaaucccugacuagaccaauaacaagcucugaaaaugaggcaguaacaaccuaccaaccaaaagaagcccaggaccagacggacucacagcugaauuccaccagaaauacaaagaggagcuggcaccauuccuucugaaacuauuccaaacaauugaaaaggagggacuccucccuaacucauuuuaugaggccaacaucauccugauaccaaaacugggaagagacaacaaaaaagaaaacuucaggccaacaucccugaugaacaucaaugugaaaauccucaauaaaauacuggcaaaccgaauccagcagcacaucaaaaagcuuauccaccacgaucaaguggcuucaucccugggaugcaaggcugguucaacauacgcaaaucaacaagcauaaucuaucacauaaacagaaccaaagacaaaaaccacaugaucaucucaacagaugcagaaaaggccuuugauaaaauucaacaucccugcauguuaaaaacucucaauaagcuagguauuaauggaacguaucucaaaauauuaagaguuauuuaagacaaacccacagcgaauaccauauugaaugggcaaaagcuggaagcauucucuuugaaaacugguacaagauaauaaggauguccucucucaccacuccuauucaacauaguauuggaaguucuggccagggcaauuaggcaagagaaagaaauaaagaguauucaaauaggaagagaggaagucaaguugucucuguuugcagaugacaugauuuuauauuuagaaaaccccaucaacucagcccaaaaacuuguugaacugauaagcaacuucagcaaaguccgagaauacaaaaucaaugugauuuuaauaggcaagcagagagccaaaucaugaaugaacucccauucaaaaucacuagagaauaaaauaccuaggaauacagcuaacaagggaugugaaggaccucuucaaagagaacuacaaaccacuguugaagaaaauaagagaggggccgggugcaguggcucacgccuguaaucccagcacuuugggaggcugaggcaggcagauuaccugaggucaggaguuugagaccagccuggccaacgugguuaaaccccaucucuacuaaaaauacacaaauuagccgggcgugguggcacaagccuguaaucccagcuacucgggaggcugaggcaggagaacugcuugagcaagggaggcggagguugcagugagccgagaucgugccacugcacuccagccuggccgacagagcgagacucugucucaaaagaaaaaaaaaaaggccaggcacgguggcucaugccuguaauccuagcacuuugggaggccgaggcggacggaucaugaggucaggagaucgagaccauccuggcuaacacggugaaacccugucucuacuaaaaauacaaaaaauuagccaggcaugguggcgggcgccuguagucccagcuacuagggaggcugacgcaggagaauggcgugaacccgggaggcggagcuugcaaugagccaagaucgcgccacugcacuccagccugggcgacaaagcgagacuccaucucagaaaaaaaaagaaaaaacagaaaauaagagaguacacaaacaaauggaaaagcauuccauccucguggauaggaagaaucaguaucaugaaaauggccauacugcucaaaguaacuuacagauucaaugcuauucccaacaaacuaccauugacauucuucacagaauuagaaaaaacuauuuuaaauuucauauggaaucaaagaagaucccauauagccaagacaauccuaagcaaaaagaacaaagcuggaggcaucacgcuaccugacuucaaacuacacuuacaaggcuacaguaaccaaaacagcaugguacugguaccacaacagaccuacagaccaauggagaagaacagggaccucagaaauaacaccacacaucuaccagcaucugaucuuugacaaaccugacaaaaacaagcgauggggaaaggaucuucuauucaguaaauggugcugggaaaacuggcuagccauauguagaaaacugaaacuggaccucuuccuuacaccucauacaaaaauuaacucaagaugcauuaaaaacuuaaauguaaaacccaaaaccauaaaaauccuagaagaaaaccuaggcaauaccauucaggacacagucacggccaacaacuucaugacaaaaaugccaaaagcaauagcaacaaaagccaaaauugacaaaugggaucuaauuaaacuaaagagcuucugcucagcaaaagaaacuaucaucagagugaagaggcaaccuacagaaugggagaaaauuuuugcaaucuacucaucugacaaagggcuaauauccagcauuuacaaggaacuuaaacauauuuguaagagaaaaacaaccccaucaaaaagugggcaaaggaggugaacagauaccucucaaaagaagacauuuaugaggccaauaaacaugaagaaaagcucuacgucacugaucaucagagaaaugcaaaucaaaaccacaaugagauaccaucucacgccagucagaagggugauuacuaaaaagucaggaaacaauagaugcuagcgaggcuguggagaaauaggaaggcuuuuacacuuuugcugggaguguaaauuaguucaaccauuguggaagacagcauggcgauuccucaaggaucuaacaccagaaauaccauuugacccagcaauccuguuacuggauauauacccaaaggaauauaaaucauucugcuauaaagacacacguacagguauguuuacugcagcacugcuuagaauagcaaggacauggaaccaacccaaaugcccaucaaugauggacuggauaaagaaaaugugauacauauacaccauggaauacuacgcagccauaaaaaggaaugagauccuguccuuugcagggacauggaugaagcuggaagccaucauccucagcaaacuaacaaaggaacagaaaaccaaacauugcauguucucacucauaaguggcagguaguugaacacugagaacacaugcacacagagaggggaacaacacacaccagggccuaauaggggugggagugaggggagggaacuuaaaggacgggucaauaggugcagcaaaccauggcacacguauaccuauguaacaaaucugcauguucugcauaugcauccuuuuuuuuuuuuuuuuuuuaaagaagaaauaaaggccgggagcaguggcucaugccuguaaucccagcacuuugggaggccaaggcagguggaucacaaggucaagagauggagaccauccuggccaacacggugaaaccccgucuccacuaaaaauacaaaaauuagcuaauuagcugggcaugguggcgcgugucucuagucccagcuacucgggaggcugaggcaggagaaucccuugaaccugggaggcgcagguuguggugagccgagaucgcgccacugcacuccagccuggcgacagggcaagacucuguuucaaaaaaaagaaaaaaaaagaagaagaagaaaaaagaaaacauuacauuaagugaaagaagucaggcacaaaagaccagauguaugauucuauuuauauaaaauauccugaauagacaaaucuauagaagcaaaaaguagauuacuagucaccuaggaguggggaggaagaggacugggcaaaugcuaaugaguguaggauuuauuugggggaugaugaaaauguuugaaaauugacuagcaugaccaucaaaccuguaaauauacuaaaaacuacugaaguguacauuuuaaauggugaacuaccuggcauaauuauaugguacauaaaauaauaucuuuuuucuuuugagacagggucucauucugucggccaggcuagagugcagugaugcaaucauggcucgccgcauccucaaccucccaggcucaagugauccucucgccacagccucccaaguagcugggaccacagccaugugccgccaccccuggcuaauuuuuauauuuuuuauggagacaggguuucaccauauugcucaggcugaucucgaaugccuggguucaagcaauccgcccaucuuggccucccaaagugcugagauuacaggcaugagcuacugcacccagcuauacauuauauuuuaauaaagcuuuuuuuuuuuuuuuggagacagagucuugcugucgcccaggcuggagugcaguggcgcgaucucagcucacugcaagcucugccuccuggguucacggcauucuucugcuucagccucccuaguagcugggacuacaggcgccugccaccaugcccggcuaauuuuuuuguauuuuuucuuuagagacgggguuucaccauguuagccaggauggucucgaucuccuggccucgugauccgcccgccucggccucccaaagugcugggauuacaggugugagcuacugcacccagccaauaaagcuauuuuaaaaaaauucaugauuaaaagauuuuuuuuuacaagucuucuaagaagagaauuuccuuaacuagauaaaggguauuuauuaaagacaacaggaaacauaaugcucacuggcaaaacauuccgaguucucccugugugaucggagguaagacaaugagcuggaggguccuagccaguccagugagacgagaaaaaaaacaaaagguaauuggagaaagaaaaauaauaugaagugcacagaaaaaucaaggagauucuauagaaaaaaaaaauuuugcaacuagcaaaacuuuagcacagauacuagucacaaauucauuauccaaaaaucaggcugggcauaguggcucaccugaggucaggaguucgagagcagccuggccaacauggugaaaccccaucucuacuaaaaauacaaaaauuagccaggugugguggugcaugccuguaaucccaguuacucgggaagcuaagguaggagaaucaccugagcucaggaggaggagguugcagugagcugagaucgcgccacugcucuccagccugggugagagagugagaucuccgucuaaaaaacaaacaaacaaacaaacaaacaaaaacaaaaaucaacgcauuucuauauaccagcaacaaguaaaaacuaagacuuuaacagauaccauuuacaacggcauggaaaaauaugaaauaggugguaauauaugagauggaagaccccuacagagaucacaaagaacaucuaaauagauaagcccacacccacaaauuauaggaugcaauauaaagaggacagcaccccagaaugaacugcaaguucagcucagccuuaaaaucccagcaggcaggcucuacguguuuaagaaguaaguauauaagauacauguggaagugugaagggacaagaauagccauagaugaucccggagaaagauacagugggaggguuugcuccguccgcuaacaaggcuuauaaauaaagugacaagaaccgacuuaguggguuauuagcacaucgauauguaaaugaccaaaagaacagagcacagcccagaaacacauccacagcagaagcugcagugcagaucaauggaaaaggacagucauuucaaucaacguugggugcuggacuaauugcacauccauguggaaaauuagacucccugcuucacacaaucaucaauuccacgcagacugaagauucaagugcgaaagguaaaacuguacagcuacgccaagauaacccagggaguguuccgggcaugucccucggggagacacaauaggcaccaaugauagugggcggaugaauacaccaucuauguuaaaacuaggagcuucuauucauccaugauuccaggaaaagggcugggcgcacagaucacaccuguaaucccaacacuaugggaggccaaggcaggaggaucacuugaggcuaggaguucaagaccagccugggcaauacaguaagacccccaucuccauacacaugcacaaaaauuagccaggcgugguggcagcgcaucagucccagcuacuacagagguuuaggagggaggacugcuuaagcccaggaguucaagguuaaagugagcuaugauuauaccacuagacucuagccugggugacagagugagacgcugucucaaaaaaaaaaaaaaaaaaaaaaaaaaggauuccaggaagcuaagucaaagucaaaggacaacugggagauauuuguaacugaaaaaggacugauaucuagcauuuauaauaaauaauaaaaaagacacucuuacaaaacaaugggaaaaaagagaauuuaaaagcagauuugaauauacaauucucaaagcagaaaaccaaacagcaggccgagugccauggcucacaccuguaaucccagcccuucaggaggcugaggcaagcagauugcuugaggucaggaguucaagaccagccugggcagcauggugaaacccuguagucccagcuacucaggaggcugagaugggaagaucugaggugaggaggucaaggcugcagugagucacgauggugccacugcacuccagccugguugacagcgccagacccugucucaaacaaaacacaaacacaaaaacaaaacacucugaaaaauaauuuggcaugauccuaugauccucacaauuccacuccuagauguuauacccuagagaaauccaagauuccaaacaccugaacauaugaccguaauguaguaacgggaugauuuacaagagcacaaaagcuaagcgugucacuguggcagaauggauaaagugccucgugcucacagacaggaauaccacgcagcagugaaaauuaaacugcagucagcugcaacguggaugaaacugucacggcgucgaccaaaaagacacaugcacgccacacacaaaauacacuaugauaccaucacacuaacuccaaauccggcaaccaagcugugccauuuaggggugcauaaauaauugcucacaccggggagauggcacagaaaugauuaccuuuccaaaaugaggaaggggaaaggaagaaggccgugauuaccagugggaggcuuccaaggaacaggcaugguucuacuucuccaccuguguaaggaucacaggaguggcucgcgaugcuauuauuauucguuaaacugaacaaaaaugcacuuuuccauacaugucauaucucaaucaaaagcaauuacaaccuauaauagcuaauaauacaucaguagccaggaacguuuaaacaaccauggggcuucaauagucugcaaaacuacucgguuuauuucgcacggaaagcgauacaauauaaaguuuaggaaaaaagaaaacaaaccucacacacccacuuauuggaaugacgcaaaacggcguguagaaaagaguaaaacggacacagagcgcuccggacggccggggucuuugcgaggugagaacaagaaaauccagucagcggacacuggagcuaccgagcccaggccgccccuuccucacgcggggguuucucucgggauccccgcccucgcccaggucaccagggcugcguccccgacgggaaaccccgaugggagaccccgcuggggccggcgcacccccgcuccaagagucggucgcuucggcacggugggggauuaggguggugaggaccgaaggcgggggaggcgggggcggguggggaugaguacccgggggcccagggaggggagugaggaccugggggucguagcgagaacccggggcccggcggggaggagauugaggaucccaggggaggugaaaacuuggguaggggugaggacgaaaaguagggaggugaggacccuagugggggauucccagggggcgaggaggggcgggggguccugaagacccacgguggggaugagaaccgaggugggagaugaggaucgaggcgggggaugaggacccagggggaggugaggacuggagggagguauucggaggagcgaggagggggcgugagggcgggccggggggguuaacagucugaagggggaugggaagguugggggagggagcgaggaggguccggaguugggugugcgggucggaggugggaagguugggaaucugggggccgcggggcgccacgccugccuuaccucguccaccgugcggcgcgggaggugcagcgucccgaguagcaacuugagcuucacugccgacgagaggccauggaagcagagacggauguugucgaugaccgcggccgugagcagggacgcgaugcugggcggcgcccacagcucguccguggcccccagcuuguugugcagccacaggcccgugucgcucucccgcauggacgccaucuugggggaaagcgcgcgccgcugccccggcaucuuaugaagacaccuacgcgucccucgcuaggaccccaacauggcggcgcccgucgggcugcgggccgcagaggcggcgcagguggcgcggucccacgagcggggcuucccgggagagcgcuucuggguggcgaccgcgucuccggguagcggccgcgucuucgggaagcuuuguggcaaagccgagagccggaaggacggggugccgcugagcaaggacuaucggcuuccguaaaacaucau

SEQ ID NO: 191464 - RNA, 46407 nt, Homo sapiens
agaaguuaggaggucugcgucugggucucggcucacccuggggggccgcggccauggggcuuaguuccuagccuaggaagggaaacugagacucugggaggggcaggaacgcccccaaggucacuuggaaagucgggcaggaugugcuguuagggggaagacccgggcaggguuuuuguuccccgcugacgacgccuccuuuguguguucgcgccgccgccccgccaucguggggccugcgaguuugccggggugcgugggccgcguggcggggccuuuuguaggucgggaggaucugaguacgggugcgggccugaccgugggggcgccgaggucgcagucuaaaacuuaguagggccucgauuuccgggcgcgcuuccgggccccggcuggugguugguggaacgugcgacugugaggcuugcggcccagcccugcaccgcucgggcccuucaccgcucuggcgcgccuauagacagguguaugaagauucucacgacccgaaacagaguugcuaguaaacaccgcuuuuccgccuuugauccaucgagggaagagggaaaaggauagagcuugggcaagccguuuugguagggauuucagcuuuugucuuucacuugucaguucccauagacguucacaaacuuaauaaucuucguucuguuucugcaccaaguucuugagccagacguagggucucagcucuggagccuggcuuagacuguccaacugacuggggagacugagguccagaaaagugaaguggucugcccaaggucacauagccagcuauuuggcagcagaugagguuaaguccuaccugcaagauuuggguuuugaauucauugaccaggaguuuugggaccacugucaauaaaagagacauugaagggaaucuuuuguuacuuucuuggugauuugcuuuuuaauggacaaggacauauuggguucaguuuuaucugugaguuugaggugaaauagaggcauucgaguagcaagauauauugcuggcuuuuguauugccugaauuugagcuuccaaaaaucuuacuuuaacacaucguuuauugaucuuuucuugaauuacuaccuuuguaaggaccuuuuguaaacauuguuuuucuaaucuucaugaaaucuuaaugccauacguaaacuauuucuuuuuauauaauguaugcacaucugugcuuuguacauaaaaugaguaagauuuuucacucuccucaagaucaaaguagcguauuuuugaggucuccuguaugccaaccuuucugcuuggaauacagcaguaaacagucgugguccuccuguagcugggugaggauggagggaauaagagauaacucauuuuauuguguuuugcaaauacugccuuuuuuuuuuugcaaggugaagguuuauagcaaggauucaucgagcaagucuguaaaugccagccauuuuuccaacagcaugugcucacuuugugucucuugugucacguuuggguaauucacaauauuucacacuuuuuuuuuuuuuuuuuuuuugagguggaaucucacucugucacccaggaugcagugcacuggcguguucucggucucacuguaaccucugccaucugggcucaagugauucuccugccucagccuccggaguagcugggauuacaggcauguacuaccacacccaguuaauuuuuguauuuuuaguggagacgggguuucaccauauuggccaggcuggucucgaacgccugaccucaagugauccgccugccucggccucccaaagugcugggauuacaggcaugagccaccaugcccagccccaaaccuuuucauuguuacaucuguuauagugaccugugaucaauguuuuggguuaccaugaauagcacucauauaagacagugaacuuaauugguaaaaguuggguguguacuaacagcuccacugacuggcaguucccagucucucuccucaggccucucaauuccuugagacacaauauugaaauuaggccagucagugacccuacaguguccaggcaaaaggagcagucaguugaaucucucuuacuuuaagugaaguuaagaaauguuuauccuuagugagaaaggcguaucaaaaguugagauaggccaaaagcuaggccucuugugcugaaugacaguuagccaaguugugaaugcagaggaagaguucuugaaauuaaaaugcuacuccaaugaauacaugaaugauaagccaaacagccuuauugcugauagggagaaaguuuuaguggucuggauagaagaucaaaccauccaugacauucccuuaagcgaaagccuaauccggagcaagguacuaacucucuucaauucugugaagagugaggaagcugcagaagaaaaguuugaaacuggcagagguuaguucaugagguuuaagggaagaagccaccucuguaauguaaaaguguaaggugaggcaguaaguguugaugaagaagcugcagcaaguuaugcagaacauauagcuaaaauaauugaugaagguggccacacuaaacaacagacuuucaauguaaaugaaacagccuuauauggaaaaaaaaauacuaucuaggacuuucauagcuagagaaaggucaaugccuggcuucaaaggacagucugauucucuuguuaggggcuaguguggccagugacuuaaguuguaacuagugcucauuuaccauucugaaaauccuagggcccuuaagaaguaugcaaaaaucuacugugugcugaucauugaaacaggaaagccuguauaguagcauaucuguuuacaguauguuuuacugaauauuuuaagcccacuauugagaucuacagcucagaaaaaaagauuucuuucaaaauauuacugcucauugagaaugugcuuagucaccaaagaggucucauggagaugaguaagauuaauguuaacaucuguucugcagcccauggaucaaggaguaauuucaacucucaaaucuuacuuaagaaaugcaucuugaggcugagcacaguggcucaugccuguacucgcagcacuucgggaggccaaagcugguggaucgcuugagcucaggaguuagagaccagccggggcagcauagugagaccacccccuccacugccagucucuuaaaaaaaaaaaaaaaaaagggcggcagggggaaagaaagaaaugcauuuuguaaggcuacagcuacauagauugugauucuucugauggguaucaacaauguaaauuaaaaaccuccugaaaggauauacuauucuagauaccauuaagaauauuugucuccaggcacgguggcucacccguguaaucccagcacuuugggaggcgaagugggcggaucacaaggucaggagaucgagaccauccuggcuaacauggugaaaccccaucucuacuaaaaauacaaaaaauuagccggucuuggcagcgggcaccuguagucccagcuacucgggaggcugaggcaggagaauggugugaacccgggaagaggagcuugcagugagccaagauagcaccacugcacuccagccugggcaacagagcgagacuccaucucaaaaaagaaaaaaaaaaagaauauuugugauucaugggaggaggucaaaauaucaacaucagcaguucacgguggcucacgccuguaaucccagcacuuugggaggcuggggcaggcagaucaccugaggucaggaguuugagaccagccugcccaacauggugaaaccccgucucuaccaacaaaauacaaaaauuagccaggcaugguggcacgcuccuguagucccagcuacuugaggagcugagguagguuaaucgcuugggcccaggagguggaggcugcagugagccgagauugugccucugcacuacagccugggcaacagugagauuccgucuuaaaaaaaaaaaucaauuaacacaacaagaacuuggaaaaaguugauucugacccucaugggugacuuugagggguucuagacuucaauggaaaaaguaacuguagaugugguggaaauagcaagagaacuagaauuagaaguagagccuggccgggccugguggcucacgccuguaaucucagcacuuugggaggccuaggcggguggauuacgaggucaggaguucacaaccagccuggccagauggugaaaccccgucucuacuaaaaauacaaaaaauuagcagggcgugguggcgcacgccuguaauccuagcuacucuggaagcugaggcagagaauugcuuaaaccuggaggggcagagguuguggugagccgagaucacacuacugcacuccagccugggcgacagagcgagacucugucuagaaaaaaaaaaguagagccugaaggcugggccugauggaucaccugaggucaggaguuggagaccagccuggccaacaugauaaaaccuugucucuacuaaaaauacaaaaauuagcugagcgugguagugggauuguuacugcauaguaaucccggccacuccagaggcugaggcaggagaauugcuugaacccaggaagcagagguugcagugagccaagaucgggccacugcacucaagcguggacaauagagugagacuuugucucaaaaaaauaaaagggccaggcaagguggcucacaccuguaaucccagcacuuugggaggccaaggcaggcggaucacgaggucaggagauugaaaccauccuggcuaacacggugaaacaccgucucuacuaaaaacacacaaaaaaauuagccaggugugguggcacgcaccuguaaucgcagcuacucaggaggcugaggcaggagaaucgcuugaacccaggaggcagagguugcagcgagccgaaaucacgccauugcacuccauccagccugguugacagaacgagacucugucucaaaaaaaaaaaaaaaaaaaguagaaccugaagaugugacugaauugcugcaauuuuuaaauaaaacuugaacacauggagaguugcuuccuguggacaggcaaagaaagugguuucuugagguggaauuuacugcugaaggugcagugaacauuguugagauuauaacaaaggauuuagaauauuuuauaaacuuaguuaauaaaacaguggcaggguuugaaaggauugacuccaauuuugaaagaaguuccacuguggguaaaaugcugucacacagcauugcacgcuacagagaaaucuuucaugaaaggaagagacaacugaugcagcaaacuucauuuuaagaaauugucacaguuggcccagugcgguggcucacgccuguaaucccagcacuuuaggaggccgaggcaggcggaucaccucagguugggacuuccagaccagccuggccaacauggagaaaccccgucucgacuaaaaauacaaaaaaauuagcugggcgugguggggcaugccuguaaucccagcuacucgggaagcugagacaggagaauugcuugaaccagggaggcagagguugcggugagccaagauugcgccguuguacuccagccugggcaacaagagugaaacuccaucucaaaaaaagaaaaagaaaaacugucacagcugccccaaccuucauuagccacugcccugauccaugagcagccaucaucagggcaagacccuucaccagcaaaaauauuacaacuuugugaagacucaaaugaucauuagcauuuuuuauuuauuuuuuaagagaauaucucccuguugccccaguuggagugcauuggugcgaucguaacucacugcagcuuccaacuucuggguucaagagauccucucaccucagccucccaaguagcuggggcuacaggcgcacgccaccgcaccuggcuuuuuguuuguuuguuuguuuguuuuugagauguagucucacucugccgcccaggcuggugugcaguggcgcgaucucggcucauugcaagcuccgccucccagguucacgccauucuccugccucagccucccggguagcugggacuacaggcacgugccaccaugcccagcuaauuuuuuguauuuuuaguagagauaggguuucaccguguuugccaggauggucucgaucuccugaccucaagauccacccgccucagccucccaaagugcugggauuacaggcgugagccaccucgccuggcccacaccuggcuaauuuuuaacaaaguuuuguagacugggucuugcccuuuuguccaggcuggucucagacuccagacucaugauuuaauaucuaugguugagugauucccuacuucuuacucucuuacagaaccacucuauaagauaguuguuguaguuagccccauuuuacucuuccugaggcacugggagaucagggucacuugcccaaggucacacaauuaguaagcagagcucgaaacuucaccccaccccugacuccuaccuuuguuccuuuuguuaggcuuuguuaugucaucugcuuuuuuuguguggugggaaagcacauggccaauguuucuagaaacuucaaauaguaaaaacaaaauaguaucuuuauuuuugcuuucaccgcagaggagucugauaauuauccucaagaaaauuuauugauucucaguaacuguauuguauuccucaaaguuauuuuuccuaaguuuucuccucucaccagcuaagggaaguuguccuagggccuaggcauuucccugucugccacaccucaccucuuacuuuagccaaacuacugcuaaauucugcuccuaaauauggcagcauucuguguuaccugcacuaaaauuugcuucccuuguaaguaccuucuugaugucuuccaguguugguucucgccuccuacucuugcaaguugaaaaguugaaaaugccucagguagaaauguucucuccuauucucccaucaugaucaucuguguuuuuuuguuuuuuguuuguuuuuugagacggagucuugcucugucacccaggcuggaguacaguggcacgaucucagcacugcaaccucugccucccggguucaagcaauucuccugccucagccuccuaaggaccugggauuacaggcaugugccaccacggcuggcuaauuuuuuguaucuuuacuagagaugggguuucaccauguuggccagccugucucgaacuccugaccuugugauccacccaccucggccucccaaagugcugggauuacaggugugagccaccacguccagcccuuuucuuucuuucuuuuuuuuuuuuuuuuaauuuaagagaagguugucuuccuauguuucccgggcaggagugcaguggcuauuugcaggugcaauuauauagcacaguacagccuaaaacuuuuuuuuuuuuuuaaagacagaaucuuguucuuucucaacucacuucaaccuccaccuccuggguucaagugauucaccugucucagccucccgaguagcugggauuacaggugggcagcaccacgucuagcucauuuuuguauuuuuauuagagacaggguuucacuauguuggccagccuggucuugaacuccugacuucaggugaucugcccgccucagccucccaaagugcugggauuauaagcaugagccaccaugcccugccuacagccucaaacuuuaagcuaaauuaauccucuugccucagugucccaaguaaaugggaauacaggugcugauaugguuuggcuguguccccacccaaaucucacauugaauuccuacauguugugggagggacccagugggaggcaauugaaucuugggggcaggucuuucccaugcuguucucaugauggugaauaagucucaagagaucugaugcuuuaggucgggggcgguggcugaugccuguaaucccagcacuuugggaggccaaggcgggcggaucacgagguuaggaguucaagaugaguguggccaacauagugaaacccugucucuacuaaaaauacaaaaauuagcuggacauggugguacaugccuguaguuccagcuacuugggaggcugaggcaggagaauugcuugaacccaggagguggagauuacagugagccgagaucaugccacugcacuccagcuuggacaacagaguagacuuaaucuaaaaaaacaaaagagaucugaugcuuuuauaagggggaguuucccuacacaagcucucuuugccugcugccaucuauguaaggcaugacuuacuugcuucuccuugccuuccgccaugauugugaagccuccccggccauuuggaacuggcuuuuguaaacuucuugcuuuuguaaauugcccagucucagguaugucuuuauuagcaucgugaaaacauacugguacaguaaguugguaccaguagagugcgaugcugcugaaaagauaccugaaaauuuggaaacagcuuugcaacuggguagcaggcagggauuggaacaguuuggagggcucagaagaagacaggaaaaugugggaaaguuuggaacucgcuagagacuuguugaauggcuuugaccaaaauguugauaaggauauggacaaugaaauccaggcugagauggucucagauggagaugaggaacuuguugggaacuggagcaagggucacuccuguuauguuucagcaaagagacuagccgcauuuugccccugcccuagagauuuguggaacuuugaacuugagaaagaugauuuaggguaucuggcagaauaaauuucuaagcagcaaagcauucaagagaugacuuggguacaguuaaaggcauucaguuuuauaagggaagcagagcauaaaaguuuggaaaauuugcagccuccugucaaugugcuagaaaauaaaauuccauuuucugaggggaaauuaaagccagcugcagagauuugcauaaguaacagggagccaaacguuaauccccaagacaguggggggaaaugucuccagggcaugucacaggccuucauggcagccccucccaucauaggcccagaugcccaggaggaaaauaugguuuccugggcugggcccaggguuccccugcugugugcagccuaggggccuggugcccugcguuccagccgucucagcuguggccaaaaggggccaacauagaguagaacucaggcugugguuucagaaggugcaggccccaaaccuuggcagcuuccacaugguguugagccugcgagugcgcagaagucaacaaugaggguuugggaaccuccacuagauuucagaggaugcauggaaacaccuggaugcccaggcagaaguuugcugcaggggcgggacacucauggagaaccuccgcuagggcaguguggaagggaaaugugggguuggagcccccaagcagagucccuacuggagcaccaccugguagagcugugggaagagggccacuguccuccacaccccagaaugauagauccacugacagcuugcccuguacaccuggaaaagcugcagacacucaacaccacccagugaaaacagccgggagggaggcuguacucugcaaagccacagggguggagcugccuaaggccaugggaacucaccucuuggaucagcgugaccuggaugugagacauggagucaaaggagaucauuuuggagcuuugagauuuggacugcucugcuggauuucggacuugcauggggccuguagccccuuuguuuuggccaauuucucccauuuggaauggcuguauuuacccaaugccugcacccccguuguaucuaagaaguaacuaaauugcuuuugauuuacaggcucauagguggaagggacuugccuugucucggaugagacuuuggacuuuugaguuaaugcugaaaugaguuaagacuuugggacugugggaaggcaugauuuauuuuaaaaugugaggacauaagauuugggaggggccagggguggaaugauaugguuuggcugugucccccacccagaucucaucuugaauuuccacaugugggagggacccggugggagguaauugaaucaugggggcaggucuuucccauguucuggugauggugaauaagucucaugagaucugauaguuuuauaagggggaguuuccgugcacaagcucucuuugccugccgccauccacguaagacgggacuuacuccuccuugccuuccaccuugauugugaggcuuccccagccauguggaacuguuaaguucauuaaaccucuuucuuuuguaaauuggccagucucaaguaugucugucucagcagcgugaaaacggacuaauacaggugcacacggcuguacugucccccguccugcuuuuaaggcuuucuuuguuuccuaauugugacuguuuuuacuugcaauguaaaggcuucauuucccccaucucugaaauuauuuuuuucucuuucaaaaacacucugccaucuuuucaagguauccgccaucucuuucaagcaugugaggagcuugauaacuuuuguugggggucgguguucagaaugacaagggucuugcccaggcuggagugcaguagcacagucauaacucacucuagccucaaccucccagggcacaagcgauccucccaucuuagccuccugaguaacugggacuacaggcacgugccaccacacccugcuaauuuuuuuuuuucuuugguauuaauauuuuguagagaaggaguuucaccauguugcccaggcugguccagaacuccugggcucaagcaauccugccuuggcuucccaaagugcugggauuacaggcaugagccaccaugccuggcccuagagcuugauaauuucauucauucauucuuuuuuuuuuuuuuuuuugagacaaagucucagucugucacccagguuggagugcaauggcgcaaucuuggcucacugcaacuucugccucccgaguucaagggguucuccugccucagccuccugaguggcagggauuacagaugcccaccaccaugccuggcuaauuuuuguauuuuuaguagaggugggguuucaccauguuggccagguuggucucaaacucccaaccucagguaaucugcccaccuuggccucccagagugcugggauuacaggugugagcucagaccuugauaauuucagugaggaaaaaaaaaaaaucucauuuacauguuugugccaagugcugugcuaguggguggggacaccaugauaaguauuugauaaguuauguuucuugauuuaagggaguauagaagaaaugguuaagucaggacuaggaggagugagagaaauggaagcaaccuuugagguaggcccugaagaacgagcagaaauucccuaaagcggggugggagcggcaggaccaaccuggccaacuucggaccuucuuugagguccaaagucagguacuuugaacugacuuccaggauaccuggaguaaaguacaguucuguuugaaguguuuguuuggaaagaugaguuuguuccagugagguugcuguauuagagaaccacuugagaguuugcugcccacagugucaucugugagaaauauuaggugaacgcaaaaaguugaggccagcugaaccaagccauguaauauacacaccuuccacauagaucagucaccucaguugacuuguaugugagccacauuuguguccaucugauguuacagcauucacucucuuugccuccacuucucaauaacucacaaucuguaaacugacugaggcccgcuuccacagagcaagcuucaggccuuuuucaagguaaaguaucacaguuacuuguauuucuuaaccauuucucauguguagagcuuuacuaccauuuucacuagauuguuuugugugugugugucacugacaacauuuuucaguguugugcccuaauuccauuuuuccucacaaaugguggguuuuugcauagcaagaugcuuuuuuauuuuuuuuaaggaacacauauguccguaacugcaaaugaacccagaaaagugaggacgaguugggaggggagguugguaugauauaaagacuuugaccuauguucuguaggcaaugcuugugauuauuugggagcaauacuugcaauauucuuggauauuuuggagccuggugauucuuagcauuaccuuguggcgcuuuucaguuccuuggaccuccuccuccugcucucuucugccuuucugucuccuucagagcauuccuguugugcgugccugcuuuuaucuucccugggagccagugauuuuuuugacuugcauguguguuuuuguguuuuuuuaaagacagagucucgcucuaucaccgaggcaggagugcaguggcauggucagggcucacugcagcuucaaccucccagucucaagcgagccucccaccucagccucccaaguagcugggacuacagucguacaccacuaugcccggcuaaguuuuuguauuuuuuuguagagacaggauuuccccauguugcccaggcugggacacugauuuguuagucuacuuucuagguaaaguguugaaggagaguugaagagggccuagauuagggcuucugggugcuggauuucuccaccaagaugcaagccccuagagaguugaguuuggcuagcccuuuggugacagcuuguauugucccuuagcccacagaugcaucugacuaagaguagaagaacaugucucucuuuaggagcccggagccagagacagugcuguuugagauuaggcccccucuggugugcccuucgagaauucccauuguggggcacugcucaguugcucccaucugguaugggucaaauaaucagauuugugagugucucacaaccaucccuguaccccagccaacccuggguucugaauacaguagaggcagcuaagcugcuagcuggucuccagcaggcucugugcucaguggccaucaacaccagguagcuuggcaagccugccuccugugcugacugugggcccuggggaagugucgaggauguugacggccucuagcaucugagguacaucugccccucggccuccggaggaguggauccuuagguuuccuucauuaucuuacccuuucuccuggcucccagaaauuaccuuguuuuuauaugaggccccaaagccuaggccaucuuggcugauagaugugaaagcccuuugcuccuuucaggccccuggggauuuugguuguagccugauugcugguggcagcuuaaucggggccauaagauaauuuuauggaagaccugguuacuuggcaucugaacaagccucauugccucucugagcauagucugcugcuuucugcuuugaucaaauucauuccucuugucccugcaaaccuucaggggaggccaauguucaaggccccugagccuuaggaauaaauaacucugggugagaacugccugucauuggcugugugccggcuuucuucaaccuccucugaguccuguucuaagucuaagccguugugauuagcuacauccugccaagucuguucuggaaaugaauaaagcccuugcugagagccggaaacauugguuccaguuccuccuggggugaagguuuguuuugccuuuauuuaauagcacucauaccuguaagaagggacaugcucuccagcccuucugauauaauaccuauuuauuacuugauuuguugaucaucuuuccagcuaggauauaugcuccauggguaguuuuuuguugcuguuucccaucccauuccuagccccuggagcagugccuuacccagacuaggcaccugugaauaguuagcaaauuaguugauagagcugccuucugggugcuaggaaccauacuggguguuucauucagcggucacugguuccacagaggugagguguucuacucaauuaaagauguggacacugaggcacagaaggcaaguauuuguccaaggcuguagggcuuauuggccagccacaucauugcugaccgcuuaaccacauacccucauuuguauaaugagcaagaggcucauauuucuucugaguauuaaggugugguuauugauaugacugaggguaucaaaguucuguuuaagagguguuugugaacaggugcgguggcucacaccuauaaucccagcacuuugggaagucaaggugggcagaucacuugaggucaggaguuggagaccagccuggccaacauggcaaagccccaucucuacuaaaaauacaaaaauuagccgggcauggugguggguuccuguaaucccagcuaguugggaggcugaggcacaagaauugcuugaaccugggagguggaggcugcagucagccaagaucacaccacugcacuccagccugggugacagaacaagacugugucucaaaaaaaaauuauuuguuuuuauugauuuuuauuuauuuauuuauuuugagacugaguuucacuuguugcgcaggcuggagugcaauggugcgaucucggcucaccuccaccucuuggguucgagcgauucuccugccucagguucccgaguagcugggauuacaggcgcccaccaccacacccagcuaauuguuguauuuuuaguaggggguggguuucaccauauuguucaggcuggucucgaacuccuggccucaggugauccccccccgccucggccucccaaagugcugggauuacaggugugagccaccaugccugacccaggucucuuauuuucaguggguaauuguaucagacucugccucccaggugggguuugaggguucuguguaccugguguaggccuaggcuaaacagaagagcuucucguuagagcaucucccuguggacuggcugcagaguuacgauaucauucugguucugcugugcuccccacugccccuuuucagcugacucuuugcucauaggaauacagugguaugagauagggucauagaauuugguuccagucuaacacucuuccuguuuccugcccgccuguaugucucuauccauuagcagacuccuuuauguaugauagagacacaugcacauaugcauacacggacagucccugacuuacaguguuucauuuagaauuuuucaacuuaugauuuauugggaguuagccccauuguacgucaaggagcaucugcacaucguauacauauauaccaugaauacacauaauuauaugucacacuccugcuagaguggggggggucaauaucugaagugcuuauaauagcuuuauugggggggaccucuaagaaaaacagaauaauuacuuagaccuuaaauaauaaaucuauaagaaugaagaaagccccaaagcccuuccagcuuccaucccgucagucaccucucuguccuauacucugccacuaccccgagccucauggcuuucuucucaccugggcuacccugagucuccuccuuggucuacagucugacuuguucagucucccaucuguucucaccagacacaggugacauggucucuaaaugcagaucucaacaugucaucucugucccaaaacccucgauggcccuguccugaggguguagucagugaggcuuguuaggaacccucggcaccuuuguuguccuccacacagugcucgugugggacaucccugcucccuuccgcccaccccacccacauacauuguuucuuaauuaacuccuccugucacuugaggccccauucagcacugcuuccucuagacagcccggcuugauccucagcgcguuugggcugggacugcgacuccuuugcugcugcuuccacuugcuuaggucaccagcgucccacuuccguguuugagcucacuggccgccuuucaguuccccagccugugcauugcagcuguucacugcuuccuccuccuugaagaaggagguuuugucugagugacggcuccagguucuccuagcuuuguuucuuuuaaauucucuuuuacagauucuaucuaccugccuccccaaguuuucacacauucugaaaucucuacguccauccgaguucucacucuugaguuuccagcuaccuugggcccuuucucccugggugucucacacccugcuuuucuaaaacuacacucagcaccuguuucuguucucccuucccucauuggguuuuauggccucauucuugcagaguaagaagcuagauaccuuggcgugaguuguuucuccuuucaccuuggaagcuuuaggaauaccuagcauccggcucuccugaccauccccaguuaggaaugaccacuucucuaccccagcuccucuuuucucaguggcaggggcgccaucaacaccccacucuuacccucauuuauuccuucaauaaauaugagcaucugcuuuguguaaggucuuagcuagguagaaaguaaauagagccuuguccucguagcgcuuaccuaagugagagcauacuggacgagagacuggaggaugguggggcccuuucuugaaauggaguauauguuggcggaaggaggaggcaaggguuccuuuuggaacacacuaaauuugagaaaucugaaaaaucaccgucaguguucccgcuaguuucuggaauugauguauuugauucuggcacuaacauaccuauuugagggugugggucuugguaucagacugcccugguuuaagucuaggcucuguuuacuagguguggaugacuuuggggaaguuccuuaacuuuaauccuuagcugcuucauggguaaaauggggaacauaacagugcuuauuuccuuacugggugaugugaggagcacauguggugauauuaauauuuaggaagcgcagugccuugugcagaugcagagaaggcaccucucagcuguuguuaguuuucuuauuccauuggacucucaccugcaugauccagaacccuuuguaguuggugagggcuacuuucccaugaccgcuaaggucuccauucacucugcauuucuacguccccaccacgcugggaugcucugcuggaaaugcuccugucucaccucagugcccuggugaaauccagccucuugguggcuuauccccaagaccagccuuccaaauuccuuugaacucugacuccugacccuuacuaaacccaaaagagagagaaaaaccagauuuggggugaauugcuguaugggccagggcauggagaaugagggggcuccagaaagcuucccagggaaguaguaauggucuagcugggccugcagggaugcaggaggcugguuucagaguggugaggggugugcaggccaggacagccacaaggcacaucuucagcagccguauuuggaagccucaauaucagugaagugggaggagagaggcuuaggaacagccuggguguggacaucagguguuucccuuugcucugcaggcugauuucucugucuuccuuugucaguagcuucucuuuucuaaauucuaagacacgcuauugauguggcggggagaacaagccccuauaugauagaugugcacccaaauguaagauauuucuugagaucagaaacauucguggauaugagaacccaggacaugugguggaucugggacugucguguggucugaaugaucuugugaguccuaaggugaugucgaggcaccucccaccucuguugaaaccaacuagacaagucuuuuccuagccagagccucuucccugaaugucuguuuaaaguugaacacuuaccaggugagguguugcuuugagaagcauuugugcuccgggcuggagugcaauggugcagucauggcucacugcagucuugaccuccugggcucaggugauccuccugucucagccccuggaguagcugggacuacaagugugcaccgucacaucuggcuauuuuuuuaauguguuuuuauuuuuauuuuuugagacagagucucucucuguuggccaggcuggagugcaguggugccaucuuggcucauugcaaccuccgccucccggguucaagugauucuugugccuuagccuccuacguagcugggauuauaggcgcacaccaccacacccggcuaauuuuuauauuuuuaguagagacgggguuucgccauguuggccaagcuggucuugaacuccugaucucaagugaucugccugccucagccucccagagugcugggauuacaggcaugagccacugcccagccucauuauuuuaauuuuuuuauagagacaggaucucaccauguuaaccaagcuaguuuccaauuccugggcucaagagauccucccucuucaacuucccaaagugcugggguuauagggcaugagccacugugccugccccauuugugcauucuguugagagcacccguagucccauaguaugggccagccuaaggagaugcaagucacccuuuauuagagugaaacagugaaggggauuuccccucuaaaccauugaggucaagcuagagaaugaggcgcucagggagugagauacaguaugccauuuucucagaaccagacgaccaagugcugaagaaaaugcucagcucagcugggacggcggucccuuugggcaucuccugaaaaaccuacucuggccucccuuucuccuccuguacuucuugcacacuuaguuccuaacuucguuauagcugccugccagcacccuccucacccuucuccccgcccuagauucugcacagaggcuguguuugcucauugcuguauucccagggcaggggcuguacugugaaugaggcggggagguaugcauccuuucuuaaagcugggugggaggacagacgugguggcucaugccuguaaucccagcacuuugggaagccgaggcaaguggaucaccugaggucagaaguucgagaccagccuggccaaccugguggaaaccccaucucuacuaaaaguagaaaaauuagccuggugugguggcacaugccuguagucccagcuacugggaggcugaggcaggagaaucacuugaaccugggagguggagguugcagugagcccacugcacuccagucugggcaacagagugagacuccgucucaaaaacaacaacaacaacaacaaaaaaaaacugagugggaugugauaucacacagcauuuuagggcuugagcagaagguuggagcuggucacugggaagguuuauuuggagagacugccaaccuggugcuguggggcugaguguggugauggguaugugucagcccacagacacugagccuuuccagugugccugcacuguuccaaacacucucuuguaauaacuucuggaauccucacacaccauuaagguaggugcaguucuguucuauagauaaggaaauggggcacagagaaguucaaugccaugccccaaggucacagguugggguuugcaggugccuggauuuuauuuucauuuuuuauuuauuuauuuauuuuuuugagauggaguuuugcucucguuguccaggguggaguguaauggcaugaucucggcuccucugccucccagguucaagagauucuccugccucagccucccaaguagcuggaauuacaggcauccaccaccacuccaggcuaauuuuuuguauuuucuaguagagacgggguuucaccauauuggccaggcuagucucaaacuccugaccucaggugauccacccgccuuggccucccagagugcugggauuacaggugugagcuacuacacccggccgaugccuggauuucaaucucaguugccuggcucaagagaugugcccuaauugcagugccagccuggcuccacacaccaugcuuaggaguuaggccuugauaaggagccagggaaaguugcugcggcaaauguuucggaaagauggccuggcaguaggguagacgggcacccagggacaggagacccagcaugagcaggcaugguaauggugcacaggaggaugacacggcacagcacuggggaugcacagaaggguggaugugagagcguuccugucguuuccgccaccuggaucccucucaccugugucuguuuugcaacuccaucucguuaugcuacuucaguacguuccaugguguggucucuggaagcagcaccugggaacuuguuagauacguaaauuggagggccuagcaggcugugcuuaacgagcccucugugggggagccugauacaggcucaugcuugagaagcacucuccuaaucuaagccacuagcacccagcaguggguggccacaagggucuuguccuugcuuuggcucucucucaacccucaggcuugccugugcucagggcuuuguggcuccauuaaccaugcgucgcugacgcugaguuuaccguggucggccucgcuucucagugaaguccaagggccucgcagccucugcaucuggugauuucucugccuuuccucaaagcuucugcuuggcugccuaguccacagccucccgauucaccauucaccuggucccagcaacagaagucucagcuggacacacaacaugcuuuagagugaguggcucuugucuucucaacuccggacggcgacagugaaauugugggaagaaccugaggcucugagcuguggccucagaagcucugucccuucccuucugguuccugaggaguugguguggucauguguggcaguccugacucgcaccuccucccagcaguuagcacgguaccuugccaagguggcaggagccaggaagaagaguaggagguggcauaauaauuacaauugcaggcuuugggaucaggaaguccuacaugcgacaagaaugcuuacuuccuaagaugaauauaggauuaaggaugucauugcgugaaauaguaagcaaauaaccuagggacaggaaggaccaguacauuauugagcucagcuuuguuucaaugauguaaguggcaguauuuaucaaauuaauaucuuuguuuuucaggacuugaaaauacuggaaaucuguccggauccaaauuauuuugcaagccagaugaguaaccagagggcaugaaagguugagaacauuugacuucccugcaaaccuugguauagaucacuuccuuuucuguaggaaaggaaaggcaccaaagagcacaaugaguacaguaaguuuuaucaucucuugaauuuuuaauuuuguagggcuaauuaacuaccuuauuccuuguagcacauuagugaaagugaguuccauaaugucacuucuaaguaaccccacuucuugaaggaguauguauaggagcuuucuggugguuacaucagcuuacuuaccgacauugagcuacauucgagucauaaagggcagagcccugaagacaaaaggcugagaaggaauagcuuaggguuugguaaucucagaccuucacaacaguugucagugucauagaaauacuaaaacuuuuugcuuuuuaaaauuguuuguagacugggcaugguggcucauguguaaucucaacacuuggaggcgugaagguaaaaagauuacuugagccuaggaccagccagggcaacauaggccccaucucuacaaacaaacaaaauguagccaggcgugguggggcgcaccuguagucccagcuacuugggaggcugaggcaggaagauuccuugagcccaagaguucaaggcuagcuaugaucacaccacugcauuucggcaggaugacugagugagacucuauaaaguauuugcaacccaguuuucuguuuucccgucuguuuuguuucccugugacauucuugguucauucagugugagcaugguaguaauaauccauagugaaaaguuucuuauauucacugaccaaaguugauucgucauuauaauuacuguuuagcgcuuuuguuuguuuguuuuugaaacagggucucgcucugucacccagccuggagugcaguggcccgaccucggcucacugcaaccuccacguucuggguucaagugauucuugugccucagccucccacauagcugcgauuacaggcaugcaccuccccgcccagcuaauuuuguauuuuuaauagagaccaguuuuugccauguuggccaggcuauuuugguuuguuuuuugagauggagucuguugcccagguuggaguacagugguaccaucucggcuugcugcaaccuccgccucccagguucaagcgacucuccugccucagccuccggaguagcuuggauuacaggcaccuaccaccacacccagcugauuuuguauuuuuaguagagaugugauuucaccauguuggccaggcuggucucaaacuccugaccucaagugaucuuggccucccaaagugcuaggaugacaggcaugagccaccgcacccagccguuuuuauuuguuuuuaagagacagggucucacucagucucccagucuggagugcaguggugugaucauagcucacugcagucuccaacuccuggagucaagcaauccuuucaccucagcauccugaguaguugggaucauaggcaugcaccaccgcaccuggccaauuuuuaagaaaaaauuggccaggugcgguggcuuaugccuguaaucccagcacuuugggaggccgaggugggcggaucacgaggucaggagaucaagaccauccuggcuaacacggugaaaccccgucucuacuaaaaauacaaaaaauuagccaggcauaguuggcgggcgccuguagucccagcuacucaggaggcugaggcaggagaauggcaugaaccugggaggcggagcuugcagugagcugagaucgugccacugcaguccagccugggggcagagcaagacuccaucucaaaaaaaaaaaaaagaaaaaucauuuuuguaggcauggagucuuacuuuauuacccaggcugaucuugaacuccuggcuucaagcaguccucccaccuaggcucccagagugagcgacaauacccagacuguuuagagcuuuuaucacaucugugagacagcucugguuugguguaauucaggugucuccuggaaccccuugagcucucgaggagauuaccugaaggucccccugucccaguuuauucucuacugacagaguucucacugcaaguuuguucaaaugaucuaaacucaaaacaucuguugucugagauccugaauuccuugucagacagaccagaugugaaauagccugcugauuucuuccagugcuccagaaguacugugaaugguaugggaagauggaugguggggacaggugagacugaacaaacagcugucagagggaacagugauggaaaugcuggucacacccucugagccuuuuggguccucacccucuucuguuacuuccuggccgccauugugcuccagggcccacuuuugauggugauacacaaaaaagcccacuucuuugaccucccaccuuggugcuucaccugcagguuaccauguagcucaccuauggggaaauaggugcuuuaagccuuaacccaucucugcuuaggccagaucagaacaggcaaaacaauguagccuuuugugcaugugugugaagaaauugguuaaaauuccugaaaguuacggugugguuauagcuuaugugguugugauaggauggucaguuuucaccaaaagcuauggaccucugagggcccugcuagugaaaaggaagagaauuaugaccagaauuaugggagggccagaguggggagcucugcagauauuccuggauugauugagccugucuugaguggugcagggaagcuacuugggaggaggaggcucagagacagcagagugggaggguaaaggauguccucaggaaggaggugacauuugaguggguucuggaaagcugugcaagaauuggccaaguaaagaaagggagggacaggcacuccaggcagggaagaagcucugguuaaaggcauggaggggucgauagagcaggcagaaaagaggauuccugagguuagggagggguggggacauuccuguaauuauccgugaggggagauuuuggguccaggacccauggcugcuuucuuggcucccucaguggggcccagaaaccacacagguagcugugggacauggaggucugcuuagcagugccuaguaagaaagacuuggucugcuacaggcugggcaugguggaucacaaggucaggaguucgagaccagccuggccaacauggugaaaccccguuuccacuaaaaauacaaaaaaauuagcuaagcacaguggcgggugccuguaaucccagcuacucgggaggcugaggcaggagaaucgcuugaaccugggaggcagaaguuguggugagccgagaucauuccacugcacuccugccugagcaacagagugagacuccgucuuaaaaaaaaaaaaaaaaaaaaaagacuuggcuacaagggaaggagccuauacgaggacaaaggacauugucaaagagaaugggguaaauauuuucauuuauuuauuauuauuauuuugagacagagucuugcucugucgcccaggcuggagugcaguggaugcaauauuggcucacugcaaccucugcugcccggguucaagcgauucuccugccucagccucccgaguagcugggacuacaggugcaugccaccacgcccagcuacuuuuuguguuauuaguagagacgggguuucagcaucuuggccaggcuggucuugaacuccugaccucgugauccacgagaaugggguaaauauuaaagaguccuaaguguuugaaaugcuuguuuucuggugcuguaaagaaauagcauuugaacguaaauucaauuuuuuuuagcaaggccauauuuauacuuucugcagaaaggguacacucaccaguuguuuugccaugagaauacauugaauaaaggagacaggguuauuuauaacuugauguguuuacucugcugcuguauccaguuuuuauuggcuggaacaggaccucacauucuguauuugucccaauuggcuagcaacuuagaacuuuuuuuuuuuuuuuuuuuuggagacagagucucacucugucgcccaggcuggagugcaguggcaugaucucggggucacugcaagcuccaccucccggguucacaccauucuccugccgcagccucccaaguagcugggacuacaggugcccgccaccacgccuggcuaauuuuuuuuguauuuuuuaguagagaugggguuucuacguguuagccaggauggucucgaucuucugaccuugugauccgcccgccucagccucccaaagugcugggauuacaggcaugcgccaccacaccuggccagaacuuuugaaaagaggcaaaggcagaggagaauaaaggaaggaggaaguaacuuguggaaugcugaaaaagguaaaaauaaccuuuaaauaaggaagaggaacaggcuaugaucuaaugcuugcuuggacuaauauaagcaugccaagguaaauauuuaggcuaaauugugggagcuaagaauauaaaguacauugauuucuuuauuauggcuagcagauauuuaagaauguuaguacaggucuuugaauaaauuuugcuuuuaagagaaguuacuauuuauuucuaauuagauggggaggaaagucuuugaagaggaaccucuacuuuacuuuuuacauaagcaaccugguggcugcuggggaaacccuuaaaacacugggcaguagaacuccacugagguuagugucagcucccuugaggccaagagcagcugcucacuugggaguuuuggcugcugucgcuuggccucugggcccuccuggggcugguucugugcuccuuaguccgugggaaguuacuagacccagcuucauuuccaaaacaucucaagcugccauuugauaagaguagcauuggaacacagaaucaggcuuaucccuguugccuagcgagggcuuggcuggaugguggguguuccuggaucuuguaugaaucucuccugcaauaucugguccuuucagaguuuccugggacagauugacccuaguaaggcuaaggaauugggauaguaguagcaucuuccgucucugcgcaguacuuuacauacaugaucucauuuagaccuuauaacagcucugcaaggcugguacuggugaggaacuugagacuuaguagugcaguacuugucccagguuguccagugcaaaggauagcaggacagggcacagggagaagagcacggaaacaccagugggaauacaaggugacaggcucuguugggaagcucuuuuuuuuuugggggggggugagauggagauuuacucuuguugcccaggcuggagugcaauggcacaaucucggcucaccgcauccuccaccucccagguucaagugauucuccugccucagccucccgaguagcugggauuacaggcaugugccaccacgcccagcuaauuuuguauuuuuaguagagacggguuucaccguguugcccaggcugaucuugaacuccugaccucuggugauccgccugccucugccucccaaagugcugggauuacaggccugagccacugcgccuggccagcucugucucuugauuaagguggaggauauucucagcuugucuuuugggaccaggcagaccagaaaugcuggagcauauuggcaaaccagcagccuaaggauuuggaagaaaggcuggucagagugucaguugcuuaucaaccagcugagagccugaacuuuccggaagacauggcucuuggguagccacugggaacaggcuuaaaacagcuuugguucuuugaguucuuuguggggagugauugucuggugugaaucacaguugauagugcccugaaagguucaaggccacauuucccaggggaagauaagcuuuccacaauguauagaaacucagaaaacuccaaguucuuuaugcuaagaaacaaaaagggcucagaaaggcugaacacaaagucaaggaagagaaauugauaacuuuugguuaaagggaagaguuuccagccuuuuggccagggcauccacuaccaaguccaaauccugacuuggccucaagcuuuuguaaagggaugcaucgugucccuuuugaccugcugauaguuuuuuugagauggagucucacacugucacccgggcuagaguacagugacgcgaucucgccucacugcaaccucugccucccagguucaagugauucuccugccucagccucuggaguagcugggauuacaggugccugccaccacgcccagcuaacuuuuguauuuucaguagugaugaggcuucaccauguuggccaggcugaccuugaacuccucaccucaugauucgcccaccucagccuccgaaagugcugggauuacaggugugagccaccaugcccagccgaccugcugauaguuugauaaaacagaaguuuuacuuucuggaauuucuacucauuuuauguuuuggaugguuucucucuccguaagcauucaguauucuugaaucucaaguuuugaaaggagcccuaacuucaagucuacucgcuggcuucuuaaugaagugaaccauuucuauugcccauuuaguucuuccugaaacccugacauucugguguucaugugacucuucuuucccccuugcuacucagagaaagcgucgugguggagcaauaaauucuagacaagcucagaagcgaacucgggaagcaaccuccacccccgagaucuccuuggaagcagaacccauagaacucguggaaacugguaagauugccagggacacuacaacugugggguguuaaaguggagagagaacacuguaccagggugagcuaguagaaggugcuuucagugucuuuagaaggccuaugcagucucacacucaccauguacaacucaaagcuucacagauucugaaauagcuucucaacugggcuaacuguucaacucugguaaugugcagcagugggguaggauccauuuaaaaaaaaaucuagcgcaaaugagauagcccaccuuuucuaucugaaacugcauccccaauugcuggaccuuguaaaguacuucgcuuuccucuucuguuuuucauuaggacaugaaaucacccaagaaggcaaacuuguccacagagcucccuguguuggagcuugguauaggcagaggccagauuggauuuccccuucugccugcucaagaagugguugauggcuggccuaagucccuuugcucugcauauauuguuuuuauaacuaggauaccugcaaacuggcauuuuauuuuuacuuauuuauuuuugagauagagucuugcucugucgcccaagcuagaguguaguggugcagucucggcucacugcaagcuccacauccuggguucacgccauucuccugccucagccucccaaguagcugggacuauaggcacccgccaccacacccggcuaauuuuuuguauuuuuaauagagacaggguuucaccauguuagccaggauggucucgaucuccugaccuugugauccacccgucucggccucccaaagugcugguauuacaggcgugagccacugcacccggccaugcaaacucgcguuuuaaacagaagaaacuuagugcaagauaaauuucaugggccccccaggagaaaugaaguucucuauauggucucugaguuucacuucuacaaaugaguucuugaaagccuugacuugaggcuaggauccuggcucuagaccaaaaaggaacgaacugcuuuccgucauggcacuugucauccucuaggcagucuuaccccuguguguacuuagggcugcccauuagagcacuguuuuguuuuuguuucuguuugaggcagaguuucguucugucagccagguuggagugcaaucgcgugaucucggcucacugcaaccucugccucccagguuuaagcaagucuccugccucagcuucccaaguagcugggaucauaggcgcccaccaccacacccggcuaaauuuuuuuuguauuuuuaguagagacgggguuucaccaugucagucaggcugaucucgaacuccugaccucagauuauccaccugccuuggccucccaaagugcugggauuacaggccugagccacccgccuggccuagagcacuguuuuuguaagagcccagaauuguguucaccagaaagagaaugguucaauaaauuguuguauaucaguauauggacuguuggacagcccuucuuuuuaauaaagaaugcaauaauuuuauauaaauuauauuguauauguaagauuaucacgguuuuuauucuugugaaacuuuaugauacaagaaaauaaaacaggccagccagauugcuugagcccaggaguaccagaccagccuggacaacauagugagacccugucucuauaaauaaaaaaauuagccaagugugggaggcugagguaggaggaucacuugagccuggaacauugaggcugcagugagccgugaucgugccacugcacucuagccugggcaacagcaagaccccaccuaaaaaauaaauaaaagaaguuacguuggguugggcgccauggcuggcuccuauaaucccagcacuuugggaggccgaggcgugcagaucaccugaggucaggaguucaagaccagccuggccaacauggcgaaaccccaucucuacuaaaaaugcaaaaauuagacgggcgugguggcgggcgccuguaaucccagcuacuugggagguugaugcaggagaaucacuugcaccugggaggcagagguugcagugagccgagaucgugccacugcacuccugccuggacgacagagcgagacucugucucaaaaaaaaaaaguuaaaugcauuacaagacacuuuccccaaauauuagaccaauacuguuucuuaaaaaacuucauuuaguguuuuguuguuguuguuguuuguuuguuuuugagauggaguuuugcucuuguugcccaggcuggggugcaguggcgugaucuuugcaucccgggguucaagcaauucuccugccucagccucccgaguagcugggauuacaggcaugugccaccacaccucgcuaauuuuguauuuuuaguagaaacggaguuucuccauguuggucaggcuggucucgaacucucaaccucaggugauccgcccaccucagccucccaaagugcugggauuacaggugugaaccacugugccuggcccauuccgugcuuuuuaauauuaauauuaauaguaaucagaaauaaaaaugguugugcgucauuuuuuacuuuauauaaauggaaguuguacguuaacuguuugguccauguccuucucaccuuuauccugugcacauguagacaucacaguauacccuaagggcugaaaggcaagcuucacaacagaugcaacccauuuuguauguugagguucuagcuaucaguauauaucacuguuauucuccauccaacuagggagacaaacuugagagauaaauggaaauuaaaaguuuguccuuggccgggcacgguggcucacgccuguaaucccaacacuuuggaagacugaaguggguggaucacaaggucaggaguucaagaccagccuggccaagauggugaaaccccaucucuacuaaaaauacaaacaaaauuagccaggcaugcugccaggcgccuguaaucccaacuacucgggaggcugagacagagaauugcuugaacccaggaggcggagguugcagugagccaagaucgcaccacugcacuccagccuuggcgacagagcgagacucugucucaaaaaaaaaaaaaaaaaaaaagaauuugcccuagauuaaccgaugaaguuacuaagcuaagccugacuuuugguccuugggccaagugagaguggucagcuucaccugcugggaggagcagagguuucaggcuaguccaucccaaagagaaaggccuggggcugggcaugcauggugcguucucccagauggggcacagaggcauagccguguggaagugggaugccguggaauagagguaugcacaugcgcacacauacauaaccccccagguacauuuguaaaaaccauaccuccccacucagagcagaauucuggaagggugguuacuggcuuucccuccugagggagguguugguccuggugcucuuugcaguguauacuucaggauuguuuuaguuugggguaagccuauaacauuagcagucauacuaaaguguagagggauacaaccuuacuuuccucuuaaucuuaaugcuuguugaaauacuuucuuuugaagcuggagaugaaauuguggaccucacuugugaaucuuuagagccuguggugguugaucugacucacaaugacucuguugugguaaguguuggagugugagagucggcuguuucuuggguaugggucccuggccagugccagcaucugacagccuuggucacagacuccaagucaagguuacagcuuaugcuaaagaaguucaugcaucuuguggaauugagcuuuuagaaagaaaauaaacaguaacaauaauaauaacaaagaaguucaugcauucagugacgagagcccaaaaugaaaaauguuucuggaaaaucauuuguuauagccuugucgccuauggaguaggucuguguaaccugaccuugccacaccugggcacaaaagugguuuggggagaaucucaagacccccacaucugucuucagucccugauuccacaguuuacaccagcugugugaccuugggcaugugacuuagccucauucacuuuccaugaaauggggacaggucacucaugucagcagggcaugguguaagacaucuuacaacagaugccguguuugagugccugacaccuagaauggugcccagucacugugaguguaugcccucccaacugaaaggaaagggaacguuggcucagcacugcccaugggaaaucucucaaguuccaaaagugccugcuacuuagcauggccucaggggaugcaggcucccugcauugccaccugaugccugcugcguccugaugccagggaggcuggagcccaggaggcugccugugucccugucucauggcaccgguuacagacugcaggggacguguguauacguguccugccugccaggagggaggccuugucuggucagaggacacacggagaagcuauuucugauagaccuguuucauggugcaugcaggucugggaaucuggucagcaucuuaagggcaaguuugccucuggaagaugccacuugaguguuuucugacagugugcucggaacacaggucggggugggggcacacuuggcagcauuggcaguggggugguaagugcugcugaggaggacuguggggugugggggcugcuaguagcugagucuucgccuuggcccugggcucacugguguugggguuauccuguuuggcugaugccuggguaucugaauagggacaccccauagguguugcuucuuaguugugcugagaacuucagaauaggguuauacugagaaguuucaagacuucaaugcaaagaaaaggacagggauggaaaaccaucugagauaagcagcaguggguuuaguuguacguggucccugcuuaggucucauuaacguguuuucugagguacauacacacauaugacuuugcuuaucaucccuguguccugcauggaguucuggaaagauaacuaauuugguauauuagcuggcagcuacagcacagucacugauuuuuccccucuuucuuuuucccagcugacaccuugguuucaccaguugcucauuaaagcuggaaaguggugucugcagaaguuuuuuuguuuuuuguuuuuuguuuuucuugaauacucaguguucaccacagucuucuuggccuucucucugccagacccugaggagagagcuaggauuuugacugcaggaagacaaugauugauuggcuuuuguuggcugacaaaccaacaucauuuccccuuucacacuuguguuuucuuuugcuuuagaaacagggucucaggcugggcgcgguggcucacgccuguaaucucagcacuuugggaggccgaggugggcggaccacaaggucaggaguuugacaucagccuggccaacauggugaaacccugucucuacuaaaaauacaaaaauuaugcggacgccuguagucccagcuauucaggaggcuaaggcaggagaaucgcuugaacccaggaaucagagguugcagugagccgagaucacgucacugcacuccagcccgggcaacagagugagacuccaucucaaaaaaaaaaaaaaauacaaaaauuagccaggugugaugaugcauaccuguaaucccagcuacucgggaggcuaaggcaggagaauuacuugaacccaggaggcggagguugcagugagccaagaucgcgccacugcacucaagccugggcgacagagcaagacucugucucaaaaaaaaaaaaaaagaaaagaaaagaaacagggucucacucuguugcccaggcuagagagcaguggcaugaucacaccuuacugcagccuccaaccccugagcuuaagugauucucccacauuauccuccugaguagcugagacuacaggugcaugccaccauacacuacuaaauuugggucggguggugguggugauuuuuuaauauuuuuguagagacagggucucacugugaugcccaggcuggucuugaacuccugggcucaagcagucacccaccucagccucccaaagcacuaggauuacaggugugagccaccacacuggccagcuuuguuuuguuuugaugacuaagcugcucuugcuaaaagggcuuccucucugaacuucccuaccuuucuucuguuucccugggcuagggcuccauguuggcaguccuacucccaauuaaccuggggcugucugguuaaccuuuauaagaucugcagucauugggagacccggggaccaggaauauugguguugagggagcuacccuggaaaguggauggguggccagagggagagcugauagguaaaagggagacgcuccuggcuugggaagcaggaguccuagguucuggucucucagaucuacuggucaguuugaucaguggauuuaucucacacuguccucaguguugucagccacaaaauaacugcuuuggacuugauagcucuugcuaaucauucucuacuuauuuuugauuuuaauaaguccaagugccaguuuaugaauuuacacugagacauauacuugaguuuggaauucugccucugagcagaucuguuugggaggccucuaaugcuagucacugaggauaaggggcaucuguagauggaucguguguucagggugacccuaggcugcaccugcaggagaguauaaaauggauaaauguauucauucuggaagcgggguaaccuuccuuaccaguuccgccaggaccugucgaauaguuugagugcacugcuuuagcuccaguagcucuguaccuguaauauaggaaucccuggauaccaggauccagagguagccgucagaacaucagggaacccucuaaacuuugugccuguggucccagcuacugggaaggcugagcaaggaggaucacuugaacucaggaguucaaggcaagccugggcaacauagugagacccugucuucuucaaaaaagaaaaaaagacuggaaacuuugcauacaggugugcacauucuuccaacuuucgaaggaauucaaagccccugaaaaaugaagggaaaugaaaaaugcgguaagaugcagugagagacuuuguucaucucauuugauuaguuucccucaaaaugaacuuucauuuuuggcauugcauagccuagaaaaggcaucacugcugugucccgaggugugagugucuuugauuuuuacuggauaaaugccagacuuuucuaaagagggagcaguucacauucaugccaguguuugagguucuccacauccucauggccacuuuuaauuuuagccauucugaugcuuguccaguggugucucauugugguuuuaauuugugcuuuuuuauuacaaaugggaucaaacaccuuuucauguuuauuuuucucuuuugugaagugccuguuuaaaacuucuuuguuuuauagcuuuuauuuauuuauuuauuuauuuauuuauuuauuuauuuauuuugagacagagucuugcacuguuacccaggcuggagugcaguggcgugaucuuggcucacuguaagcucugccuccuggguucacgccauucuccugccucagccuccagaguagcugggacuacaggcagccgccaccaugcccggcucauuuuuuguauuuuuuuuuuuuuuuuuuuuugagacagagucucacucugucacccaggcuggagugcaguggcacgaucucaguucacucaguucaccuccgccucccggguucaagcaauucuccugccucagccuauugaguagcugggacuacaggcacgcaccaccaugccaggcuaauuuuuuauauuuuuaguagagaugggguuucaccauguugcccaggcuguucuugaacuccugaccucaggugauccacucgccuuggccucccaaagugcugggauuauaagcaugagccgcugcaccuggcuguuacauagcuuuuuuuuaugcaacuuucguauauaaacuuuuuucaucauaaauaggacuuuucacuuuaguaccuagcucaucccaguagcuuuuccagaacugcugucuucaccacaaagcucccuacguuuucccaaugcaaaccugaguguuuuuagcauuuuaacuuuccucacagagaagacaucguggagcggauaaauagauuugcaggcauuucugugucuucuccagugcugucuggaauaauuuucuccaccacuucuuucaaguuauuugucugcaucucucuuuuuuuuuuuuuuugagauggagucucgcucuguugcccaagcuggaguacaguggugcgaucuuggcucacugccagcuccgccuccuggguucacaccauucuccugccucagccuccagaguagcugggacuacaggugcccgccaccacacccggcuaauuuuuuguauuuuuaguagagacgggguuucaccauguuagccaggauggucucgaucuccugaccucgugauccgcccgccucggccucccaaagugcugggauuauaggugugagccaccgcgcccggccuugggucaugauuuccaucaucuuagaccuguuggugcugagguuuucuuuaaccauugguagucuagacaucaacaugagcuucaaucauggucugccuuuuuuuuuuuuuuuuuuuuuuuuuuuuuugagacgguuucucacugucacucaggcuagaaugcaguagcgugaucucagcucacugcagccucugccuccuggguagcugggacuauaggcaugcaccaccacgcccagcuaauuuuuguauuuuuuguagagacaggauuuugccauguuguccaggcuggucucgaacuccugaccucaagugauccacccggguggucugccauuuuuaaaucacacaacacauuuugucauggguaagacccacgcauggaagcuaggcaguuuuugcccugaacaucuugaacagucagcuugaguuuucugcaagucagcaagccuucaaacauaacccuugaggccaucagauacaguuuugguuccuugaguccuauaaacuuuuuaaaucguugaaaaaauugaacuagaacaaagcaaaccauuuguuguuuucuuuuuccccccugagacagagucucgcucugucgcccacgcuggagugcaguggcacagucuuggcucacugcaaccuccaucuccagggugccagcgauucccaugucucagccuccugaguagcugggauuacagguacacaccaccacggccagcuaauuuuuguauuuuuaggagagacgguuuugccauguugaccaggcuggucuugaacuccuggccucaagugauauaccugacucagccucccaaagugcuaggauuacagacgugagccaccauguccggccuccuugguugcuuuuuaacagcaaauaaucuuuuuuuuuuuuccaaguugugugcuuucuccaaauuuguuuuuuuucuucuucuucuucuuuuuuuuucccuugaaacagggucucacuuuguuacccaggcuggagugcaguggugccaucacggcucacugcagccuguaccuucugggcucaauugagcuuccugccucagccuccuaaguagcugggacuauagggguaugucaccaucccuggcugauuuuuuauauuuuuuuggagagacaaggucuuaccguauugcccaggguggucucaaacuccugggcucaagugauccucccaccuugguuucccaaagugcugggauuguaguugugagccacugagccugaccuugggucacuuuucaugagcauuuucaguaugccagucucugcucuggcuagaagcaaugcagugguagaaaagagacuggcaacucucuuuaaggaaucgagauucuuuaaggggaagguuauugaaaauguuacuuaggcuguuuuucuuaaauuuccaaagauugucucuuaguaagguugauuuuucuggaaucuuuuuuuggucuguuucuauaauguaugaauaagucacacuauguguguuuuauucuguauccugccugguuuuccauuuaugagacucuguagaaaggaugcuugauaaaggcuuuucuggaaggaaggaaggaagagggagggagggagggaaggagggagggacagaacccuguagaucucuggguguaaaggacacaggaggcacacuguuggaauaagugagccagcccaauuccauagaaagaaagaagagcucagaaaagcccaaacaucauauccaggaauuagccaagauggguuggcuacucaacuacaaugugauuguccgcaccagucuucccgacuuuccugccagugccgcaaguaacaggcaucaguaacugcaugauguguguagcuguuggacauugaguagccuuuugugugcacagugcuuggagauggcuguuuuuccaguggagcaaugugcagugcugugagcuguaaaguugucuaaagcaagugugucuuggugcccuuggcugggugaacauuccuagaaaugccaggggccagccugagugcacgggacccagugauuccuauacuugcuucuuucaugcagagguguucugaggcucaccugugcuuuuagaagcacaaaggggcuucgagugaccaaucagaugugccugcugcagguccacucgucucuaaaugcucugaccuauggacuguuguccauaguugagaagaagcuagaguaaaauaaaauguaugagugagugaaucuuuuucuuuuuuuuuuucuuuucucuuuuugagacaggguguugcucuguugcccaggcuggaaggcaggggcccgagcucagcucacuguagccucaaccucccagguugaagagauccuccugccucagccccaggaguacugggacuacagguacacacugccaugcccagcuuauucuuuguauugacgggaucucgccguguugcccaggauggucucgaccuccugagcucaagugauucaucccgccuuggccucccagggugcugggauugcagauaugggacaccaugcccagccgaggaagugugaauuucugaucuugggcuagcuuaccacaguacuaauuaaacuauucaguucaggggauuaguuaauuguuguuauuucaguuuugguuuuucacuuaucuuaaaagccucucaaauagauuagaggccccagagcuuguguuacaccucuauccaucucucaacucaucugguaggcauuuaugaagcgcugguacucuucccucugcaccuaucuucugugcugggcaaguacugugccaccugcagggccauagcugugauuuagguucauuacagaguucuugagaugucugcagggauucuggaauuugaugugacucggccacuggguggagggaacaccaguaaucaauacuguauuguccaccagcugagaggccaggcuguggucguugguuuuguuuuuuuguuuguuugguuuuuguuuuguuuuguuuuguuuuuuguuuuuguuuuguuuuguuuuugagacggaauuucacucuuguugcccaggcuggagugcaguggugcaaucucggcucaccacaaccuccaccucccagguucaagugagucuccugccucagccuccugaguagcugggauuacagacaugagccaccacaugcccggcuaauuuuguguuuuuaguagaggcgggguuucuccauguuggucaggcuggucucaaacucccgaccucgggugaucugcccgccucugccucccagagugcugggauuacaggcaugauccacugccccaggccuuuuuuuuuuuuuuuuuuuuuuuuuaauuaaagacaguuucacuauugucgccuaggcuggaguacaauggaucucagcucacugcagccuccaccucccgggcucaagugauucuccugccucagcaucccaaguagcugggauuacaggugcccaccaccacacccggcuaauuuuuguaguuuuaguagagacaggguuucaccauguuggccaggcuggucucaaacucccgaccucagguuuucugcccgccucugccucccaaaaugcugggauugcaggcaugagccaccgggccugugcuuuucuuuuuuucuuuuugagacaguuucgcuauuguugucuaggcuggagugcaauggcgugaccucggcucacugcccccuccaccuccuggguucaagugauucuccugcuucagccucccaaguaguugggacuacagccacgcgccaccacacccagcuaauuuuuguaguuuuaguagagacaggguuucaccauguuggucaggcuggucucgaacuccugaccucgagugauccgcccaucucggccucccaaagugcugagauuccaggugugagccaccgcgcccagccugugguguuguucuuauacugaagacucaucuggaagcuguuuuucucucauuaaaagcggggacagucagaauuguuaccagugaggaaacacucuggcgacccuguucuuaugcaccccaguaguuguguguguaucaccugcugcuugccagcagccccugggcucagugcucaggacaggccucaguuugguaccauccacaggcaagcuggguaugacucacaagagaccauaaagacucaguacgcgcacugucauggcuggggcacugggagugucauacccuuuccagguguccacaccuaauuagugggucaucuuggcagagggugggggcauguuggagcuguagaaagcuggggucauuucuagccacagaagaauuugcuuuugcucccagcuaaacccaaggcuuuccccaagggccagcacuguuaccagagccuccuuuucuagauuucaugcggacaguacauugugccggcccugguaaguuugguccugauggugagguugacugauuguccccagauuucccuuuucaccgucugcagucuccucuaagaggaaaggggagcacguuucaguggcuccacguauguggauuauauucucauccucaaaucaaagaccuuuauacucaguccugcauucuuccugcauggccguuuguguaugucaggaugccauuugggaaacaaaauccacucuaauuauuccuaagcuuaguggauuuuaacauggaaggagaagccuaaaucagcagugucugggcugggucuccaggaauaacucuugaccucgaagcauugacccaccuagggagcugcugugucugcuccaugaagaaggucuggaggcggcauccacccccugcacucauaucuuuggguucguguagacaguacugcagacccuuucuagggaggagaggccugggcucaagacauagcagccucugccagaaguguuucuucaggaugcagcugugccugccagugccaacacccucagcagcucaaaucggccuccauccccugcccugccaguagcaugagugugucuguuugagggaacucgguucacgucuaggauccuggcugcacgggagucagaguagaggauuagagcuucuugucacuguagggcaggauguccugcccaggggacaggcagggugaggugagcaguagggcuuugguggugagaacuuuccugaaacagccccuccuacgugcucagcaagagggaaagggcguuccacuggccccccuagauggguaagagcacuuggccagaaggugggaggaaccacguuugaaacuguuggagcagaaauugucuagauguaaguucugagcuggcaggugagaggcuugucagguucuuaggcccccaggacagagaauuggauuguguucaauccuuggugugugucacacgcauuggucaugcauagccugcuuuucucuguuaguuacuuguaacaaccuacugagcaaugcaaauccuccuccacaugaaggcuccaccuuggcaguggccuacauuggucgcgucagcuugagagagcaucaugccccuagugcugucuaaauguucacugccucacguaacccucacaacagcacagucagaugugggcucuggugacucugcuucagaagagaaagcugcagcccccagauaguaaguaagguccccaggucuugcagucagcacaugguguggcuguggcagcccccagauaguaaggaagguccccaggucuugcagucagcacaugguguggcuguggcagcccccagauaguaaggaagguccccaggucuugcagucagcacaugguguggcuguggcagcccccagauaguaaggaagguccccaggucuugcagucagcacaugguguggcuguggcagcccccagauaguaaggaagguccccaggucuugcagucagcacaugguguggcuguggcagcccccagauaguaaggaagguccccaggucuugcagucagcacaugguguggcuguggcagcccccagauaguaaggaagguccccaggucuugcagucagcacaugguguggcuguggcagcccccagauaguaaggaagguccccaggucuugcagucagcacaugguguggcuguggcuguguucacgcuccaggagacuccacuaaacacccagcagggagagacacagcacaucagcugggagguggagugacuugggaagugggcuugacugacugggagaggugcacagauccucugugggugggaggaggguggggccucugcugcucaccagaggguuccacagagggugucacacgucagaaaaaagaaauggcuucguuuaucacuuauaucaaacugauugcuucuuucucuuuuguuuuucuccuucuguuuacaagauuguugacggugagugguuucguuuccuuuuucacuggguuuggagaggaaacuggcauaggugagagccgcggugcugcaggucuugccagaccauccccaagggcuuggagcgcuccaagcaggaagaugccuucgcagaugcuguggucagacccacacagccagucccccuugugccugcugaagaaacuucaccacuaucauugagcacugagcuauaguccuuucuuguggccuaccagauuuuggagaaggcugguagcucacagcagggguugggggguuucuccugggaagauaagauaguggccuccagagcugggcagaaccuucuggguuauagcugagcauggcagcaguuugucucugggggucccaggcagggaaggaagagggucuuaagaggcgucaggaugggaguggugaggaugguaagaguagagagccuccaaccugaaaaugugaccucuuaccuuagaaagaagaagaccaaggaggaaugcuaggaggcugccccaggaccaugcugacagcuguguggugagcagugacgaugaggaguuguccagggacagagacguauaugugacuacccauacucccagaaacgccagggaugagggcgcuacaggccucagguaccaacgugcccccagcucugcugccgccaugcuaggauguggggccagggcaugggaauacuuuucagcaaaucugugagcccuuggcccuggaagggcuugcccaagccucuacccagcaucuggauacaguuggaacuggguccagaacugaguccagcuauucccacuguaaccagaggaugccaagcgcugacacagugugugcagacagucccaguggccccagacagggauccuggggcugguaggggccugggggagggcagggugacucagguugugugcaccuucucauguucacccucccacaugcccuuggggcaguuggcuuuccugaaagucucucggaugcccgcgcuaaggcagagucaggaggccagggacgggacucuuguaggggauaggggccacucacgugacaggguauaauaaaauguuugcguugacugagaaacuaacgugaagcacugugcucuuaggcccucagguacugucaguugucccaucugcauggacggauacucagagguaaguaaaccaagcuguaucuuccaggcuucugguuucuaaacuucacugaaagaauuggaugagacaggaucuucccccucggugggauuggacaccccuacucacagucaugccugggccgucacuuauugcagaucugccugugaggggagaaugugccaguuucuccuuggacccuacaacuuucaccuucagccccuauacuccuguaugcccugagcuuccgggugcaaaugcguccuccuuuuuugugccccauccuggcucuaacugaaagcugcuaguguuuacuggggucccucauaacccucuugggcugucacacuguugagaugccauggccccugccuccugcucuccagcugagagagaccacagcagacacaguuagcucuccagaccccucccuguuguagccuggcccuugcuuuccuuuaauuagucaucuuaggcauaggugggugggauucucuggccccauggcugcucugggacaagggcaaacucggaggcucuucuuuuuaaugccuucuagaucgugcagaauggacgucucaucguuuccacagaaugcggccaugucuucuguagccagugccuccgugauucccugaagaaugcuaauacuugcccaacuuguaggaaaaagaucaaccacaaacgguaccaccccauuuauauaugaaguauucagagccccccaggagagacggauggacagacagacagccagguucuccagugguaucugccuccauuuuccugagaucaaaaagacuguuucgaaaccaacaucugauauguaaacugcucuuuuguuuccaaccccuuccuuuuguuaucuccaguuugaugcuauggcgcuggacccagggcccucccaggccaucucuguuccucuggggugguccaguucuagagugggagaaagggagucaggcgcauugggaaucgugguuccagucugguugcagaaucugcacauuugccaagaaauuuucccuguuuggaaaguuugccccagcuuucccgggcacaccaccuuuugucccaagugucugccggucgaccaaucugccugccacacauugaccaagccagacccgguucacccagcucgaggaucccagguugaagaguggccccuugaggcccuggaaagaccaaucacuggacuucuucccuugagagucagaggucacccgugauucugccugcaccuuaucauugaucugcagugauuucugcaaaucaagagaaacucugcagggcacuccccuguuuccuaagaacgaaaaagugcaauaaaggccauucguuaccuacuuuucagcagcccacaagauguagcacuauuagugucccccucagaggcuuaauguugccuguggagcagugcccaucccagcccguuucugcccaccaguuguucucaggaaccuuacccaugcuccagcguccuucaccuggcacaggacaugcaagauaaauagggcaggcacguguuuggguguccucucuuuucugauaaaauccaucccguguuugccacacgcccuccaguccucaguucccacugccuaacgucugcccccguguagauacugagaggugguggcaguaauuguggccuuaucagccgcucaguuccaggcuuuugcccaggucacuguugccccauguucggagaaccuggcccaccugucuuggcuuucucauccuucccaacccagugccguuuauuucagaagcuuccuggccacugggcuuggaugcuucgggcuucugacugcuccauagguuuugacuggugaaacaggggcccagaugacaaccucuccuucgcuccacagguacgcgggagccucagguucucucaggggcagcaaaguggcccaagcugccccugacagcacagggccugggggguggcuaacgagagaggccuuacagugccggcaugccuccucuuccacugucguccuuccucagagggccucacgccaaacaaacggccuuuucgugugaaacaucuucagggcgggaaaggggccacuucuggcuuuguuagcaauaacugaccuucaguuuacccuucugaaggagcagggacucagcacagaauucacuuuagacggggcugaaggagugucccuccucuaugugaaaagaaaauuguuuuauucuucauucugacuuuuuaacuguuuggcucacuuccaguuaguuugaaugaaaauaauaauuuucuacuuggaguugaagagggcagaauccgcagcucucaucauugugauguguagcaugucugcccucugacuggacaucauugccauuaacuuucuucugggcaucacggcaaugucacgaugcccagacuuggagcaaggcaaccuuggagucaguccacucauaaaauaugguaacacccauuuuaaaauuuaaguuuuguccuuaaagacaacuucagugguuaauuauaaaaguuguguuacuucguccuaaauuaaauugauagaaagauuuaaaaauguguuuuguuucuacuauucagaaacugcgaacuagggaaagguugguaugaagaaaugucuuuccuuuuuucaauguacauaguucaacucuuucuuuguuacauuuaaacuauauccauggauaucagucugcuuuggacuccucugcuaguguuacagauggaaauaaaaccauuaauuugaaccaaaua

SEQ ID NO: 191465 - RNA, 25455 nt, Homo sapiens
uucauuuauaauugaaaauauaauuugcauaacaacaguaaauucuacacaugaaggcaaacguccgugguugacagaaauuacacuggccagaauccccaguccccaugaggcuuguccagacgcagugaaccagucgcagcugauaacacacagaccauucccgaucccagaggugcauuucaggauucauucuauuucaucaggugacguuuuaacagaaacaaaaccgcaggcagcggguggggggagcuggagguuggaaucacaccaacauuauagcauuauuacucuaaaaaaaauuacuuuuuuggcugggugcuguggcucacaccuauaauuggggggccaaggcagguggauuaccugaggucgggaauucgagaccagccugaccaacauggagaaaccccgucucuacuaaaaauacaaaauuagcugggcgugguggcacaugucuguaaucccagcuacucgggaggcugaggcaggagaaucgcuugaacccaggagguggagguugugccauugcacuccagccugggcaacaagagcaaaacuccgucucaaaaaaaaaaauuuuuuuuuaagcgacacagucuugcacuguggccgaggcuggagugcaguggcucaaucacggcucacuguaaccuuggacucagcucaagcaguccuccugcuucagccucccgaguaguugggacuacaggugcgugccaccacacuuggcuaauuuuuauguuuuuuugguagagacggggucuuccuguguugcccaggcuggucucgaacuccugggcugaagcaaucuuccugccuuggccucccagaggguuggaauugcagaugugagguaauguccaguuccuugccuuauuuauaaaauguaauuuauuuuuugaacuuuuuccucuucagagccuuccauucgccuuccuguguagccaggcuguuaaaaagcugcuuuacuuuccgcuuucuuuccgcaucccuaaaagaaacaaaaggcaaaugcccauuuuuggauuaguucuuggagagcaucuugcccucucucucccacaucagaaccacauuagccaccguggccacguucaguucaaacagggggaagugaaccugccuggcuccaacccccagccagagccaaggcugugggaugccaggugcccggugcucugcccagggccacacagcaccaaagcugagugacaccacaaucgugucgcacacacacgucccccucaccguuccaugauuucugagaguugcauccucgccaggaacugauuguccuugcggauuucucgaacggccccuuuaaauucacgcuuguguuuguggaucagccucuuccuuuccuguuccuccuuacuacugccuuguuuucuuccaaacucgaggcuacaaccagaaagccacuguuaaggaagcaagagucuguccccaccucucagccagagccugcuugggaguguggcuucacuccguagucaucugcucaacugcagaacuggcagacgccccccgucagcucccacugagcccacagcccuggccucccagggagaugcugccagcacccacacuuugaccagccggggugugaaaagcuucagugggacaggcuugcucuucucacaggucagcggccggcagagcugcuucuggcuuuccauuucggucagugugcucugacacagcuccugaaaaacacgaaauccccgacucugcgaugacucaccugcugcgugcccugagcuccacgcacggguucuguggugucaaggcagcgugaggacagugcugcgagcucccugcagcaggauggugcccuugcugugcgccuaccggugggcggggggguaagccaaggcuguggcugcucaaguccuggcacagccggaacgaaguaaagccacugucuucuugaagagggagggccgugggcuggccccugagagcacucucugaaaggaggggacuuggggaguuggaggucaccauagccugugcuccucacagccagaaacgucaacagaaccccucuuucccagacaaacuuggcacgaaaggccgugagccacuugcuucgugagaaggcucacaggagaaccccuuucugccgcggggggccgugugcaugcuagagcccagugugcaaacugacgcugggugcuaggcggggcaggguuuccaccagucuuggcaguuugaccuuauuuucaagccaacagaaccagaugguuaagacccauuuucaccaagaccuuggcuuccagaagaguuggcugguggcuucugaggaaucucccgaaagguaguucacugagguugguccuacccgcuuucuccugcacagguguguccuggaacccuggcugcacccacagauacagccacuccugggcccauguggauguaaccuucgagugccggaaugccucgucuccauggagaccaaacucaagggccugacuggcccagucuaccgagaccaugagaccugcugugccccucggccaggccaacccaaauucuuuuaaauaaaaggcacaagccacagccacaccagcaggaaguggauacaggauaaggggcagggcucacaucucauccucaucagccuuugaccaggcgacggagucugugauagcuagcuuaucugcucuaugcuccagggaccuggccggaacgagccgaguugcuguccucauggaacucucauccuaguggggcagagacaaggacgguguaacgugcccgggggucagcaccacagacaaaacgcagggagcacggcacagugugggccagggaaggccuggcuucccaagggugugggcgcgagcagcauggcuguggggaguucuaggugcagagaacuacuccagagacgaagccaggccugcgaggaggccggagcgcaugaggggaaggcacgaggcaaggcugccagggcugugcugguggugcgggacgguccuguggggguagcugcggagauggcacugaugccuucggcuccagcagcauccugggcuggugcgggccaauaaggggcaggguuggggcaggaugaaaggcacaagccacagccaugucaagcaggaaguggaugcaggguacagccugucagggucagggugaaaggcagggaggcggguaggccauaggugaauuuggagcagccuguagaggacaggaugugccaucaaagacuuguucuuggguccagcugagacugucccuuggggcuuccugucaccuugugcaggauagugagaccauccuuggaaaacccaucgggacugcagagcgcggcucagagcugacuguccaggccuggcaggggcugaccccugggcgcuggugcacccuccgugcggccucuuggaggaagcacacaaggcgacaguucccagcugccgccugagaugcagcaucugcuuuacuccagcccagcacugcucaccgucacugcccacucuuaugauuuuacuucccuucauauuugugauuuugcaaagaugguguugacuuacagcugcagcaucaaaugacugacugccaccagcuuggccccagcucagggacaugucugagcccaggcagagcacccuaguggccgggaagccucaccuggagcuccugcggguggcugcaguccgccaggugauccgugaggagggcuuggagaggccccaugauggcguggaaggauggcagggacccguacaugagcacgcagcgcuucagcagggccaggcccacagccaggcaggacagucugugagggcaggaggcaagaggagguccaacuuguucuguuugucacugacaaaaccaauaacguggcaaaaaugaacuuccccacuuccacuaggcugaaaacuccaguguggccaccuuggccggccaggguugggcccaugcaaccacgggcaaggcaggcucagggucaggccuaacgcaggaggggaggcugugggaaccgcagcgccagcugggauggggcggcuccauuuuugguuccaaauuaugauuugugaaaucaagcaaauguauuuugaaaaugaaaagaaaaagggacagcaagccaacaugccucagaaaggcuuucggccuccaucaaaccaaacggccgggcggcaaguucacuaagaacagcacaucagaaagcacgaguggcuucuccugccucuggggacgcuguagggcacaggccccaaagcgggguccccucacauaccggaugugauuggccucugucgaaguuggggcccucagucuacucgcccagcggagggagaggcugcucugcugccacguggccacauccucucuagcagacaccacgagcaguuccgaguucuucccaagcgcucugaaagggugcaccagaguggaaccugaauuccaagugcgacaggacagagauggccugaacauuacugggcucccagcaggcucugcggcaccgagccuguggaaguucacccucuaacagacgcacaccgauuuuuauguuucuggguugugccagacacugaggguuucagcgugggcagggacaccucaggggaggggaaaagcuuuggcagggggcgcggugagagccaagugccugauccugccugagaggccugcuggccacagacuuccuggggccuacuaggcacacauggggcugaugaggcgcucaggccacauccgggaacagacugaagucccugccccugucggggagacaggcagugcacagcacccagaggagcaaauggaccagacagaacacgagaaaggaaaguggaggggcaggagggagacaggagagucagucgggggugacgguggagggcgggagaggccugaggggcagacgucagcaaaggccuguaggacgcaggagucaauucacucgccacggagaagggcaauccaggccgaggguguggcuacacggggagggguggagaguggguacaguggggcagaggugccgggccaagcgagaggggaaggcgugggucaggccccgccccacacuuccccaaagccgagaugcccaccccuuccuugacuccaccugugcccagccuguuccgucacagcccuucacacgugggacugcagcuaucuacagguggcucucccggaggcagggagcaugugggcggccgcgccccucuggcgcccagcaccgagccugacagacaggagccuugggaggcaggugguggcagaaugggagcacugaaccggaagagugggccagaccccucuuggaagggacucugcugguggugugaaugaugccacagcaccugcuccucaggucaguccccuggacaugcaggcgcuuagcacugcacggugagcuggaaauagaggacaggggucugagccuugagguccaaccucuggucaggcugggagaggcguccacagacauggaagagcucaggaagaggcugugcagcuccucaccccccagagggaagcagcaagugcugaggaagcauccaggagcagggcuggcaucaggggaagggggaggagcacaggggcuggggugagggcccaggagggcagccagugugcagacugcuccucaucccaacacugcucuugccgcccucgcuccugaauucagagcguuaagagaagcgacacagcagcgcggccugugugagcugcacgagaacuuucacacugccuugucgucacgugagaaaaaguaaaaaguuaagauugauuuuaacaauagaccuuaucuaaccccaaauaccaaaauauuaugauuuuaacacauaauacaaaaaauuaagauauuuuaaguauuucugacacuaagucuucgccacuugggcauaugucacagguaggguacgucucaguucagacucuggccccuggcaaccacgcuggacagcacaggucaccgguagcacugcuuuuccccauguggcgcgugcacacgcucacacagagggacagacagugcggcggguggcagguuguguguuuccucuacuuucgcauauucuaaacuuucuacaaugaguaugaacuacuuaaaaaaauucuaaaguauaacauauuuguaggaaccucccucaaaucaacucaccuuggcuugcuuuguuuggaguugcuauguaaagaaucccaagaagaaaauuaauaagcucagguauaaaccucugggacaaagccacauacuccaggaacaggcagcacacgaacaggcccuucaccacguccuggagggacaggauggggcacuggaaaggaacauaugggggguuacuguccugggacgaugucaugccaugcuaggccgaccaccgggcuucccugaugaaccacgcaccccacugagcuucacaaguacagagggaacccccgcaccuuauagcagugucgagagcaucaaaugagaugaaaacaagauaaagagcuuuagugauuuuuuuuucccgagacggaguuucacucuuaccacccaggcuggagugcaauggcacaaucucggcucacugcaaccuccaccucccggguucaagugauuuuccugccucagucucccgaguagcugggauuacaggcauguggcaccacacccagcuaauuuuuguauuuuuaguagagacgggguuucgccauguuggccacacuggucuugaacucccgaccucaggugauccgcccgccucagccuccgaaagugcugggauuacaggcgugagccaccgcgccuggccagagcuauacugauuauaaaguuccuuccacccauacagagcguacgauuacugcacuaagcauguaccaaucacaugccuaauaaagaaaaaggaacagcuugaacuuuuuaagccaaaaagggaacaaaagcccuuaucaucacacuggauaacuucaccacuaacuugaaagguuguuuucugggguagcaccaucuguaaccuugaggugccaaaccaggcccucccacucccacccacaucuggggcugcucgagccggggcucuuuuagaugggcccucuuuggccuaaccgcagugcucggucucugcagcccuuaaacagccacacucauguuccacaaggccccgaggggcuguggcuccggccacccguggugcagcaggccgaccccugccgcauguggagagaacgcaccuuggugagcagcugacugaggcacacgagggcaggggucaccacugggugccagaagucggaaguuggaaauagcagcccagugauuuucaaauaaaugagcuggaaagaaaguguuaccacagguuaaagaagguaaaugaaguccauccauaugcccuccccgcaaacacuccggagccaagaacaggaucuggcgaggagagggugcaucuccuuggcccagagcucuggccucagugucacagaacaggcguccaaccaccgugggucaaccagcuaaacgugcagugaggacacugaggcccaugaagacuucaaagcagucaacaaugguuauagacacgggcucagaucauguuuuggggaguugauuaaaaaucacuaaccuaaguccuacauuuuuaagcuucugcuaacuauugugaauccauuucaacacaaacaccaggcaacagaauaaagagcguaucucagcaaguauuuccuuaaaguuacuaaagcugaaaauacagcaugaggcuguuauaaaauuguuaaaaaucucagcguacaaaugucucccaaccuuugaauaacauagaaaccgagaccaauuuaaaccagcccacaggcuugggcccuuaaggacaauaccgugguucuauuugccuuccaauguuuuugucacuggaccaaauacagcaccauucacguggaaucaaaccagaaucucccugcacgacccacacguuaguccauggcuaguggaggagugcccuccccucccaggcucgcugccgugcacucucacuccagaucacccucacugccgugcacucucacuccagaucacccucacugccgugcacucucacuccagaucacccucacugccgugcacucucacuccagaucacccucacugccgugcacucucacuccagaucacccucacugccgugcacucucacuccagaucacccucacugccgugcacucucacuccagaucacccucgcugccgugcacucacuccagaucacccucacugccgugcacucuccagaucacccucacugccgugcacucuccagaucacccucacugccgugcacucucacuccagaucacccucacugccgugcacucucacuccagaucacccucgcugccgugcagcucacuccacaucacccuggaagcacaggguacagccaagagcaucguacccgucguccaccuucugugaugccaaacagaacuucuguggcaggggcagugccuagacugaacucugcuuaccacauccaacccuggcaaugccgcccggccuuuggucucaaucauuucuuccaucucaugcaucgcaucucggagaacaaauuugauagcgucacuugcagauucaggaaacaucuggcaaagaugauauaagugccuguuaagcagaaauguaaagucaggagagaaugacuuuagauaagaaacacagaaaagcccugcaagccacuuuccuaugcagucaccuguugacugagcaaguaagaacuggaugaauccgcuuuuucuaacagcauucuuaagagucuacacucacuucugccauuuccuaaaaacucggccauaacauuauggacuggagguggugggagaaacagcucgauuugugguacagacguuguugggggcaccacucuguguggcagcugcagcugacagcuccaaggcacuuuccauauuaacucauuuauuccucacgacagguacuucuuugauagugccuccaugcaugcagaagaugacguggagagcuccgcgcggcacagggcaggaagcuggugugcacucucauggauccgaagccaacacacgccucucaacugaggacucugccccucuggcauucuuccagccaccagcccugggggccaggagccacugagugggucacacagccuuagagggcaacgagggcaggagcucgcccuggcgguccccaugcagacaagagguacacacucccuggcaugcaaagccacccaacuggguuucacugaagggugaggggcggggugucuaccgugcuuuccaaauaccgcucagucacccagagcuugaaacuuacaaugagccaccccaucccagccacaaaucuaaagggguucacuuguuucaaaaucaacuuguuugugguuaaaagucagucccagcucuacaguggcuggagcggcacgugugagaagccggcuugcgcugugaggcucacaagcccugggugaccaccugcccacuuggcaugcugacaccaucauuccaccuaccuuaguaacucuggaauguauuuuuaugacucuaaaugggagaaaaauuguucugcuuaaccccacaucccagaugacacaccauuuuuacuuacacaaccaacuuaucaaugacugugaggucuggugggucaucuguagccaaaucgccaacguauuccaaaagaaagccaaacaguuucugcaggaacaugaauugggaaauaaagcucagugcucagcaccaagaacaaagccacaggcacacagcuucuggaucacguacauucuggugacaaccagguggggcaggggagcccagggugacagacacgagcagccuucuaaaauguaagcaaauacacugcuagaacuugcuaagcacuagaagguguaggggggagaaagcuaagggcaaggcgcauccuucuacagaacagcugacaacacaccacuaggaaagcacgacgaggaacacgggcagcacggcguccuccucacaggcaauauccaccauucacugaaagaggcacgaucacagccaccuaucugccacagcaaagucuggcucugccacacgcuggcuaugugaacccuaguguccuccccugugagaugaaggugaagguccccaugccugccucuggcugggucuggcacgaggccuagagaggggccaaagccaagggaggccucugccggugccauaccaaguacucccagccaucaucauagguaaccaugugacgggcuggccccaucuggccugaggcacacauggccguugcacaacuucacacaauucuggcauucauauacggggcuaugcugacacucccagcgcuccacacacacucaauccacguacuucuaauuuugcuuuguuuccuucugcgagacucgggugguugcacuucugaauucucuccaccaccaaaagcugcucuuccaucgaucuuccuaacaacagagaucucaguuccucauaggauucaggggcuaucaaaaacacaaaacauacugcacauuuaacauuuauauauauguauauauauuuauuuuugagauggagucucgcucuguugcccaggcuggagugcaguggugcaaucucagcucacugaaacuuccgccuccuggguucaagagauucuccugccccagccugcugaguagcugggauuacaggcacucgccaccaugcccggcuaauuuuuguauuuucaguagagacagggcuucaccguguuggccaggcuggucuugagcuccugaccucaggugauccgccugccuaggccucccaaagugcugggauuacaggcaugagccaccgcaccuggcccacauuucacauuuaaaaugagaauuacuuacaugucugcugacagagagguaauuuuauauaacuauucuacuucacgaucacaacaaacccaccagcguuugcccugguacaccuggaggggucucagccauccugaccugggcugucaggugcgaucacgcaccugggaacaggcuaauaaggaaaugcccucccaccuuuccuugauuaggaauuugcuaaaacacccacaguuucagagcaucuugguggcagggugcuggguuuagugcccagacugcuucagaaggaccuggaaggagccacugugagccaagcagugucagcucaggagacucuugccaccagagggcacuucacagaggccagcuucaccacuagcuucuccucuggaagcgucuggcaggcacagaauaauucggcauugcuuacuagaaccugaccauuuuucuuuucuuuguuuugagacagggucuugcucugucacccaggcuagagugcagugguguaaucucggcucacugcaaccuccgccucccaggcucaagugauccucccaccucagccuccugaccagcuaggaacacaggcacaagcuauugcaccaggcuuauuuuuuauauuuuugguagagacgagguuucgcaauguugcccaggcuggucucaaacuccaaggcucaagugacccacccaccuuggccucccaaaguguugggauuauaggcaucagccacgcaccuggccuggacaauuuuucuccacauacuagacaaaacaacacuguauauuccaucuaaaauguuacguggccaaacaggaggcccaggugggaacauggaagccuucucgcagaugcucacccaccuccccagcccugccccucugguccaccacaagaggcugaccauauacuaaaagggaggugaagguaccacuagagagaggcgcaucuggcccaucgggggccggccuacagaaccacagucacaaacuaagaugaccacucacucuaagaccuggaucagcagacacagggguguguccaggcacucccaagggcauccuugguccccauuccacaaaugcaaccccugggagggagacgaacacacacagcuauggccaggucauaaagguuaucccagaaccugaggaaacccgcgcacuugcccaccugcgaacguguagggcagcucgucucugguagcuuuuccagcucuuuccuugccgcuuaucaacccuuucccaggagucugccucugcucuuuugcuggcuucucguuuucuuccucacucuccacguuggauuccagguccaaguggcuaucugggcugucgcucuccucuguguccuccccgccugaacugucaccuucuuccucguugcucucagggucacuggcuuccuugcuuugcucuuccuggacaucuuccucgacauucaucuuuccauccuaccaagagcguggaaaccacagggcaugaggacaggcggagacaacgcuggaccaucucacagccacaucaagaggcugcccacaucagggcuuucuacgugguugcaaggaacacaaaccugugugcuccauuugcccacuggcacuaggccuccugcccaccacccgcuucuaggcuauucgagccgcaggagcuacaggcugcuagagaacccugcggcaggaugcugggcgcgguucagcuuuugccagggagcagcaugggacugggauuuggaagguguacaguggcugcgggcuuuagcaggaggagugucuacagcaccuucugcuccuccagguaaccuaguguuuuuaucaguauccauuuuccuguguggaucucuucugcuugaaaccuguccugccuauuuuucuucccuggacccugacugauacacucuuaaaacgagaaaaggguaccgauuuauaaaguucgugaauuaaaaacuacaccagucauggaaacucaaugacaucacucaaagaaaauucacaacucuagccuugaguuagcucccucaauaguaugaugaggucaugcagauagaaucauacaguuauuaacaaaaguaguugauguuaaccgaguaaucaguuuuaucuguguuccuuugagacagagagagagagugagaaagagagcgugagcaagugagugcacauacuauuguuaaagucuucucucuaaaguuuuaauaucugauauaccauaaacacccagauaaagaacuuuagagaaacugguuaaaaagauuuaaaauucccaacuguaauaaaucccuaaaaugaauaccaaaaaaauguuuuuaaauuaaaaaaagagagagaaagagaaaaugaaggcaaacaucuuacuuuguaggaaagcaaacgccugucaucuuuaucuagcacgaagccaucauucagaucaucugcugacauauguuuugguuucuuaacauuuucauccucauccuuuccaagcauucuucgaagucucucagccugagcaggaaggaaugagaugucuuagagcacacucuuccaacauauggugagggggccgugcaguccugcccugggcagcgggcugggccuacgguccucccagcucugaggcuggugcauccagccugcuuucugccugcaguuuucaaucaggcaugcaaacacuagcuaagcagcacauuccucauuuaacaaaaucaacuguucaaacuuuguggccaauacucuccagucaccaggcaagccuauuauucugaggccuucacagcccaauucugcuggccagccccgacugggacucaucacccccugcaccgagagaauaggagccaggacgccaagagcaagcagcuccacggccuccacuauuugaccacacacuggacacgggaagaagcuagugaugugguuaugucaaaacagccagcugagccagcugugauggcagcccacaccuguaaccccagcacugugggaggccguggugggaggaucagcugagaccaggaguuugagaacagccuaggcaacauagggagaugcucaucuauacaaacaauuuuugaaaauuagcuggggccaggcgcgguggcucacaccuguaaucccagcacuuugggaggccgaggugacuggaucaccugaggucaggaguucaagaccgccuggccaacauggcgaaauccuaucucuacuaaaaauacaaaaauuagccgggcgugguggcaggcgccuguaauccuagcuacucaggaggcugaggcaggagaaucacuugaacccaggagguggaguuugcagugagccaagauugugccacuguacucuagcugggugacagagcgaaacucugucucaaagaaaaaaaaaaaaaaagguauucaugaauaaauauaaacuuuaaauagacuaaaauauuccacugaucaaacagaguauucucuucagcccauccugcaaaauggagcagaaggggcuguggacggacagcagcacagcccugcuccugaggugcugccacccuaccuccagcuuccugaggugcuccugcucuuccuuugccaauucugccuccgucuucauccuguuagagggcugcgccuucauuucaaagccaagcucgcgaaccaucaugucauaugcaucgggcuaagguagaaagaagaaauucuucauuuuaaaaauauauuuauuucuuauuuuacaaaaagaaaagaucuagcuuccuggcacauucuaguaauggcuagauaauguuauugaaguagcuaagccacaucuacgucuuuucuucuagagagaaaacuguucugauaagcccugaggauugcgaaaucaguggacauucggucacaaagaauuuguuuaccccuagaaaaauucucagaauacaucugcuuuaacgaaaacaggccaggugcaguggcucacgccuguaaucccagcacuuugggaggccaaggugggcagaucacgugaggucaggaguuugagaucagccuggcccaacauggugaaacccugucuuuacuaaaaauacaaaaauuagucaagcaugguggcacgcgccuguaaucccagcuacccgggaggcugaggcaagagaaucacuugaacccaggagguggagguugcagugagguggagguugcacuacacuccagccugggugacagagcgagacuccgucucaaacaacaacaaaaacgcuacuuauccaggcauuacgcccuaaacgugggaaacuaaguaaaguaacgguaacaucaaggcugacugacaaagaugcacagaugaccacaugacacuaaucugcugggaucuagacuucucugagaacgcaguuucuuaaacaaaugcagcauuuuccaauaguuucgacuaaagagaaugcaguaggaaacaacuguuuacagaggcaaaaauaaguaaauguauauuaaauguauguauuauguaucaacagacaaacaugucacagggaaguucagacaccuauucuaacguguccacccugaaguacuucuuccauccagaaacaccacuuuuuucaguuuaauucaccugcaauagagacucaaguaacugaaucuacuuccaccccaagauuacacacagcagguaauucaguaucaauguucaacagaaacuugcccuaaaggagacagguagaagagccguccagccccagcccuuucucuggagaaagucggucacccaagcucagugagugaagaguuuguuucaguacuuggcucccaccuuggguuuuuccuuuuugucucuguucucugacuugggaguuuugugggacaggagagucugaauuucuuuccagucuuggucuagcuucuccgugagcucgagggcaucuucucguugagcuugucucucccucuggggaaaaaauaacagacacacaccacauaccguuacuacuggacuucaacccagaggcccaaugucagugccaaggacacacacagugaucacucaguuggcaccaaacguuucaacacagaaaagaggccaggagaaaugaguauuuuaaaugcaaagcuaccaaaucucaucagacggaaaucuuuuccugccauaaaccauuaauuuagaugcucugagcaguucacugcaaaugaauaaaaaagugauuuuuugggcacaugucagauacuaaaaccagcaacaacaaaaaacccauccgcgccaggugcaguggcccacccugugcuuuagaacuaggccaaggugggagaacugcuugagccuggucgacacagcacgauccccaucucuacaaaaaguaauuagcugagcaugguggcgcccacuagcuacuuggggagcugaggugggaggaucacuggauccuugagcccaggaguuugaggccacagugagcuuugaucgugccacuguacuccagcccgggaaacagagacuacgucucaaaauaaaacaaaacauaaaccaaaaaaaggcaaaagaaccaaaaccuguccgagguauaugcuuuaugugauuuuuaaaauuccuacucacaauaaaugcuuuuacugaacucauauaaaauauuaaacacagccuaaaaagguacaggaaaaaaaagcucaaacacauuuuggugagccugucuuaccguggagaagaugaucaagaacacucacuaacccaccuucucuuguuuugacuuggcaaugagcucuucaaucagcucuuuccgggacuucgguuucucccgcuccucgccuuccuguugagucuucuugugaaggagcccaccgccuccuccaaagugggcagcagucagcucagcugggggcaaaaggcagaaaaccccacagugaagcccagcccuggcgugggaaguguuuccuguagcacucugccagugcuucccccauaguggucuggaaaaguccacauuugagaaaaaaaugcucacacgcaacagccuggccugagaccacaggcacaauggcacuugagaaauacccaagguaagccacucugagaaaacccagacccauuacacucccaacuggccguaacccaaguggcuggaaacacccagcaccuauuuuugauugugcugguucuagcgaagacuggcaaacccagagcaagcugacuccagggucuuggugggagcgucgcccaggaucaguggugcaaucugugucccucccaccucccugggcagggccuggagacucuagucaccuguaccacggcgcccccucuagucaccugcacgccacggcgcccccucuagucaccuccacgccacggcgcccccucuagucaccugcacgccacggcgcucccucuagucaccugcgccacggcgcccccucuagucaccugcgccacagcgcccccucuagucaccugcaccccacggcgcccccucuagucaccugcacgccacggcgcccccucuagucaccuggaccacggcgcccccucuagucaccugcacgccacagcgcccccucuagucaccugcaccacggcgcccucuagucaccugcaccacagcgcccccucuagucaccugcacgccacggcgcccccucuagucaccugcacgccacggcgcccccucuagucaccuggaccacggcgcccccucuagucaccugcacgccacggcgcccccucuagucaccugcaccacggcgcccucuagucaccugcaccacagcgcccccucuagucaccugcacgccacggcgcccccucuagucaccugcaccacagcgcccccucuagucaccugcacgccacggcgcccccucuagucaccugcacgccacggcgcccccucuagucaccugcgccacagcgccuccuggcaaugaggggaaggccacucgcccaacucacaccaaggcaguuaccuccagucucggggaauuaggaucuccccagggaaugcguuuuauagcuaaggguccacgagaagucuugaacaaugaaaagagcaaagacaaaggcacagagggguuaaaauaacuggccauucucuucacgcccgugaagccgagcaguggcggggccuccuggugugccgcagauggcggguucugcaccacaugcuugcugcccuaauuccuaagccuuuuacccccuggauuagccaaauaucagaaggcagccccaggcuuuaacgccuuaacuuucacacacugacaagacaaagcuuugagagucaguuuuagauuuguacaccuuuguucugaagaugcuggaaaugggaccuacuuuaacuuacaagaaaugucaaguaauugaugucaugacugcaaccuuauaaauaggguucaagacagucagacccgaacugaaucuuaaacucuguuaacauuauuuaaggccaaaauuuaucuguuucauguuguuaucuacagauaugaggcucaauaugauuuuccucaaacugcuauaauuccacaguagguaaaagcuaaaggaacuacaucaaugccacugguacaaauauuaggcuggaauugauaaaguagggggagcaaaguagugcauucagugaggcaccuggagucagugagguggguucuccccacagcucugacucuggcaucgggcaaaacaccuuauuucucugagcucauggguagaacgagcuauuuugagguucaaauaaaauaauggauaucaacaugcuuucuuggcccauaaaagcaucuaucuacacaccaucuuaaaguucugaaaacuuaaaaaaaaaacaaaaauacauaaaaacugucacuugugaaauuuguagagagguuaaugaucaguaaaacuuucaugcaauaacuuucucuagucucuaagaagagcagaaggucuaacaaugaacagacucucccugacuccacgcccacaggcccgugcacagcaccccagccucaccagacaacguuccucgauccucagcaucgcugucacuguccacaaugucauuaugcuucucgaugucugccaaagacuggccauaaugagucaauucuucaucuucauuuagauuguagaugcuuuuuuucucaugaugucgcugacagaagagaaaaaaaguuuccuaaaauuaccacuuccauuucacagcaaaaaaaaaaagauaagguagauauauauauuuccauuauauuugaaauaugacaacgaauccuaagcagccuuaaagaguauuuugggucaacuaagcaaugauucaugauucagacagaaaugaaacucauggaggguaauucuuuuuuuuccuucagacagagucucgcucuguugcccaggcuggagugcgguagagugaucugggcucacugcaaccucugacucccugguucaagugauucuccugccucagccuccugaguagcugggauuauaggcaugcgccaccacgccuggcuaauuuuuguauuuuuaguagagacgggguuucaucacguuggccaggauggucucgaucuccugaccucaugauccacccaccucagccucccaaagugcugggauuacaggcaugagccaccgcgcccggccucauggaggggaauucuuaaauaagcccaggggccaguuuccacuccagcaaugcugcucagcugagaacuccugugcacacugcugccguguaguagaguuaaggcauuuauccauucagcuaacauuugcagaagagguugcuucuccuuuggccuagccagauaaggcacaggauucgagggcuauccccuggaccuuccgagugcccaggaacaugcaaaacaugcagagucagccuucuccuuggccuugacuucccugugaaauguacagcaaaaacccuccuccaguuucuuuccauaccugcuguuccagagcaaaccucuucaucaucuucuccucggggcucauguugcuguuguauucuccgaagcguuuaucucugaauacauuggauuuaucccuuucuuuguacucuuuuaguaaagucuguguacgcuggaaaacaggucagaaacaaucucacaaaaaauucuugugauuuccacuacaggggacaucagaacagugcauacuuuaaaguucagggcuaugcacagugaugucaaaguucacacccaaucugcuuucaugcacgauaggcuuucucuacuaaucacagaauuuugagaagagcaaaacaacuuucaaggauaauggggcaaucacuuucuuuucuucuuuagagucuaccggugccaaaaggaaggguaaaaaagaacacacuagucaagcucaaggcaugaauggcucccucggcuguaacagcugccuuaagguuuaaaacgugcacauuuggaaaaguggaaauggguuuagacuccuuccgucauggaggaggguacuauuucccaucaaagguacuccuaagaaauguguaguugugaguucauacuagacacaaggcaauaaacaaguuagcgaggucacaguuuaggggcuucaccuuuauaacaccaagaggagcaauauuuuaaauacgguuagcaaguaucaaauaauuugguuauuuucccagcagcaacaaaaaaagaccaaguuuaacaguauucaaaguuggcuguccuggagguugaauucccuaaagaaagcugugagaggacagagaugggugaggaacgaguggccucugcaaccugagauggccacauugcaaacucuuucuugcugcggaacuucuucuauuugcuaaggaacugccauuacacugguguuuacacagcaauuccgaaaggaaauggcaucaaggcaaaaucuugaugccauggaaggcccuuggaaugauccaauucagugguuuuacaaacccaccacaaaucggugccucggcagacauuugaaaccucucaucuaacccgacuuaaguguuccuugccuuccucagggauuccucuaauuugugaagucacuuugaaagaaugcgugcguguggcaggagggagcguguggugacuuggucacugccacucugguuccaaguucuguuucaggaggggacaggucagauuuugcuccagacauaggucacuuccccagggucggagaugaacuuaaaggcuaagaaacccagauuuaaggucaaaaccaggagcuggaagaggaggaaaagagaguggaagggguuaagaagcagcugggcaagagcagaagaugcuccagcagggacagaagcacgaccuggcccuccuuuccauuuagagcacauuccaucuggagaggucaaccgaaauauuaaucauguggacaggagaaaaggaugugaaaaaaccauuucucuuaucucacuuugaaaugugaaagugcuauuauuacacuuaaaaugcaugaaaaaccccucugcuaccugaagaguaggaaaccauccauuaguucaauaaauacugccaaggcaauuuucgucauuuucuucaagaauauuucaagaaccaauuuguuucaacugacacacgcugaguuauuaaucccuaguaacuucuaguaacuuccuaccguggcagugcuaaacaauguuuguuaaaaacaccuuuggggccgggcgcgguggcucacgccuguaauuccagcacucugggaggccaaggcgggcggaucacgagguuagaagaucaagaccauccuggguaacauggugaaaccccgucucuacuaaaaauacaaaaaaauuagccgggugugguggcgggcgccuguagucccagcuacucaggaggcugaggcaggagaauggcgugaacccgggaaguggagcuugcagugagcugagauugugccacugcacuccagccugggcgacagacaaagacucugucucaaaaacaaaaaaaaacaaaaaacacaaacaaaccaccuuggguacaauuuccugaaccagagucuaaagacagcgaguguccccagauagaccagagggcuccaucgccauugcucuguucucuccgcuucuguuacgagccauuccagagcgagauccugcuggaugcugauagugaaccacacacaguacugaaucagguuaagcucucugaaccuucaccauucuuuauccgcagagcaaaauuuuaaaacaacaucucacuauuuaaaucacaaggucuagcuggcaaucagaugggagcacauuacaugugcuagccuguacugcucgaugaacucuguacggacagaggcugcuugcaugcuacacugagaccuuuuuuuuuuuuuuuaaagauggaaucucgcucugucgcccaggcuggagugcaguggcacaaucucagcucacuacaaccuccaccugccggguucaagcaauucuccugccucagccuccccaguagcugggauuacaggcgcacgcugccacgcccagcuaauuuuuuuguauuuuuaguagagaugggguuucaccguguugcccaggcugguuucgaacuccugagcucaggcaaucugccugccucggccucccaaagugcuaggaucacaggugugagccaccaaacccagcauacaccgagaagacuucugaggucugucccugcagagggagggagugucacuggcuucuagcaggaaggggguagauggggcaggcaucagccaucucugccucuaaaaauauuaguucucauuaucuggaauaugauucuauggguaaaucuuagugaagaacagcccuuaggcuauaaauacguaauaugaguuauucuacauuauugugauucucuuucuuucuuaaacuauauagauguugugacaucauauggaauuuacggcauaaaauggggauaacaguacuucccccucauaacggugaggauuaaauguaaaccguguggcacaaggccugaccaacuguaagggaccaguaacuauauuauuaauauaguuacuauauauuauuauauuaauauuauauuaauauuauaaucacauuaauauuaauauauuaauauuauaaucacauuaauauuaauauauuaauauuauaaucacauuaauauuaauauauuaauauuauaaucacauuaauauuaauauauuaauauuauaaucacauuaucaauauauuaauauuauaaucacauuaucaauauauuaauauuauaauuacauuauuauuauauuauuauaucaauauuauauuaauauuauaucgauauuauuuuaauauuauaucaauauuauuauauuaauauuauaucaauauuauauuaauauuauaucgauauuauuuuaauauuauaucaauauuauuauauuaauauuauaucaauauuauauuaauacuacaucaauauuauauuaauacuauauuaauauuauaauaauauauuaauauuuuaauaauauauuaauauuauaauaauauauuaauauacuaauauaauaauauauuaauaugcuauuacaauaauauauuaauaugcuaauauuauaauaauauauuaauauauuaauauuguuaguauauuaauauauaguaacuauauuaauaauauaguuaguauauuaauauauaguaacuauauuaauauaguuacugauuuaagaacuacauuaauauaacuuauuuuauaaauuauuucagaaauaaggaaacugaggcacagcuauaaagcaauguccugagacuggcaccugggggcugcccucuuccugccagacugagugccucagagugcuacaacugaccagaggggagaagccaacugaggcagccuguuuacuucuaagggacuaacccacaugaaaagacccaggccuccugcgccggccucacggccccuacacgcguuaucaagcuuggagucaacuggacgaccugcugucccucagacagcugugagugccacacuucaccauaccgggacaaugugccuuugcauguguguccucugcccacccugggcccaugaacagcucacuccccuugcaaaacuugacuguaacucccucuagaagaauuuuuggacuuuccuaacuauuacacuuuuuccugaccgggaucuccuaaggcacucagguuccaucuuugauuucuucaaauauuuguguuucuuccaagggccaagcauuggagauccaaaaaggagcagcaauucccguccccgucccaggccuucagcacagggcagggagguggaucugcucaauaccagaaguuugagcaaccuguccuauuuggguuacauagcuuggguggugaaccugagcuggcccuuuagagacuuucggagguaaggcagaccuuuuggacaaacugaguugcaagaggcgaagcaaggacaacagccagacugugcgggacucgaacgacaagccaagaagguuaagaauaacaguauuuagagaacacuugcugugugcucuaugugcuaucuuacuuaauucucacaaaccaccacgagggguaggauguauacuaucaucucuacuuuugaaaugagaaaacugaggcuucaguggugaagacaaaugugucucuucuagggaaccacacuaccuuauucucccaccccggcccggggguguguaaugagggacuccuaucgaagucagcuguaagucuaucuugccuauucauuauacaggcugucgucuucgcgcaguaaggauaauauguguuuugauucaaagaccauccagcuugcacacugugaugaacagagaucaggagcucaugaaggcaagggcaagucuuauuuaccuuuaucuccccgaaccuagaagcgaggucaaacagaagcgcucgggguagcaagaaggcuuuguagauauugaaaugugaaugcaugcccagcccuuaccaggugcgugaccuuaggaaaugcacuuguccuuucugugccuuaauuuuuucaccaaccugcuaauguauguuccucagugaaaauuuaaaaaaaaaaaaguuaaaaaaacuaggaagcaaugaguuuccauagaguuacuucccaaggaacaagguuacgcgcuucgggagagagccgaugaaacaucaaacgcagcauccuacacagccccuauccaccguccccaaaccugcagagcucaaaguaaacgcggaaggguuaacaagcagcuugguccagggcgccgcccgaagugacugacucggccugacccgguuggaggagucgccgaaauaacacgagugcagggucuccaagacggcgagaguuuccaggucacuccagcucagagaacagcagaggcuuucggacuaucaagucagugccgugugccugucacggccugugccgcucaacgaggaaaccgacgcaccgagaaggacgcagccggccgagagcagcgugggguccagauccugccuuccggcuccccgugcgccccccgcuuaccuuccugagggcccgugcgcgagacaccccgggcagucccacgucguggcgcgucuuccggcccaggaucuggaacuucugccuguuaacuuucaccucgaacggauuggaguuggccuucgccgggcccccucgcgcucccgccggcgccccggaggccuuccuucgcgccccgaccuucuucgccuucgccauggcgcgcgccccgcugcgcccaagggcccgagacccgaagagagacaggcgcgcgcuacccuaagacacgug

SEQ ID NO: 191466 - RNA, 169280 nt, Homo sapiens
gcugccgggacggguccaagauggacggccgcucagguucugcuuuuaccugcggcccagagccccauucauugccccggugcugagcggcgccgcgagucggcccgaggccuccggggacugccgugccgggcgggagaccgccauggcgacccuggaaaagcugaugaaggccuucgagucccucaaguccuuccagcagcagcagcagcagcagcagcagcagcagcagcagcagcagcagcagcagcagcaacagccgccaccgccgccgccgccgccgccgccuccucagcuuccucagccgccgccgcaggcacagccgcugcugccucagccgcagccgcccccgccgccgcccccgccgccacccggcccggcuguggcugaggagccgcugcaccgaccgugaguuugggcccgcugcagcucccugucccggcgggucccaggcuacggcggggauggcgguaacccugcagccugcgggccggcgacacgaacccccggccccgcagagacagagugacccagcaacccagagcccaugagggacacccgcccccuccuggggcgaggccuucccccacuucagccccgcucccucacuugggucuucccuuguccucucgcgaggggaggcagagccuuguuggggccuguccugaauucaccgaggggagucacggccucagcccucucgcccuucgcaggaugcgaagaguuggggcgagaacuuguuucuuuuuauuugcgagaaaccagggcggggguucuuuuaacugcguugugaagagaacuuggaggagccgagauuugcucagugccacuucccucuucuagucugagagggaagagggcugggggcgcgggacacuucgagaggaggcgggguuuggagcuggagagaugugggggcaguggaugacauaaugcuuuuaggacgccucggcgggaguggcggggcagggggggggcggggagugagggcgcguccaaugggagauuucuuuuccuaguggcacuuaaaacagccugagauuugaggcucuuccuacauugucaggacauuucauuuaguucaugaucacggugguaguaacacgauuuuaagcaccaccuaagagaucugcucaucuaagccuaaguuggucugcaggcguuugaaugaguugugguugccaaguaaaguggugaacuuacguggugauuaaugaaauuaucuuaaauauuaggaagaguugauugaaguuuuuugccuauguguguugggaauaaaaccaacacguugcugauggggagguuaauugccgagggaugaaugagguguacauuuuaccaguauuccagucaggcuugccagaauacgggggguccgcagacuccgugggcaucucagaugugccagugaaaggguuucuguuugcuucauugcugacagcuuguuacuuuuuggaagcuagggguuucuguugcuuguucuuggggagaauuuuugaaacaggaaaagagagaccauuaaaacaucuagcggaaccccaggacuuucccuggaagucugugugucgaguguacaguaggaguuaggaaguacucuggugcaguucaggccuuucucuuaccucucaguauucuauuuccgaucuggaugugucccagauggcauuugguaagaauaucucuguuaagacugauuaauuuuuaguaauauuucuuguucuuuguuucuguuaugauccuugucucgucuucaaaguuuaauuagaaaaugauucggagagcaguguuagcuuauuuguuggaauaaaauuuaggaauaaauuauucuaaaggauggaaaaacuuuuuggauauuuggagaaauuuuaaaacaauuuggcuuaucucuucaguaaguaauuucucauccagaaauuuacuguagugcuuuucuaggagguaggugucauaaaaguucacacauugcauguaucuuguguaaacacuaaacagggcuccugaugggaaggaagaccuuucugcugggcugcuucagacacuugaucauucuaaaaauaugccuucucuuucuuaugcugauuugacagaaccugcauuugcuuaucuucaaaauauggguaucaagaaauuuccuuugcugccuugacaaaggagauagauuuuguuucauuacuuuaagguaauauaugauuaccuuauuuaaaaaauuuaaucaggacuggcaagguggcuuacaccuuuaauccgagcacuuugggaggccuagguggacgaaucaccugaggucaggaguuugagaccagccuggcuaacauggugaaacccugucucuacuaaaaauacaaaaauuagcuggucaugguggcacgugccuguaauccaagcuaccugggaggcugaggcaggaaaaucgcuugaacccgggaggcagagucugcagugaguugagaucacgccacugcacuccagccugggugacagagcgagacucuaucucaaaaaaaauuuuuuuuaauguauuauuuuugcauaaguaauacauugacaugauacaaauucuguaauuacaaaagggcaauaauuaaaauaucuuccuuccaccccuuuccucugaguaccuaacuuuguccccaagaacaagcacuauuucaguuccucauguauccugccagauauaaccuguucauauuguaagauagauuuaaaaugcucuaaaaacaaaaguaguuuagaauaauauauaucuauauauuuuuugagauguagucucacauugucacccaggcuggagugcagugauacaaucucggcucacugcagucucugccucccagguucaaaugcuucuccugccucagccuucugaguagcugggauuacaggcgcccaccaccauguccagcuaauuuuuguauuuuuaguagagaugggguuucaccauguuggccaggcuggucuugaacuccugaccuugugaucuguccaccucggccucccaaagugcugggauuacaggugugagccaccaugccuggcuagaauaauaacuuuuaaagguucuuagcaugcucugaaaucaacugcauuagguuuauuuauaguuuuauaguuauuuuaaauaaaaugcauauuugucauauuucucuguauuuugcuguugagaaaggagguauucacuaauuuugaguaacaaacacugcucacaaaguuuggauuuuggcaguucuguucacgugcuucagccaaaaaauccucuucucaaaguaagauugaugaaagcaauuuagaaaguaucuguucuguuuuuauggcucuugcucuuugguguggaacuguggugucacgccaugcaugggccucaguuuaugaguguuugugcucugcucagcauacaggaugcaggaguuccuuauggggcuggcugcaggcucagcaaaucuagcaugcuugggaggguccucacaguaauuaggaggcaauuaauacuugcuucuggcaguuucuuauucuccuucagauuccuaucugguguuucccugacuuuauucauucaucaguaaauauuuacuaaacauguacuaugugccuggcacuguuauaggugcagggcucagcagugagcagacaaagcucugcccucgugaagcuuucauucuaaugaaggacauagacaguaagcaagauagauaaguaaaauauacaguacguuaauacguggaggaacuucaaagcagggaaggggauagggaaaugucaggguuaaucgaguguuaacuuauuuuuauuuuuaaaaaaauuguuaagggcuuuccagcaaaacccagaaagccugcuagacaaauuccaaaagagcuguagcacuaaguguugacauuuuuauuuuauuuuguuuuguuuuguuuuuuuugagacaguucuugcucuaucagccaggcuggagugcacuagugugaucuuggcucacugcaaccucugccucuuggguucaagugauucucaugccucagccuccuguuuagcugggauuauagacaugcacugccaugccuggguaauuuuuuuuuuuucccccgagacggagucuugcucugucgcccaggcuggagugcaguggcgcgaucucagcucacugcaagcuccgcuucccgaguucacgccauucuccugccucagucucccaaguagcugggacuacaggcgccugccaccacguccagcuaauuuuuuuguauuuuuaauagagacgggguuucaccguguuagccaggaugaucuugaucuccugaccucgucauccgccgaccuugugauccgcccaccucggccucccaaagugcugggauuacaggcaugagccacugugcccggccacgccuggguaauuuuuguauuuuuaguagagaugggguuuugccaugaugagcaggcuggucucgaacucccggccucaugugaucugccugccuuggccucccaaagugcuaggauuacaggcaugagccaccauaccuggccaguguugauauuuuaaauacgguguucagggaagguccacugagaagacagcuuuuuuuuuuuuuuuuuuugggguuggggggcaaggucuugcucuuuaacccaggcuggaaugcaguaucacuaucguagcucacuucagccuugaacuccugggcucaagugauccucccaccucaaccucacaauguguugggacuauaggugugagccaucacaccuggccagaugauggcuuuugaguaaagaccucaagcgaguuaagagucuaguguaaggguguaugaaguagugguauuccagauggggggaacagguccaaaaucuuccuguuucaggaauagcaaggaugucauuuuaguugggugaauugagugagggggacauuuguaguaagaaguaagguccaagaggucaagggagugccauaucagaccaauacuacuugccuuguagauggaauaaagauauuggcauuuaugugagugagaugggaugucacuggaggauuagagcagaggaguagcaugaucugaauuucaaucuuaagugaacucuggcugacaacagagugaaggggaacaccggcaaaagcagaaaccaguuaggaagccacugcagugcucagauaagcaugguggguucugucaggguaccggcugucggcugugggcagugugaggaaugacugacuggauuuugaaugcggaaccaacugcacuuguugaacucugcuaaguauaacaauuuagcaguagcuugcguuaucagguuuguauucagcugcaaguaacagaaaauccugcugcaauagcuuaaacugguaacaagcaagagcuuaucagaagacaaaaauaagucuggggaaauucaacaauaaguuaaggaacccaggcucuuucuuuuuuuuuuuuuugaaacggaguuucgcucuugucacccgggcuggagugcaaugaugugaucucagcucacuaaaaccucuaccuccuggguucaagugauucuucugccucagccucccaaguaacugggauuacaggcguauaccaccaugcccagcuaauuuuuguguuuuuaguagagaugggguuucaccauguuggccaggcuggucucgaacuucugaccucaggugauccacucgccucagccugccaaagugcugggauuacagguuugggccacugcacccggucagaacccaggcucuuucuuauacuuaccuugcaaacccuuguucucauuuuuucccuuuguauuuuuauuguugaauuguaauaguucuuuauauauucuggauacuggauucuuaucagauagaugauuuguaaaaacucucccuuccuuuggauugucuuuuuacuuucuugauagugucuuuugaaguguaaaaguuuuuaauuuugaugaagucgaguuuaucuauuuugucuuugguugcugugcuucaagugucauaucuaagaaaucauugucuaauccaaagucaaaaagguuuacuccuauguuuucuucuaagaauuuuagaguuuuacauuuaagucugauccauuuugaguuaauuuuuauauaugguucagguagaaguccaacuuuauucuuuuccaugugguuauucaguugucccagcacuguuuguugaagagacuauucuuuccccauggaauuaucuuaguacccuuguugaaaauuaaucguccuuaauuguauaaauuuauuucuagacugucaguucuaccuguuggucuuuaugucgauccugugccaguaccauacagucuugauuacugaaguuugugucacaguuuaaauucaugaaaugugaguucuccaacuuuguuccuuuucaagauugauuuggccaugcugggucccuugcauuuccguacgaauuguaggaucagcuugucaguuucaacaaagaagccaaguaggauucugagagggauuguguugaaucuguagaucaacuuggggaguauucgcaucuuaacaauauugucuuccaccuaugaacaugggcaaacuuuguguaaauggucagauuguaaguauuucgggcugugugggcacagugucucugucacagcuacgcggcucugccauuguagcaugaaaguagccauaagcaauauguaugagugucuguguuccaauagaauuuuauuaaugacaaggaaguuugaauuucauauaauuuucaccugucaugagauaguauuugauuauuuuggucaaccauuuaaaaauguaaaaacauuucuuagcuugugaacuagccaaaaauaugcagguuauaguuuucccacuccuagguuaaaauaugauaggaccacauuuggaaagcauuucuuuuuuuuuuuuuuuuuuuuuuuuugagacggaguuucacucuuguugcccaggcuggagugcaguggcgcgaucucggcucacugcaaccucugccucccagguucaagacauucuccugcacggccucccuaguagcugggauuacaggcaugcgccaccacacccagcuaauuuuguauuuuuaguagagacgggguuucuccauguuggucaggcuggucuugaacuccugaccucaggugauccacccgccucagccucccaaagugcugggauuacagggugugagccaccacacccugcuggaaagcauuucuuuuuuggcuguuuuuguuuuuuuuuuaaacuaguuuugaaaauuauaaaaguuacacauauacauuauaaaaauaucuucaagcagcacagaugaaaaacaaagcccuucuugcaagucugucaucuuugucuaacuuccuaagaacaaaaguguuucuugugucuucuucccagauuuuaauaugcauauacaagcauuuaaaugugucauuuuuuguuugcuugacugagaucacauuacauauguauuuuuuuacuuaacaaugugucauagauauuguuccauagcaguaccuguaauucuuauuaauugcuauguaauauuuuagaauuucuuuuuaaaagaggacuuuuggagauguaaaggcaaaggucucacauuuuuguggcuguagaaugugcuggugacauauucucucuaccuugagaaguccccauccccaucaccuccauuuccuguaaauaagucaaccacuugauaaacuaccuuugaauggauccacacucaaaacauuuagucuuauucagacaacaaggaggaaaaauaaaauaccuuauaaagcacuguuuaauauuguauuaaauuggaucaauuugggggcuagaauguauguuagagacaugauauguccauagguccuugcuaucacagugaggucucagggacagucguuugguaucauuugggaucucauaagcagacucucucugcuugaccugacaaaucagagucuguguuuuaacagguucagugagugacuuacaugcacauuggaguuugggaagcuccacuguaggugcuuagaccuuaccuuuguuguugcuaauaacaaugcaagcauuugggaggaagaccuguguugcucauauguguccagguguagcugagguggccuugcuuaucugcuguagggccguugagcauuucuguagcugugaugagugagcugaggugagccugcggagagcucccagccauugguagugggacucgcuuagaugaacuggaaggacccuuucaucugagcagccacuauggagaaaaacaaccgaaugaggggagagacaaugugcaauuuuauuuagggcacaaaggagagcugugguuagaaggugacauuugaguggaaagggggcaagccauguguauagcgggagaagagagguccaggcagaguuaacagaaggcagaaaugcuuuccauguuugagaaccaguaaggaggccaguggcugaaguaaggugaagggcagaaauaaggaugaggcugcgagagaugagagguuagagacgagcgucuugugcaccaagauaagcuuguguggucaaaacaaguaguuuaauuuauguuuuuaaaagaucauuuuggcugggcacaaugguucaugccuguaauaccaguaguuugagacgguguggugggaggauugccugaggccagacgaccagcauagccaacauagcagcaccuauaaggucucuacaaaaaacuuuaaaaaauuagcugggcauaguggugugugccuguagucccagcuacucaggaggcugaggaggcuggaggauugcuugaguccaggaguuugaggcugcagugagcuaugauuaugccacuacacuacaaccugggcaagagagugagacccugucucuaaauauacacacacacacacacacacacacacacacacacacacacacacacacacacacacauauauauguauauauaugcauuuagaugaaaagaucacuuugacaauaccacaugcuggugaggauuuagaaaaacuaggucacuuauugcuggugggaauauaauauaguacggccacucuggaaaacaguuuggcaguuugucauaaaacugaacauaccguuaguauacagcccagcagcaacuacaauccugggcauuaauccuagagaaaugaaaccuuaauguucacauaaaaaccuauacucaaguaugcauagcagcuuuacccauaauaucuaagaacuggaaucagcucagauguccuucaacaggugaaugguuaaacuacucaguaauaaaaaggaaugagcuacugauagcaugcaacaguuuaggugaaguuaugcuaaugaaaaaagccaaucccaaaagguuauacauacuguaugauucuauguuuuuuugcaauggcacaguuuuagggauggagaauagauuagugguugccugggguuagagaugggguaguagaguagguuagugguggcagaggagagaaaagagagggaggugaaugugguuauaaaaggacaacacaggggaauacuuguaauggaaaugcuuugucuuuuuuuuuuuuuuuuuuuuuuuggcgacagagucuugcucuguugcccaggcuggagugcaguggcaugaucuuuucucacugcaaccucugccuccuggguucaagugauacuugugucucagucucccauguucagagugaaacaaaccagagguaauguucauccaaauaauccaacacacaugacauuaaaacaucaagaucaggucggacgugguggcucaugccuguaaucccagcacuuuugggaggccaaggugggcagaucacuugaggucaggaguucgagaccagccgggccaacaugaugaaaccccaucuugacuaaaaauacaaaaauuagccgggcaugguggugugcaccuguagucccagcuacuugggaggcugaggcaagagaacugcuugaacccgaggggcagagguugcagugagcugagagugcgccauugcacuucagccugugugacagaguaagacuccaucuccaaaaaaaaaaaaccaagaucaauuaaaauacagcauuacugggccgggugugguggcucacaccuguaaucccagcacuuugggaggccgagaugggcagaucacgaggucaggagauccagaccaucccggcuaacacggugaaaccccgucucuacuaaaaaauacaaaaaauuagccggguauaguggugggugccuguagucccagcuacuugggaggcugaagcaggagaauggugugaacccgggaggcagagcuggcagugagcugagaucgcgccacugcacuccagccugggcgacagagcaagacuccgucucgggggaaaaaaaaaaauaaauaaauagaaugcuguaguguccuugaguuuacaugccccuccuuacgcuugugugcccgugcagauugcuugauuacacaauuagaggaggcuggcggaggauuguuuuaauuuuuuuuuuuuugagacagucuggcucuguuccccaggcuagagugcaauggcgcaaucuuggugcacugcaaccucugccuccuggguucaagcaguucuucugccgcagccucccgaguagcugggauuauaggcgcccgccaccacgcccaacuauuuuuuguauuuuuaguagagcagcguuucaccaugcuggccaggcuggucucgaacuccugaccucagaugaucugcugccccagccucccaaagugcugggauuacaggcgugagccacaccuggccguuuguuuuaauuuugaaggugaagugaaagugacuacauuuaccaaaagugauugaaaagccaggacuguucuuacccuguuuuuccaguucuugcucagagcaaggugguuucuuuuucacuuaaucaccauacuuacuuuucauguagaacaagucaguuugaguuaucaguucaucaucuuaacuaaauuccaugggggaaggaauuaguuuuaguuucuuaaacuuccagguuugcuuauuggacaaaaugagauagcaaggcaguguuuuuaaguuagauuuuuuauuucuuugguaauacaauuuucucagaaacuuaguagucuuuuaguuuaguuguuuuuaguugguccuauguuuuggaucaccccucucuacuuuauuuugauagugccaacugugaagacaucugaagccauagguuuggaugggaaggaggcaucuuuagccugaucaucuucgccaggcuguuuaucuccuuuugcuuggcugagaagucuuaauaggaggcuuauucccagcuauuuggggacauagaagcaguuagccauugcuuauauuuuacugaggucugugugguauguugauuguagucaguuaacgauuuugagaacugaaggcagccugguauauauagaguagguauuagacuguguuucuucuaauugaauuucccaucucuuguaaucuaugccaucaucuucuguacugcugagaaagaaagaaaguuucuaaucaaacuauaccacugguuguaagaugcaguuuggcuuuagugauguuaacacaugauucaaacgugaaauugauugaguauuggugaaauacagaggagauuuaaagccagaagaccuggguuuaaaugcuggcuguaugacuucauaucugugugaucuugggcaugucaugguuggcacuucaauuucuucucucuauaaugggggaagugaggccagucaugguggcucauaccuauaaucccagugcuuugggaggccaagaugggaagaucgcuugaggccaggaguuugagcaauugggcaacaucgugaggccccgucucuacaaaauauuuugaaaaaauuagccaggcccaguggugcgugccugugguccgcgccacucaggaggcugagacgggaggauccuuucagccuaggaguuuaaggcuaaagugagccaugauugugcuaucguacuccagccugggcagcagagcaagauccugacucuaaaaaaaaguaaaauaaaguaaaaugggggaaaugaacugcuuuaguaacaucaucuguuuuuucugugagcagcguagcuugacagccauuggugaacucgugcccugugcuucccuguccagauccccauucugcccgcaacauggaguauaacgguuuauucauaguagucgagaaacacucacugaaugaaugaaugagguguagaacuaaguggaguggguaauucaacacauauuaauuuccuucuuuuuuuuauuuuuagaaagaaagaacuuucagcuaccaagaaagaccgugugaaucauugucugacaauaugugaaaacauaguggcacagucugucagguaauugcacuuugaacugucuagagaaaauaagaacuuuguauauuuucagucuuaaugggcuagaauauucuuugugucccagcuauuuuaaauggauucagaaauccauuuaagaugaagaaggacccuuuucccauauuucuggcuauauacaaggauauccagacacugaaaugaauaauguucccuuuuuguaaucuuuuaugcaaaaauuaaaaccauuaugguaauugaacaacauguuuauguuuaguuaacacccuuagcaacuauaguuauuuuaaaaccaucuaugguuugauauuuuugcauuuguugcaauaguaggaacagcacaagacaguucaguuugucucucuuauuugcuuuuucuuggcaguuugcuguccuauuguaccucugcuccuagcaguggcuggagcccacuccucugugcuucgggauuaguggggaucguggggcauugacuguaggucagcuuuccuugcuugaucuuucucacugggaugaacuagcagcaccuucuuuuguagcugcuuugcuuuugacuaucuuucugaccguuguuccuaguagcuguagaugguaaauauauuuaggccuguuuccaauggcucaguaggagacauauucaccuaugauaucugaauucuguuacccacaugggcaugcgugaaauaguugccuugccuuacuuucccuuggaauaaauaauucauguuauucuccugguagaagcuagaaaaagccuuuauagucagucagaaaaaaauuuuuagacaaauaaucuugauuuuaguacugacaaaaacguguggugauucuuuuuuuaauuuuuuuuugagacggaguuucacucuuguugcccaggcuggagugcaauggcgugaucucggcucacugcaaccucugccuccuggguucaagugauucuccugccucagccucccaaguagcuggaguuacaggcaugugcuacugugcccagcuaauuuuguauuuuuaguagagauguuggucaggcugaucucgaacucccaaccuuaggugaucugcccgccucagccucccaaagugcugggauuacaggcgugagccagggcgcccggugauucauuuguuuuuucaaaaaauuuccucuuggccauugcuuuucacuuuuguuuuuuuuuuuuuuuugagacggagucacgaucugucacccaggcuggagugcaguggcaugaucuuggcuuacugcaagcucugccucccagguucacgccauucuccugcuucagccuggcgaguagcugggacuacaggugcucgccaccacacccggcuaauuuuuuguauuuuuaguagagaugggguuucaccguggucuugaucuccugaccucaugacccgcucaacucagccucccaaagugcugggauuacaggcgugagccaccgcgcccggcccucucuugucuuuuuauugugguaaaaugcacauaaaauugacugucuuaaccauuuuuagggguacaguucaguauauauauucguaauguuguacagccaucacugccaucuacuucauaaguuuuucuucugucaaaacugaacaucugucuucauuaaacucccuaucauccauucuuuccuguagucccuuucuacuuucugucuguaugaguguaacugcucuggagaccucauguaaguggauuccuacaggauuuguguuuuuuuuuuggugaucugcuuauuuuuaaugccucugugcauuuguauuauauacuuucaaagugauuucacaaaaccguuucauuuuagguuaacucauuucuguuguuugugaaauacuguguaugauucuguucuguuucugucuaauuuguggaaauguugugggaagaaaaugaaauaacaaaugagcauauguccugaaaauaaaaauauaaaaauucuaaguuagcaugcuauuguagaauacaacgcuaugauaaaaguaggaaaaaaaaagguuugaauucuaucucugcuaccuguguaagcugggugacuuuagauaagcuguaacguguuugagccuuacuggcucauuuuugaaauguaaucccuaguuacacaguucuugugggaucagaugguacaugugaaacacugugaaaaagcaacugcauagauauguucauuagccaccugagcgggaagcguaucccauugcgaugcccaucauccaaagcuauauguuaucuuuacuuuuuuuuuuuugagacagagucuugcucuguugcccaggcuagagugcaguggugcaaucucagcucacugcaagcuccaccucccggguucacgcuauucuccugccccagccucccaaguagcugggacuacaggcacccgccaccaugccuggcuaaauuuuuguauuuuuaguagagaugggguuucaccguguuagccaggauggucuugaucuccugaccucgugauccgcccgccucggccucccaaagugcugggauuacaggcgugagccacugccccuggccaucuuuacuuuuuuugugaaaugacuuuaaauacuuggcaaacauuuggucauuguucaucugaucuccaccauccaggucucagagaacauaauuucucucugaaagcuuauugacccaggaaauaagaucucuuucaaucugagugcgucaggcuuuauucuugucauuuugucuuuugauaauuuucaaauggaauucauggaauguuggcuuauauucauauauuaguaaaguauguugagacaucuuaagauugauuugugguucuauaugccauauuaaaucaaaauaauagcuguuaaugguuuucacauuagucugucucuuguuuuuauggaguaaugcugagaguucauuaugcuuguucuacagaagagcauguuaaaaggaguuuuuggagucagagagguuauucuugguuucauaggauacacucuauacuuuuuagggauuucagaguauauagcugaaggugauauuuuauguaaauauguuuuauggaaacuuauugcucaucgcuguuuccuguuaacucuccuaaaauauaauuaaacuuuuggaacuuuuuuauagcuuuugugcuagacuaauuuuugucucuaaugagguuauauaaauggcagcuucugacguuuucaauguaggaagucauuuaaaacuucauguauauugugaaaauguagucugcuuuaagcucucuaaaguggucuaaguuacugguuccuaaguauggaugagcaucaaaaucaucuggaaaauuuguuaaaaauacaguaaugaaggcaccucacuguccuuuuucccaaacauacuucugcauucuguuugaguagguagggacuacacauuuuucacaaguauccucuugggaauacccaggaaugcuuacuugagcaaccucuuacuaauauguaccuugauaagguggcuagguaaacauaaauauacaaaaauccauagaucucccauauauuagcauaaaucagcuagaaaauauaacguuuaaagaucuaguucacaguagcaccaauauaucgaacucuaaggaaucgauaaauaugcaaaaacuuuauaaaaacuucuguuaauguuucugaaagauauaggugaccacuuucuagauaggaagauuuuauauuacuaaguugaauuuucucuaaauuaacacagaaauuuaaaauaaucuugaucaaaauucuaguagagguauuuuugaacuuguucacugcaagaauaaauacauaauugcaaagaauaucucaaaaucaucaccaggccuggugugguggcccaugccuguaaucccagcacuuugggaggcugaggcaggcagaucaccugaggucaagaguuugagaccagcuggaccagugcggugaaacacugccucuacuaaaaauacaaaaauuagcugggugugguggugcaugccuguagucccagcuacuugggaggcugaggcaggagaauugcuugaacccaggagguacagguugcggugagccuagaucgcaccacugcauuccagccugggcgacaagagcaaaauucugucucaagaaaaaagagaaaaaagaaaaagaaaucaacacuaauauggugagacuuaauguaugugacauuaaaauagugauuggauguuaaaacagguauagaacagaaagaagaguguauguguguaucuguaugaauuuaugauggguguaacauauauguauuagggaaaugagggaaaugauacauuucucugacuuugggagaacauuauaucucuaccucauauugcaaacaaacauaaaguucagauuaauuaccuaaaugugaaaaaaugaaauaauuucuuuaaaaaauguaaucuuaguuugaggaagguuaacauuauaaaggaaaaaacuguuuugaguggaauauaguucaauaugucaaaauccaccuucaacaaaauugaaaguaaauugaacuuggggaaaguauugacagcauauagaucaaagguuacuagccuguguaaagagcaguuauaaauaucguuaagaaaaacacugucgaccugucggcaccuuguucuccgacucccagccuccagaacugugacgaguaagugcuuauuguuuaaaccacccagucuguaugugguauuuuguuauagaaacucaagcugauuaggacacuaguaaucaguagacugaaacugaaacaaaaauaagaaccuuuuuuaccugucaaauuggcaaacauuaagaauauucagauuuuugucagaggugauacaaccuucuaagaaggcaauuugggaaaauauaaagcuuuagauuauuauaugucugaccuagcaguuuuaccucuagggugcuuaccccuaggaaaguguguaaugauauuggugcagugcccuucaucccauuagaaaauuaaaaauaaccuuaauggccuaccacuaaaaggggauugaaaauuuaagauauauuuauuuauguguuuauugagauggagucuugcacuguccgccugggccagagugcaauggugcgaucucggcucacugcaaccucugcuucccggguucaugugauucuccugccucagccuccugaguagcugggauuacaggcucacaccaccgcacccggcuaauuuuuuguauuuuuaguagagaugggguuucacuguguuggccagacuggucucgaacuccugaccucaugauccgcgccccucggccucccaguguugggauuacaggugugagccacugcgccuggccagauacauuuauacaagagaauguuaguuaacauucauagauauuuauauuuuguuuacuuuuuauuaaaaaaauuuuuuuuagagacaggaucuuacucugucacccaggcaggaugcaguugcacaaucauagcccacugcagccugaacuccugggcuuaagugauccuucugccucagccuuuugaguaccugggggacuuuaggcagugcuacuauaccuggcuaauuuuuaaauguuuuauagaugagaucuugcuguauugcccaggcuggucuagaauuccugggcccaagugauccucccaccuuggccucccaaagcgcugagauuacaggcaugagccaccacuucugaccaauagauauuuauauuugugacuggaaaauauauuaacaauguguuaaaaaauucaguuaaaaaauaaugaaagauuuuugcuucuggcuaagauagaauaacaaggacagcauuuaucuucuugccuugaaauaguugaaaacggaagaaauauauguaacagugguuuucaaguuauugggcaucaggcaaagaagaauaguuaucccaggaaaaugaauguggagagcccuacaauuuccuuacauuacugccuggucauggcaagaggaaaaacugagaggagacugaggcugagccagugguuugcuggguugaggaggcagagcugggagugcagagaugcaagguggugagagcccauauggaagaauaccagggaagagagcugcagagggagcuccggagaccugcacccugcccucucaguacccugucauguguguagcugaguacugacgagcacuugcuugugcggaaaugacccagggcuggagguagagccaccugaaaggauuagaaggaacaguugcugaaagucacacagggccaggaagaauuucuaaucacaccaguuggaguggaaaaccucagcucucauagagcagguaggguacucagaaggguuugcccaccuagccccagacuaaguuucguuacucugacccuaccuaauauuaaaaagagauuaauuaaauuguucgcaacaaaaauaauauauuucaguguuuguaacacguagaagugaauuguaugacaauagcauaaaggcuggaagagcagaaauugacauguauuugcgcugggcagaauaaugcuccccucuuuccccaaaagauaucaaguccuaaucccuggagccuguaaauauuacuuuauauggaaaauuguuuuaugaugugauuaaauucaggaucuugagaugagggggcuaucuuggaugaucuggguaggcacuaaaugcaaucacauauauauaaaaaggaggcagagggagauuuuacacacagagagaaggcccugugaagauggaacagaaagauuugaaggugcuggccuugaaaauuggagugaugaagcuauaagccaaggaaugcagcagccaccaaagcuggaagaggcacggagcaguucucauuuagagccuacuccagagggaauguggugcugccaauuccuuuuuuuuuuuuuuuuuuaagauaucauuuaccccuuuaaguugguuuuuuuuuuuuuuuuuuuuuuuuaguauuuauugaucauucuuggguguuucuuggagagggggauuuggcagggucauaggacaauaguggagggaaggucagcagauaaacauguaaacaaaggucucugguuuuccuaggcagagggcccugccacguucugcaguguuugugucccuggguacuugagauuagggaguggugaugacucuuaacgaguaugcugccuucaagcaucuguuuaacaaagcacaucuugcaccgcccuuaauccauuuaacccuuaguggacacagcacauguuucagagagcacgggguuggggguaagguuauagauuaacagcaucccaaggcagaagaauuuuucuuaguacagaacaaaauggaguguccuaugucuacuucuuucuacgcagacacaguaacaaucugaucucucuuucuuuucccacauuuccuccuuuucuauucgacaaaacugccaccgucaucauggacuguucucaaugagcuauuggguacaccucccagaugggguggcggccgggcagaggggcuccucacuucccagauggggcggccgggcagaggcgccccccaaccucccagacggggcggcggcugggcgggggcugccccccaccucccggacggggcggguggccgggcgggggcugcccaccaccucccggacggggcggcuggccgggcgggggcugccccccaccucccggacggggcggguggccgggcgggggcugccccccaccucccggacggggcggcuggccgggcgggggcugccccccaccucccggacggagcggcugccgggcggaggggcuccucacuucccggacggggcggcugcugggcggaggggcuccucacuucucagacggggcggcuggucagagacgcuccucaccucccagacgggguggcaguggggcagagacauucuuaaguucccagacggagucacggccgggcagaggugcucuucacaucucagacggggcggcggggcagaggugcuccccacuucccagacgaugggcggccgggcagagaugcuccucacuuccuagaugggaugacagccgggaagaggcgcuccucacuucccagacugggcagccaggcagaggggcuccucacaucccagacgaugggcggccaggcagaaacgcuccucacuuccuagacgggguggcggcugggcagaggccgcaaucuuggcacuuugggaggccaaggcaggcggcugggaggugaagguuguagugacccgagaucacgccacugcacuccagccugggcaacacugagcacugagugagcgagacuccgucugcaaucccggcaccucgggaggccgaggcuggcagaucacuugcagucaggagcuggagaccagcccggccaacacggcgaaaccccgucuccaccaaaaaacacgaaaaccagucagacauggcggugcgugccugcaaucccaggcacuuggcaggcugaggcaggagaaucagguagggagguugcagugaguagagaugguggcaguacaguccagccuuggcucggcaucagagggagacugugcgagggcgagggcgagggcgagggaauuccuuaauuucaguuuagugauacuaauuuuggacucuggccucuaaaacugugaaagaaaaaauuuuuuguuuguuuguuucuuuuaagccacauaguuugugguaauuuguuacagcagcugcaggaaacuaauuuaugcugcaugugaaaugguguaauaagguagauugugaugaagauacauaguauaaacaauuaagcaacaacuaaaagcacaacaaggaauuauagcuaaugaaccaaaaaaggagauuagaauaauaaaaauggugaaucccaaagaagccagaaauaggggaagaggcaaauaaaggaaagaaagagcuugaugguagauuucaaccuaacuaugucaaaaaggacauuacauguaaaaggcagcgauuuuucagauugaauggaaaaguaagacucgguauaugcugcugccugcaagaaacacauucuaaauauaaaggcaaaaauaaccuacagguaacagaacggaaagaaguucacugugcuuacaagaauuagaugcaagcuagacugguucuguuaauaucagacaaaguggauuucaaagcaaaggcucuugcccaggaugagauggucauuucauaaugaugaaggggauucguucaucagccuggcauagcaagcugaaauguuuaugcaccggacuacagagcuaaaauacaugaagcaaagccugacagaacuacaaguagaaacagacaaauccacagugauagagauuucaguagccgcucucaaugauuuguagaacacguagccauaauaucuggaucuagaacacuugaccaacacuguccccugugcaaccucauuggcauuuacaggacacuccacccagcaccagcagaagagacacucucucaagugcucacagaauguuugccaagauagagcagaugcugggccauaaaacaagucucuaaauuaaaagcauucaaauuauucagaguauguuuucugaccucaguaucauuaaguuggaauauauuauaggaagauaaccuggaaaagccucagauauguggaaaaacccauuuccacauggcccaugggucagaagugaagucaaaagggaaauuugaaagucuuuuggauugacugauauaaaaacaauagauuucuaaacuuguggggugcuguuacagcauaguaaauggaaauuucuagcauuaaaugccuguuuuaggaaagaaagauuucaaaucaaugaccucagcuucuaccuuuggaaacuugaaaaugacaagcaaauggaauccagaguuaccagaagggccagguacgguggcuuaugccugcaguucugccacuuugggaggccgaggcagguggauuguuugagacuggcaguugaagaccagccugggcagccuagggagaccccauaucuacaaaaaacaaaaaaauuagccaggugugguggcaugugccuguagucccagcuaaccaggagucuaaggugggaggauugcuugagucugggagguugaggcugcagugaacugugauugugccacuguguuccauccugggcaacagaaugagacccugucucaaaaacaaaaacaguuacuagaagaauggacaucauaaagauaggagcagaagucaguaaaauagaaaacaaaaauacauaggaaaucaauaaaaccaaaagcugguucaucaagaacaucaauaaauugguaaagcugauaggaaaaacagugaagucacaaauuagcaauaucaggaaugagggagaugacaguaguauagauuauauagauauuaaaaggacuguaugaggcagguguggugguucacgccuguaaucccagcaccuugggaggccgagguggacagaucaccugaggucaggaguuugggaccagccuggccaacauggugaaacucugucucuacuaaaaauacaaaaauuaguuggucguggugcugugugccuguaaucccagcuacuugggaggcugaggcaggagaauugcuugaaccugggaggcggagguugcagugagcugagauugugccguugcacuccagccugggugacagagcaagacuccaucucaaaacaaauaaauaaauaaaaaggacuauaugguaauauuaugaacaacuuuaugccaauaaauuugacaacuuauagaugaaauggaugaguuccuugaaagacacagaaacuauuaaagcucucucaagaagauauagauaagcugauuagcccuauaucuauuuuauugaauuuaaauguaaaaaucaauauuuaguuacuggaaaacuuuuaagugugguuggaaaugguauacgaacuuuuucaacugaauuuuaugaagucuaaucacagguaaagguuuucugaugaaaauuuagugucugaauugagauauacuguaaaaaauguuauauaucuuaauuauuucuucacauuaauuacauguugaaauaauacuuuggguguauuggguuaaauuaaauauuaugaaaaucuugccuguuuucuuuuuacuuuugaugcgucagcuaggaaauauaaaaguguagcucacauucuguuucuguugacaguacugcuuuggagcacaguguuugaaugaucuaucauuucaaagaccuuuccucaguucguuauucauggcugucuguauuccacauagauaaggucugaaauacugcuaaguggcauguuuuguuuuaugcuuuuauaaguuuguugaucauuacugauguggacuuuuggugccucuuaggcucauugcuaucuuccaaccauuguuugcaauuuuuaccuagagauaaagagaaagagacauuugguuucagaguaguuagauugggaucaugaaagagcaaccucauuuugaugcuucaaaaauagcacaucccccguauuacugggauuugcuauucuugggauuacuucaagaacauccuuguguuacugguuuggaugcuucugaaugcugugaagucaguuucauguacauggcucaucaguuuagcucucucuuggcuuuguuuagacaguuggagcaugauggccuaaacagcuucuuucaauuaaacauuuuaaaauaguuuacaaauaguaaacaaacuccaguuuuugugacucuuugucucgcacaacaaaaacacaaucugaccaugaucaucuggcaucuuagggugaaauaugguuauacuuuggcccauaccgaaagcaagauuaaaaaggggcaggagagauagacugcugaacugauuuucaagguuccaagaauauuguagguuaagaguaaaaguaaacuuuugguagaaagcaguggguugucuaggauugaaguaucugaaguuuuuaaacgaaaauuuaaaaagaaaaaugagaauugccuuacaaguacaaucucuucuuuuuuaaaaaauaaacuuuauuuugaaauaguuuuagauuuauagaaaaaaauuagauaggguaggaaguuuucauauacccuacauccaguuaccccaguuauuaucauccuaauuuagugugagacauuuucauguuuaaugaaucaauauugauaugcuauuaacuuaaguccagacuuuauucagauuuucuuaauuucuauguaauguccuuuuucuguuccagaauuccaugcaggacaccggauaccucauuacauuucauugucaugucaccuuaggcuccucuugacaguuucucuucuuuuuuugcuuagaaauucuccagaauuucagaaacuucugggcaucgcuauggaacuuuuucugcugugcagugaugacgcagagucagaugucaggaugguggcugacgaaugccucaacaaaguuaucaaaguaagaaccguguggaugauguucuccucagagcuaucauuguuguaggcugagagaagaagcgaucauugaguguucuucuguuuugagucccugaggaugucugcacuuuuuuccuuucugauguaugguuuggaggugcucuguuguaugguuuggaggugcucuguuguaugguuuggaggugcucuauuguaugguuuggaggugcucuguuguaugguuuggaggugcucuuguaugguuuggaggugcucuuguaugguuuggaggugcucuguuguaugguuuggagguggucuuguaugguuugcaggugcucuauugcaugguuugcaggugcucuauuguaugguuuggaagugcucuuguaugguuuggaggugcucuuguaugguuuggagaugcucuauuguaugguuugcaggugcucuauuguaugguuuggaagugcucuuguaugguuuggaggugcucuuguaugguuuggaggugcucuguuguaugguuuggaggugcucuguuguaugguuuggaggugcucuuguaugguuuggaggugcucuauuguaugguuuggagaugcucugguaucugccugcauugcuugccacaccugcccggucagaaggcgcuauguugacaauugugccugcacggugccuaggucaaugaagggaaccgaugguagccacuggaugcuccugggaaaaugucacuacaggcaccagagaagccagagcuaugcccaaauuucuaugagucucaguuuucuuaaccauaaaaugggaucaauguuuuuguggcauguguaugagugugugucuguguaugugugaggauuaaauuguguaugugugaggacuaauugccacuacuggauccucaaagugguaagaaguguucuuauuaauaaugacauccuuacacucuuacccagcaagauugauggguguggcacugcuucucuuuuuccaucacaugguuuccaugguauccuuuugcccagggaaucuuugcuuuguggcuagcacuuuguuguuuggcuaaucacgcuuucuguggucaggacgcuggcuucucuggagccaugggauucuagcucccugucuugucccuagaguggucacugucuucucucuccgcuugcaauuccugcuuugcucgcaucucacuuaugcagugacguauaucaguuucaccuuguucuccgugccugcugaucauuggcaccacuugcauggugccauuuagggccugcuuccaguuaagcuugcuucuccacaggccuaaauauccuugcuugcuucuuuuauucucacuggcaggaccagggcggucugucuuugcaugagacagggucucgcucagucacccaggcuggagugcaguggcugaucacggcucauugcagccuugagcuaccgggcucaagcuauccuccuggcuuggccccuugaguagcugggacuacaggcgugcaccaccaugcccagcuaauuuuuaaaauuauuuguagagaugggaucucgccagguugcccaggcuggucuugaacgccugggcucaagugauccucccuccuugguuucccaaagugcugggaucacaggugugagccacugugccuggcccuugauguuucaguucuugauauuugauccucagagucagaaaaucuaaaaagagggcuaucccagguugccuugguucauggcaaaugggacguuaagagggcagagagaauaugaacagaaacuguucuaauauuggucauuuaauguguaaguauuguucuuuuuuaaaccuccuucauuuuuuuuccaggaauugcuggacacaguggcuuggugugugucugaggacuguaggccauggcccuagguugugguuuuaggucucaggugcucuuccuggcugucuccuugcuucuuucccauguccucuucuuuguuuccagccauuucucccuuaugcuuaaguuuggugcagcaggguuuggcugcucucagauuccugcuuccucagaugcuguaguugucaggcccagcgggcuggcagcgggaucaggaucuggcuagguuugcucucacuguggcagaguagggggaggcgugggagagcacgugugaccccaggccagcuguagggagcauaggcauggucacguagccuucagguccuagacuuugucuucucaugaguauggcuguguguguauggugaaaacuagguucuacuuagcccaagaaaaugggcacauuuugcaugugguuucuguagagaaaugcacuggguaucugacauagccuggcagcaugccucccucagguagguuagucucaggcggugaagcacguguguccagcaagaacuucauauguggcauaaagucuccguucugugaggugcuggcaaaucaccaccaccgucaagaggcugaagugauuuuugucuagggaggcaggaaaggcuuccuggagucagcagccaguaggugaaagaguagauuggagaccuucuuaaucaucaccgccucuugucucaaggggugccaggaagcuguggaggcugaacccaucuuaugcugccagagagugggacaccaugagggucaggucaagggguuguaccuuguuugguagagaauuaggggcucuugaagacuuuggauguggucaggggaguguaucauuuaggaagagugacccggugaggacgugggguagaggaggacaggugggagggaguccaggugggagugaguagacccagcaggagugcagggccucgagccaggaugguggcagggcugugaggagaggcagccaccugugugucugcggaagcaggggcaagagggaagaggccagcagcgugcugccaucacccagcgacuggcguagauugugagagaccauucccugcucuuaggaggggcugaguuuuaguuuucucuuguuauacaauaagcuugguauuuguuuacaaaacauuuguaaagcuaaaucaagguuugauaaggcuucuaguuuuauuuaagaaguaauguugaaauaaauguuuguccaauucgcuuugcucauuuaaggacuuucaguacaaacugcaacaacaggauuaggauuuaaacguuucugagauguuuuuacuccucagaauuucccagaaugugaucugguuuugauuuucaagcuugcugacccaauagguuaacccacaaguuuuacgaagaccaucucaguccacuuacaucaacugcccaugccacgguuaaagagaucaucgacugauguuuggcacagcuuccucccucuugggugggcaagcauuuggaagagaaggcuccuaugggugagaguggggcaccaaagucuucccugucccauccccuagcuugagaagcccuucucuaauguggacuuugugccguuagcaucguuacuagcuugaaguugaccaucuggacguacuuucugguuuagccucacaagugagcaaggaggguugagagaugugcugugaggaauguggggccccagcuggcagcaggcucugggucaggggggcagggaccacgggcauaccugacagugaggaggggccacaccugcagaaaaggaugcaggacuccgccuugggaaguguucuaggccagagcgagggucugugguuuauaaguacacccacagugcucgggacccugcagauguccagggugccgucugagcccguaucauccaacagaauguucugcuagugaagauuaaagauuuacuccaggggcuuuaggauuuauuauauauauauaaauccuauauauauaauuuuuuuuuuuuuuuuuuuugagauggaguuucgcucuuguugcccaggcuggagugcaauggcgugaucuuggcucacugcaaccuccgccucccggguucaaacuauucuccugccucagccucucgaguagcugggauuacaggcgcccaccaccacacccggcuaauuuuuguauuuuuuaguagagacggaguuucuccauguuggucaggcuggucuugaacuccugaccucaggugaucugcccgccuuggccucccaaagugcugggauuacaggcaugagccaccccaccuggccaggauuuauuguauuugaaccaucuaccauuuuaauuuugauguuauguaguauuugaugauaaugaaaguuaaauuguuuuucuuuccauuuuucuguuuaagugaaugaccuguaucuaguuuauucaguaacuuccugcauauauuuguuucuuucauucuuaaugaauauauucuuaauuuaguugcuauuauguuuugcuuugccccaaaauugaaaucuuaguuuccuuuuagcucguuuuagaacuagugaugggaugugucuuccauaaaucucuugugauuuguuguaggcuuugauggauucuaaucuuccaagguuacagcucgagcucuauaaggaaauuaaaaaggugggccuugcuuuucuuuuuuaaaaauguuuuaaauuuuaaauuuuuauagguacacguauuuuguagguacauguaaauguauauauuuaugggguacaugagauauuuugauacagguauacaauacauaauaaucacaccauggaaaguuggauauccaugcccucaagcauuuauccuuuguguuacaaacaauccaguuacaugcuuuacuuauuuuauuuuauuuuugagacagagucuugcuuucacccaugcuagaguacaguggcaugaccuuggcucacugcaaccuccgccucccggguucaaccgaacuuugggcuggucucaaacuccugaccucaggugauccgcccgccucggccucccaaaguguugggauuacaggcgugagccacugugccgggccugauuguacauuuuaaaauaacuaaaacagucagggcacaguggcucaugccuguaaucccagcauuuugggaggcugaggcaggugaucaccugagaucaggaguucgagaccagccuggccaacauggagaaacccugucucuacuaaaaauacaaaaauuagccaagugugguggcgggcgccuguaauccuggcuacucgggaggcugagguaggggaaucgcuugaaccuggggguggagguugcagugagccgagaucacgccacugcauuccagccugagcgacagagugagacuuugucucaaaaaauaaaaaugaaauaaaauugggccgggugugguggcucacaccuuagucccagcacuuugggaaccugaggcagguggaugcuugagaccaggaguuugagaccagcaugggcaacauggcaaaacgcugucuguacagaaauuagcugggugugguggugcacaacuauagucucagcuacuugggagauugaggugggaggauuaauugagccuggaagguugaaucuauagguagcugagauugugccacugcccuucagccugggcgaccaagugagacccugucucaaaagaaaaacaaaaaaacaaaaaacaaaccacuauuaucgacuauauauuauugucuaugaucccucugcugugcugucgaauaccaggucuugggcccuuauuuccaucacugagcaaacuucacucuguuaagcagcaggugugggauuucaucguuauucaguaauucacaauguuagaaggaaaugcuguuugguagacgauugcuuuacuuuucuucaaaagguuacucuuuauuagaugagaugagaauuaaaaaugguaacuuacuuuauaucuuuauaauugaagcccacuagaccuuaaaguaguuaccagauguuuuaugcauuuaaauggccuuuucucuaaaauuagaaaguaacaaggaaagaaaaugcuucguuucuaugcaacccucuuggugacuaguaugugacucuuaaugcaacccucauugcacccccucagaauggugccccucggaguuugcgugcugcccuguggagguuugcugagcuggcucaccugguucggccucagaaaugcagguaaguuguacacucuggauguugguuuuugucgggggccagcugcuacugauccuuuaugucucagcucagaugucauuucaaaagucugcucugcccucuccaaauugcagucgaccuugcccuguuuauguuucccucauagcacuaauccaugucagaaauugucacguacagucuaucugugugcuuguuuauuuucuaucccacccuuccgcaagagacuuaugggaugugugccccaggacagcaggggucuuacugucuuaugcucuguugcagcccagcagcgauaacagugucugcacauaguacuugcuuaaaagauacuugccaaauuguugaagguugagguaccaauuucauuauugcugacuauaggaguuauagcaaaauauccauuugucuguuacaugaguuaaaaauaugguuguugcacugugaauaguuugguuuagucaaaacaguuguaucuuaacggauugagaaacaaaagcaggaccacuuuucaucagcucccuccuucuccuuaaccagcaauacaugcugaugcugauaucccauagacccucagcuccauccugagucacugggaauguggucuaaacccucacuauuaauaugaacugaguuucaauaagaaucuuauaugggucgggcauaguggcucauaccuuugaucccagcacuucaggaggccaaggcagguggauugcuugacccagacuaggcaacauggugaaacgccgccucuacaaaaaauacaaaacuuagccaggcaugguggugcgugccuguggucacagccacucgagaggcugaggugggaggaucacuugagccugggagguggaggucguguugagccaagaucgcaccacugcacuccagccugggcaacagagugagaccugucucaaaaaaaccaaaauccagaaaagaacuuauauggcugcagagguauaaucacuaaggaaauuuccuuuuguauaaucuuuuuucuuuuacuaucauuuaaaaaaauguguuauauuucugaagcaacacauccagguucugcacauagcagccaaagugaccuuaaagaauauaacugggucuugucauucccuuauuuaaacucuuguacccauuucccagugccguuuagauagagauuccagacucgucaauggcucugucaccucagacacccugcauugacucauuagucugauuagagucagguuuuucuuccuccugaugguuuuuuuuucccccuuaguucucagcggaacagucacuuccuuagggagguuuccccagccacccucugaggccgugcuuguugccagacucugccacuagagggcagggcugcaccacuccuggcaccucgcacccggccugcccugucacucuguguguugggugaauuccugugaucugugacucacugcucuguguccuacacauucggcuuuucuucucuccccacaaccccauuuuauaauucuccuuuuucaggaaagcuuuauucccauuuaaaaauuuuuguuuuuaaaaugguauuuucuuacacuuauuuucuaauuaaaaaugaguguuuuaagaaguauuaugauuuacugcaaauaauuuuuaaacccagccuuuuagauccucugugaucauaagagaaaugaaggaugucucccaacacuugagcuucauccacauuucauccuccuguucuuucagcugaguuuuccccaucccauuagggacuguuggaauauaaaacuggcuuuucccuaacagggaaugaauugcuucuguuucuccugaaggagagcuggaagaaugacuugcguucuuuugcauacacaggccuuaccuggugaaccuucugccgugccugacucgaacaagcaagagacccgaagaaucaguccaggagaccuuggcugcagcuguucccaaaauuauggcuucuuuuggcaauuuugcaaaugacaaugaaauuaagguaugauuguugccucaggucacaaacaugcgagugaugcugugagugagucuguggagggugagggcuucugaacagggaguccugugggagugcuucuugggguauguuguaugucguaauuuagacuaccaucauuuguguuauuuuugaggcaccuaaggacuucuuuccacuucucauuucuuacuguggggugaagaguugaauugggagaugguuucuagaugcaaauugaaaaggcauuuuuccagagcagauuuguuuucggcguacuagagugacucuuuaaccuagcugcgggaagaugacugugccaagacugcagguaggagaaagcucacugacgaggccuugugggucugaacguccugcagcuaucagagccuguuggcuuccuguugugcauuccaacaaaucaucuucaaacccacuuuaguguuuuguuuauaauguccagaaauagugacccugucacaugcucuacagauuacaggauucuuagccucuuccuuuuugguaggucaguccuggguuugagcccaagugacccuccugggaggugaugauacacacuggguagaguggaaucagauggacuuggauuagaauucuguccucuuuacuaguuauuuuccucuaggcaaacugcccaacagcucuaagcuauuuccuucguauucugaaaaauaagccuuaaugggacccauauagggcaacucugagaguaaaauaaaggaauauguguuagaguguagcauagucacccacgggaagggcuuagauguuagcugcuacugcucuuauuagcugaaugauuuggaauaaacuguuagccucucucauguuuuuucucuugagcuucgaaguuuucuuguuaauacuaaggagauauucaaacuagucaugggguuuuggaaugacgaagggagaugaugaaucuaaagaauuuaguguaauauuucuucaugcucaguaaaugguaguuucugcugcuguuauuuuuauuaccaucucuuuggaaugggaguaggugcuccuuuguggucagaggcugugagagcuccacagcgccaguuugcccaucuguacacuggggucuguugaaggcaguccccucugugauaucucuggcugucagagcucagaugauagaugguauuuuuguacucuuaguucucaucauuuucaugauuucgaucaccauuugaguaugaugaugcuaacacuuuguugaacguagaauccguuaauuacuuccuuccugaaccuuuggcauuaaaaaaaaucuauucugcuaccucucugcucauuuaugguuauucaaauuuauuaucaagagccugguacaguggcuugugccuauaauuguagcuacuugggaggcugagguaggaggauugcuugaggccaggaguuugagaccagccugggcaagauagugagacccuaucucuaaaaaaacugaaaaaaaauuagcuggacaugauggcaugugccugugguccuagcuacucaggaggcugagacaggaggcucgguugagcccaggaguuggaguucgaggcuacacugagcugugauugugccaccacacuccagcaugggugguaaaacaagaugccauuucuuaaaaaaaaaaaauauauauauauauauuaucaaugaaauucaguaguaccaacaggauuauaaacaaagauaguaguucccuuccuacuuuuucucuuaauccuugugucucacaggcaaacauaacucuuaguauuucuuccaauauuuacuuucauguuucuuucuuucuuucuuuuuuuuucuuugagauggaguuuugcucuuguugccaaggcuggagugcaaugacgcaaucuuggcucaccacaaccucugucucccggguucaagcgauucuccugccucagccuccuaguagcugggauuacaggcaugcaucaccacgcucggcuaauuuuguacuuuuaguagagaugggguuucuccggguuggucaggcuggucucgaacuccugaccucaggugauccucccaccucagccucccaaagugcugggauuacaggcgugagccacugcgcccagcaacuuccacauuucuaaauaacaugcuucuacugcuauuuuuuuuuucaauuuuagacauuuuuuuacuuucacuauaguucuaucagaauucaguguguacguuauuaugccuaaguaaauagucaugguugcuuacguauuauauuucuuugauuguguuucuuauuugaugagaaagcuguguuuuuugcucuggguugaaacuggagagaggaccuggggaggaggaggaggacagaugaaguuggugacuguaccuucauggccauagcuggguucucagcacccggggaucugcugaucaccuacucauaggccaggccccuaucgaaguucuaggugacccagugcuggggacgggggggccaccugcaaggucuaaucauggaggugggggcuacaguguuggcuugugcuggggccagcauccuuaggaaggcaucuuggagguggaggagacagccgcccacuucuugauuggggccuucagcagcaccagcuucuugggcaggcuggugcuggcuuucaucaccaugucguguucaaucuucuuccagauccugacuucuagguucagcuuuccucagacccugguuccuuucagaggccauugcugcugccuugcucuuugcuggcuugugccuugauuauaugucuuuguacaacuuuuuguuuuccuggaguuaaucuucacaucuguuuucuuggaguuaaucguuaccucuauaucgcuugcuuauuauucuuuggccuuuuugucuucucacaccuuccaacuucuuuguaauauguguuuaguacaauuuuucaugacagguaguuuacugaaucaguuuuuccccaguguggucauccaacuugaguuauccagcucucugccccagucugggcagguugaucuucaggucuguaguacacuuguauccuaggacuucucuuugccauuagccuggaauuuccuuugcaguucucccguuggaugcccaguuccuagaugccauauguuuuucuaucgucuaguagcuuccugagagaagaugaaugggagggaaauuguaugagguuuugcauucauaaaaaugccauuuuuuuuccuguacacuuggcuggguaugguguucugggguagaaaucauuuucccucagaaaugcaaagucuuugcccuguugucuuaaaaucuccaacgugacccgauuccuuaaccuaugaauguacuuuucuuuggaagcuuuccauuuuuggggaggugaagugcuagguacuuaguaggccuuuuaauuuggaaacuuacaucccuucaguucugggaaaauuuucuuaacauuucucugagaaguucuugccuuuuauuuucuguguucucuccugaaauugguuaguuggauguugguccuccuagauugacucacaucuuaccuuuuucuuuucuuuuucugguacuuuuuagauauccaucucaaacucuucuauucauuguuauguuuuuaacuucuuucuuuucuuugucucuugauggggucuugcccuguugcccagguuguggugcaguggugcgaucauagcucacugcagccucaaauuccugggcucaagcagcuguucugccucacccucccaaguaguugggacuacagguaugcaccaccacguccagcuauuuucuuuacuuuuuuuuuuuuuuuuuugagauggaguccuacucugucgcccaggcuagagugcgguggugggauuuuggcucacuuaagccucugccucccagguucaagcaguucuccugccucagccucucaaguagcugggauuacaggugugcaccaccaugcccggcuaauuuuuguauuuuuaguagagccagaguuucaccauguuggccaggcuggucucgaacgccugaccucaggugauccgccugccuuggccuccgaaagugccgggauuacaggcgugagcccaucauuagaucuuuaaauaccaguaucuauaagucuuuuccucuugagucagcuaguaucccuggaaggaaauuacucauuuuccugcuuggaggcuauaagcuuggcuauguuuauccugcaaccggggacuggaagggaggggacugacaguguugcuggucagggugcccucuuacuuuuuguuuucugugugcaucucacgucuguccucagccuauguaaacaccucuugagauuaucccucucaaucuuugccggaggugggggaggggcugcuuccugggcugccuuggauuggagggaagaccucaggugagugggugggaauuugcccaaggagccaugagaccagccacuauuucacccucuccaucccuccacuuucagauguauguggcgccuccaaagcccgagcucuucuuggcgucuguggcuucaauaagcuugcuuuuugcugguaucccuccuacccuccccuguccccagcaaagcuugcauuugaacuucuuccuacgggcuaacaaaucagucaguuauguagcucuuguuacuuuuuagcuuccgaaguuuuguugacacccguagucugcuaaugucccuguucuguucuuucuguucguguaaauauaugcuuuauacaacuucuuuacaugauuuuugugggguuucuggguagcagagcuucacaaguucaauccagcguguuggauuagaaaucucccacccucugguuuauucuuauucucaaaauuaccugccaaacacugauacucccuuguuuuuccuuuuccugacaggaaauguacauaccauacaggacagaaaucauuaguguaucccuuggugaauaaccacaaagugaacuuaacccuuguaaccgccacccaggucaagacagaauauuaccaagcacucagaagccucuccccuauucccccgucacugcuccugccuuccuccccaaggucaugacugcuggcuucuaauuccagagucuguuuuuaaauucuguguacauagaccauggauuaaguguucuuuuugucugguuuauuuuggucgacauuaaguucaugagagucuucuauauuaucguguguauuaguauuccuguaguuuuaggagcuucauagcauuccauuguagggauauaccacaguuuauucauuguauuaucacuggguuguuucuaguucuuggcuauugcgagcagugcuacugugaccacucuuaggugugucuuuuggaguacaugugcagguuuccaucuugcacagcuagagguggaguuguugggugauagggugugugcaucucagcugcaguagaaacugccaaauagcuuuccuugagugcuuguaccagcucacccuuuugccacuguguauggggauuccaggagcucugguccucgcuagcacuuggaauugcugaugcuuuuacucuuagccuuccugauggguguuuucuggaaucacauuaugauuuuaauuuccauuccuuaaaguacccuuggcucugaaguuuaaugauucaugcaucucuucccuuuugaaguacucuuacagguauguugugcauguguugaaaaguggcacuaucuauucuaaaauacaguaugccuccucuguguuugaacaguuguagcguggccuuggggccuccuguuagcuggcuuggagaagggauucuugggauuguagagauuagaccugaggaggccccuuggagcucucugacuaaauuuuauucuuuauuauuccaaacuauuuaagcucaccgugugcugacucaucauaauaaugaguagcucucauugugcuugucuauuuggacucauacaaugauuuuuuuuuuuucuuugagacagagucuugcucuguugccuaggcuggagugcaguggcacaaucucggcucacugcagccuccaccucccagguucaagugauucuugugccucagcuucucaaguagcugagacugcaggugcguaccaccaugccuggcuaauguuuguauuuuuaguagagacgggguuucaccauguuggccagguuggucucaaacuccugaccucaagugaucugccuucuucagccucccaaagugcugggauuacaggugugagccacugagcuuggccaaaguaguuuuuuaagauguuaguaucuuuucuugcagcuaaaaaaguuugucagagaugauucuacuuuguucuccagguguuuucucagggagaaauuggaggcaguaagccacugggggaguccuguggcuggggggugggguaguccuguggcuccuugucagggaguccuguggcuggcaaggagagaaguccuguggcuggguugggagggaguccuguggcuggggucucauccugugccuaacaguguccagaggugccgagaccagcucagucggggagacccuaacccagcagcgcuagaggaauuaaagacacacacacagaaauauagaggugugaagugggaaaucaggggucucacagccuuuagagcugagagcccugaacagagauuuacccacauauuuauuaauagcaaaccagucauuagcauuguuucuauagauguuaaauuaacuaaaaguaucccuuaugggaaacgaggggaugggccgaauuaaaagaagagguugggcuaguuaaccgcagcaggagcauguccuuaaggcacagaucgcucaugcuauuguuuguggcuuaagaaugccuuuaagcgguuuuccacccugggugggccagguguuccuugcccucauuccugucaacccacaaccuuccagugugggcauuagggccauuaugaacauguuacagugcuucagagauuuuguuuauggccaguuuuggggccaguuuauggccagauuuuggggggccugcucccaauacagaggucucguguaaauucccugggaggcgauaagccucugagaaacagacuaugcuaaccacgccaugaaagagaaacuuauuuauaaaucagaugccaguuacuaguuuacugcuuauuugcccaggcguagcucugacagaguccccgacucauagugcuugcucagugcaugcugaacaaugauuggaaucaagucauggcucagagcauaguuuugaauaaugggaaauggauguucuuaaguaacauagucaccaagauaaugcgacuagcugggucaccccuuuucaauuuuaggauauuuuuaucaagauuuaaauggccaucauuagaguuauagcacuuucuccuuuggauuguccuagaggcccaugagaaaguauucccuaauuucuuaggagaacaguuuguggguaguaugcggucauguccaguuaaauugcagauauuuccgaucgaagauguuccaguccugagaacuucgugacauuagcaggacuucuacaagccaucucuuaggguggggcauuuacugcaguuggcuaguacucuuuucuccuuaacuuugucauuuguugauuuuuuuuuaacuguccccaaauacugugggcagaguguaucuagaauugaggccuccaccauugcggagaggacauggaugcugagcaguccccugagugaagguuauaaagaagcaaauagacuacacaugucuguaaacugcucuugagugucccaaauuugggguacuucaguucagcuguaggaaaagccucaaacuguuuauacuuugcaagaauuggaaacuucuaauucacguuaaguuuuauguaauacaugauaagcuucauaggagcuucaucuuuuaucuacuuggacuuuugcuuccguagguuuuguuaaaggccuucauagcgaaccugaagucaagcucccccaccauucggcggacagcggcuggaucagcagugagcaucugccagcacucaagaaggacacaauauuucuauaguuggcuacuaaaugugcucuuagguaagguggaggcauaugaguggaagagucuccagcauguacucaagauagaccuuugaaauaaauaaaaccagaugaucccucagcuucuagaccaggcuauuuggcacugguugauugaaugugaacugcacuggggcugcugugagcccgcaugggucucugugacccugcagaugcagccgugcccagggacugggcagugggugugggcuggugugagcccugucugccacccagggccuggcccucugucugugucggccaugacuauggugagucuuguaggcuugagacugugccucggguuccugcggguucucuguaggucaguugacaguuucuccuguuguuuggguaacuguggaaacgaacacuggcaagugcugaagcgagcauguggacgugcgauaugaaauaacgaccuggcuuucaaaggcagugaggcucucuggaaaggaccuugcugagcuagggauguggguguguagccauucccagugggccucauggcguacucguucaugaucauguuugugccaucuugaucucucaggaucucuucuuuuuuaacagauuaagccgggaaucuccaaacagugagucagauguuaagaugucuugcuuccacccccacaggcuuacucguuccugucgaggaugaacacuccacucugcugauucuuggcgugcugcucacccugagguauuuggugcccuugcugcagcagcaggucaaggacacaagccugaaaggcagcuucggagugacaaggaaagaaauggaagucucuccuucugcagagcagcuuguccagguaggagcacaggguuuacucuaggcccugcaugugaaugacugacauucaaagaaccgauuaauuuggaagagaagcggcagaaccgagaguuagagguguggacucuggagcugcgcugcucguuuccaacccuaggugcugaccucuagcugucuucccucuguaugucccugucaccgugagucaaaugcgggugaugccuccucaggugccguguuaccuaagccucucagagaccacugcuacccuguuucuaaaaccagaggucacgauauguguucauccacccaguaaauacugauugagcacccacugugugcuaggcucugggauaggggcuggguauacaauggugaguauuucagcugcagcuucugccccguggaggcuguggccuagcacacuggucuaggcacggugguauaugcucacucaaggagauagggacguggucguuuggggugucggaacaaaaugucggaacuucucuuuccaaugcagagaaaccuugcaguaauucuaauguacugugauuggcaguugacuucaguucuuuguagcacgcuuacucagguuauuucacuaacuauguaaccaugcagccucauuuuaagcaauuggauuuuuugaacuuuacuuaaaauguuaugucaggguuuuuauugugcuuaaugugugccauuuagcuaaguuuuguaggauacgaaauuguaaguggcuuaaaaugauucuuaauagaaucaugaauugaagauaaugcuaauaauuuaagcacugaguuagguaguguuuguaaaaugcuuagaaugcuuccuggcacauguuaaggccauguaagugcugcguguugauaaacagcugagcaaaaguggacucuuaagaaaguauuggggcugagaguucuguuccaaccagcugcccuuugguuauuuuucagaauaaaagcagagucucaugggauaugacauuuauauuuccuucacaaaaaacacugcugaguguuuuguugaguaaaaaggguguagccaugguaauaauacauuuaaaauauaguuuauuucaucuuuaccuugccuuguuuuuuuuuuaagcuagcuuuuuauugagaauuccacacauacaaaaguaucaacucaugaccaguuauauuucauuuauaauccuacuucucccuuuuuuuauuauuugaaagcaaaccccaauuauccucuuauuucaucuauaaguauuucaguaucucuauagaugaggacucuucuuuauuuuuaaaacuuuauuuuuaaaaugauggucagaugcaguguucaugccuguaaucccagaacuuugggaggccaagcugggcggaucacuugaaccugggaguuugagaccagcccgggaaacauggcgaaaccccaugucuuaaagaaaaaaaucagccaaguguggugaugcaugccuguagucccagcuacuugggaggcugagaugggagggucacaugagccuggaagaucaaggcugcagugauccaugauuguaccacugcacuccauccugggugauggagcaagauucugucucaaaaaaacaaaacugcaaaacaacgucacaaaacagugccauuguuagaccugaaaauauuaaacauuuccuacaucaaauacccaccaacucauuaucaauuuuucucucuacucuuuuggaaucagcaucuaaauaaaauuggucgauaaggauuguaaaucucuuugaugaacugguuccccuccaucccaguuuuuuucccuuagaguucauuuauugagaaaccagauuguuugucuucuaaguuuuccuguggucugauauacugcuuccaucuccacuguguaaauuaacaccuuuuucucuucucuguauuuccuguaaaucaauaauuggaggaaaagccuugucagauuuaguguauauuuuauaucugaguccaguauuucuuauauaauauuuuaagauaaguguacucuuuuaaaaaguauugaaacuauaugcucaauuuuuuuuaacugaugcuuuuaagaaggcugcuugaucauaaaaguuuagagaucauuggucugaugggaaaagcaaauaauuacuaaaccguuuagcaagguugaggugcacaugguggggccuggagaaguucagucaugagccgucacuuaugggcacguggaaucugacccggcacagaguugggagaagacaggagcuuuauagacagaaaauguggucuuugcuaagucccaggagugaaagggugagacagugcucacagcacacgagugugggugcguagacagagcaaggguggguccugaaaaggccugcaggcuuucucauagauuagcaagagugcugguuacggagguuucuaacauuugugaacagaucgaaacuguguuaaauugggauugcaguaauccuggaaggacagggauagagggugaaggggaaaaaaggguauggaugugagacuuaauugcugauuuucuuaagaccuuucuccaaaguaaauaaaugauguggcacauuuuugaacuggcaaauucuaaacucuagauaugauuaucucuauaacauaucuuacuccaucuucuuuugacuaaaaacuguucuuaauuaaauuaccaugagacguucaauucagcaaauguaguuuggcuaaccauauuuaauuagaauuuaauauaauccuaggccuggccaaacuauuaagcaagugugggcaaaauauugauaauuuuagauaugcaggaacuuaguuugcuuuccaugugugcuuuucgaaaaaggaauaaauugaaaaauagaggaagcccugaaauccaagaagcaaacucucucaccuaggcaugcaguaaaagcaauucuaggaugauugcuguuuggcgcguaguucguauuagaaaccauucuucuugaauaaauaguauguuuaagaagcugggcagagggaaggcauaugcauauauuaucaacaaggagggagaaaaaggcaauuaguaaccauccauaggagggucagcaagauuuauaaaggaaauuugugauccaaguaugaagcaaaauaaggugcagaauaaauuuuaagcaaguaauagauuagaguaagagaacccauuugaccauuaaccuugggacauucucuuucaaaugacauggaguaguacugaaaucuuucuuucuuucugagucuagguuauugugacuggacucagaaagaaauauuucauuauugcagugaauaacauuugugaacauuauuguucauaaauuaugcagugaauaacauuuaugaacacgugauguguaagauacauacuguuuauuuuuaguuaaguuuuuuggcucaacuucuaggcagagaacauuaaauguaaauaguguuaccuaggagcauguaaauggaaaucuccauaguaugaaagcagugcuguugcuaacagaauuuaggagggggcagaugaggugaaggaaaugugggugcugauuuccuuauuacauugagaggagccaggagauucuuuguucaaaauggauggcuuaagaagucaaaguauaagcugauuacguagagcagguacccaaaaauguuuuguguaaggggccagauaguaaauauuuucagucuugcaggccaucccaagucuguggcagcuacucaacacuaccuuuguagcaugaaagcagccacaggcagcccauaaauguggcucuguuccggugaaacuuuagguacaaaagcaggugcaggccagaccugaccugugcacugugguuugcugaccugggauucagggguauagaaguuaccaucagaagagcuaaaagugagacuuuuuacuuuauacucuucuacacugucugauuuugaaaaaaagaaacauguauuuuauaauauuaaagauaggguuggcaaauagcaaauaaaaauacagaauaccagugaaauuugaacuucagauacauuaugaguaauuuuaugguguaaguauauuccaaaucaugugggacauacuuacacuacaaaauuauuuguuguuuguuuacaguuuaaauuugagugccuuguauuuuaucuggcaacuguaauuaaagggaaaaagaauaaauucauuauguucauauaaugugauauagcagggguccccaacccccaggcugcagagugguacugguccauggguccccaacccccaggcugcagagcgguauugguccauggccuguuaggaaccaggcugcccagcaggaagugagcagcaggugagcuggcauucccaccugagcaccgccuccugucagaucaguggcagcauuagauucccauaggagugcaaacccuauugugaacugcacaugugaggggucuagguugugcgcuccuuaugagaaucuaaugccugaugaucugagguggaacagucucgucuugaaaccauccccuggcccuguggaaaaauugucucccaugaaaccagucucuggugccagaaagguuggguagcacugugauauaguauuaaaagugcuaauaaauauggcauacugccuuuaaaaugucugguagcucuuucucaguggcacucauaauaguguuuuuugauuuuuaaaugugugucaagcugacucuccccuccguguaugcugggcuuuauuuucccuuuccuagucaccaguuuugggaaauagagaucuucauucucaugcugcuccucuagugcaagugcuccauuuauuuuuaaggaauuaauauaacaaaaaaucaugggaauuuagaaaacaacauggaagcuaaugaucacauugguggaagugauagggaaauauuuagggggagaaguuaagguauaaacuuugucaaugaaguccuauuaaaaacaacaaaaaagugaagcuuaggaugcauuuuauaaacucugaccagaacaccuguguuucucuguuucuagguuuaugaacugacguuacaucauacacagcaccaagaccacaauguugugaccggagcccuggagcuguugcagcagcucuucagaacgccuccacccgagcuucugcaaacccugaccgcagucgggggcauugggcagcucaccgcugcuaaggaggagucugguggccgaagccguagugggaguauuguggaacuuauaggcaaguuauuagcaaggucuacucuuacaauuaacuuugcaguaauacuaguuacacucuauugauuaugggccugcccugugcuaagcagucugcauuccaucuuccuugccaaaacuuauaauacaaauuucaucuuuauuuuauaaauaggggaguugggcugggugugguggcucacgccuguaauuucagcacuuuggaaggaucgcuucagcccaggaguuugagacaaccuggccaagugagacccugucucuacaaaaaaaaaaaaaaaaaaaaaauuagcugggcaugguggcacaugccuguagucccagcugcuuuggaggcugaggugguaggauugcuuaagcccaagagguugaggcugcagugaaucuugauggcagcugcacugagccuggugacagagcaagaugcugucucaaaauaaauuuaaaaauaaaauaagagaauuaaaguuuagcagguuggguggcaaaaugaggccacacauuuaaagccccuccuccugauucuuuucucugccuuggcugccuccuguggcauuuuaggugcugagaaaugaaaacaguagggaaaauaguuccaggauccucauguuaauuugccagaaauggcaucuucaagucgucagagggaucugagaguuccuuccuggccugacuugagaaaauccgucuguccccagcucugcgucugccuccacugcccagucaccuccucuccaugcucuuggggcugggcccuaccccaccaugcagugcugcccuggagcagugagcuugguggguccugucuggcaugagagcugccuuugggagcuggaucccagccucuaccacugggucuggugccuagcaggcuauggauaaacuucugcugacuccggccucuccuaagccacugcaacguggucgguguagugcacagugugugugcagcguggccuuacucacagccuccacauuagagagaaucugacugaagucuuacugcugccucgugugaacauaaauguuugccagaaccaugagcaggaaauguuaaucugccuuguuuccuguccuuuacacggaagaauuuuuuucuguauggaaugcgugccuuacaaauaaugaguggaaauacccaucgcuaaugaaaaguuauacuugacuguuagucagcuaaauaaucugagauuucuaauacuuuuaauuuggcuuuuacaaugcaauuuaucuuagcuuuuuugauuucuuaggucauaucuuuagaacuauauauuugaauguuaauguaauuuucauauugaaauuaaaauguugaacugcgauguuaaguguuuccuguggaaaaacguucacauuuucucuaguuuuaaaguugaaucaagcuguuugaagauuuucacauuucuucuagauuuuaucagcuuguuacuuuaucugucacuuucugugauuugcagcuggaggggguuccucaugcagcccuguccuuucaagaaaacaaaaaggugauuauuucagaaaucagagucuuguguugaaucuuacugauuuucuuguauuucuguaauguaauguaucuuguauuucuuguaauacuguauuggacucuguguauaucucuucucagaugagugauuauaugugugaauguugcuggaaucugauaaccaggccugaauaguuuuguaggguggcuuuuaaaaauuacuuucauaucagaauugcuuugucauaaauuuugaacgcaucauaaauuucuaauguucggggucagcagacuuuuuuuguaaagggacagaguguaaacaucuuagcuuuaugggccauauggucucuuuugcaacauucagcucugcccugugacaggaaugcaguuguaaagacaugagcuacuggccagcuauguuccaguagaacuuuacuuacagaaacagacaggcuguaguuugccaauaccugccuuagggaauguguuguuauauuuugugaguuaccuucucaguaaauuuuauuuaguauuagucaggaauauuauuaaguagcuucuuuuccagccuggucaacauagugagacccggucucuaccaaaacaaaacaaaacaaaaaaacagccacgcauguggcaugugccuguagccucagcugcugcucagggggcugaggcaagaggauuguuugagcccaggaguuugaggucacagugagcuguagucaugccacugcacuccagccuaggcaacagaaugagaccuugugucuuaaaaaaaaaaaguuuccuuuguuggguuauuuuaauuuggaccugguuaucauuuuucagccauauuuaacuuuguacauaucagaauguucugauaaaacuuaacuuuuauuaaaguguuugugauauaaucugcuaguuuugguacacauuaucuuuugcaaugccaguuauuuucuuuuccaguguggguuugcauaggaaaagaauugcugucacuuucuauuuugaaaucuuaaaagacugauccuuuuuugugucaugauuugaguauuuaauugagagccuaaugccuaauauuauuugcaguauuaaaugggaucuuaacaggaauagcauucuagccuucauugaauuaaguaaacauuucuuaagagaacuuggaaucuauaauauuugcgucaucauaguaugagauacuuaaucaaguuugagauuuuagugaaacauuguuuagaagccaaaaggauucuaggaaaaauuaaugucuauauucuugaauuaggagagauuuugggacgugugacuaaguuacgcugacacuuguuuguuucuuagucgcuuuuuccaguggcggugagaacgaagaugacugauucacauugcucagaugaguuuauccucuucuggcugggacaugggauauauccugucucuuuuaagccuuuuugguauuuuucccccauugagagcugugucuucaaacucuucuguuauagcuggaaaauccuuuuuaagugaaaucugcccaaauuauaagacagaugaagguagaguuguguuggauauaggauuagggugaaaguaguggggguguccuggagccucucuucugguggcagccuagcucuugugccuuugaggaaauuacccuggggacggcucuguggaacauauuugcaaaccacugauuuggaagauagagauggcuuuuguuaagaucugaauucaccuuuuuggcauuuuauuugauuucucaagguaaagaacuuauuuuguaauaaaguuuccuauuauuuaguagauaggccaaguugcuguguuaauuccauguagauuuuggguuuccuuugcucauuuuuucacucuuaaucucacaucauuguaaguuuauggaaguuaucauacuucugacuuuuucuuugaagagcagaaauuagaaauucccaauaauuauuuugauagugucauuuaaugacacucacaugugauguagccacaaagauuuaaugaguucaguuuuaaaucauauuaagacuguugguuucauuuguucucauuaauguaauucugaagaugaacaauaaaauguauuuuuagaacuuucaaaugaaauauuauuucauccuuccagaucauauaaugcuuaaguucugauuguuaaucauaaagucuagaaaauuaaaagauaauaaaaugaaagugacuuuuagguauuagaguuuuauuauaaauucuggugugucauuggagcuaugacaugaauauuucaaaggccaauagcauuggaucuuuacaguuauaacuuaccauuuuuaaguuuaaguaguaauauagauuauuuaauaaucaaaaucaauaaauauuaauuauuaaaauguuuugugguauaguuugagaaucauugcuuuuaacuuuuuccauauagguuuauugacuuuaauagcauucuaaacauaacaucucuacauucuuuguguuuaauacuguggagguauaaaaauacuuauauaugaugauaaacuauauuagaguaaauuaaauauucuuaugaguuucauuuuagagugcauuuacuuaauuuugaaguccuuauuuuuagcaaacuaaaaggaauguugguacauuauuuacuaggcaaagugcucuuaggagaagaagaagccuuggaggaugacucugaaucgagaucggaugucagcagcucugccuuaacagguaguucucacuaguuagccgcugguguggaccuucacugucugccuuccaccccuugcccuuccugcucgucccccugcaccugguggacagcacgacugggggcagcaguggagccagguugcuuaaauggggcauauucgggcuucuuuuauaauacuuacucugaagcuugugugucugugguguuugcaucauauauuuguuguuuuccaugguuuaggcuguuuuaaaauuagguuuauggcuugagcauagggcuuugugaguaggggauggcaggucgaaacaucucaugaguuggauggguuaugcuggggguugggaaaugggaugaaaaauuaugggaugaaaaauugccuauggauaguuuaacuugaaagaaucugccuuuguuuacagauaguuaucuuuuuucuuuuuugagauagagucucacacugucacccagugcagauacccagugucacuggagugcaguggugugcucuuggugcacugcagccuccgccuucuggguuccagcgauucuccugccucagccucccaaguagcugggacuacaggugcccgccaccacgcuuggcuaauuuuuguauuuuuuuguggagacggguuuuugccauguuggucaggcuggucuugaacuccugaccucaagugaucugccugccucagccucccacagugccgggauuacaggagugagccacugugcccggccaguuacagauacuuaucuaaugaaauucucuguguacuuuauaaaagaugaggauuaacugaagguacuaauaacuggauuauaugagggugguuuugguuguauaauccuaucuaaaagaauauuuuagcuauaacugaaaguaagacuuaaauauuuagagaggaaaaucugaauaauucuaguaguaauuauuuauuuacaaaauaaaaauagauuuuuuuuugauuacacaaauuaaacaacaauaaaacaucacagcaauccggauacuauaaagcucacaugcuuaccgacccaacugccccaggagugaccacugccaacagcuucaugucgaccuuuuugccauaauuuuuauauagccuuuuuuguuuuuaaaugguaauuuagaaagucaacuaggaaaauguguuacagguuuaucuuccaggagaauaggacuggagucgagaucuugaauguggcuuggaagaaggcaagcccaccccagagagaugaguugacaguuguuucugaccacugcuugcuuagagggccugcgugucugugaccgccuagcuuugcgccccugacuaggcugccccuuaauuacaaaugucuuuauauauugcuccagcuaaggcuuggaguagucgguuaagaacuugaacuucgguuuuugcagugaaacagcauuugagaauaucaccuucugauaagccuuauuuuauaagguggguacuguagugggaggcagugugagagaugcuugaaggaugcacugcuguccugcauuucagcaucuucaggaugcugugcagcugaaacauuugauaacgguggaacuguucguuauuuugcaagccugugauucccuauugaauguuuucucucgccauuugacaaaugaguguuucucugucuucagccucagugaaggaugagaucaguggagagcuggcugcuucuucagggguuuccacuccagggucagcaggucaugacaucaucacagaacagccacggucacagcacacacugcaggcggacucaguggaucuggccagcugugacuugacaagcucugccacugauggggaugaggaggauaucuugagccacagcuccagccaggucagcgccgucccaucugacccugccauggaccugaaugaugggacccaggccucgucgcccaucagcgacagcucccagaccaccaccgaagggccugauucagcuguuaccccuucagacaguucugaaauuguaagugggcagaggggccugacaucuuuuuuuuuauuuuuuauuugagacagagucucacuccauagugcaguggaggccgggcacaggggcucaugccuguaaucccagcacuuugggagacugaggcaggcggaucacuugaggucaggaguucgagaccagccuggccaacauggugaaacccugucucuacuaaaaauacaaaaauuaguugggcgugguggcacaugucuguagucccagcuguuagggaggcugaggcaggagaauugcuugagccugggaggcagagguugcaaugagccgagaucgugacacugcacuccagcccgggcaacagagcaagacuccauuucaaaaaaaauaaaaaaauaaagugcaguggcucguucucagcccacugcaacuucugccucccaggcucgagcgauucucccgccucagccuccugaguaggugggauuacaggugggcaccaccacacucagcuaauguuuguauuuucaguagagacaggguuucaccauguuggccaggcuggucucaaacuccugaccuuagaugauccacccaccuuggccuccuaaaguauugggauuauaguugugagccaccaugcccggcccugccaccugccaucuuuugaguucuucccuggagaccuagaccugaacccuccugcuuguucucuuguuaucuaauaccccuauugacagcgcagcuuagaucauuaauggagagcuugaccucaucugauaccuucacugaaggaaacaacuuagugucuuuuguguugaacacugagguaaaaaauuggaauaguugauuauaugaacucugcuaaaauugagugcauuuuacauuuuuuaaggccuuguugggcccugguuaaauaauuauuuuuaaaaauccuuaaggagccuauuauaaacagaucuguggucuuaaugaaaugugauuaauacugugcauuauuuuaagaacuuuugacuuuucaaaaaacuuuuacaacauuucccauuugauagcggcauagguuuaagcacuucucaucucuaaguuaguggacaaaaaacccucauggauagucuaauaauguuugcuacaaguccauguugaguuuuauacuccauuuuauuuucaguuuuaaaaacugugguuaaauauguguaacauaaaauuuauguucuuaaccauuuuuugcguauacaguucgcugguauuaaauacauuuaaauaaugucauggaaucauugcuaccacccaucucuguaaccuuuugaucauguaacacugaagcucuguucccauugaacucuauuccuccuuucccgccaagucccuggcaaccacgauucuucuuucugucuucugaauuugacuacuuuggguucucauauacuuuaggagucacacaguauuuguuuuacuuagcauaauguccccaaagcucaugcauguuguagccuauguuagaacuuccuaauguuucaggccaaauacuauuccauuguauggauaggccacauuuugcuuuuccauuccucuguccauggacacuuguauugcuucauguuuuagccauugugaaucaugcuguuaugaacguggguguacagauagcuccuggagacucugcuuuccauuuuuuuggcuaaauacccagaaauggaguugcuuuuacauuccaauuuuaauuuaaaacauucauaucauugaguguuuuacuuaauaguauaguaguuaacaaacuuaauaaaauaguauuuugguaauaauuugcugguaguccauuguucaguuuuuuuagguaaauuacacaggacauuucaaguggacaugaaacaucuugugauguggaaucaugccccaagcugauggcuaaacauaugaaauaccauacccuaaauuuaguagauuuagucuuugcaauuuaggagauaaccuguuauauuguuagguuuuugucgaaaagcuuuguccucauauuuccaacuugcuguaaaauuuguuugugaagacaaauauuuuuguauggguuuuuucuuuuucauauuaaaaagaaauguccacauuggaauuuuuuuggaguuuuuagagcuaauagagcuuuucauaauguagugggaaugagugaucaguaagcucuuagcaguuuccaugcgugcauuucugugccuugaaauaaaugacagaugaguacauuuguguucuguguguaaaaugugcucuuuccucauugcacuuccauguuggagggcuugucucuuggugaucacacuucaaaauucucacagccccccuugaaccguuuagguguuagacgguaccgacaaccaguauuugggccugcagauuggacagccccaggaugaagaugaggaagccacagguauucuuccugaugaagccucggaggccuucaggaacucuuccauggguauguggacuacaggugaugcgcuacaaagugguuuguauucagaccuggacaucuuaauuauaucuuugcuuccaagaagaaguccuuugauacuguuuucugaguucugaauagcugaugaaaaugaccaauugaggaauaaucauacuuuuucuugaucuaaaucuuauacuuuugaguuaucuuagcauaaauguauaauuguauuuuaaguggaaauuugucacuuaaucuugauuucucuguuuuuaaagcccuucaacaggcacauuuauugaaaaacaugagucacugcaggcagccuucugacagcaguguugauaaauuuguguugagagaugaagcuacugaaccgggugaucaagaaaacaaggugagggacauaggcuugagacgacuugguguuucugagcuugugugaggauuuaaaaucgcccuggcuacugucuacuuuauugcuuucccaucccugggccuuuaaauuuccccuuuaaauaccagcucuucccaggccuguuguuuucugccuuuccagguacuacccacagccuugagaauugccugaguucugccuccuuugagagugugccccagacaaaucuauucuguacugaauguuuccuugucugauuucuuggaucauucauuugaugguugcguauggccugcaacguuucuuguuuugguucuacugaacuguucuaaaagucucucuucauauuaucuuuuuacauguaaauguaacugucuucacuuuuaauuccucaaggacaaggaauagcguuucacaguucgucccaucaaucagaauuauagccuuuggcaucucccuaucuaccaggcccacuuccucuuagauuugggcuuccccaggcuguugccuuuccccaaguagcuucugcuuguccuguagaagaccuuucaugcuuugcuucugcagcagccguuccugaaugccuagugucaacugccuucuuaccacgcccacccucccugcaugcugcauuuauccccugccacagcccugugacccuguguccugcugccucugacuugucuguuucugcuuggccauggucucugugaggucaggugugcauaugggcacaaaccagggcaucucuuuauccccagcaccuggcuuaagugcugcucuggaacuaucuguugaaugaacuaaugcaugaauguauuguugaguaugagacaaacaagugucauugucuccuuucuagccuugccgcaucaaaggugacauuggacaguccacugaugaugacucugcaccucuuguccauuguguccgccuuuuaucugcuucguuuuugcuaacagggggaaaaaauggugaguacaaaaggggaugugcacaguugaaggaaauaacuagguuucagaggucagcuugguggccuguuuuugccuugcgugcagcagaggaaguagaaucugaggaugaguuugguuuucacuagccgaggggagggaggaaaugaugggagcagguagguuauugggucugguuuuguucauuugaaaacaaucuguuguuugaggcugaagguggcuugggugauuucuuggcagugcugguuccggacagggaugugagggucagcgugaaggcccuggcccucagcugugugggagcagcuguggcccuccacccggaaucuuucuucagcaaacucuauaaaguuccucuugacaccacggaauacccugguauguuaaaaguucacaucuuauuuucucagauuuaaucauuauuguaaaaacuauuucaguauugacuauuuuaguuuuagagcaguaaguguuuugaguucauuugggauauuugaccugcguuguagcucuucagaaaacacaugaauagugaaguucuuuguuucauggguucccuuuagaugaaacccauagaggagaaaaguagaaaccucagcacguaagagccaacauauauacacaucggauuuaaaccuaaagcacaaauugugccuggucgcaguggcgcugagucgcacucagccaggccaggcauucacacucagggugagugggaaccaggacuggcugaggcagcaguggacccaagucuccaucgcgcccaugcuuacuauggagccuucucguucucucuuuuucuuugggugagaggguacacuuguguuuuugaauuuauaugagguaaguguguaauaggguuuuuucuaaucuuuuuuaaguggaaucuggaauuuuaaucagauuuauuaucugacaaccuagaauuauaauccagaaagucugugguauugaggacauauuggcaauaugaugaaucucuaauucuuaaauccugaaacuuuuuuuuuuuuaaucacuuaggguuauuauagugaagucauuucugaauuuggaucuucucuucacaccucuuuuucucuuuccugagaauuaagcuuuuguuucgaguuagaaaguugauaguagggaauuguuccauggcugagcaauuuaucuccacagaggaacaguaugucucagacaucuugaacuacaucgaucauggagacccacagguucgaggagccacugccauucucugugggacccucaucugcuccauccucagcaggucccgcuuccacgugggagauuggaugggcaccauuagaacccucacagguaacggccaguuuuucagcuguguuuuuucuaguuaugcuuacuaagguuuaaguuuagaugaugauguuuguugcuuguucuucugguuaggaaauacauuuucuuuggcggauugcauuccuuugcugcggaaaacacugaaggaugagucuucuguuacuugcaaguuagcuuguacagcugugagggugagcauaaucuucuguggaaccauuucuucacuuaguggacauuuuaucauugcuacaauuaaaauuggagcuuaauaggaaauauuuccaugcacucuaaagcuguaaccaguaauacccaccauguauccaucucucagcuuuagaaagaaaacguugccaguaaaguuaaugcuucauaaacuucaguuuaaguucuaauucucagaauauuuguuugaaauagaccucuuccuaaaggauauauuuagaaauaaccuaucauuaaguguaaagucuguugaauaugcugggcacggugacucacaccuguaaucugaccacuuugggaggccaagguggaaggauugcuugagcccaggaguucaagacuaugggcaacauaguugacccugucccuacagaaaauuaaaaaaaaaaaaaaaaaaaguagcuggguaugguggugcauaccuguagucucagcuacucgggaagcugagguggaggggggauugcuugagccccagagaucaaggcugcaguaaggcgugguuacaccacugcccucuagccugggcaacagagugagacugucucaaaaauaauaguaauaauaaucaguugaauuaaaaaaaaaaaaaaaaaaaccacugugcuaggcccauaguaugguaagaguuaaagugagccuuagggauuauuuacucaaccucuguuucuguauaaaguggaauaggcucaauucuuuaagugauagcauguugaaccuuuccauaccaacuggcucauaagucacaacuggccagucaacaagaguaaaaauuaacugguaaaaaucaaagcaaaaaaccuacaauugucaaauuugugggauaacucccccuuuuaaaaugucaugccugacaguaauuucucucuaguuuccagguuuucagucaguugugucuuuuuugagcagaaggaagcaugcuaagagcucaaucuuguggcuagcugggggucuuugugucagccaugcaugugauggugccccugggugcuuggggcugcaggggagggguacagcaguaggggccuguucuguucucucgugcuguggaguacauagugacauaguggggugguccuugguguaggucccuuguuccuaccccugggucugagauuuauuuagaagugguguuggggcugugcggcaggccccucuguaacugaucaauguuugugaaguugcuguuugagaguugaaaccaugacauaagcagaaauggaaggaagaaagaaccaguuaugugaaagggacacauuuacuuuuaagcuuguauuuacugagauaaaguauucuuaaucaauguucuugagaggugugggaaaaaugcaacauccugguugcaguuaaacccagaacauuguguguugaagagugacgguucucaaaccgucaagacgcggguacugagugggacuaaccugcuguccucuugccuuggaccuuguguuccagaacugugucaugagucucugcagcagcagcuacagugaguuaggacugcagcugaucaucgaugugcugacucugaggaacaguuccuauuggcuggugaggacagagcuucuggaaacccuugcagagauugacuucagguaagugagucacauccauuagauuucaugaacuaagcucaauugaaaguucugggaucacuugaugcaaggaaugauguuaucaaguacccuguccaucagaaauccgagugguuuagguagaugacagugauuuucuccucccaguggcuuuuugcugaacuuugcccuaugcuuggaauuuuauuuuauuuuauuauuuauuuagagacaagaucuugcucugucgcccaggcuugaaugcaguagcacaaucauagcucacugaagcuuugaacucuaggacucaagugguccuccugccucagccucccgauuagcuaggagaauaggugugugccgucacacuggcuaauauuuuuuguagaaauggggucuugcuauguugcccaggcuggucucaaacuccugggcuugauugauccuccaucuuggccucccaaagugcugggauuacaggcaugagccacugugccuggccuagaauuuuaaaauauaaguagaagaguagauuuuuuuuuuugguaguccucgucauuuaaguauucuggauagugggaauaaaagagcuuagaauuuuucaucuuugucuuaaacuuuuaaaaaaauguagcuuauauuaauucugcuuguuuaaaaagaauauacucuucauuauacugaaccuagguaagacagcugguuuauauuuuguugcaauuaaaaaacgugagcugugguugcagugagccaagauuguggccauugcacuucagccuggcaacagagugagacuuggccucaaaaaaaaaaaaauaacaugagcuguguuggcacuuucauuuucuaagaguaguuuuggcuggagaaguuuucuuucaguacuuucuuuuagaagggaaauuuuccuuuauaauuuaggguuuguuuuuuuuuuuuccaagccaccuuuuauagagcccuuguggguuauuucauuuaauccuuagaauguuuauaaaucugggcuuguucucggcuccacccacagauagggacgcugagcgugcaugagugggcagcaagauagcagguuauggagggcccagcucaccccuucuguggcuugagccaauuuuauagggcacuuacagagucuuuugaaauaguauuuauuuugaagaaaaagaaaaacaguuuacugaguacugucuuauugagucuggaauugugagaggaaugccaccucuauuuauuuaaagccauuggccuuuuuuguuguuuugaguaagugcugcccaagguccuuccagggcaccuggaugagccugcucuggagcaagcuggcgguaaguguuuacugaguaacuaaaugauuucauuguuaaaugugcucuuuuguuaggcuggugagcuuuuuggaggcaaaagcagaaaacuuacacagaggggcucaucauuauacagggguaagcgguuuauuuuugugagaugcuguuuuaccuucaagaaggugaaagugaggcuuuccuuguggaauuucucuaaaugcauucgucauguuuuagauguuuauuucacaguuuauaucaugaaaguuauaaucuugucauauggauuuaagucuaguaauguugaguucuuucucacuagcuuuccaaaauaucuuaccuaaaauuuagucaaauacaagauuauguuuauuuuuauuauccuucucucuaaagcuuuuaaaacugcaagaacgagugcucaauaauguugucauccauuugcuuggagaugaagaccccagggugcgacauguugccgcagcaucacuaauuagguauuuaccaauauuuuaucucuuuuccuuuuuugguugaaguacuaaaagauacgagaauggaaagagagggaagaauucaaaggauguagagcaguauuccugaaucugagcucauuucagccauucuauucuuaaacuauaaugaaaaaaaaauccaaaaaagucuaaaauuauaauuaaaaaaacaacaaaauacuaacuguccauuguaaaaaguaaugcacuuucauuguaaaaauuuuggacuauagagaauaguacuaagaagaaaaaaaaaaucaccuucaauucugcugccaccuggagguaaucacuguuaauauuuugcuauauacucuaugaguuucuuguucaaaaucaggucaaaauuacaugcaauuuuguaaucugacaauuuccacuuaauauuuuauuagcauuuuccuguuaugaaacaguaauuuuaguuaugggucguuguuuugcuaugcgguugggauaaaauuuuauauacuuuuuuuggcaauuacuuauuauacauaaauguuuguguauaguuuucuuuuucugagaauuccuggaaguugaguuaccaggcccggcuuugaauuuuuuuuuuuauuuuuuuuuugagacagaguccugcucuauuguccaggugcuaucucggcucacugcaaccucugucucccugguucaagcgauucuccugccucagccucccgaguagcugggauuacaggggcacaccaccacgcccaauuaauuuuuguauuuuuaguagagacaggguuucacgauauuggccaggcuggucucgaacuucugaccccgugauccaccugcauuggccucccaaagugcugggauuacaggcgugagccauggcgccuggccaggcuuuaaauuuaaaacaaaucuucuaauagcuuuauggagguuauaauuuacauuucuugaaauguacucacuuugaguguauaguaaacuccaauuuuaucacauuucugucaccccaaauguauccuugugcccauuugcuguaaccuccgguuccugccccaacuccuaggcagccacucaucuauuuucugucccuuaagauuuguguuuucgccaggcgcucaugccuguaaucccagcacuuugggaggccgagguugguggaucacuugaggucaggaguucgagaccagccuggccaacauggugaaaccuugucucuacuaaaaauacaaaaauuagucggaugugguggcacacgccuguaaucccagcuacucgggaggcugaggcaggagaaucacuugaaccugggaggcggagguugcagugagcagagaucgcgccacugccuuccaaccugggcaacagagagagacugucucaaaacaaacaaagauuuguauuuucuggacauuuuauaguacuggggucauaguauagauggacuuuugcauuuggcuucuuuuacuuaauugugagauugguucuuguuguagcauguaucaguaguuuguucauuuuuauuggcgaaaguauucuauuauaugaauaauaccauauuuuaucuauccaucagauggauauuauagaguucauguuuuggcuaauuuaugaauuaugguacugugaacauuugccugcaagauuuuguguagacaugucuucauuucucuugaguagaucaccuagaaguggauuuuuaaauaauuuugguacuuacugugaaacugcucuucaaaaacauaccauuguuccuuccuuccuuccuuccuuccuuccuuccuucuuuccuuccucccuuccucccucccuucccuacuucccucucccuuucccuuucccuuccccuuuucccuuccccuucccgccugccugccugccugccuuccuuccuuccuuccuucguuucuuucuacauauacacauuuuuuuaaauuucaaugguuuuugggguacaagugguuuuugguuacauggcugaauuuugguuacauggugaagucugagauuuuaguacaccugucacccgaguaguguaccuuguacccaauauguaguuuuuugucccucaccuuccagccuuccgccuugugagucuccaauguccauuauaccacacuguaugcccuugcguacccacagcucagcucccacuucugagaacauauagcagaaacaugccaaaguauacucccacuaccagaaugugauugugccugauucuucucaccaguacaaauauuucaaaaaaaguuaaauauguaucaguuuuuugggcagaaguugauacuucucuuuauuuauuuauuuuuuuugagauagggucucauucuaugaugcccaggcuggagugugguggugcgaucucggcucacugcagucucugccucccagguucaagugauucccacgucagccucccaggaagcuggaauuacaggcgagggccaccacugccagcuaauuuuuguauuuuuugguagagaugggguuucaccauguuggccagacuggucucaagcuccugaccucaagugauccaccugccuuggccuuccaaagugcugggauuacaggcgugagcuaccacacccggcugauauuucuuuuuaaaauaacuuaccuucuuuugaaaguaauacauguuuaaugaacagaauuuaaggaaaauauaaaaaaacgaaauaaucuuuguaaucaaacuacugaaaagaaaaccaaaguuacauuuuggugcauauucuuuuucauuuucaucauuguaauuugcauuucuuugauuacuugugagacacuccuuucauuuacuuaauagguuuauaugacuugccuauucagagauuuugcagcuuuaccauuuucugcaaaugauagcaacuucuuuuuguuuguuuguuuguggagacagagucucgcucugucacucaggcaggaaugcagugguggaaucuuggcucauugcaacuauugccuccuggguucaagcgauuuuccugccucagccucccaaguagcugggauuacaggagugugccaccaugcccggcuaauuuuuguaucuuuaguagagaugggguuuugccauguuggccgggcugaucuugaacuccuggccucaagcggucccccugucucggccucccaaagugcugggauuacaggcgugagccaccguacccagccaguaguuacuucuuauauucuagaaaaaauucuacucaugaucaagucuccaugaggaaagagacuuuaauugaagaucauggggcuugcagaccaauaugauaaaauaguucauuguuucuaaaaguauuacugaguguugauggcagauaugaacccuuuuguuuuuguaggaaaauguuacccguauucuccauuugaauucaguuuagauuuguuaggaaucgcagcuuaagcuuugccaucugggaguguuugggacaguuuugcagacaaaauugcaaaagugccuaaggaaugcagcuggcauucagaccugcucugugcucaguacucuguggacagacacuguucagcacuuguugaucagaagguuuagaaagagaacuuucaaaguugguuuuuaauuaaagcauuuaauaguguaaauagaaagggauuaaauuuuaugacagacaaaagaaaguacagcacccagcugggcgugggggcucacgccuguaauccagcacuauggggggcugagguggguggaucacgaggucaggaguucaagaguucaagaacagccuggccaaggugaugaaacccugucucuacuaaaacuacaaaaauuagccgggcgcgguggcaggcgccuguaaucccagcuacucaggaggcugaggcaggagaaucacuugaaccuggacggcagagguugcagugagccaagauugcaccauuguacuccggccugggccacagagugacauucugucucaaaaaaaaaaaaaaaagaaaaaaagaaaguacagcacccaguuauguccgagugggugcaugagagugacccugagauuggagacaacgcugucacgugcuugaagaacgccaccugagaaagggggcgagaagugguguccgcugguaaccagagguguuggcuuagccaucugcagggaggaggguggucuaucacaggugaguuucaucuacuuucuuaagcaaauuaaccuuacuuuuguguuaggcuugucccaaagcuguuuuauaaaugugaccaaggacaagcugauccaguaguggccguggcaagagaucaaagcaguguuuaccugaaacuucucaugcaugagacgcagccuccaucucauuucuccgucagcacaauaaccagguaugcugacccaguggcaucuucacauugucgggaaaaugcccuuuccugaugccuuucuuuaggcuuuaauugaaaacauuuuauuuucuagaaaaaagcuucagcucaggauguuugaguguaggucaguccuuugauaggauauuaucauuuugaggauugaccacaccaccucuguauuuaagcucugccacaaucacucagcugugacacuguaaaucucuuaauaguuuauuacauuccaugugcugacaguuguauuuuuguuugugacacuuacguauuaucuguuaaaacauuuucacuuuaguuguguuaccuuuaaagaggauuguauucuaucaugccuguugauuuuuuggugagcgggcuauuaaagucaguguuauuuaggguuauccacuaguucagugauuugcgagauuaucauucacauuuauuguggagcuuuugaauaucgugucaaauggccacauauaucccauucuuaucugcuucuuaggugagugggacacagugcuuuaaugaagcuauaaucuucagaauucuagcuugcagagaagauugcagaagugauaagacuugugcuuuuuaauuuugucuuuuaaauguuauuuuaaaaauuggcuuuauaugauacucuuuuuuucugcugaguaacaguguuuuacaaaacuuggacuaaaugacuucuaagcuuaaaugaucacuugaugcuuuuuuucugaauuaggaacucagcuuaucaaauaucaaagucauaauuccugaauaaauaacgucuuuuuucauguaaagacugcuuuaaaaaacacauggaaggcugggugcgguggcucacgccuguaauccuaacacuuugggaggcccaggugggcaggucgcuugagcucagggguucaagaccacccagggcaacauggcaaaacccaccucuacucaaauacaaaaaauuagccaggcgugguggcgggccccuguaaucccagcuacucgggaggcugagggaugagaaucacuugagccccggaggcagagguugcagugagccaagauugugccauugcacucccagcuugggcuacagagugagacucugucucaaaaaaagacacacacacaaacaaaaaaaacauggagacauuuuuuuggccaccuuaauauuuccccucagauaauuuccuuuguuuaaacucagaacuggcauuuucucucuuggagaagauucaggacaaauacuccuuuaagauaaguagaagcagugaaagaggauuugauuaucaggaauuugauaagcuuagaauaaauuguugcuucuuaaugucauuucagaagaugaauauuuauuaauagaugccaacugagauaucauuaaaauugauuacuaacuacuacuuggaaaagucucccaguuccaaacuucagcaggccucuugacaauucagcuguggucaauugggucuugcgugauagauacaaugaccaauugugcagcagagugugcugcuuagcugccuauucuguuagcauucauguguuaacuuaaaaucauaaucuccuuaguuuuguugagugucuccguggacaagacacugugagggauacaaaaucagauuggcuuuauucaaaccacugggguauuauaauucauuuauaauuuauuuuauuuuuugccuuuuuuccauguguucuaaaggaauuagaguuuguauauaacuauaaugggggauagaaauugacaugugccaugaagggaaugcaaaaaagugccgugggagaugagaaguggagaaaggaauuucuuuuuucuuggaagcaggaauaacuucaugaagcauguauuucaacuuaaacagauaguaggcaacgcuguaaggggaguauggcugcagcaaaaguguucggggcagacugggaggaagggagggaauaaauucagccauuguuauggaauaaugaucaaaauuuauuuucagcccguuucacuuaaaaguugagacugcuuaacuuuuuuuaaucuuuaaucuuaaacuuuuaaaugccauuugaucuuuaaaaauauauguuuuaauaguguauuuuaagucucuauauuuuuguuauuagaauauauagaggcuauaaccuacuaccaagcauaacagacgucacuauggaaaauaaccuuucaagaguuauugcagcaguuucucaugaacuaaucacaucaaccaccagagcacucacaguaagucucuuucuugaucggucuuacugacauuguaauaguuuuugguagcuuguauggccaguuaguuguauggucaucuuacggugaggugcuugucuuacagcucuuacuuauccaugaggcuugcuaagaaauugugcuucugugaaaagaaucucagcuuacuccaggaauguaaaugacuauguuuuuucugauuauuaaaguaauacacgcccaaaauaaaaaaauucagccaauuuaggaagacacaacaauuaaaauaagccaggcaugguggcucaugccuguaaucccagcacuuugggaggccaagguugggggcucacuugaggucaggagucggauaccagccuggccaacguggugaaaccccaucucuacuaaaaauacaaaaauuagcugggcgugguggcgggcgccuguaaucccagcuacucaggaggcugaggcaggagaaucgcuugaaccugggagguagagguugcagugagcugaggucaagccacugcacuccagccugugcaauagagcgagacucugucucaaaaaaaaaaaaaaaaaaagaaaagaaaaaaguaaacuacugucaccugcauugguaauguaucagaaguuuaaaaugucuagauuauaauuaacucagugaccugguaauauauacuaagggaaaaauauuuauaauuuacauuuuuacauuuuuauuuuuuuaauuuuauuauuuuuuuuuugagacagaguuuugcucuuguugcccaggcuggagugcaauggcaugaucucagcucaccacaaccuccaccucccggguucaagcaauucuccugccucagccuccugaguagcugggauuacaggcaugcaccaccaugcccggcuaauuuuguauuuuuaguagagacaggguuucuccauguuggucaggcuggucucaaacucccaaccucaggugauccgcccuccucgaccccccaaagugcugggauuacaggugugagccaccaugccuggccuuacauuuuuauaauaagaauuuauguugcugacauuagaaaagaaccauaauauccaagaauccaagaauaauuaaauuauguacauaugcuaguauauagugugaugcuuuggagaauuuuuaacaauauggagauguauaaucuggauuguaauauugagugaaaaaaggcagaauacaaaccugguggggguauagucggauuucaguuaagaaaaauaauauuuacauauauacauuucucacacuggcagauaaucaccaagauaaauuuugggauuguggaugauuuuuuucuucuuuauauuuuucagauauucucaaauuuucuaaaaugagcaaguauaacuuuuguuaucagaaaaaaauaauauacaaaaguaauguuaauuugcuggugaccagguuaaaccuuuuuauuuuuauuuuuugagauggaaucucacucuguugcccaggcuagagcacaguggcaugaucuuggcucacugcagccuccgcuuccuggguucaaaugauucucuggccccagccuccugaguggcuggaauuacaggcguguggcaccacaccuggcuaauuuuuguauuuuuaguagagguaggguuucaccagguuggucaggcuggucucgaacuccugaccucgugauccacccaccucggccucccaaagugcugggauuacaggcgugagcuacugcgcccagccagaccuuuuuauuuuauuugacaaaagaaauacuuccauguuauagaagacuaaauauuguuugggcugucugcaguauggucuucccuugauuuguucaaaauaucguaaacuuugcuuauuuauuuuuauuguggccgacugugucgggcacuguuguaggcuugggauggaaaaacaggauuccugcccuuaggguuucugcaggcuggucagggagacgaugugguaagcuggagcucagcuccuaaggaugugcaggggcaguugagaggcggaagggugggagaucauuccagggugugggcagcacaggaaccucucuucauugggauauaauugccauucugauaacacguguuugaggugucuaaaguaggaaguuguaccauggugggacagauauccugugguuaucauacacagaucucaguuuucuucucauuguuuguacuuuuuauaaaggguaacaggagauauaauucaauaaaccuuugugguguuugggugugauuuuauuguuucuuucuucucaguuuggaugcugugaagcuuugugucuucuuuccacugccuucccaguuugcauuuggaguuuagguuggcacuguggguauguauuuuccucaguauauauuaauaguugucuacaacaguaugacauaaacauaguuauuaggaugcccuuuuucuuucuuuuuaagucuuuuaucaauuuggcuuuuuggaaaaauaucugauggaauacuuguuucugcuauauuagcugugugagacuagugacaggagcugugggaaaugaaugccaaauguucuuaggcauugaugggaauuucaggguguggucuucaaguucauuuaagggaauuuucauaugcuggcaaaaggcuuuucucauuagcuugacucuuuccaaaauuauuugcugugaauuagaaguuuaggaaccuuuuuucacuuaauugugaccuagcauacgaaauggugaugauuuaggaacuacuguucuuguauuaacagcuuuuauuuaaaaaugauuuuccuccaguagauggcccuacuagcaucugggaaauaauuucaagucuucuccagcauucaggaauaggcuuucauuuuguguaucaauuacugagaaugauuuuggugacucacaucacauuugagaaguaaaccugcagauuucuugugugugucagcaaaugaccaacugauauuugcuugaaguggauuacauuaucugcucuagaaugauugcuuucccaccuuccucacauacagacugagcagcuacgguuucuaaucauaggucuggcacuagacuucacuucugggcaacuuuggcauuggaguaaaauguauuaauuuaaagaaaguuaaaaauccguucaaguaaacauacaguucuaauacuuuuuacaauuuaaaauauagauuuaaaugauaaaauaaaaaagaaaauauggguagacaccauaauccucguuucugcaucuguucacaagggguugauauuuaugaguucuauucuccauauccauucuauguucucuuaaugcucagucagcaccucaggugguuggaguucaaugcuugguaguuugacuuacacugucuuuucuaggggauugagcccuggguaguccugcuuauuugagguugcaauuugucuuucaauaacuuuuacuacaagauauggcguguuaaaggauaccauuggggaaccaacauaauaauaucaggaaaacuaaccacgucagaccugccccauuguguaucaaguacacuauuuuuccauaguaauaaagaguucaccccagccaauucucuuuuauuuugugccuguuuacucaauggcauuaacaugcccaaaugucuggguagcugucucaucuccaguucagcagaaccauugucauaugcccuaguaaaagcauuccuucauuggacacuuaggccccaauacuuucauucagaucuacuaccugauuucauuucucaaaugauuuuuauggagcucugauuuauaggaaagauguuaguugauuaaaaauaaaacaauuucugagcugguauaaaauguauugugacaugccuuccucuuggaauugcaagagaaaggaagacuguuguuugcuuaaaaauugucuauaauuugacuuugcaaaugucugcuuccagagugccuccacugagugccucagaugagucuaggaagagcuguaccguugggauggccacaaugauucugacccugcucucgucagcuugguucccauuggaucucucagcccaucaagaugcuuugauuuuggccggaaacuugcuugcagguacugguacugaguugaaacagggacuccaggacuuggauuuugauuuccuuagggggaauggggguggugagcauaugaggggaaaauacuauaaggucauugccagugauggcuugucccuuuagucaaauuucagauguuaccuauaugcauaaacacaugcaguuggcagcuguucugugcugaguauuuuaaaguagccucuucccaauauagccccucaguuaacuacaaguaaacucauuuugaauuucauuuuaaugggcaccauaugccaguacucccucgggcacugggauguuaagaaaguauaauguauggacuucauucucaaguuaguuuuagauuagagggggauacacguaaacaaaagugcaguggucacacagaguggcccuaaucacucuccuugggcagauuuaugggcugguaggaaagagcacaacacggagaggguguagcaccuuggcgaugauaauggaggauguggccagcaaggaagacggaguccauugaaauugauuuugggagaaguugccaaucuccaugaaagaauuggggccugugcuauuugcuucagggggcuauaggagaguuucgugaaagggacuaaaagaugaguauuuuaauaagaucauucauccaacuugaacaugggcuggaggagaagguagggagacucaggagauuaauguugaugcuaaggcaagauaauggcuuugggacuguagggaagacacugauuguaagagaaugaaggaggcagaauugccaggccugguucaccaacugaacuucgguugugaagacaaagaaaccugggaugacuucacauccugggcaggugugugguggugacagucauggaaauugggaacacagauuugugcgggaaacaucaguuucaguuugaguuuggcuuaucaguugaauaucaggcacagaugucuggccaacucucaacauagggucuuaaaugacuucaguuccccaagcaauuuguccuucccaugcuauugggguggagagguaaugucugugcccauaucacagccagugcucccaaaucucugagaaguucaugggccucugaagaagaagccaacccagcagccaccaagcaagaggaggucuggccagcccugggggaccgggcccuggugcccaugguggagcagcucuucucucaccugcugaaggugauuaacauuugugcccacguccuggaugacguggcuccuggacccgcaauaaagguaaugucccacuugggugcuggauucauacagccuuaaugacuauggguuuccagacuaccuuuguuuaguaaucugucccuucuuuauucucuuuuugcuuuaaaugaacaaaauugcucagauugugacacuaaauuuaacaucaaaaugugaccauguggaugggugcaguggcucgugccuguuauuccagcacuuugggagacugaggcaaguggaucacuugaggccaagaguucgagaccagccugggcaacaucacgaaacccccucucuacuaaaaauacaaaaaauuagauggguugggccgggcgugguggcucaagccuguaaucccagcacuuugggaggccgaggugggcggaucacgaggucaagagaucaagaccauccuggcuaacacagugaaaccccgucucuacuaaaaauacaaaaaaauuaucugagcaugguggcgggcgccuguagucccagcugcucgggaggcugaggcaggagaauggcgugaauccgggaggcggagcuugcagugagccgagaucgugccacugcacuccagccugggugacagagcgagacuccgucucaaaaaaaaaauuagaugggcaugguggugcgugccuguaaucccagcuacuugggaggcugaggcaagagaguugcuugaaccugggaggcggaguuugcaguaagccuugauugugccgcugcacuccagccugggugacagagucagacucuuuccaaaagaagaaaaaaaugugaccauguguuuuauagcucuuuuaguaucaucagucacuguuaucccuaagagggaaauaccuagcuuuaguuuuagguuuccagcauuagccaagaaagcucagaauugauguuccuggccaaguaccucauugcugucuccuuaaaucuugguuaauggcuacuguccuggcuagcauaguuauggagcauuuccaugguuguagaauguucugccaaucucagggacaguuuugcuuuucugugaagcaauaaaaucaacuucaaaacaaauguuaacuauuuguacaauggauuuaagauagaccaguucacauacuuuuuuuuuuuuuuuuuuuugagauggaguuucauucuuguugccugggcuggagugcaauggugugaucucagcucacugcaacuucugccuccuggguucaaacgauucuucugccucagccucucgaggcagauuacagcugggauuacaggcaugcaccaccacacccagcuaauuuuuuuguaguuuuaguagagacgggguuucaccauguuggucagguuggucucaaacuccugaccugaagugaucuauccgcuucggccucccaaaguguugggauuacgggcaugagccaccacgcccagccuaagauagaccaguucacuuacuguuuauaucugauuacucucucuuugccuugucuucuaccuuuaaaaaucucccuacuaacuucccauucuccuuuagcugccaucagucuucucccuucucugcaaacaucucuggagagucccagccucagcccacagagcuucccacugcucugagguggaccuuguuugcaaggcuucuuuggcucucuuggccuggacccugucuacuacuucagccauccuuccuuaaccccugcuggugguuucuguugccacacuccauagcagcguuucccgcccagaucaugucuuuacaucucugggcacugcucugguccugccugccuuucccucuuuguauccugcaggcugcuacccccaucuugaguguccucuucaguuggcuuucagagggccuccuggguguucccuuacccacuugccacuccccagucacuggguucaguccuuccugcccaccagcacaugcuuucuaggcucuguccuaggccgucuucucucuuuguagucucugggccagugcuguucuagagaguggcagaauuuucuauaaccauggcagugcuccauagcuaugccaggcaagacaguagccacuaaacacauauagcuguugagcccuugaaaugcagcuagugugacugaagaacugaaccccgauucgguuuaauuuucauuaaauuuaaauuuaaauaaccuuauguggguaguggcuccaguauugggcagggcagccugagagucggggcuguucuccugucuucagugucuagaugagggaccucagaggaccugucucuggagcugcaguucaauguagccagcugccccgugacacuuacauauagcugauuuguggauaugucagacacggugugaugagcucagcuuucuguccuccuccccacaucugccccugccccauuuaccccacuuugugucuuaucaagcuagaaacaggucaccacaagucuucauuuccacucaccaagucuuuuguuuccccuacuaaauauuuugcgagaagaaaguguguaccuuuguauucacauacauguacaugcacauauacaugcacauaugcagggguccccaaccucuguuaaaaaccggacugcaggccgugcgugguggcucacgccuguaauuccagaacuuugggaggccgagaccagugcaucacaaggucaggagaucgagaccauuccggcucacacggugaaaccccgucucuacuaaaaauacaaaaaaaaauuagccgggugugguggcgggcgcccauagucccagcuaccugggaggcugaugcaggagaacggcgugaaccugggaggcggagcuugcagugagccgagauugugccauugcacuccagccugggcgacagagcgagacucugucucaaaaacaaaacaaaacaaaaaaaaaaaaaaccaggcugcacaggaagaagugagcaagcauuaccaucugagcucuaucuccucucaggccagugguggcauuagauucucauaggagcguguaugaguucguucucacacuucuguaaagacauaccugagacauauaaagaaaagagguuuaauuggcucacaguucugcaggcuguacaggcuucuguuucugggaaggccucaggaaacuugcagucauggcagaaggugaaggggaaguaggcacaucuucacauggcccacaggaaaaagagagaaggagagagagagagagacagagagagagagagaaaaagaaagauugagagggagagaggagggagaaaggagagugccuguagggggaguugcuacacaaaggagcaccagggggauggugcucaaccauuagaaacuacccccaugauccaaucaccucccaccaggccccaccuccgacacuggagauuacaauucagcaugagauuuggguggggacacagagccaaaccauaucagagcaugaacccuauugugaacugcacauuugagggaucuagguugcaugcuccuuaugagaaucuaaugccugaugaugauuugagguggaacaguuucaucccgaaaccaucccccgccaacccugguuuguggaaaaauugucuuccacagaaccggucccuggugccaaaaaguuuggggaccucugcacauaugcaugcaccuguacauggacacauaauacauguacauaugcauacuuuauauucucugccacuucugguccagacugauauacuaucucauuuggauuacugcacuagccuuuuguuuuggaaacagcauuuuuuaaaaaauuuaauuuaauuuuuuugagauagggugucauucuguugcccagcuuggagugcagugucaugaucauagcucacugcggccucgaucucccaggcucaagugauccuucugccucagccuucucaguaguugggacuacaggcauacccaccaugcccagcuaauuuuuugauuuuuuuuuuuuuuugagacagagucucagccugucgcccaggcuggaguggguuggcgcgaucucagcucacugcaacuucugccucccagguucaagugauucuccugccucagccucccgaguaguugggauuacaggcgccugccaccacacccagcuaacuuuuuguauuuuuaguagagacgggguuucaccauguuggccaggcuggucucgaacuugugaccucgugauuagcccgccucggccucccaaagugcugggauuacaggcgugagcuaccgcucccagccaggaaacagcauucuugagauaauucauauaauucacccauuuaaaguauauaauucauucucuuuaguaugcccacagaguuguacagccaucaccagaaucaguuuuagaacccauaaaggaacucuguacucuuuacccaaaaccuccaugccuccagcugcaggcagccacuaaccugccuucugucucugugacucuacgucuucuggacauuacuguggaugggcucauacagucagugagcuugugacuggugccuucuaccaagcaggguuuucaguguagcagccucucuguuuuucuuuuuuuuuuaaauugugacggaacuucugccucccggguucaagcgauucuccugccucagccucccgaguggcugggacuacaggcccaugucaccaugccuggcuaauuuuuuuuuuuuuuuuuuuuaguagagauggguuucaacauguuagccaggguggucucgaucuccugacuucaugauccgccugccucggccucccaaagugcugggauuacaggcgugagccaccaugcccggcuaaccuuucauuuacugucugcauuucuucccugaugccuuccaguccaugcacccgauuguagccauucauccuauuaugguuuaaggugacugucuuagucagcauggguugccauaacaaaauaccauagccuggguggcuucaacaacagaauuuacuucucacacuucuggagguugggaaguccaagauccaggacuuucgccuugcccucauguggugagggggugaggaagcucuguggggccucuuauauauggaugcuaaucucauucaugaggggucugcccucaugacccagucaccucccaaaggccccaccuccuaauaccaucacccugguaauuaaguuucaguguauaaauuugggggacuauagacauugaaaccauaacaagcacuuuucuaagaucagggagugaguaaguagcagagcuaggaccucaauuccacaugucagucaucuugccuucacucugcuccaugauggcugccuccuagagcauugggagucucgauguucuauaugcucucauguguuguguauuggagauaguugaggcuuuaugaauacaucuggauuuguugacuucuagcuuugcugguaaccagcugugaccuugaauaaguuacuucaucucugagccuguuuccucuuuuagaaacaggaguuuaaaaugcugcuuuggguugggcacgguggcucaugccuguaauuccagcacuuugggaggcugagaugggaggaucacuggagcuuggaguucgagaccagccugggcaucauagugugagauccugucuccucaagaaauuaaaaaauuagcugggugauguggcgugugccuguggucccaucuacucuggaggcugaggugggaggauugcuugagcccaggagguugaggcuacaaugaaauaugauugcaccccauccugggugacgagugagacccugucucaaaaaagaaaaaaaaaaugcugcuuuguaccccuuucaugucauggcgucauggccaacauagaaugcccugguuguuugcuguuggagggcaugggccugggggcucccugagggcuccuuccaucuucaacucauucucugugcaccuguuaggaaguugugggccagucccuaccauguaucauuguguggguaaaaguaaauaaaauguguacagugucugaacuguacauaucaggguccaagaacaaaaugagugacauggguuagcucuuuuuaauaaaugguaaaaccaaauauucuaauuuucaguuuuguuauacuuccaucacauguuuuuguuuuuuuguuuuuuguuuuuguuuuucuauuuuaggcagccuugccuucucuaacaaaccccccuucucuaagucccauccgacgaaaggggaaggagaaagaaccaggagaacaagcaucuguaccguugagucccaagaaaggcagugaggccagugcagguaggaaacagcguggggaagggagggacaugagugcagcaucugucauguagaaacauaggauuuaaguaacuugguguuuuagagaaauaaauauaauacacaucaguaaagugagagaaaguuucuccaggugcgguucaagauauuagaaacuaaugacugauguacacagaccaccuuuuggucugaagcauuucuaagugccacuggcugacaugcagccccuacagccuccaggcuuccagcccuagcauggagcaucacucuccuaugcuucccugguugcaggugauggcuggagaggccuccugauuuucaguaagggaagugguguagaugcuuaggaauagauguagugagugaaaaaacugauucugauaugucaaaaauucugauuggaaauggaauauuuacauuuggaagagcuaaaggcgagagaaaguggggauaaagucaucugaguuggaggagcuuaaaccauucacaaguuuggaggaccuuuuuuuacccaugaaaaggucagaacagaaggggcuaggauuuaggugugacugcaguuuauugaauucccauccauacugcucucggugggcaguggcaggggcaggagaggagccuggcaaagcaugaagugacugcugcugccucugcuaucugggacgccuggccaccugucuguacagucucccuccagacccauucucacgcugucucuuggcacccaggggccagugaugguucucccauuuguuuuguguauauagcauuuauaucaaggcuauuuauuuauuuauuuauuuuauuuauuuauuuuuuugagacagagucucacucugucacccaggcuggagugcaguggugcaaucucggcucagugcaagcucugccuccuggguucaagcaauucuccugccucagccuccugaguagcugggacuacaggugugcaccaccacaccuggcuaauuuuuuguauuuuuuauuaguggagacgggguuucaccuuguuggccaggauggucuugaucuccugaccucgugauccguccaccucagccucucaaagugcugggauuacaggcaugagucacuguacccggccuauuuauuuauuuuuaauugacaaaauuguauauaucuguaauauacaacaugauguuugaaauauguguacauuggccaggcgugguggcucacaccuguaaucccagcacuuugggaggcugaggugggcggaucacgaggucgggaguucaagaccaaacuggccagcauggugaaauccugucucuacuaaaaauaccacaaaaaaaaaaaaaaaaaaaaaaagccgggcaugguggcucgcgccagucgucccagcuacuugggaggcugaggcaggagaauugcuugaaucuggcagguggagguugcagugagcugaguucaugccacugcacucuagccugggcgauagagcgagacuccgucucaaaaaaaaaaaaaaaagaagaaauacauaugcauuguggaauggcuaauuaaccugugcaucaccucacguaucauuguuuuguggugagaacacuuaaaaucuacucuuucagugauuuucuugcauaugguacauugcuauuaacugcagucaccaugcuauacaguagaucucuugaacucauuccuccugucuauaaaugaaauuuuguauccuugaccaacacauucaagguuuuuuuugagauggagucuucuucacccaggcuggaguaccauggcacgaucucaucucacugcaaccuccgccucccagguucaagcaauucuccugccucagccuccugaguagcugggauuacaggcacaugcuacugcaccuggcuaauuuuuguauuuuuaguagaaguggaguuucaccauguuggccaggcuggucucgaacuccugaccucaagugauccgccugccuuggccugccaaagugcugggauuacaggugugagccacugcacccggccucaagcguuuuaaaagaugcucuuuucuaaggauugacuguaguacaggaggaagauugaccuguugaaaagccucagccuuuacaaguguaaaauuaucaguauauuacuaucaucuuucugaugaauuaaauaaacuaaggacuccaagucaaaagucuucaaacugaaguagaauaguuguauauagugcuuggcacuuuaauauuuaguaucgguuuaaugauaauguuugugccuuugccgucuuuaaaacauuuuuacaucaucccuguuugauuacuuggugugcucaugaaguuguuggccacuaaggaaucuuaggcucagagagguucuggaauuggccagugguccuugaaucagcugcuccuaugauucucuaacugauuucucacaaagcaaacaagcaaucauaacaaaacaacugugcacacugcucuucuuauuuuguuauuuaaaaaguacuuaggcucuacuuauguuuguuagucaauuucucauuacuucuaguuaaucaaaaggucagaggaaauacuugaauauuuucauacuagaauacuuuaaaaaaucaugauuuccaguaaucucuuuaaaacuuggcaaguuauuuugaucuaaaaguuuaucuuuugugugcauauuuuuaaagcuucuagacaaucugauaccucagguccuguuacaacaaguaaauccucaucacuggggaguuucuaucaucuuccuucauaccucaaacugcaugauguccugaaagcuacacacgcuaacuacaagguaugggccucugcaucuuuuaaaaauauauaugcacacauacuuacgucuaauggauaguugauguuuuucuuaugauuuguaggauguauaagcccuuugagauaugaguuacauuuaguuuuuucaaguuuguuugucuuucagcuuuguuuaugauagcuucuaucauacagguguuuuggauuuucauauuguuuguacucacagcuaagauugauuacagugacagagcuaggaugugcagccagguuauagggggaaguggcccugguggagucuggagggauccguguacaggcuuccuucccucccgugaggcucacacaaaaauacagcaacaugcugguccugcagguacccucugccuaacaugagccacaauuccagacucacagaagaaaagcagguguucggcauaaaccauguguuucaaauagucugggcauggugagccacuuguuaucagcuagggaaaguuuaugucagcguaagaaacuguucaccagauacccccaagagccagccuuucugucuagggauguuuuaguuuuuuaguucauuuuuuuuuuuaacuuuaaaauuuucuguucaucugcaauuuguuagauaugaaguaugugucuaauuuaauuuuuguuuuugguuguccccaauaauguuuacagaagaauuuuucugcacuaauuggcuugaguuacuuacauucucauaguucucuaguuucaguaguuucauuuauuauuuuguuauaucaaucuaucugucugcucaucuauuagaagcauccuuguuuuuuuuuuuucuuuuuuagacagagucuugcucuguccccagguuggagugcaguggugcaaccaugccucccugcagucucagggcucaagugauccucccaccucagcuccugaguaccugggacuaccggcaugugccaccacacccagcuaauuuuuacauuuuuuguagagacagggucucccuaaguugccugggcuggucucaagcuccuggcuuaaguaauccucccuccuuggccucccaaagugcugggauuacaggugugagcaacugcacccggcuacaaguauacuucuuaauuauuguagcuuaaugguauuuaugaggggaucaguuccccuguuguucuuuagaauuuucuggauauucuucuuuauugauuuugggaugugaacaauagaaucaacuucuacuuguagauugauuuagggagaacuuauaccucagauguuaagucacccuguccagaaugugggaugcuuuccuauuuguucagaacuuuuuaaauuaccucagaagcacaugaaauuuaaaggauuuuaaaaaaaacuuaaagauuauuucacauagcucuugcacauuucuugauaaaugaauccucagguauuccucuguuuuuguuacuaauaguuacuucuuauggguuuuuuuuccccugaaaaucauuuaucaaacguauguggcuuauuuucugaaggauguuugauaauuuuggaagauaugaaagucuucauauuuuacaagguuugaggucucuuuaagcugcaugguucucaugucagcucccaaagcagaagacggcauguugaaaaaugccguagagaagauacuucuuuuccaccuguuuucaacucauaucaucuugaauuucagggcaccuuuccaugcuccuagugcuugcuaucuguuuauuauuuuccuuccugaauacccugaacuccagcauguucugcuguaauucuggccucccuggcaucuuggacuccuguuuccuuugcucugucauccccgcggucagcuccugcugcgcagcuucucagcugaagugcguuuggagugccuggcgugucuugcuggaucuuugaguauugccucugguuuccuugguuccuucugcugaguugcucagcgucuccacuccccauuucuuguguggcccuuccugcacuccucugauuccuuuugucuucccugguuucuugcuuugguuucgagucuccacagaacuuuugcagcucuucugaagaccuggaagcuuuuucaucuuaauucucaucucaugaccucuuuucccuucuuugagagcuagaacuucccauggugaacuucucuuuccagaauuccaugccuucuuuucccucccacuuaccuguuguccaggagaggucagauugcugugcauauuggaggagaacccuuucuucccugggcucuucaucucacaugacaucaccacaucaccucguuccuuggacccucaguggugucacugcuggauuuuucuuuccuuuggcuggccuuagggcacacccagguugacuagcguagucaugguauuuagauccacucacauuuucaguuucugugucugucucuugccugcuucugacuucgcccagagaaagcuucucuuucacaaggguucuuagauuuauguucacugagcaccuucuuuucugaggcaguguuuuaccaauauuuauuuuccuagucagucucgccuuaccuuucuuguuaugcaugucuuugguccugacccauucucugagucuguaaaauagaauugcuguauaauuuaauuacaugaaauccuuuagaaucuuaacacaucuuacaccugauuuaauauuuuauuguauccaaauugaaccaacccuaugugaauuugacagugauuucucccagggauccuaguguauaaggaauaggacuuaguauuuucuauuuuuugauauaccacauaccagauacugauuaugauggacauuuaacccuuuuuucucauuaugaaagaaaguuaggaauuauuucuuccaguagcgccaguguaaccugaaagccuuugaaagaguaguuuuuguauagcuaucugaaaggaauuucuuuccaaaauauuuuuccagugcugacaacaaacacgcagacacacccugcaaggugaguguacggcgccgcacaguggaggcaucugcugcagccgucgauguuugugucuuugguuguacauuaugagaucgugacagggccaguaaccguguguucucuccuucaccuucccaaggucacgcuggaucuucagaacagcacggaaaaguuuggaggguuucuccgcucagccuuggauguucuuucucagauacuagagcuggccacacugcaggacauugggaagguuugugucuuguuuuuucuccuuggguuguggcuggcacacuugaugugcgucuucugggcugaguucaucuaggauggagccugguucuccagggugccuccgggagacuccucccugccccacgugcuugcgucacaggacccaagucugacucugccuuagccaugaaguuuagggggaaguuucuauuuguauucuauuuuugucuguuaucauguauuagcuuagacccaguuuaguuuggaaaaucaguggguuucaaaauguguuuguagaguccuuuauuucuuaacuugaccuuuucaaguggaaaggggcaaaacagacggguaagggggcggggcgggaggugugacuugcucuuuugugccugaggaaguaacagagcugggguugacagucauauucucugacacagauagucucugacuuaucucacagaaagucagcggcagagccugaguuaaaagucucguagauuuucuuuuucuuuuuuuugguggcuaauuucaguuuuauuuauauuuguuuauuuauuuauuauacuuuaaguucuggguuacaugugcagaaugugcaguuuuguuacauagguauacacgugccaugaugguuugcugcacccaucaacccaucaccuacauuagguauuucuccuaauguuaucccucccccaguccccucacuccccaugggccccggugugugauguucuccucccugugcccauguguucucauuguucaauuuccacuugugagugagaacaugcgguguuugguuuucugaucuugugauaguuugcugagaaugaugguuuccagcaucauccaugugccugcaaaggacaugaacucauccuuuuuuauggcuguauaguauuccaugguguauaugugccacauuuucuuaauccagucuaucauugauggacauucggguugguuccaagucuuugcuauugugacuagugccacaauaaacauacaugugcaugugucuuuaucguagaaugauuuauaauccuuuggguauaugcccaguaaugggauugcugggucaaaugguauuucuaguucuagaccuuugaggaaucgccagacugucuuccacaauaguugaacuaauuuacacucccaccaacaguguaaaaguguuccuauuuuuccacaaccucuccagcaucuguuguuucgugacuuuuuaacgaucgccauccuaacuggcgugagaugguaucucauugugauuuugaucugcauuucucuaaugaccaguggugaugagcauuuuuucguaugucuguuggcugcauaaaugucuucuuuugcgaagugucuguucauauccuuuguccauuuuuugaugggguuguuugcuuuuuuuucguaaauuuguuuaaguucuuuguagauucuggauguuaaucuuuugucagauggguagauugcaaaaauuuuaucccauucuguagguugccuguucacucugaugauaguuucuuuugcuaugcagaagcucuuuaguuuaauuagaucccguuugucaauuuuggcuuuuguugccauugcuuuugguguuuuagacaugaagucuuugccuaugccuauguccugaauguuauggcccagguuuucuucuaggauuuuuaugguccuaggucuuauguuuaagucuuugauccaucuugaguugauuuuuguguaagguauaaggaagggguccaguuucaguuuucugcauguggcuagccaguuuucccaacaccauuuauuaaauagggaaucuuuuccccauugcuuaugugugucagguuugucaaagaucagaugauuguagauguguggugguauuucugaggccucuguucuguuccauuggucuauauaucuguuuugguaccaguaccaugcaguuuugguuacuguaguguuguaguauaguuugaagucagguagugugaugccuccagcuuuguucuucuagcccaggauugucuuggcuaugcaggcucuuuuuugguuccauaugaaguuuaaaauaguuuuuuccaauucugugaagaaagucagugauagcuugauggggggauagcauugaaucuauaaauuacuuugggcagcaaggccauuuucacgauauugauucguccuauccaugaacauggaauguuuuucuauuuguuuguguccucucuuauuuccuugagcagugguuuguaguucuccuugaagagguccuucacaucccuuguaaguugucuuccuagguguuucauucccuuaguagcauuugugaaugggaguucacucaugauuuggcucucuguuugucuguuauugguguauaggaaugcuugugauuuuugcacauugauuuuguauccugagacuuugcugaaguugcuaaucagcuuaaggagauuuugagcugaaccaauaggguuuucuaaauauacaaucaugucaucugcaaacagggacaguuuuacuuccucucuuccuauuugaauacccuuuauugcuuucucuugccugauugcgcuggccagaacuuccaauacuauguugaauaggaguggugagagagggcauccuugucuugugccgguuuucgaagggaaugcuuccaguuuuugcccauucaguaugauauuagcuguggguuugucauaaauagcucuuacuauguugagauacguuccaucgauaccuaguuuauugagaguuuuuagcaugaaaggcuguugaauuuugucaaaggccuuuucugcaucuguugagauaaucauaugguuuuuguuguugguucuguuuaugugauggauuacguuuauugauuugcguauguugaaccagccuugcauuccagggaugaagcugacuugauugugguggauaagcuuuuugaugugcugcuggauucaguuugccaguauuuuauugaggauuuucacaucgauguucaucagggauauuggccuaaaauucucuuuuuuuguugugucucugccaggcuuugguaucaggaugaugcuggccucauaaaaugaguuagggaggauucucucuuuuucuauugauuggaauaguuucagaaggaaugguaccaucuccucuuuguaccucugguagaauucggcugugaauccauccuggacuuuuuuugguuaguaggcuauuaacuauugccucaaguuuagaaccuguuaucagucuauucagagauucagcuuuuuucugguuuagucuugggaggguguauguguccaggaauuuauccauuucuucuagauuuucuaguuuauuuggguagagauguuuauaguauucucugaugguaguuuguauuucugugggaucgguggugauauccccuuuaucguuuuuauugagucuauuugauucuucucucuuuucuucuuuauuagucuugcuagcggucuaccuauuuuauugaucuuuucaaaaaaccagcaccuggauucauugauuuuuuuuggaggguuuuuuuucgugucucuaucuccuucaguucugcucugaucuuaguuauuuuuugucuucugcuagcuuuugaauuuguuugcucuugcuuuucuaguucuuuuaauugugauguuaggguguuaauuuuagaucuuuucugcuuucucuugugggcauuuagugcuauaaauuucccucuacacacugcuuuaaaugugucccagagauucugguauguugugucuucguucucauugguuuccaagaaaauuuuuauuucugccuucauuucguuauuuacccaguagucauucaagagcagguuguucaguuuccauguaguugugugguuuugagugagauucucaauccugaguucuaauuugauugcacuguggucugacagacaguuuguugugauuucuguucuuuuacauuugcugaggaguguuuuacuuccaacuauguggucaguuuuagaauaagugcaauguggugcugagaagaauguauguucuguugauuuggggugcagaguucuguagaugucuauuagguccgcuugguccagugcugaguucaaguccuggauauccuuguuaauuuucuggcucauugaucugccuaauauugacagugggguguuaaagucucccacuauuaccgggugggagucucuuuguaggucucuaagaacuugcuucaugaaucugggugcuccuguauugggggcguguauauuuaggauaguuagcucuucuuguugaauugaucccuuuaccauuauguaauggccuucuuugucuccuuugaacuuuguugauuuaaagucuguuuuaucagagacuaggauugcaaucccugcuuuuuuuuugcuuuccauuugcuuguuagaucuuccuccaucccuuuauuuugagccaaugagugucuuugcaugugagaugggucuccugaauacagcacaccaaugggucuugacucuuuauccaauuugccagucugugucuuuuaauuggggcauuuagcccauuuacauuuaagguuaauauugcuaugugugaauuugauccugucauuaugauccuaguugguuauuuugcccguuaacugaugcaguuucuucauagcgucaguagucuuuacaauuuggcauguuuuugcaguggcugguacugguuguuccuuuccauguuuagugcuuccuucaggagcucuuguaaggcaggccugguggugacaaaaucucugcauuugcuugucuguaaaggauuuuauuucucguucacuuaugaagcuuaguuuggcuggauaugaaauucuggguugaaaauacuuuuuuuaaagaauguugaauauuggcucccacucuuuucuggcuuguaggauuucugcagagagaucugcuguuagucugaugggcuucccuuuguggguaacccgaccuuucucucuggcugcccuuuccuucauuucaaucuugguggaucugaugauuaugugucuugggguugcucuucucgaggaguaucuuugugguguucucuguauuuccugaauuugaauguuggucugccuugcuagguuggggaaguucuccuggauaauauccugaagaguguuuucuaacuugguucuauucuccccaucacuuucagguacaccaaucaaacguagauuuggucuuuucacauagucccauauuucuuggaggcuugguucauuucuuuucacucuuuuuucucuaaucuugucuucucgcuuuauuucauuaauuugaucuucaaucacugauauccuuucuucugcuugauugaaucggcugucgaagcuuguguauacuucacaaaauucucguucugugguuuuuagcuccaucaggucauuuaagcucuucucuacacugguuauucuagccauuagucuaacauuuuuuucaagguuuuuagcuuccuugugauggguuagaacaugcuccuuuagcucggagaaguuuguuauuaccgaccuucugaagccuacuucugucaauucaucaaacucauucuccauccaguuuuguucccuugcuggugaggaguugugauccuuuggaggagaagagguguucugguuuuuggaauuuucagccuuucugcuaugguuucuccccaucauugugguuuuaucuaccuuuggucuuugauguuggugaccuacggaugggguuuugguguggguguccuuuuuguugauguugaugcuauuccuuucuguuuguuaguuuuccuucuaacagacaggccccucagcugcaggucuguuggaguuugcuggagguccacuccaggcccuguuugccugggcaucaccagcagaggcugcagaacagcaaauauugcugccugauccuuccucuggaaacaucgucccagagcacgaaggugucugccuguaugagguguuuguuggccccuacugggaggugucucccagucaggcuacaugggggucagggacccacuugaggcagucuguucauuaucggagcuugaaugccguaccgggagaaccacugcucucuucagagcugucaggcacguauguuuaaaucuggagaagcugucugcugccuuuuguucagaugugcccuucccccagagguggaaucuagagaggcaguaggccuugcugagcugcagugggcucugcccaguucgagcuucccugcugcuuuguuuacacugugagcauagaaccaccuacucuagccucagcagugguggacaccccucccccagccaagcuccugcaucccaggucgauuucagagugcugcgcuagcagugagcaaggccccaugggcgugggacccgcugagccaggcacaggagagaaucuccuggucugcugguugugaagacugugggaaaagugcaguauuugggcaggaguguacugcuccuucagguacagucacucauggcuuccuuuggcuuggaaagggaagucccccgaccccuugugcuucccaggugaggcaacaccccgcccugcuucggcuugcccuccgugggcugcacccacuguccagcaagucccagugagaugaacuagguaccucaguuggaaaugcagaaaucaccugucuucugugucgaucucacugggagcuguagacuggagcuguuccuauucggccauuuuggaagcaucccuuguuuuuugagguggagucuugcucugucgcccaggcugacgugcaucggcacaaucucggcccacugcaaccuuugccuccugguuucaagcgauucuccuaccucagccuccggaguagcugggauuacaggcaccugccaccaugccuggcuaauuuuuuguauuuuuaguggagaugggguuucaccacauuggccaggcuagucucgaacuccugaccuugugauccacccaccucagccuccuagagugcugggaucacaggugucagccaccacgcccagccauauuuucagaucucccucucuuugcccuaaaccacugugcuuaauaaguaguuuuuaguggccagcagucuccauguauaacacauuuuagcaaaauggaaaauacuauauguuuuaaauuugaacgugagauuauacugaaauaaaaaucaucuaacugggauucuuuaaauaguaagauuuucuuuuuuguauguggguuuuuuuuuaaccuuauuauuaugacugucauauauagaaauggcuguuuuucaguuacagucagugaauguaucaaaugcugccuuauccaaauaauaaaaguaaauuauuaauaagucacaauuuaaugaagauugauguuaguugaucuuuauauucuugaaaucagccauaugguuguguguguauguauauauuuuuaaagguacauaaagauaauaagcucaucucugaaaauuuuuacauuuggcauaagaauaacuggauaauuaagcaucuuauucucuggccugugucuuuacaguuaaagguagauuuacucaccucuccuuuuuuguuuuucuaaguucaucuuuuuugcuguuucaagacagaggcccauuuuagcuuucucgcauauccuuuuguuuguacuuuggaagccucaccugcuuaauuguugaguuuuuauccguggucuuuuagagggggauauguaggguagaagcuuucacagguucuuguuugcacuuggccccugacuguuuugaggaaucucccucacugacucacagcauggcaagguuucagaucucuuucugccacacagcaguucugaggcagcuggaaagauauccagaugcuuagauugucaggccaggcuugagauauacaaacuauugagccuuaucugugaccuugcuuaggugaaggcaucagagccccugcaccaacaugcauaggccucugcaugugugcggggcuggguguugaggucugagcacaaguguagcuggagaggugagcuugauguggcgacggguaugagcagguuuucuucagacuucugugaguuuaccuaguuccaggauuuaaaggcacagagacuuuagaauuaaaauagaaucauuuucuuuuucuaaauagcaacacuaggaauaaaaaauaauaauuccacauucuugacagguaauguuuuuucuugucuucuaauccuuauuuauuccauacucauuuuuauacauaauugaaauguauuaugcauuggauuuuucuuuugcauuauauuauagacgauuuuucauguaacuccuuacuguuccauuuuauauguuuugucugguuuaagacuuuaucugcaaaccgggaaacugucucuacaaaaagaaaaacaaaaauaguuggccgcaguggcaugcgucuguggucccagcuacucggggcugaggugggaggauugcuugagccuugggagguugaggcugcaaagagccaugaucaugccauugcacuccagcaugggugacagacuuuauacugucuguuuugggugauuugauaaugauaugcccugauguaguuuuuuuauaucuuguguuucuugugccuggguuuauugagguugggucuguggcuucauaguauuuuuaaaguuuggaaaauuuuaggccauucuuucuuucuuucuuucuuuuuuuuuuuuuugagacagugucucgcucugucgccugcguuggagugcagugacacuaucuuggcucacugcaagcucugccuccuggguucacgccauucuccugccucagccuccugaguagcugggacuacaggcgccugccaccacgccuggcuaauuuuuuguauuuuuaguagagacgagguuucacuguguuagccaggauggucucaaucuccugaccucgugaucugcccgccugggccucccaaagugcugggauuacaggcgugagccacugcacccagcuaggccauuauuucuucaaagauuuuuuuucugcccugccucccuccuuuuuucccucucuuaaaggggcugugauuuccugaaugauugcuuaguguugucccauagcuuacugaugcucuuuucaguguuugauuguuuuauguguuuucuguuuuguauaguuucuauuauuguguuuucaaguucucugaucuuuucuucuacagugucuacucuguuguuaaucuguuaaucuguuguuaauccuguccagcguauuuuuuuuuuuguuuuugaaacagucucacucuguugcccaggcuggaguuuaguggugcgauaucagcucacugcaaccuccaccucccaggcucaagcaauucuucugccucagccucccgaguagcugggacuauaggcacgugccaccacaccuggcuaauuuguguauuuuuauuagagaugggguuucaccauguuggccaaacuggccuugaacuccugaccucaggugauucauccgccucggucucccaaaguguugggauuauaggcaugagccaccgugucuggccccuguucaguguauaucacuaauuuuguuuuuaucucuagaaguuugauuuaggucuuuuaaaaaugucucccuguguuucuguuuagcuuugugaacacaauuguaauaacuguuuuaauauccuucucugcuaguucuaagaucuucuaauaacuucccaguucuugguguuucucauugguugauugauacuccucguuuuggguuguauuuuccugccucuuuguauggcugccaauuuuuuauuggaugcccaaccuugugaauuuuacuuuguuggaugcuauauauuuuuguguucccauagaucuucuugagcuuuguucugagguuaguugaguuacauauagaugguuuacucuuuugggucuugcuuuauaauuugucagauggguuggagcagugcuuaguuuaggacuaauuuuuuuuuuggacuaauuauuccucuuuaggaauaauuagguaccaugcuuaggaggcaagaccauccugaguacucuaccuaaugaaccagaaaguuuggguuuuccaguccgccugcugagaacagugacuuucuagcccugugugagcgcugagcucugcuccuucuaauccuuuccaaugcuucuuucccuggccucagggaguuuucucacacacauaucucugcugaguacucgagagggaccuuccccagaucuccagagcucucucugucuuguuuucucuucucuggugcucugucuuaugaacuguggcugucuuggucuccuuagauucucagcaccucuucaauucagaggguugccugucccuccuccuugugccacagccuaggaacucucucaaagcagcgaguuggggcagccauagggcugacuuagucucucgucucccagggaucacuguccuucauugcucauguccagugucuugaggacucuggguuuugucuguuuuguuuuuugguuugcuuugguugucucaggcaggaggguaaacccagucccucacccucauugugcucaguaguggaagucucacucuauuacauuagauauuaguauuuguagcagagcccugguucccugguacuuggggagcucuugaaaggccagaaacagcaugcuuucucaccuuuuccagggcuucaguuucuggugcacaucaagcauuccauacacauuuguuaaaguccuuuguuagacaaguagugauucacagguucuauuuguaauuuuuucaguuaacauguauuggguaucugcugggagcuaguaaaaacaaaaaguggugugugacaaauucaauucugacaagaacaaccuuaaacacuuagaauauacuuugagcauaucagaauuuuaaaaauguguggcccuugaguauuugaaaccaacaagaaucuauugcuuauuaguagaggauauuuuguuaaacaaguggagagagaggcauuuucagucuaauugguguuggcuuuuagcagcugauggaaaccaguucgugauuagccaggcaguggugaaacaggcugugcauucugaaugccuagguaucuaggcauucagaaugguggcgcucuuugaguuagcaucuucuucuuucuugauucuuuuuuuuuuuuuuuugagauggacuuucgcucuuguugcccagguaacaacuccagugcaauggcgccaucucggcucacuguaaccucugccucccugguucaagcgauucuccugccucagccucucaaguagcugggauuacaggugugcgccaccacgccuggcuaauuuuguauuuuugguagagaugggguuucacuauauuggucaggcuggucuugaacuccugaccucaagugaugcaccugccucgaucucccaaaaugcugggauuacaggcgugagccaccacucccagccccuucuugauucuugaaaaggacauugggugcuguacaucucguuauagauguugauaaaaaugcuugugagaagaguaacauuaagguaguuauuuggucauuuuugcagauuauuuuaagacaauucuaggacugauuugugguaaaucacacauugcuguaucauaguuguguucacugaacauauucaggggcucuacagaugcagggcucuuagcugcuuugcacacuucugaauuccugcccugcgaacaggacuggauaccuaauagacaacagguacuugauaacaguuuauugaauuaaugagugaaugaacagauacauaaaugcaugaaagaaugguuguaauguauauaacuuggauuucaagacuuuuuacugacuguucaaaauaagaaauugaaaacuuuccucugauuuuccucuacuauuuacacaauuuaaauggaaguuaucuuguaccuucaauuucugucuaggauucguacaauaacgggucaucucugagucgcuuaaugucucacuugucuuucuacaguguguugaagagauccuaggauaccugaaauccugcuuuagucgagaaccaaugauggcaacuguuuguguucaacaaguaagagcuucauucuuuuccucuucuguuaagacguucggguaugacagcaaaacgcugcuacuccuuaagaggcaggcgcuguuggcauaaucagcugggaggauugugggguccagcgcagcacuuuuuggcucaguccaugauugagccaagaggccauccuucccuucacuccccaggaggacgaggucugucacuguggagggcagaggacaccagaagcuccucugcaaccucgcuaguuaacuuccagucccucggaguuucuguuuagaaugcucaaucucauuuagaauugcaaggaaacccaaaacgccuauuuaagguacaaacagcacuucauacaauaucucaugagguauuaauagugauucacaggaagaauuucacgcugugagucuuugcuaacauauccaguuauuuacagauggauuugauauuugugugggagauucuuaaaaguguuguucacgccacauuguugaugccucauuuuuuucacuguaguuguugaagacucucuuuggcacaaacuuggccucccaguuugauggcuuaucuuccaaccccagcaagucacaaggccgagcacagcgccuuggcuccuccagugugaggccaggcuuguaccacuacugcuucauggccccguacacccacuucacccaggcccucgcugacgccagccugaggaacauggugcaggcggagcaggagaacgacaccucgggguaacaguuguggcaagaaugcugucguugguggaagcacgaaagagcaagcaggaaauacuuuguaaaagaauaaaaacgaaaaauguuagcgaacaucuucuaauagucugcuguauucagagaacucuaggagauauauaugguugaugcaaagaugauuuaaggcauagcccggccuuccaagaaguguguggccagugagugagaugggcuugggacuuacacaucucagagguggggguagaggaggaggaacacugagugggcugagaagcagccagcucucauugccaaagugugucagcaaaccagaaugcaguucauaauguccccacccauucaaagcacaggaccuguagagugguguggcauguguugguggcacuuuucaggccuguaacaaggaugaaagaacagcuucauagcagcacaguagugcugguguucagaggugugugaaggccauagaagcaucuuggauauauuaccuuguguuuugucagcuuuaugacuagaagucucuuuucacuuaaauuuguuuuuuuuuuuuuugagacggagucuugcucugucgcccaggcuggagugcaguggugcaaucucagcucacugcaagcucugcauccuggguucaugccauucuccugccucagccucccgaguagcugggacuacaggcgccugccaucacgccuggcuaacuuuuuuuuguauuuuuaguagagacgggguuucaccauguuagccaggauggucucgaucuccugaccucgugaucugcccgucccggccucccaaagugcugggauuacaggcgugagccaccgcgcccggccucuuuucacuuaaauuuauguuuguguuuuuaaugccuaguauacaggacuucuuaaauugccuuaaguaugaacagguauuugaguugcuaaucuguauaguagcaauaauagaaucccuuguuuuuccuuuuauaaauuuagcgauuaaauagcuacaauuaaaacacuagagucaggagucaaggaaaauacccauguuccaggcuguauguuagugauguacuuacuauauauuggaguuucaggaguaagucuguuucaaugcuuucuguaaccauuugggguauuaauaagcaugugagugugugcauguuuggguuaauuucauauauguuucuuagaagggauaucauugauguaaauauuuuaaaggcuuguccuccaaaaaaaucauguaauuucuucuaaauuacugaucuuuuaaaugaccuucaccuuucucucaaaucucacuuaagacugggcugaguagucaguuuccuguagcagaaaaaagcucagacuugaguagccuucugcgagugaggagacuugauggcugucaggcagcuguaaacucuaaauagagugucauuaucugaagagggcgaugcugccacacugaguggccuuucaaguuguuucucaaucugacacguucugaucgugugaaugugaaauugguuugagcaggaguauaucugagugcagaggagauuauuuaaagauauucucauucucugcuucccuuuuauucccauuuggcagaugguuugauguccuccagaaagugucuacccaguugaagacaaaccucacgagugucacaaagaaccgugcagauaagguaaauggugccguuuguggcaugugaacucaggcgugucagugcuagagaggaaacuggagcugagacuuuccagguauuuugcuugaagcuuuuaguugaaggcuuacuuauggauucuuucuuucuuuuuuucuuuuuuauagaaugcuauucauaaucacauucguuuguuugaaccucuuguuauaaaagcuuuaaaacaguacacgacuacaacaugugugcaguuacagaagcagguuuuagauuugcuggcgcagcugguucaguuacggguuaauuacugucuucuggauucagaucagguuugucacuuuuaucuuucauccaucauaccuguuccuaauuuaguacaaauuacccuaaaagacacugaaaucuacuuuaaagaaauguggucugcauguuucccucaucaguugcugcugcuuaucuuuuucaugcaccuagcuggugcagaaggccuggggcauagccagccucagcaagucagcauccuugccccagcucccuggacucaaggcuaaccugggguuggcuguuagggauuuccaaagguuugucccauccacuugccuccccuccaaaauaaguuugaauuuaaauugugagauacaauuaagauuuauuguuuggggaacauuuuugcaaaaucuagaguuaguuuaaacagauuaucaauuauuaccauaauugaucaucugcaguuucaagcuaucuaacagguucacuuaccucuuuaaaaaggaauggaauuuagcaggacaguaacugagacccgugcuccuggaguccaugugggagcuguguggcucugcacaagcauuugcacgcuuccccucuugacugcauuaccuuccuccuauaguugcugugggcaccagauucuggcuaguccugucccuucaugaugcacauuuuccucaagauucgucccaguuaaaucacugcagaugaaacugccuuuucaucgucaaaauuuaacugucauuuuugagccgugaucuugggcuacuuucuuaugugggguaggaauauuugugaguuagaaauauuacacuucucuauuuccuucuagacguaaaucuguuaauccugucagcacuguuacucaccugaaagggucuguuucccuaggagaacugagggcacucggucaacacugauuuuccacaguggguauuggggugguaucugcuuguuuuuuuuguuguuguuguuuguuuuuuuuuguuuuuuuuuugagauggagucucgcucugucacccaggcuggagugcaggggugcgaucucggcucacugccagcuccgccucagagguucacgccauucuccugccucagccucccgaguagcugggacuacaggcacccaccacuacgccaggcuaauuuuuuguauuuuuaguagagacgagguuucacuguguuagccaggauggucuccaucuccugaccucgugaucugcccgccucggccucccaaagugcugggaugacaggcgugagccaccgcgcccggccuggggucugcuuuuaaugaaggaggcaucaaggggugggcuuugcguuggccugaugcuuucaucuuucuuucacaaaaccuguccgaagaaaauccgucuaaaugggccauugcucuccucaggaaauagucauugggaacuucuuuuccuuuccuuugacacuaggaggcugacuggggagaagcccuggucuauggcugugggcagcaggggcugagaggagcaggcucucaggggggcacggguaccccaagggaagccagagcccugauuuguuccauucuaguaagaacaaagacugcucugguuucauguuuguucugauugccuuucaucaaccgguccccuuucucccaguucuuaagauucaguacagugacaguuuuaugaacaagaauagaacacuagaacagacaaaccauugaacucuaugcugauaaagauuuauugagcuccugcuguauguuugcauucugcccagaggcucugagaaaaccaggccauaugcuccaugcuuuauccauggaagcuccccgucagguugggaaagcugacagcugcagggaauacagugugacacaaaacuggcucccaugcagcccuuacgugucgccucucagaugguugggggacgaaggucgacuccuuuggguaucuuauuacuaaaccaguuucagggaaucugugccacccuaucugccauuaacgugaacagaugaguccccaagguguaauuuuggguauugucugaugucucuuggaauuuauuauuuguuuuuccaaugagauuucaccucaggguauaguaaaguuguugaggggauuccuggauguguucugcaauuaucuaggcugauuucagaauagaguuaugcuuauagucaaauuuaucagcugucaagaauuuuauuuaaaauuuaugcagauaagcaggaggaaaagaagccugguuuuuacauuuuaauccuauuauugaugugaaauuuuauuuuccuuccuguagguguuuauuggcuuuguauugaaacaguuugaauacauugaagugggccaguucagguaauagcauuuuauuauuuuagauuuuuuucuucuucuuguguacuuacauguaauuuagguuauuaagugaauguuuaaacuacuguuaggcauuuuugcuguuuucuuuaaauggaaaucugacuaacauacugugcauuuuugcuucucuuaaaaauuaauguauaucucaagacuuguuuggaaguaguuauguaucugaaaauuccauauguugucaguauucauugcacauuucaaagcauuuaauuguguugacagaugguggaaugaaaucuugugguggagcacuaguuuuuaaaucuucuuagagaaagcaguuuuauauaauguugucuuuaguaauuauuaugcauuuguauucucugcagcuuuuucuugcuagauguugagguuuuaauacuucuugcuaguccauuacagguuuauaauuauuaaaaguuaaaauucuuuuaguaccuaaaaugcuuaauaaacauuguaauuaggaaaauuuagugcagaaggaaaguguucccagauucccuggggucuggaaacauaguguuuauucuaauuacaugacaccuccacuguguuuuggggcaaguuacuguuucucuuuugaguuucaauuucuucaagagcaaagaggcagaggagagcuaggaagaucguagcugcugugccccugugccgucgggugccuucuaccugcugccuccgaaccuuuacacaugucccugcucugcgcgagggcacagaugggaugcacuguggcaggggugggguuagaguagaucacggacaccuguuagcuugaugugugcuugcugucaagguugaaucaugaauuauuuuauguugcuuauauugauauguaucuuaauuuuaaaagaaaggucuaaauggauguuuuuguuuuuagggaaucagaggcaaucauuccaaacaucuuuuucuucuugguauuacuaucuuaugaacgcuaucauucaaaacagaucauuggaauuccuaaaaucauucagcucugugauggcaucauggccaguggaaggaaggcugugacacaugguaacgggacacaccuuucacugucgucuucggugucgugaugugcuuggcaguguucguuuucauauacccacuuugaacguugucaguggcagccaugugcuucucaggcucugcaugugugucuguguaugugaagguacugguuagagacguuucaaaagagaagagagcauauucuuuacucucagcaauuuguaaucuucucagggaaaaaaauucaagaaacaguaagauaaccuaagguacagauagauucugaauauaaaguuccuguucauucacaugaaacgcuaaaaguucuucacuugaucuuagccaaaaggccaagaagcgaugcaacacuaaaaauucuuaaaucgaacuugccgugaauuaaauuuugaucucucauccagugguauuggagauauaguuugacuuggguucagggcuuucuguuuugccugaugauuuugcuggagcuuaaauaaggaacccaggagauggccagcugugcaagcccccagccuguggaaggagcuagugugguuuuaugaaugaguugcaaaucuuucuuugagcuuuuugaacugaucuuccagcauugcccuauugaccccucccugacuccuuugcuggaaucuguaggcuuuugaacuuugacagggacacauccuaagacccuugcaaacucccagaugugagaauggcacuacuacuuagagucuuuucgacucagcgugugugcagaagagcaucaaccgggcuguguugcgaggcagggccuuggcugaccucucaguguuuacauagcuaagccaguuaguguuugccacggccucacaagggcuucagauucacacagccaaaguauagauuauuaaaggcauagguguuugguuuccuggacuuggagggucuuuggacagaaaaucaguaggcaaccacacccaguacuuugugcugggaagcuuggucaucugugagagggucagagaguauacccaugcgugcaugccaccgaagggucagugaguauuccugugugugcaugucucagggccggagagaguaugugucacugagaggucagaguguuugugugugugucaaagaggguugcauugugcccuucacugaggggucagagggugccucgcguguguguguguguacgugugugugugucacugaggggucagagugugccugugugugugcuugugugugcguacaugucacugaggggucagagugugccucugugugugugcucaugugugugcauacgugucacugaggggucagagugugccucugugugugcucauuugugagcguaugugucacugagggggucagagugugccucugugugugugcucaugugugagcguaugugucacugagggggucagagugugccucugugugugugcucaugugugagcguaugugucacugaggggucaguguuccuaugugcucaugacauugagggucagagugugccugugugccaaugaaaggcauuucuuauauuuuuuuauauguggucauaguagaccaguuaauuuauuuugacuccuguguuagaccaaaauaagacuugggggaaagucccuuaucuaucuaaugacagagugaguuuacuuaaaaaagcauaauaauccaguggcuuugacuaaauguauuauguggaagucuuuauugucuuuucagaugaaucaaguagauuauucuugagaccaggaauguugcuguuuugguuauuuggaaaguuuuaucauuuucaaauugacuuuugaauuugagucaccuuuuuucagaagugguguuaaauuauaggagcccuagguuuuuuuucuuuuuuuagaagucaucacaaaaugaucaguguucagaggaagagcuuugaccuuccacaugguauaaugauugauaaccuuaauucaucucuuaccauaaaccaaguauguguaaggguuuucuuuauuucuugaaagcauuuuguagauguugagagcaguuuuccaaauguaauuuccaugaaaugccugauaaggguacccuuuuguccccacagccauaccggcucugcagcccauaguccacgaccucuuuguauuaagaggaacaaauaaagcugaugcaggaaaagagcuugaaacccaaaaagaggugguggugucaauguuacugagacucauccaguaccaucagguaagaggaauguauguuggaacugucguggauacuuuauugacccgugcagauggaaggaagugccaugugguaacgcucacuguuaacuguguuacuuugaaccagguuugggcuuucuggggccuggguagaugccggugcagggggauggggagggaggcggggggugggggggugugguggaguuggggaggugcaguggcaggagguguuguugguguguauccuuuuuuuuuuuuugagauggagucucucuccgucgcccaggcuggagugugguggcacgaucuuggcucauugcaagcuccaccucccggguuuaagcaauucuccugccuccaccucccgaguagcugggauuacaggcaugcaccaccaugcccagcaaauuuuuuuuuuuguauuuuuaguagagaugggguuucaccaugauggccaagcuguuucgaacuccugaccucaagugauccuccugccuuggccucccaaagugcuaggauuacaggcgugagccaccaugcccagccugguguuuaucuuuaaagugggcacagccacaggaguucaccugacuccuggucugagagucacgagaucguucaagauagugaggcccucuuuuccaaaacgaggaccaaaaaucaauugacaguguuggucaagaugguagaaaccuuaaaaugauagaaaucucaacucugaaauaaaaacuuuauuuguauauuuauuuaccacuauuuugacauagggcuaaggucuuuuucuuugagcugauuucugguuuuguuuucuuaaaguggcauaagaauucaaagacauuuugaggaaggcugagugcagaaaucucucuuuuuaaaugacuucuccuuucuuuuaacuugcacuguugucuagcccucacuuauuuugucaauucuuuuuagcuguuugucuuugaaucuucauaaagccauagcuuuucucauaagaagcagcacuuucuuuguucauucauauuuuaaugaaccccuguaguauuuaauuaaauacuuaaugccuaauuaaaucacauaauugcaaugcaaaaguacauguaucauaaagaggucugaaaaugagcaacuggcaagcaggugguggcaggcagagcugcuugggugggugggugucauggagaggaguucaucagccacauguucagugagcucuggauaugucuguuuagaaaugaucacuaauaaacuugugcucaaccauguauaccucugggaagcaggugcucuucaguagauugccucugcagagaacacagaauugaagugaauguccacaaaggcaaugagccaccugcagaauaguuuagucaaggcuguguuugaaguuugccaaagauuaauauacauuugauuuucauguugugccuuuucucugauugugaaauauuacaaauucuauacaaauaacaaugauggcaaauccuccugagcaaagugugcaccuuguaugugcccuagaggaacuuguguuucguucugauuccccuacauuucucaugucauagaguggggguugcauuagugucccccuguccucgcugggaucacaucuguuuggauccuagagucuuccagcugaacugggacaaguauaacagacggacacguagggguggaaaggcgucucuuggcagcagacuuucuaauugugcacgcucuuauagguguuggagauguucauucuuguccugcagcagugccacaaggagaaugaagacaaguggaagcgacugucucgacagauagcugacaucauccucccaauguuagccaaacagcagguuuguccccgcagccuuggcuuguuguugcauagugaugguagcuuaagguccuugugaaagguggguggcuggaaucagcucuuccuucaguccuaaucugugccuugauagcaguucuccgugcuagucaugggacagcugacuucauuucuucucacaaugccaucucagguugguauugcccaccuacuuuacaggggggaucccacagcuccgagagguuauggaggugaucaggcagcacacagcuuuagagugcuggggugagggcgggccaaggcuaacucuaaagcccgaacccuuaccuccuacacugccuccugcauucuggucaacccaguguuuuauuuggugguuagauuuuuguuuuuguuaccuuacugcuuguaauuuagcaguuuuccuuuccuuucccuuccuuuccuuuccgacagggucucacucugucacccaggcuagagugcagucguguaaucucacugcaacaaccucugccucccagguucaaccaauucucccaccucagccuccugaguagcaaggaccacaggugugcaccacuacgccuggcuaguuuuuuguauuuuuaguagagaugaggucucgcuguguugcccaggcugguuuuaaacuccugggcgcaagugauccaccaaccuuggccugccaaagugcuggcauuacaggugugagccaccucgccuggccuauucaucacuaaucagaauuucuaugaucaaaugacaugaaucauuguuuccacaacugcaguggaaggaaauggccuggcagugccaguuucagaagcagccugcccccagucaggcacaggccacugugcccccaguguagcagcaccucuguagcucacagagaagggugguggggaccuccuugaggcagcucugccagaaaaucucaugagcugccuggcacagcuugagguugccuuuuaaguggacucagcaaauacauguuuguucaucuugauuauacacaauaaacaacuacucuguauaguacgaguaguccgugguuuuuggcauuugauuuaaacuuagaggcaugugauauugauguuacugccuucaugacugcacccccauucugauuucauaauggaauguuaucuugagaccaguuagacaacaggacagggaucuuggcuucuggugagauugacagcaguuuuaguguggucagggucucccugccuacagaugguuuuagaauggugcccuggaagcuuuaucccauucuuuucugugcguaaucugaguagaguggagaucgaaggccugaauacauaguaaauaccugacuuaauaucugccgcaauggaaauugugugauacaacauuuaugaaacgcuuagugcagcaccugccagguagcucaccacaggugcauguugcauucagaaguagugcuagauacuauccuguuacuggcagugcauacaucagugaucaaagcagauuaaagaaagacccccugccuucuuggagugaagauuuuguugggaugcggguaaggggacagacaauagaaaagcaagugagugaagucuauaccauggcggcugaucaggaacaccguacagaagaauccaggagggaagagaguuagguggugucugcggugggaguggcauuguucagcuggugaugagaagaagcuuuggugaucuggugacauuugagugaauuugcagaaaggaaagauacaagccuaggagauaccuggggaaggaacauuccaggcagagcaaauagcagugcaaaggcccuggcggggggcggacaugcuguuaggguacaagcaaugaggguggaggaguggggcagccauggggagggaagggagugaggccugguggggugaggccaguguggaggagccuugagaggguuugcgcugaugugguguagguuuuagcaggaucauucuuauuccugaguugagaauagccuugagggggaggugagggcagagcagggccacccaugugagacccggcacuggaguggaauggcccaagucagcaucccuuggcagcaugaaagcaaaaccagcaagguuugcugguggcuuagauguggcaugugagagagagcagggcuuugggggugauuucagggugaggacaggguggcuguggacaagguagggcagacauugggggcagcaggaggucagagccugucuggauguagcaguugagaccccauaggugccuaaugaggugaggccagcaucagguguaugagccuggaguugucgagagacuguggggcagggggucagcaucugagauguccacucacaguggacccagacuggcuggagaggaggaggagcuugaauaccgagccugcugagucccagcuccaaggucagguaggugaggggagccagugcuggggcagggggaguaggcaggugugggguuccuaaagccaagauuuuuuuuaaggcauuuugugcaggagggcgacaucugcugucagcaccuugggaacuuggcccagguuuggcagcaccgagggcacugaugagugcuuuuggaggagcaaagggagccaaacccuaaugggaauguguuccugaaaggacaggagagagacuugggaaaagguuuuacuugaagagggaacggagaaauagggcaguagccagaggaggagaggagucggcaauggguuaaguuggcagaaaugaaggccuguuuacgcacugagggcagaagcaacagggaggaucaguucaugacacaggagacacaaaucgccguugugguguucacagacauggguuaggauuggcugcauggaugacagagcacuguggguucucccagaguugcuggggaggaggcagaguuggugagcacaggcgaggguccaggaugcaggaauccuggagcucaagucaguuguucccuuguuguaagauguggccaguguugugagcuucacaucugugccuugaaaaacaccacaucuguuugcagaguuguuuacuauguauacacacucaguagaaacaaaaauuggaaacagucagugcccaccaucaauaaguaaugguugaacacacugugguauaagcuuagacuauuuuagcuugggcuauuuugcaugauuaaaaauguucuggccaggugugguggcucaugccuguaaucccagcacuuugggaggccaaggcaggcagauugcuugagcucaggaguuugagaccagccugggcaacauggugaaacccugucucuacuagaaauacaaaaaguagcugggugugguggugugcgccuguaguccuggcuaacucaggaggcugaggugggaggaucacuugagcccauucgugcgccacugcacuccuggggcacagagugagacucuguuagaaagagagagagagaaagaagagagagggagggaggaaggaaggaaggaaauaaauggaagaaauggaagggaggaaggggagggaggaaggaagaaaggaaguucagccaguugccuugggaguucuccauugcacuggguuaagugagaagagcagagacguuuaugauuuuucaaaacaacuaaaacaaaaccucugugggugagggggcaaggauauggcuauaggaacauggggcagauuaagaaagggauauacacacaccacuuagcauuuguuacaacuguugugggagggauggagugcagaaaaagaaaaaaaaaagugcacaccaucccauguauguguauacaaagggacgcuuggaagacugguccccaaaauguugguaaugauugugucagggugcugcagugcuaguugauuuuuuuucacacuuuuguauauuugagucuuuuacagaaagcauuuauuauuuauguaauaaaaaucuaaaugacaagauuucuguuaugggaaaaauguagcuauacaguguuguuguaaaaauguuugcuugguucaccacugaacuuaaaaugcuuuuaaaugagggaaggugacgaugagaugauuaugaugauuugcccuugaguuacauagcugguguacaggaagcugucguuucuuuuggcuuacguagaaauguuuguggugucuaauuccacagaugcacauugacucucaugaagcccuuggaguguuaaauacauuauuugagauuuuggccccuuccucccuccguccgguagacaugcuuuuacggaguauguucgucacuccaaacacaauggugagucucucgccuggcucagcagaugaaucuggacggcuuguucaggcucugauuacugggaccacccccagaaugucugagucagucaguuuggguagggcuucuugagaguuugcuuuuuuuuuuuuuuuuuuuuuugguguggggguggugcggaacagagucucacucugucgcccaggcuggaguacagugucaugaucucggcucacugcaagcucugccuuccagcuucacaccauucuccugccucagccucccgaguugcugggacuacaagcgcccaccaccacgcccggcuaauuuuuuuguauuuuuaguagagaugggguuucaccguguuagccaggauggucuugaucuccugaccucgugacccgcccaucucagccucccaaagugcugggauuacaggcgugagccaccgcacccggccuuuuuauuuuuuuuggagauggagccuugcucugucacccaggcuggaguacaguggcgcuaccucgacucacugcaaccuccgccucccggguucaagcaauuuuccugccucagccucccgaguagcugggacuacaggugcgugccacugugcccggcuaauuuuuuguauuuuuaguagagacgggguuucacuguguuagccaggauggucgcgaucuccugaccuugugauccgcccgccucggccucccaaaguguugggauuacagguggcucucgcaccaagccaagaguuugcauuuuuagcaaauucccaggugaaacuaaugccugcuuuucugggagcacacuuugggacucagugauagagagguuuauugguaggauaguaaaauaggaguuauuuucuuucacaaaauuggcaauugggggaaauuuaaucuuccuuuuuucuucagcugugacuuauguauuauguuuauuuuaggcguccgugagcacuguucaacuguggauaucgggaauucuggccauuuugaggguucugauuucccagucaacugaagauauuguucuuucucguauucaggagcucuccuucucuccguauuuaaucuccuguacaguaauuaauagguuaagagauggggacaguacuucaacgcuagaagaacacagugaagggaaacaaauaaagaauuugccagaagaaacauuuucaagguaugcuuucuaucugagccuauaacuaacccaugccuuuugggaagucacgugauguuucacagucaguaagucuggaauaauaccuggucuugcuucacuucugaguuggguaaagaagucuguaucaguguaauuuucuaauccguccugcauuaucuauggcucuugguucauaccugucuugaaguucugucauguucugucucuuguccucaguagagaugcuacagcaguggcucgccucaggcagggcagggcagugggguggcuguccugggggcaggcaguaggggcacgcugacgucagggaaguugaaacccaagagaagccaguaaaagugagucucagauugucaccaugugcuggcaguuuuacacgcugucaguaauaaaagucuucucccugcagggcagccugccuccaauaaauacguguaguaucaaauccugucuucccucauaaauuguuuggaagcuccccaaggacagugaugaggcacucguaagugcuugcugccuagaugggucccucuccaccuuugcuagauucugagcauucacugaguuagagcugcuucugcaaaugugcugcuucugcuaaguggcugugacuucaugcagccuucacuugguuugucaucaguggagaugcccuguguugucgaaggagauaagcccaguaagccugcugggcaccuuuugguuugcagguucagcaggcagcccauggcuuucccugugucgcauugaagcagcuggcuaaaauugaugauacauuaaauuccugugacagaugaucagcuuguauuuguguaaugguguacaguucacaaagcuuaaaaaaaugcuaccugccauuucauccucagugaggaaggugauacacagagagaccaagugacuguguccacggcgacggcgcucugcauuucacuuuagcgguuaauguacucuaccuauauuuuuacuuuauauuuaccauauaucuuuucauguauacuuggcguaagugcuuuauaguagucaccuaauucacugucaucuuuuuuguuucuuggaagguuucuauuacaacugguugguauucuuuuagaagacauuguuacaaaacagcugaagguggaaaugagugagcagcaacauacuuucuauugccaggaacuaggcacacugcuaaugugucugauccacaucuucaagucugguaggugaaucacauuagucuuccuggagugucucguuccccauucugcacuauacacucucagaguguaggagcugugcugcccgguagaaacucugccuugcccagugugccaguugaaaauauuuguugcuguaagaguacaccugauaccaugugacccagcaguuccacucuuggguauauacccaaaagaauggaaagcaggguggugaaaagauauuugcaugccagcauucauagcagcauuauucacgauagcuaaaauguggaaccaacugaagugucccucgauggaugaauggauaagcaaaaucugguguauauuuacaguggaauauuauucagccuuaaaaaaaggacauucugacacaugcuacaacaugggugacccuuaaggacauuaugcuaaaugaaauaagccagucacaaaaggacaaauacuaugugauuccacuuacaugagggaccuggaguaguuaauucauagauauagaaaguagaauggugguugccaggggcugcaggggaggggaguuauuuuuacaagaugaagagaguuauucuagaaaugaaugguggugaugguuguauaacauuaugaauguacuuaaugcuacugaacuguacaguuaaaaauaguuaagaggaccaggugucauggcucaugccugaaauccaagcacuuugagaggccaaggcaggaggauugcuugagccaaggaguuugagaccagccucagcaacaugguaggaccccaucuguacaaacaaacuagccggggauaguggugugcauguggucccagcuacucaggagacugaggcuggaggaucgcuugagcccaggagguuaagucucuagugagauguguucaugccacugcacuccagccucggcuauagaguaagacccugccucaaaaaaacaaaacaaaacaagacaagagccaaaaaugguuaagaugggccaaucacaguggcuuaugccuguaaucccaacacuuugggaggucaagguaaaaggaucacuugaagccaggagcuugggaccagccugagcaacauaucgagaccccuaucucuacaaagaaaaucaaaaacuagcuagauauggugggcacaugccuguagucccagcuacuugggaggcugaggugggaggaucucuugagcucaggaguucgaggcugcagggagcuauuauugcacuccagccugggcuacagaaugauacccugccucuuauuaaaaaaaaauccaaaaaaaaaaaaaaguaaaccugagagcuuccuccuccuguguuaaauuuggaggccaagauguuuuuguuacuuuuacaaaugaucaaggacggugaagguugggcaugguagcucacaccugaaaucccagcacuuugggaggcugaggcggggugaucgcuugagcuugagaccagccuggacaacauagcaagagaccccaucuccacaaaaauaaaaaaauaaaaaaaaauagccaggaguaguggcaugagccugagcccaggaggucaagcuguagugagccaugaucaugccacugcacuccagccugggcgagaucgagaccaugucucuagagaaagaaaaugacaaggacagugaacccaagaaagucauaagaugccagcugugcagcaagcauggaaagcagccaguccaaauuaggacaguguguuuuccaagaagaacgaucguuuguaaugagaaugcuuugcuuuaaauaaaugacuaaauagcuagaagccuaguucuaggggauaggcacgucuuucuucucucaagaaaauagaaaggcaauucuaauuucuaguaacagcaaacagcauuaagucaugguccaaauaugaggcaaaccaaaauguggcuugauuguucagcaguugaucuguuggaagcccuugauauuaaaaagguucuccuuuaagcggcuuaggagucacgaucaaagaccuauagaaagagaugccauccuucuaggauccuuggcucucuugggaacuagauucagauagucauaauguaaauacugcuugagcuuucuuucuuucuuucuuucuuucuuuuuuuuuuugagacagaguuucacucuuguugcccauccuggagugcaauggugccaucucggcucaccgcaaccucugccucccagguucaagcaauucuccugccucagccucccgaguagcugggauuacgggcaugcaccaccacgccuggcuaauuuuuuguauuuuuaguagagacaggguuucuccauguugaggcuggucucgaacuccugaccucaggugauccacccgccucggccucccaaagugcugggauuacaggugugagccaccgcacccggcccgagcuuucauuuuugaaaucaauguaugacugaaacacugaagacuuacugacuuaauuaugguuucagaacagaaugaaaaugucuucgguucugaugaauauaaaaggaaaacuaaccaaguuaauuuggcaaguagaugguagagauagagguggggaguggaaggggaacuaaaaucuucaccuagcauuguugggauuauaugguuacaucaucugaaguugacagaccaaaauauagaggcuucagaggucuccaaauagaacuaaacauguaauucagauuguuaggagguaguauaaaugagcuaaaucucaucuuuauuacgguagaguuaaugggugaugucuaaaguugucugaagucuauaaaucaugacaaauuaugauguggugauuguauucaacagucuuucaguugcagggauaaaaccccaguuuaaacuagaguaagagaaagaauguguugguuuaagcuccuggaaagugcaggcaaggguaguugguaggacugcaucuaguguuguaauucuguggucugcauuguauauuuaugcaucucagcucugcuuucuucuuuucauuuauauaauuuuuaaauuuuauuuuaaagauagggucucacuuugucgccuaggcugaagugcaguggcaugaagugcagugcgaggcucacucuagccucgaacuccugggcucuagaguucuuccugccucagccuucuaaguagcugagacaauaggcauguaccaacaugccuggauagguuuuaaaauuuuuuuguagaaauggaagucuugcuguguugcccaggcgggucuuuaacucuuagcuucaggcgauccuccugccucugccucccaaaaugcugagguuauaggugucacccaccacgcccagucucaucucugcuuccuguguuaguuuuguucucuggugggcuguuuucacaugaccgaagaugaccucuagcaggcuguguucucagccccucaaguaggccuaugugauuggccuugcaugaguaauaugggugaccauaaaccccugaaugcucugguccacaugggccaaaugggagacuggacagcauuccauugaugaggagguggggcuggucuccgggaguaagggagaggagcacaugcaguaacugauggucugcugcaagggauagcagcacagcaguuagaauuuuggagguaacuaccagaacugaaaacagaaaugauaacaaguaguugccuuaaaaagggaugggagcagggugcuuuugugaucaaagcuccuuucucuuacuggauuuuuguacacauuuugcauacauaucuuagaguaaaagauagcauuuucagccuugguccauuugaggauacucuuggcguggcccgccuccaugcuagcaggcucugguugugccaaguucaguugagcauccuggcucuugccugcacggaacuuccagucagugcgucaguaucacaagucuugauauuuccuaugaagaagaacaguagugcagugacagacgaaaugggugggcaggcagaggcaggauuucugagggagagaaguagcuagcuuuuugcagagaagaguuccggcacccaagagagcagcugagaguacaggcaggcaggcaggaugccgguagggcccggccgcacggcgccacagaauccuggagaaaggggccucuucauggccucugcauucagcugcugucacccuccgcacaggccauggccaaaauuuaauuuucauaguggacucuaguuuuugagccuuacuugcuauuauugaaauaauuuucuuguuucuuuuuaaagaucuucggauuaugcuucacugaccacuguaauaaguuuaaaguugagaaaauauggcuuguuaaugaaugauaggucaauuuuaguauguuggucauuuuaauauuuugccaccaguugguuuggauuugaugccaggaggagacagccucauuucuaaggacuagucuugccuuugugggauaagggugguguguucuguguccuucuacauguccgagcgaucucugugcagcucaaauguggucacugucuuauugcgcugauuuccucuccuuccaucucacaauugaggcaaaauauuguuacuguugaaguguuguccaauaggacuuccagcagagacaggaugucugcacugucuaauuuaguugccuuuagccacaugugguguucuguaccugaaauguggcuggucugauuggauagcuuaauuuauaauuuuauuuaauuuuaauuaacuuaaauuuaaacagcucuguguggauaguggcuccuguaugagacagugcaggucuguugagaagcagcuuuacuggugggaguggagggcuuggagagggcacguggguuuccugcugguaucuuuugaccuuauuuaaucugcccaacauuugcaaguaaguuguguguguguguauauauaaauguguguuucugucuucuuguuuccuuugacugcauuuauuugaaagacacuagguggcagaauuacuguauuugauugguuucaagauaagaguugaaauaauucaucucguguuuuuauauaaguaagguguguuuagcauguaaaauugguaauauguauucacguacugcuuaaacaaaggcuaugaauuccacccauaaaccgaaaaugaagaccuuuaaauuuguccauuucaggcguggguacuucuuaaauaauaccugguucaggaacuagucagaauggcacccuugacuuuuuguuuccugcuuuuccucuuguugggagaggaggguauucaucccaaagugguuugccuauuucacauuccaucuaggauaagcagaauagccaagaaagauagcuguccuccuguuuacaacauuugggguaaccagcaucccucucuuuugguccaagauagacugguuuagaaacagaugauggcaccagaggcccaggagguggaaacaucagcuuuguuuguuguccauguggcugaauuagagcugucuggccuuguagccucaacacggccuuccagcuuugcucaccgugauuuucaaggacacaucuugugcucuucccugccugccauccagacuauacccagucaggguggcaggagcugcugccccuuccucccugaguccuggucgugggugguggagaugugccaugacgcucacggaggcaugcucaccccuuccucuguggcagaggggauggcugcacgacagcucuucccuguccuuuccaaagcgucugugguuccacuuuuuggggcaaagcaggaauacuggaagagagagaaagugguccuuucuauaguaauaaaguugacauugauucaaguucaugcuuggggaaaggacagggcuacuaacaauuauaaugcugggagcaauggaauuuucucauggguaugugguagguuuaauuuuaauuaucccaguuaauucuuagaacugcucugugaaguauuucccgcuuugugcuuaaguucuaaaagauccugugccaaaaccaagaaugaaaacccaagcauucuuucuugcccaucgaucuuucucucaucaggccacuucuuggguugauaguggugaguguagccgcugccacuuucagaauacccaccaugggccccagucacuguguggcguggagaagagaugguucucucugugucauagcugaacaagcccagcccagagagguuucugcccuaggagcucucgaugguggaauugggaugcgaucccacauccugccuguuuugaaaacagcauucuuuauuuccaauuccugcuuccauuguuccuuuuaauauuucuuuguuuagcucacaaaaacacggcuugcggagcugcugcgugcagcuguagcuguuucucugggugcagccugcauccgccuuccugcccgccuccuuuccugcacugccaucguggucuccgggcacuuggucccuuucucuuccccugagucccuuuggcuccccugugccacccuugugauccacaggcucugccuucuuucugucucagacugcugcucaucacuacucgggacccuaggaagggagguuccaccgagaagcaucuucucaucucagccacguucucagugccacuguugucuuuguuagguaaugguagcuacuguaacaaauaaaccaacauuuccauggcuucacaccagagaagguuguuucuugguuuuaugacaauguauugaggguguucuugguucacggaugguuuuccuccaugugggaauucggggacccaggcuccuuuccuucuuuugguucuguucuccaggccuucacauccucugugucugguuggggacaaggagagggaagguaaagaaggcuuuguggccuuggauaagugacaggcaugccuuugcugguguucucucguggugacaggucacagccccacccuguaaaaggggacugagagacgucguccugcugcuucccagcagcagcacuguggucucugauguguuuucugugaggauaaaaacaggugauuccaggaugaggaaagucagggaaacccuuggaaggaggggaccaggcgggugucaccaugggauuagugguggcuucagaaugagcugcagcgagugccaugccuucuaaagcuuuugcuauucugauaugcccacaccaugcccagcaggugucugccuugcucuccgcagagagagugaugaauccuucucaugagccucuguccaguuguuccucccuccaccuggaagggacccuggguuccucauaacaucccagcggaacaggggaccuucuauccuguccccaaguucauccucauccuccugccggcuuccuggccccucuuaugucugcuuccugacgccacauccuucuggauucucuggaauugaauuuugccuuugaugcuuauuuaaaaauauccauugcaggccaggugugguggcucacaccuguaauccugugcacuuugggaagccaaggugggcagauugcuugagcccaggaguuugagauuagccugagcaacauguugaaauccuguuucuauagaaaauacaaaaauuagcugggcaugguggcgcacaccuauacucccagcuacucaggaaccugagacaggaggaucaauugagccccggaggccaaagcuacagugggcugugaucgugccacuguacuccagucuggucaaacagagugagacccugucugaaaaaaaaaaaaaaauccauugcauacuucaccguagcgaaacauguaugucuuaccuuuccuuuccugccuguagcugcucuuuuacacuuaacagccacacuaagccagccuuaaaugaaaaacaaaccagcacuuccugugcccuccugcuuccuucaugaggggucccucccucuguguacacuccauucucauugcccauggugguuuguuucccucuuguuucucaagccauggcagccugccucuugcccucuuuacuaaaaaggccuuugcagaggcugccuguguucuuucuuucuaggucucucucauccuaggcccuccagcuugauucuguggagcugcccucuugucacucaguagcuuguggggucuucucugucuagccacuuaauugauuguguuccucgaguugcuguccauggucucucguuacuguuuucucuguguuucugccucucuccuuggccuugguagguccauccccuuugugaccuuggcuguugcucucauggacaacuuucucuugcugguccuuguaguccuggcauccagcuucucgacacgggacuuguccugccaguaccucagacuugcacuuaaaauugaacuagcaccacugucacucuccagggccucuucuuguuaauuagaucauuagggauguucagaaucccagcaucauaguauguuccuccucccgcuaccccaggaacccuaaccuuaccuccuccucucuaucuacuaggagguggcccucagaguccgucucaucuuccaccugaacuucccuaauaggcuccagcagcugccaccccgggggcugaguacuuccuccaugccuugugcagugcugagcccuuuaccuggguucuccuguuugcuccuuauuacagcccugcgaacagauacugcucuuaauuccaucuuacaccuaaggaagcugaggccccagguaaggugcauccaaggucacccagguaguagacaguagagccacgaucugaaccaggcagucugauucagagccuguguugacacucagccaccuagaacacagcuuggauuguggguuucuauuaccuguucaaaaccccuacaucccgggucugucccugcacgugcucuguggccuggcugcaucuuccuugaaggcagugcaugccucuucacucagggggcccaugcaggaacagagggccccacagaaggaugaggccagugcagaaugggcuggaggggacaaugcugaccaggaagcaaguguagagaaaucccaggaaaccuggaggagccagagacaaggcauuagaacuccucgucgugaccuggucugcauucucugagugugcugcuucuguuagcucgcuuccuuggucucagguuauaguuuaaggcauuguggagcccuaaaaagccuguacucuguuuuuaccuguuuuaggacccuuucacuuuggggauguguugauuuuuuuuuuuuuuuuuuuuuuuuuuuugagauagagucucgcuccauugcccaggcuagagugcaguggcacgaucuuggccacugcugccccugccuccuggguucaagcaauucuugugcucccgccucccaaauaccugggauuacaggcacccgccaccacacucggccaauuuuuguauuuuuaguggagacaggguuuuaccauguuggucaggcuggucucgaacuccugaccucaagugaucugcccaccuuggccucccaaagugcugugauuauaggcgugagccaccacacccggccugaaauuuaaaucagaaauaaaauuuugaucccaacagugaugccaggcagcccagaucugggggagaggguggccuuggccagcugggccuuucucuguuucccaagucuugcugccucucccugcugggcuuugcagccugugcaugucucugugccuuugaccuuguuuauccaaaggagaggauagaaugaagucaugauuccuggagcccugagaaggaugcuguggagaaauuugccgguagaaucuagcugaguguguugcugaggugccagcauuguguguggggaggcugaccgcuuggccugccuaggcccaggaugcuccauggccgggcacagaggccacuuggcugucaggugucaggagccugcagagggcacacagagccuggaccgcagggggguccugcuuucucaccuggccuccuucagcauuucugucccucaguccuuagcaagcccaggagcuguugaguuuggcaggugccgagugcuguuccugccuguguagcuguggcucaguccugugggggccccgcuguggcccgagugcagugauucgaggcgcugaguguucccugacuccuucuccaggagcuguguucagacuuucgcagcucuuggcuuggagcuccuggagggcuuggcauugccgaccaauguggaggucgacagugagagaggaggaaugcuagcuuucuugaccaguccauuaaauaagugggauauuggccaggcacggcggcucacgccuuaaucccagcacuuugggaggcugaggcggguggaucacgagcucaggaguucaagaccagccuggccaacauggugaaacccccucuauacuaaaaauacaaauauuagcugggcgugguggcaggcgccuguaauccuagcuacuugggaggcugaggcaggagaacagcuugaaaccggaagguggaguuugcagugagccaagauugcgccacugcacuccaaccugggcaacaagagcaaaacucuaucucaaaaaaaaaaaaaaaaguaggauaucuguuucugcuuagaaaaaucagaauuuucuaaaugccagguguucugaauacguaaguaugggagacgacucagccuguuucauuuuuauguaaaaucuucgcguagccauguggcacuggaccgagaugaaagcaaagacauuucuccuuaacuuuguuucuaggaauguuccggagaaucacagcagcugccacuaggcuguuccgcagugauggcuguggcggcaguuucuacacccuggacagcuugaacuugcgggcucguuccaugaucaccacccacccggcccuggugcugcucuggugucagauacugcugcuugucaaccacaccgacuaccgcuggugggcagaagugcagcagaccccgaaguagguucauaaugccccacagcccagggcgccagcccagcacccuguccugagacucccaguaaccugagcuuuggccaccguuaaagcauuuucauuuuccauuuuuugugagggcuugugaaauuucugcugcauauuaauauuccuuucauggacagcauauuauugggacaaacaugcgguccagcuaaaggcauucaaaauagcaguugcuuucuaaaugcgauuuucuuuggcagguucuuugacaccauugcaucuugugggauaugcuugucaugcucuguggcuccuacuaaguucuaguccuuaaauugguuccauagccagacauguugcaaugucuuaaccucauuauaaaguaaaugugguucugguuauccuuagauaaugaaguaacaguguagcaaauuucaaaaccucuuggaaauguuauuuuaccauucaaaaaggcuuacuaagguucucguuauggguggcccucuuuuugcaaaagguuuucaggcuuaagcuccauuucuaggugcuccaacacuccauuauuuguauauguauggaaauaaaagcugugaccacccccaacccuggcccccgcccagcugaauccucagcacaguauuucuggaaggcucaagaucccacgcuggggaaaagaaguucuggagacaaaagagggcaggugcugccgugccucucugcucaguauggauacuggaccuugugcugccagggcucccaguagggccaguucauggcacucagcuggaaaguccacuguugggaggcauucuuaaccauccacucugugccguauguaguggggucuggucauucuguuggaggagacagaccagugacgacauuugaaaugcuugguggaugucuuaggccuguuacgaugacugagcacugugggggcaggagacagaaagucagugucuccuaguucugugcugcuuuaacgugcauagaaaucagcugcggauucagcagaucacuccuuuucugacagaugggccugcuuacucugauguuauaucagaaagcucugaaucugggaauuguguccccugaauuggaguaacagaaaugcuuagaugaugaguguuuaaaagaaauaaaccaaagguaaauuuaguuuggaauucagcaagcgucuucauucagcccucugagggcaaacuacagcuuuuuguaaauguagguaaauucugugacuguuucgugacccccucugauccaguuuuccuuuauaaccuucuguauuguuccuucuauuauccugaaauaacauuaauagauuaggcugggcgugguggcucaugccuauaaucccagcaccuugggaagccaaggcgggcagaucaccugaggccaggacuucgagaccagccuggccaacaugaugaaaugcugucucuacugaaaauaacaaaaauuagccgagcauggugacaggugccuguagucccugcuacucagaaggcugaggcgggagaaucgcuugaaccuaggaggaaaagguugcagugagcugagaucgcgccacugcacucuagccugggugacagagugagacuccaucucaaaaaaaaaaaaaaaaaaaaaaaauuaauggaucaauggauuuuuaaccuaauaauuaaauuucaaaaaauaucguucuuuaaugguaauguaaagguaaaauuaagauaauauguaacaagcaugugagugucuaagguguccccgugguggaaggaaaaaauaaauccccauaaguguccaagaugcccauagagagcagagcuguucugguuuaaaccccugcucuuagcacuguguuuuuccagcuguggguggugggggaugaguaucuuuuuauuuccaugagaugagaaaaaugaauuacuagaagugugaaauacaaaacacagcugcucuuuuuuuagccauagacucagcagccauaaaauugcuguauccaguugcagaaauuccugcugcuuacucuugacccucucucgguuugugugcaucuccucucaggcuggcucccagaugggagcuggcuccaggcgacacugggugcucugcuccaggagguccuuauguggguccugcccuagccuagccccucucuuauggacucugucacuguggguuuaugauucacucucaaucugucuuaccucuuggugaacuguuagaguccugccuauacuuuggcgcuuguggguguguugugguacacaugauguguuggucacuucccagcucaucuuguucugagucacccuagauuugggacauucauucgccaccaguaccgggcgguguauggccugagauuugggggggcuugugcugcuacaaauuggggcugaauuugaguugacaguggaccuucuuuaugucuacugcucauauuugaauugcaaauacugccucuucucuuucagaggcucauuacccuauagcuguauuauugcaaagugcacaauuacagcuugaguguaagucacacugcgcuggcaggacggcccacugagaaagggcacguuuccuguucguuaguuuucacauugacacauaauuuacaauacaguaaaauguacuuuucuaucaacuguagucaguaacagccccccucccccaaccacaucaagauauagaggagugcugucacuucaaacaguucccucuuccucugccacauccugccccuccccaggucuaaccaccaauccgugcucugucccucuguucagcccauugcagaaggccauagaaauagaaucuauaggcuaggugugguggcucaugccuguaaucccaguauuuugagaggcugaagugggaggaugacuugaggcugggaguucaagacuagccugggcugccuagcaagaccccaucuccagaaaaaaaaaauuuaaaaauuacaaucacgucccuguaguucagcugcuugggaggcugaggcaggaggaucacuugagcucaggaguuagagguuacagugagcuaugaucgugccacugugcuccagccuaggugacacagcaagacguugucucuggggaaaaaagaaagaaacggaaccacgcggugugcagccuucugagucuggccccuuucggugagcagugucuaaaguucugucgcguguugcccacgcgucgguggcucgcuccuugcaacugcugagcauuguauggcuaggcuguaguuuguuuucacuucaccaguugggaaacagagaaaaggcacuuuuuaaaaaguuuaaaucuguagaauuuugguuuuuaccaguucucuucuaaauccugagggauuacaggaaaaguuguuguauuucagaauauucuuagcuugaugugaccucuguccccguuaaggcccuuugccgcaaugggaaggacgucgcucggucagacccugaaggucagaggggcaguuugggagugugucaacauuuuaacuguauggacuagagccaagagucucaagguuuauaauucccacguauucaaaaagaaaaaaacaauaaagugagaagucaguguagagugaaauaaccuguguuaguggggaagaaguguuuuuaaacaggauuuccauaacguauaacaucaacauguuuagaguggugauguuucauugggaaacgaacaguaaaacaugaaagcagggagguuuucauucuggcaguuggcaacuuucacggcagauggagaauuucaaaagcaauugcucaauuaucaaacauagccagugugaguucugaaauaaaggugcugauugaaugugcagcuuuaugguggauuuugcuauucaggcaagcauuuuaauuuucugccuguuaaauucuguuuucuuuaguuuuucauaugugguuuauuguagcuuaggaauagauaacugagaguauauauuacacauacaacauucugauauggcaauauuuaaaacaacuugucuguuuuagaacuagaauuaaacauaaucaucuucaguauuuugcaaauaagcucacugccauccagaaacauugucaaugcaucuguugcuccuucuagaagacacagucuguccagcacaaaguuacuuaguccccagaugucuggagaagaggaggauucugacuuggcagccaaacuuggaaugugcaauagagaaauaguacgaagaggggcucucauucucuucugugauuaugucguaaguuugaaaugccuguaaacgggguugagggagguggggaccaggagaacauccuguguagaugacacuugcauggacccucuggaacccagaccgcccgguguccugccaagcuccaucgaaacuaaaucuagaaugaauguuuacuucugcugugacauauaauuggagaccaggccuggccuuccagucacuggauucuaaguuggacugugagaguuuuugcagcugacucauuuaucaaaugcccggcuauuggcucacgccuacaugaugcuggguauguuuguuaauuugagggaagcaauggaauaauaauaacuaaugauuuaaaaaacaaaguaagugcauugacuguagugggguucugauuuuaaauuuuuuuaaaaauuaauaccaggagcaguggcuuaugccuaaauuccagcaacucgagaggcugagguaggaagaucacuugagcccaggaguuugagacaagccugggcuauggugugagacacccaucucuaaaaaaauaaaaaauaaaaaauuauccaagugugguggcucgugccuguaaucacagcucuuugagaagcugagggcggaggauggcuugagccugggaguucgagaccagccuggcaacacagagaaacccugccucuaccaaaaaaagaaagagaggaagaaagaaaaauuagccuggcgugguggugcaugccuguggucccagccaccugagagacugagaagggaggauugcuugagcccagaaguuugaggcugcagugagcugugacugugucacugcacuccggccugggugacaaggcgagaccccugcucuaaaauaauuuuuuuaaguuaauuuguagaaaagguguuagauguucuuugucacauuuuaugauggauuccuguuuaaaugccguucucuuuaaagaaaaaaaaauaacuugugggaguuuuuaaccauaaaacuagcaucacauauuuaccauggagaauuuacaaaaaaacaaauaaacggaggaaaauaaaaccuccuguaaucauacuacucagagauaacuugcuguuagauuuuggucuagauuuaauacuuuuucuauauuuauauuaaaaauauuuaaaacauaugcauuucuuugucacaaacaugguaucuuauagauacuacugucacauagcaaaacaguguuaaauauucugaaucagaaaaggaagccgacucuccaacugaaagagguguuauccuagagacuuuuucuggugaugacaauuuauuaauagucacuuuuugcuuuacuuucucuauugaaguaguuuuucuauuuuguucuacuuuuaaggauaauauaauuuauaaugcuguuuuucacagaaauauaagaaaaaagauacuaauuuuauaaguuaauaaaguuugaucaucccaaauccaaaaaucugaaauccaaaaugcuccaaauucugaagcuuuuugagugcugacauuauguucaaaggaaauguucauuggaagguuucagauuuucggauuuagggagcucaacaaauaaguauaaugcacauauuucaaaaccugaaaaaaauccuaaauucagaauacuucugaucccaaacauuucagauaaggguuauucaaccuguacugucagaugaucccaaaugaaaaauauuaaucguuaaccaaauaucaaggaauugaucacauuuuacaguuucugccuaggauuaugaaucaagaugaaaaggcucugcauguuuaaaaauauauauuuuuauuuucuuauaaaucuuaaauaucuacacuuaagauuuauuugauaugugggauccauucauauuuuggauucaacaguucugucaaaacuguggcagugauaggggauucuuuuuuucccacugaacuaucacaaaauuggaaaaagaguaauuggagaaccccacuggcuuagccggcccgaagcccgggagagggcaggcagugcuguggauggggucaucccagcgcaacgcugccccugcuaccugcggaucucgcugaggccugccuuuguccuuugacccuuggccauuuguuagugucucugagagcuggacugcuguacccuacuuccccagggggccuaacuucacacagccucugccgcagugcgugguuggaggugacggccuugguaaaucgaguuuccuaccuccucaauuauuugugcucauacacuguauauuuuuagugagguuuauauuugggauguguuuucuccuucuuacccuuucuggccuuucuauggcauuaauaccuggucucuucuuguguacuugaaaaugaaucucucaucauauuuuuccuuagugucagaaccuccaugacuccgagcacuuaacguggcucauuguaaaucacauucaagaucugaucagccuuucccacgagccuccaguacaggacuucaucagugccguucaucggaacucugcugccagcggccuguucauccaggcaauucagucucguugugaaaaccuuucaacuguacgucuucauccugccgacuauugccaguugcaguuuucccugccuuaaaaauggaguauugaaauuuuuaacuuuaauuucugauuugcaaaauagucaucuuuuguucuuuuccuucuugcuguuagccaaccaugcugaagaaaacucuucagugcuuggaggggauccaucucagccagucgggagcugugcucacgcuguauguggacaggcuucugugcaccccuuuccgugugcuggcucgcauggucgacauccuugcuugucgccggguagaaaugcuucuggcugcaaauuuacagguauugggaagagaaacccugauauugauuuauauugaaaauuuagcaggccaagcaaaacagguggcuggcuuuuuccuccguaaguauggucuugacauggucaccgauagaaacauggaaacaucugcaaacuugccguuacucguguguccgaucugacuguuucuuguauuuuuuucuagucugcccuuacuaggaugaacuguacacaucaguucauccuuuuuaaaugagcaugagguuauuuuggguuguuagguguuacaaacacacuaauguguuuuugucuauuagagcagcauggcccaguugccaauggaagaacucaacagaauccaggaauaccuucagagcagcgggcucgcucagagguaaugcuggaaacacaggucguccuuguguuaggacaacccaggauauaaaggauauagauuuguacgggaauaaauucacaggacaagaaaucgaugugccuuauagguggguuuacugcagaagugccauaauagaaccuuccuacuuuuaaaacaaccagaucucacuuucuaaagaguaaaggaugaccggcaggaucacgucugugacgugaguggaggcaguuugcacuccugguggcuguuugagagguagcauuuagaaugccuguauucacuguccugugaugagugggaaaauagguuaucagguuuaucuuagcaaaaucaaagcaugucaucuaauugcuaaacaagaguuggcaaaucugagagacauuacucaauccuuggcaugcaggacuuacaucugcauccuguugccauuuuaugucuucaaagcauuuaaucauuuaguuguguuugcaaagucuuugagaagccuuugucagaaaucccuacaucuccuaugugaguguauuuccaugacugcagaauaaguuaaacuuuuaccuuuuuccuucccuugcggggcgggguggggggcagggauugugugugugagagggagagagagacagcagagaaggagaauauaauuaucaugcuguguacuuugagcugaaacugcaaaaaaggaaaaacacacaaaaauuauuaugcuuuucagucuuuagaguaccuugucuauuaugcuuuucagucuuuagaguaccuuguugaugguguuuuuaaaugggauugggcacaauuagguggacaguuugggaugauuuuucagucuguagggccaagcucuuuuguaauuugcauuaugaaguugucacucucauagcagauggcgggagauaaacuauuauuacuuuuugacccuagacuuagucuucaguccagaugagggagauuaaaagauuauaaauaucuugugccagaugaggugauuuuauuuugaaaugaccaugaauuccuaucaguugucuuacugggauauuugauaguggaauuugugcauuugagucuuagaugaucuguuuuacauuuauuaagaaagccuuuauuagcuuuuauacuguguauugccuguugcaguguuugaguauaaaugaaauuucuggaaaauauuaauggaguacaaacugugauacuuaaaaguaaacuagggccugcauuuguaucaugaccuguuugaguauugaugagaagauagcugugaagaaaaagguuuaaacaaguguauuuuccuuuaagaagccacuaauagugcaucuccuuagaguguauauuucuagaauccuagugugcagaguuuagacuaagacuaaaaaaaaaaaaaaacaaauuauacuguaauuucauuuuuauuuguauuuuagacaccaaaggcucuauucccugcuggacagguuucgucucuccaccaugcaagacucacuuagucccucuccuccagucucuucccacccgcuggacggggaugggcacgugucacuggaaacagugaguccggacaaaguaaguguccagcgugucugcaugggaggcacagggcgcugagugccucugucaccuguggcagauacagagagugcagaggaggugccguggacccaaggaguucuggcgcucggcucggcucagugaagcugugguuagagacguggggggccaucaaggucugagggagccaagcagugcugaugugggacccuuuugguaggaguguggggugaguaguuagugggugaaucaaggaauagucggccguggccugcaggccccugacugcacaggccuucaagcacaugucaaugccguuagccucccuccaucuccucauaccuucuggccaccugugaguugcacugccacugccagccauucugguauguugucagcaccuccacugcucauaccucaugguuagggaccaccuggagccuugguagagccuugguagagccuugguacucuacuuuccuggacaaaguucagcuuaugaauaugaauuuagauuucaaaaaccagcagcccaaguauaagaaagcgaagguucaguccugccuucuuaggcucuauucgcuaagcaccugcccugcccugguugcuggggagagaugaguaaagcagacaacccaggagaggauggcaaaggggccgcuaacccuuagugguuuagcuauauuuggaaggccuauuggaaguucaccaggugaagggggaggcugugagggugcccaggcagguaacagaaguccaaaggggaaaaccugugguguggugagccguauagccacagccugccggccggcagcccucucagccuagugcgguguucccaagcacuggccuaggccuguagcuccagggaugugaaguccccuugaacgccgcccaucauguuccccuuauccauuuuuuucuucccaggacugguacguucaucuugucaaaucccaguguuggaccaggucagauucugcacugcuggaaggugcagagcuggugaaucggauuccugcugaagauaugaaugccuucaugaugaacucgguacggggggagcaguggaggcaaggaauccucagcuuuucuugugacuuccaagugggauuugucucaucaucaugugacccacuuguugacaacacauguuggggacuccagucugggcagggacgggaugucggagagacuccacucugaauggggccgggaaguggggaggacuccauuucagauggggucgggacauggggguuaugcugaucgagacagaaaagcacauuguuucagccacauuagaauccacggagguguuguuuugaaauccagcuggccccaaggcuggguguaugguuugggaugagaacuaucuggccuccacuggaggaacaaacacaggauguuaucaucuaagcuccauggccaagacagaauggaagucaagguugcguauuugccguagacuucaacacagugucguaaugcgugacgucaauaacuuguuucuagugucuuggaaguugaucuuuagucguaaaagagacccuuggaugcagcgagauuuccucuacucacaccucuguuagauguagugagguucuucaccccccaaccccagaugucagagggcacccugcgcagagcuaggaggccaugcaaagccuuggugucccugucccucacccgugggcagguccugugagcagugggggggccaccucuuggguauggugcagccauggcccaagcagggcuucuucucagaccuacuaggacgggagaaaccuccuggugcuuuagcccugcguugauaugcagcaaaugggagggaagugggcaccugggaggacaaaugccuguagaggccgggagugacggcagguguucaugaaaagagaccuuguggggagggcaacacaacaguguguucugauguacugaagagcucaacugaaaacaacaggagaauuagcccaaaauccauuuacuaaaauuguuuaucuuuuuuuuuuuuuuugagacaaagucucgcuguugucccccaggcuggagugcaauggcgcuaucuuggcucacugcaaccuccgccuccuggguucauacgauucuccugccucagccucccaaauagcugguauuaacaggcaugcaccaccacgcccggcuaauuuuuguauuuuuaguagagacgggauuucaccauguuggccaggcuggucucaaacuccugaccucaggugauccgcccaccucggccucccaaagugcugggauuauaggccugagccaccacgcccggccuaaaauuguuuaucuuaagauucaugcagugaaagcuaacuuacugagugauaaauuugcuuagugaucuguuuauuagguuuuccaaauuugcuaauugggcuuugaacagcuguaaaaguucugacuguaaaagaaagcuucaacuuuuggcauucaugaugcuuuucugaguauuaaacuaagauagauguuuuaccugaaggaucggccaccaaucuuuaaauggcuaaacaaaaggguugcuaaaacauaauccaaauugacauaagaaauaccauuuuuccaaccaaaauuuuggcauucauauggcuacuuuuacguauuucagcugcauuugaacaucuuuuucaaacuuuagggugguugguguaucacugaggucuuggaugacacuuuagcuuugauuuuguuuuuaugaauuaaaauugucauaccaaaauuuuuauuucaagcaaauccaagagcauaaaaaauuaaaauauuacuuaaaauacuaagagagaacagauauauauuuuacuaagcauauguugaaugaaauuguucaaauauuuauaacaggcauagaguagaauuuucuuaaaaauauuuuugaugguauaccaauuuguauuuucucagaaacauuugccuuauucuuuuuucuguuguguuuuucuuaccugauugaaagcucauaaucuguuguuauuguuuguuaaccuuuaaugcucugauuucaggaguucaaccuaagccugcuagcuccaugcuuaagccuagggaugagugaaauuucugguggccagaagagugcccuuuuugaagcagcccgugaggugacucuggcccgugugagcggcaccgugcagcagcucccugcuguccaucaugucuuccagcccgagcugccugcagagccggcggccuacuggagcaaguugaaugaucuguuugguaauuaaaauuaaaauuuaucuuauuuuuaaaaagcauuccagggccaguauaguacuuugcaccaaguaaauguacaauaaaggcaguggaucuaauacauugaaagcguuuacagagguagcuaaagagcagcacggguguccucggcucagaauuucuuccuguguguuugccacuuugccauucauugacauggucauggacauagggcucuaagcccuugaggaaggcugggccagaccucaggggagaugcagccccaaaccacgugcaguccuguggacggauguguagaugugccacugaggaacaaugucuugagcuuucaucagauucucagagaauugcuugacugccuuucgaaguugaugcaucugugcucacguuugcacccacccacgagguccuucuguuucaggggaugcugcacuguaucagucccugcccacucuggcccgggcccuggcacaguaccuggugguggucuccaaacugcccagucauuugcaccuuccuccugagaaagagaaggacauugugaaauucgugguggcaacccuugagguaagaggcagcucgggagcucaguguugcuguggggagggggcauggggcugacacugaagaggguaaagcaguuuuauuugaaaagcaagaucucugaccaguccagucacuuuuccaucucagccuggcaguaagucuugucaccgucaaguuauuguagccauccuucacccucaccucgccacuccucaugguggccugugaggucagccagguccccuucucaucugcaccuaccauguuagguggauccuaauuuuagagacaugaaaaauaaucaucuggaaguacuuuaugucuuaaguuggccuggacaugucagccaaggaauacuuacuugguuuguguuagugcuuguaauucgcccccagaauguguacacguucuggaugcauuaaagucuggccuguauccuuaaagggccaucgcugugcugccugcccucagcaaggacacacuuugcagacccacagaggcuccgccuccaccucacaccaaagaaagggaggaguccaaagggcaucagugccauuacucacaaaaugauaaauacacccuuauucugaaccacguggagucauaugguuugugaucccuguccuucagguuucagcuuaguggggaagugggaaagucagcgugugaucacagcacagggugauugcugcugauuauauuaugugccugcuguaugcaggaugaaauacuuuauaugcgucaucuuauuugacucucacaacccccugugagauaggcucuguuacucccauuugacaggugaggaaagcaaggcuuagagaauuucagugacuugcccagguccucugagcuaggaaguagccauucuggcauuugaacccaaggccugcuaucccuagaacccacgcucucaaauucaaccuaugacagaggcaagcccuggugcugugggagccccaaggaagagccucuggccugguggccacguagcccaggagagauuucuacaggagcccacagcgcugaaggagagagaggcagcagaguaagggggcuuuguggcagagaggggacuggcacuuuggggaauaggugggucaggacugaauguaauggagccaugucagagcuguccuucuggaagggcaagggcaccuggacgcgcugccccucagugcuuuggacgguuccacaacugugauucacacggcuuccccaaacgaagguacacgagugggcauucugugacucgguacuucccuuuaggcccuguccuggcauuugauccaugagcagaucccgcugagucuggaucuccaggcagggcuggacugcugcugccuggcccugcagcugccuggccucuggagcguggucuccuccacagaguuugugacccacgccugcucccucaucuacugugugcacuucauccuggaggccggugaguccccguccaugaacgguggguuccuaucauaguuccugucugcuucaccauguuuuuauuuugugcugccuguuugccagguacuaagcuaggaauuggggauggagagguagauaaaauaugcaucaggaagggcugggccccaucucuuacucuccaauauauuggagucuacacuggaauuuaacuggaauuugcuuuuuuagucauuuuauuuagauuuugaaguuucagcuuucaucaaaaauaccucuaaacuuuaugucucugugaucuuuggucuuagcuguuuuauguauuuagucuuauaugaucauaagauuaauaacauuacauucagaagauuauuuguuuucugucagaguuaaaauguuuguuuuuauacugcauuguaauauuaacguacuguaaaauaaaaguggcuuguucuuuucaaggaacaguauccucaacaagggucauuagccacaauuuuuaaaaaauuggacgucauaguuuacauguuagagggcguuuugaagcuuuguauuuuuaaauuaaauguuauagagugauguuuucauguuucauaauuguuuucaucugugcauuuguagccaacuugaaaacaaagauccagggauuacuacuuaaaagccagacuucuuggagguuauagugaugauuuugauaguaucuugagccgucucauaauaaccucagggugagagauggccaacaggagacagucgagggacuuagaaaucugaaugaaaucugaaguucaaaucuucagacauauaccacuaaccaagagauugguaccucagucuaguauugucuguuugucuaaaauugguucuaaggaaucuaggcuagucugucuaucccuuucaacuuuugugaggcugcacaaauguaaaauguugaauaaaaagcacugauggaaguguguagaaauucuucucuuuguucuguuguaauuuuaguugcagugcagccuggagagcagcuucuuaguccagaaagaaggacaaauaccccaaaagccaucagcgaggaggaggaggaaguagauccaaacacacagaguaagucucaggacccauuuuuuucuuacauguuguuccuccaggacuuaaaaaucauucacagagacgugcaccgcggugaguguggacuccuggaagcgcaccguagcuccgcuguguccugcugcuccucccuagcugucagggaggcuguaguccauugcuuugccagcucuuuuguuuccgagugaacaccuuauccguacacaugcggcugucucugacccuacagaccagcugggaugccacugggggagcgcucccuuccccccgcacuucccacacucugcaguuauucugagauccuugagggcagggaacagguuugucuucuuuguguucucagaaauuaaugcucggccucuggucagcaagcaacaaccuuuuguugagugauaaugaauaaauaaauguuucccacaugaguauucaguaaccucagugucagguucagccaucuguuuugguggauauuuaaaagaaaauuccgcuuuuccuacagaaaaaaaaaaaaauccaaaucccagugauuuaagccaguuauagacuuagacauauacuacggcuuuucaugcacuuuccucccaauucuagaguagguauuuuacuaggaaaaugguggcagugccuguugggaggaagauucuuuggccaagugucuuuuguucuugccagggccccuaggcugcuggggugcuucagcuucuuuagcccagugucugguggggaauggccccuguugccugucccacagaggugggggugccucaccuggagccuguccacacauuuuacacagcacgcuuaccuggagcaucaggcaucuuuuccaugcucuguggcucaggaaacacgccuuuucaaucaugagugcaccagugcuuuugggcuuuuucuccccgcuuuugugcaauccugguuguggauggaguuuuccugucuuuagucuucugcauaguacuuuucucuucugguucccgguucaagguuuuguaauuagagaaugacccagaagcaauggcauuuuaaugcacagccaaggacuucucugaauuuguaucucaaaccucuguggguccuucaggcuucaguuugugauuucaugauuucuuguugcuaccuaaggaauaugaaaacacccaccucccuacucugcaucuuccagccgaguggcaccucaggcuguggauccugugcuucuguggugaggauaagaauagugccaaccguguggauugaaaucaaucaguuaaucccuccauguaaagcaccuggaacggaugacagucuuguuaugaauacucaacaaaugcuaucaugauuuuuaguuagauuuccauugcuuuaaaacaguugagacaucuuggcgguuugaguuagagcaacgggcccugaaguggguucuguuugggugaagaugauuaugcuuauuccccauggcccucuuuaggcaagagugggaagcuuucuuuguuuuuuuaaucaccucgauaggacguuacuucuuaaaggucauccaauaaauauuaauaggccgggcgcgguggcucacgccuguaaucccagcacuuugggaggccgaggcgggcggaucacgaggucaggagaucgagaccaucccagcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcaagacuccgucucaaaaaaaaaaaaaaauauuaauaaagccaacucguuagcguggggcuuaauugcuuaaguccaaugagaaguccuucucuauccuaggaaguugcccaaacuguagaaucucguggccuguggguaauagccacguaauacacacucacugccucaacaaaucauauuuuaguagguaugauauucuagacucaagacaccauucuguggaucuucccaagggugugaaguguccacagcgucugccuugggaguuuccaugcccaccagaaccaugccccaagccccucaagcacucugaccuaggaaagccagugaagcaaggaugacaacauggcccuuugauacuagcugagggacagacacagguccugggagaccagagaaagacgaggggcagaggagguguccuaaaggaagucugaggcugaggagccacaggauggcuuccagcugucacaggcugcugcuggccuuaucacagagagugggccagagggcugggaaccaaggccagagcucagguucaggaccauuccagcaaucccagcagaaaauggggagaauuguaugguauaggcggauaugaagguagaaucugcaggccuucaguggccaacucagagucuaaguggauuccacaguuacagcuugagcagcugguuguaggucaugcuuucuacacugggcauauaggauguguuuuuuaaaaaguccucucuuaaccguugcuuguuuagauccuaaguauaucacugcagccugugagaugguggcagaaaugguggagucucugcagucgguguuggccuugggucauaaaaggaauagcggcgugccggcguuucucacgccauugcuaaggaacaucaucaucagccuggcccgccugccccuugucaacagcuacacacgugugcccccacuggugagucugcucguuccuugcagaagaccaaguacggugaaaggcaccgguaggcccugggcugggcacacgugagagggcgggacagaauccccgcagcccagaggcugccugcugugguucuggugcccacugugguucuggugccaggcugcuuuccucaggcaccacguguggaggucgcuaguagaaauacuggguuuucuaaaaugaacugaggcccuacaucccuaagagauuaguguuagaccugauucuagagcaacuagaccacuuugcuuaauagcagaccagaaaccacacccccucgagugagugagauuuuccuuuggagauaauucauguuuuucuacacaguuuugcaguugucuucagaauugguuuaaaguagguguuauugccaggcgcaguagcucaugccuguaaucccagcacuuugggaagccaaggugggcggaucacuugaggucaggauuucgagaccagccuggccaacauggugaaaccccaucucuacuaaaaauauaaaaauuagccagguguggugguguacgccuguaaucccagcuacucaggagacugagacaggagaaucgcuugaacccaggaggcgaagguugcaguaagccgagaucgcgccacugcacucuagccugggcaacagagcaagacuccgucucaaaaaaaaaaaagguagguguuauugaucagaacccuuguuucagauaacaugaggagcuuagcuugaggagagugaggguugauggagggggacugacuucugcccagugaaauggcaucaucucccaccagcccgcugaaauaagaugauggggccuguuccuuagggccugcagcauccucaggcaggaaagaaaggccgaccuggcagggugugagccagcagguguaggucagggagaauggagccaggucccagggaagaggcuuguggcugccugagaagggugcgugccugccugugugugugugugcacguguguguauguaugcuggagagucuagggaggcuugcuccaaggacgcaguauuguuugauccugagagauaaggauucugccgcagggaaugaagguauuccagauggcgggcuuauuccgaagaagaggccagugccuggcggugcuggaagcaguugcagaacagggaguuguaggcuuuccugggaagagagcagcaggggugcuggagaagcaggccacacuugcugcaugggguugcucucggccccacucuuggugcacagcgagucacuguggguucauuagcaucugguuaugagacaguaacugcuccuuuggaggggcucguggagaccaugcaggagggcacggucuugaggucaugccguccagagcacaccugaggauaggccaggacgggcugcacgcuguagguaaaauuccuccagcaagcucuucacuggcauugaggaguucccugagugcggucaucuggaaggcagcuguaacaggcacugcagucucucccuggguggguaccagagaggagcauaggggagcauaaccgauuuaaagagagggcuuuccuguggugagguaagagauuagcuggucauuaucauagagcccccucugccuuugugcagaugggcugugggaauccugggguuccguuggguccuuugucaccucacugaaggcauguaagcugagcuggccagaccgugagcugauccugccacuugaacagcaucaagccugccucuggauucuucugugcauggcacuugucugagcaccucacgcacagagaacuggacuucagaguuuacagaaauaagcuguaugguucauuuucaugccugcuugccaauaaacauaucugagcugaaccucauugaacgccugccuuuauucuagcacagcaccugcuguuugugggcgaggggugcugucucuaacuccugccugcuucucccagcacucccugaguggggugugccagcagccucaggaugaggacaggaagugggagggcagagcagauuugggagggccacuugauggggaaggaagucccaggaagcaguuggagcuguuuucugggggagaaggugccagcucugggacaguguugggguagugaggagggagcccaguggagagaagucgggcuuccugcuuccucacaguaugucuguccugacucaacucggaugaugucacuuccuuuucaucuucucagguguggaagcuuggauggucacccaaaccgggaggggauuuuggcacagcauucccugagauccccguggaguuccuccaggaaaaggaagucuuuaaggaguucaucuaccgcaucaacacacuagguacucuuggggccucuccuucaggucaccauugucggacaucuaccgggaggaaauccagagcccccaguacugggaucuucucauuugacuccagaaaagauuuaagcaugauaauaauacaaaccuaugugaauacauuuugcaguguuggcaaaacuccuuuuauacugagaaaauagaucccaguuccuguguuuuguggcuugaaucccagcuuuguguauuccgggcuuguuugaagucaggaaagguucauguguaguggacaacgugagaccaaauucugccuuagauuuugcauuuaggcuaaacaguggcagcacuugucucagaauguuuucuuguguucaccagucugauccuguugugucucagugguccauuuucucauaugggaacaagcagacgggagcagauggagucagguuucuuggcacucgccuuccccagagccuagaggcagcauggggagaaagcaggcuuggggcucagacaguccuggucugcuuccagcccuccuaccugagcagcgcagggcaaguccgucuaaccucuagagacccucaguuuugucauauguaaaaugggggucgugucuauuucauagaauuguugcagauuuagaaauuacauuucuaaacaaauguuaccccuuauuucuaaauaagugucuaaaugaauaagucaccacuuuugccccuauuugauggcaagaggugugaucuuguggugggacuguaaucagucaguucucagugacugugcccugcugugguguuuccuggaauguuccugucuuguccuagaaagucuggcaggggcacccugacuccacuguccaguccucuccccagucccucgggcuucugcagauuugaggcuuguuuggaucccagaagguuguggcaggagacaccuugccucuacuuuccccuuuauaauucaauguccaaagagagcccugagcagguaccucacgccagcugccucacggagcuccuccucuuccuggcugugaggaucgguaucaguggccuccugcucucucccccuugccuaacacgagcaccuuugcuuacuugggugcccuugcucuugaacugcccaucggacgugcgugacccaagacugugccgcaguccuugccuugucugugcucauuuucuuuguucauuuuuuucccuguaacguaaauuguuauauuugucuguaucugugucugaaucaguccugcacgcucuccuucucucugucucuuguucuuucuuuaccccguuuaucacggggaccccgauguccauugcucuaguucuccuguccuaagcaccccaucccgucucucuggccuuaccacaaguggcguggcugccucagacaucaugauggggacaugaagcacagcugucagaaacaacuguucguuagauacacucgaaugcagcucaucaauagggauggagggucugucggauguauuuucacugaauccccguuccuaccuugauacacucuuuuuaaucuauucuucuagacaggucagaggaaccauuacuuugacuuuuaaauuuuuagcagcuuuauugagguagaauucacauacuacagauuucacccacucuaagcggacagcuugguggccauuaguuuuauccacagaguugugcagccagcugcacagucucagggcuggacuccagggaagauuuuagcccauuuagugaguggggcagaaguggcccuggcccugcacgagguugccugcaugggcgucccugcccugucccugugucugcuccacuggggguugaccaggcugccagggccgacuugggccugugccaccugccucucaugugucucggacagugcagccgaugucuauacuucgguuuccucaaugaugaaauggaggggauaguguuccccgcaucauagaacugugugagguuuaagggacucacugcccuuggcguggagccuucuccaggggccgugcugugucggcguagcugucagcucuccguuacaggcuugagaaggguugacacucucucauguaacauuuauauuucuaggcuggaccagucguacucaguuugaagaaacuugggccacccuccuugguguccuggugacgcagccccucgugauggagcaggaggagagcccaccagaaguaaggccacacccugugcugguuggcacaugggcaguuauggccgcuugcaggccuuugguggggaauaaaauaaggcagcaagcugguguucuuuuuuucucuuaccuuauuuuugaaagaguagcugaauggugucuugacugauauuccagagcagggacaaagccugcugaggucugggggcugcgauuaccaauggcuggaaugcauuuuauuacggugcauuccauguuaaggaucaauacgauugugcccuuucuggaaaauaucuuuuaguuuaucaauauucagaggaguguagguugaauuaaaaugaaaaggcacuuuauaaaggccaugaguaguaccugguuucauuuuucuaaugucuugcagagauuuuaucaggcuucuugaaguguucacguacauuacgcuaacacgauauuaauaauaacugugcucugguacagcggagccagcagaaugggaaguuguggaaugcaggcccuugauucugauagaaggugugguuugaacucacagaaaugacaguuuggaggguagacauaugucacaagucaucaagauugucuuuaaauucaugcauagaagcuaacagggugucauaagcaaggccuguaaaauguaugagggaauucaaagauaauuuauuaaaaaguaauucauguuuggaguuuugugcccaaaggaguccuugauuugaaaaaugggcuuuugcccaucagauuguuucagggcccgugugugcggaggcccugccuugugccccgugagcucagccugacagaaauccuuugguagcacuuaaggcuccucuuccucccauugaggcagggaagacucuggguucugcaggcagaggugguugugggugucuugcugcucuuguugacaugugggcucuccuuccaggaagacacagagaggacccagaucaacguccuggccgugcaggccaucaccucacuggugcucagugcaaugacugugccuguggccggcaacccagcuguaagcugcuuggagcagcagccccggaacaagccucugaaagcucucgacaccagguuugcuugaguucccacgugucucugggacauagcaggugcuggggacaguggguuccccgcugaagcguccagcagcuucaaccaggccguuuuccuucauugcuagaauugaaaacaccguccguguggccugugcaggagaugcagacccaaagguggccuccuggucagugagaagcuggaaacgugacaggaacugacgugggguuauugagcauuuaggggaagacguuagcagagcaggaaugagcaggcaacuaguagaacacccacuuaagggcucacggacaggugcucacuuaggaagugaguuucauuugguauuacaccagguuccuuuaggcaaagcggagggaaaguucugguguuuuucacuuguaagauuuugaaggaaacaaaacacucuuuaccuuuuuucuaaaauguagguuugggaggaagcugagcauuaucagagggauuguggagcaagagauucaagcaaugguuucaaagagagagaauauugccacccaucauuuauaucaggcaugggauccugucccuucucugucuccggcuacuacagguaccugagggaaagggugcgggggagcgguuguacuugggcuagaaugagagaagacuggcaugcucaccacaccagugaugcgggaagaccugaguguggucugaguuggaggcuguggugcuaaauacgcugccccuuucauaagcaggagucuuagucaggcccagggaggaaguaaaaucuggaaaugaaugagaagcauucucuccugccagucaagaaaugagaagcgaaagaauucucacgggcuguaagaccagcaggauuuaaaaguugaauuaguugcuuauguuaagaacucaaccaaguucaucuacacaagcugaaucuccagcuuuuccuaagaaaccauguguggcaguggcugcagggcagggcacagcugggccugagcaccccgcucccugcaccucuccccucccugggcccugccugucacugcccacucucccaccaagccuuccgguugugugccugcccuaucacaggcaucggagcuugucaccugguuuaaaagaagagaguuguguggggauuugggaugcacguuuuucacucaaaaguauuuuagcguagagcucugugauuccguagcuauuuaggaguuuaagcaccuugaaggcuuuaauugcagaaaguucuauguggacgugcaauguguuauacgcagugucuaugagacucaaauguuuauuagggcguugaaguaaacugagcacuuggagggccauggauccagccuucaaggagcucauaagucaggaggacccaggagcaaugaccugucauagaaggcagaaaagaggggcacagaggugggugggaggcauacacaggcagcuccuggagcuccaaggggagcaagugcuuccagggaagggggcguggaggccccuuuggaggaggcaaguugaucuggggucuggcagaggguuagcuggggacauuuagcgggaggcuggugcccgggaauuggggggaugcccagcagaaagacaugaggaggcuggccuggggcgugggggggugugaaagguuaagugggggcauuauccugcucccgcuccugccggcuguaucuggucagccugggcaccgaggugggguucuggaaggcacuguucaccaaaaugcuuaucugggucccccagagagcuugccugccuggacugucggcucgccugcaacugcugacuccuaagcuuuugcagcucagcccacaaccaguuccuauucacagaggugggagcugaggggugacaagugacugcugcagucuuauuugucauagagaaaaagugacagaguccagcuugcccacuggcccugccagcuuaacugguuauaaagugacaaauccccaagacccacagggcucugcacaaccugggcccuccugccaguggcggcgagggcagguggcucacggcugggugccugucugggcaggagcugggcugguauggggugggccugcggcccugccccccugugcagaucaagacucagggugcugguguucacaggugcccucaucagccacgagaagcugcugcuacagaucaaccccgagcgggagcuggggagcaugagcuacaaacucggccaggucagucucgcgcccccgccgccuggccucuguccguuucuguccucagacuuuggcgcuugacacacccaggagaaaagcucagugcacuuuuuaaaugaaaggaaguuuuccuuuuuuuuaaaaaaaaauuuaauguucauuguuuuuaucuguuuuauuccuaggucccgcaagcagaggaagcauuaguuuuguuuuuauuuauguucuguauuccagaaaguaguuaagagaccucacauguagcgauagagauguguguaagagacagugagagggcgugacuuggacuuaagcaaggaccgugagacacaaaaaggggggugaggacagaguggagucagcugaaaugcucaggaggaaguagacgccaugaagggccaugguauggggggccgcaggcguggccgugagugucccuggggccagcucuuggggggcucccugagugucccugucccuguggccaguucugggugggagccccgugugcaggcagacagcucggccacuuccuagcaggucacauuggucugugcuucuguuuccuccucagauaagugaagggauucaagggucugggugugguggcuaacaccuguaaucuauaacauuuuaggaggcugaggcaggaggcuuaccugagcucaggagguugaggcugcagugagccaugauugcaccacugcacuccagccugggcaacagaccaguacucugucccuuaaaaaaaaauguaaacagaaacguagggccauuugcauaugauggcacauggcguggagcccuacagguguaugcugggcggggcccggcugugcuggccgacuugcaccuuucccuccaccccggugcugugucuuucgcucaccggguuccugauuuagugaaagcaguugugcaggacaguucucuuuguagcuuuuguuucuguggaaaugggucagaauaugguguuuagaaacacuuaugagcucugagaguuuccucuucugaguuccuggccugcagccuucacagcagaaacccugugaugucacaagccuguuucuguucccugcucucugccuguacuguccuguuuugugccugccgguuucagugacaggaagcagggagcuacuggaccagccuguauuuuucuagacauaguuggaaaaagaagucccacucuucuguccuuucaccuuugacagauguuuccaccccaagauaagugaaaaugaccaauaggaugcacuguauuuuucaugaaaguguuucugaagggcaggcugagagugagaggccuggggcucacugggugccucuggccuuguccugggcccagggacacuggucugugcccgagguauucccuauccccccaaccccgcugcauuuggccacauccuucaauguuugcguuguguccagcguccgcaaaccaacugucaugggaucauacuggggcugaaguacggucccaccccugcccugucuggggcugaaguacagugccaccccugcccugucuggggcugaaggacagugccaccccugcccugucuggggcugaaguacagugccaccccugcccugucuggggcugaaggacagugccaccccuucccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucuggggcugaaggacagugccaccccugcccugucugggauguuuagccccuagaugccacuggacugagccgcuacuugcuuuugggaaagagggguggggguuaggggucugggcgaggggagugcaggggcuccuccuuggccugagagcuguucauacagacuccucgcccacucccugcagggugcugggucccaggggggaaauggcccuuggugccaagaacgugaguuggggcuagugccagugaugauggagaacagcuuuuuaugggcacacagcccacagcacugugccaagugcucgaggcuucccgagaaccaggcagaaaggaggacagucgaggugugcugacugcgugguggcugcgugaucuagagcgcgggucacaaaggcgcgagggagcucuggccuuggguuuaccgcaaugacugccagugcgggagacuggaaaaggaaucucacguauugguuccguguuuuggggacuccauucagaugucacuuaggagugaaagcaucccuucguagagccucuuucugugucacccuccucagcugcuccugggguugacuggccccugauucaugccuuuagcaugugcuggagcuucccagcagcuguccagccccugccccacccucucugugggcucccuugcccguaaccuggggugucugaacgacccuugcuaaggggcagacuguuagacgguaggcaugugcugagucccaguggccacacccacccaccaggagccuggcacuguggccgcagcacugagcagugccccguuucuguggcagguguccauacacuccguguggcuggggaacagcaucacaccccugagggaggaggaaugggacgaggaagaggaggaggaggccgacgccccugcaccuucgucaccacccacgucuccagucaacuccagguuuuccaauggccuuuuucuuuuuaacagaaauuugaaauuucuuaucagucauuugauuuguuugaggugcuucuugaaaugagccucucaucucauguacuuggaaaauacccaucucgcauauuccacaggaaacaccgggcuggaguugacauccacuccuguucgcaguuuuugcuugaguuguacagccgcuggauccugccguccagcucagccaggaggaccccggccauccugaucagugagguggucagauccguaagugagccuucccauuccccucacaccugcacgugccacacgcaccacacacgccacacaccccacacacacacaccgcccacacacaugccacuugcacacacaccccucaugcaugcaacacacacacaggccacacgcaccauagacaccacacacacaugccacaugcacacacauacacggcaugcaccauacacacaacacacacagcacacaugccacacacacacgccacaccacaugcaccacacacaugccacaugcacacacacuccacaugcaugcaccacacacacacacacacaccacacacaccacaugcaccacaccacacagguuacaugcacacaacacacacaugccacgugcacacaccccacacaccacauguaugugccacacacagcacacaaccacacacaugcaccacacacaugccacaugugcaugcaccagacacauggcacacacuacacacacgccacgugcacacaccccacacacauguacgcaccacacacaugccacacacacaugcaccacacacaugccacauguacacacauguauauacacaccccacaccacacacacaccacuugcacaccacgcacacacaccacaugcgcacacacacaccacauacgccacauguacacaccauacacacaccauacaugcaccacguguaccacgcacccacacagacacagcacacgcauacaccacacacacacgcacacaugcgucccgcacaguaaugucucuuggguguaagaacacgacuugccaguaguagcguucuggaugcguugccuggauucuaacagcgcgauucuccccuugcccuccugguuuuccacaucuccagcuucuaguggucucagacuuguucaccgagcgcaaccaguuugagcugauguaugugacgcugacagaacugcgaagggugcacccuucagaagacgagauccucgcucaguaccuggugccugccaccugcaaggcagcugccguccuugggaugguaagugacagguggcacagagguuucugugcugaagccacgggggcccaucugccuugggaccugguguuggccagaggugccgggugcggcugccuccuuccaagaguugacccgaaccggacuccacggcccacgugagcugcagugcuucucagauggaggggguucagcgacggucagugccauucacaggucacugugauguggguuguggcggccaagccaugguuuggggucccguaucccugggcuuaugacaucauuguaguagcccauccccacagaaccacggugugugguggcgcugaggcaucguagaugguggaaaugcuacuggcuuccccaugcucugcccugaggccugacugccucacuccccuucucaguuauguuccaggccccccgagcuuccuggcuggacagcuucucuccugggggccguuuugucacagugacccuguguuucuagucccaaaucugggugcuauagucucuuuuuagcguggugguugucuuagucuuuuuuggcugcuaccacaaguuaccuuagacuggguaauuuauaaacaguggaaauuuacuucucaccguucugggggcuggaaguuuucauggucaaggugccagcagauuuggugugugaugagggcugcucucugcuucauagauggcaucuucuggcuggguccucacgguggaaggagugaacaagcucccucaggccuuuuagaagggccccaauccacaagggcucucccaucaugaccucaucaccucccaaggccccaccuucuuguacuguggcacugcaaauuaggugucaguguaggaguuucaggagggauagaaacauucagaccaucccagcggucaaguguucauccucuugaguuccuccuuauucugcuucugguuuaucaggauucagccagugcagcaugguaccuguauucuguggcacaucaccacaugguauuugccaaguauccaucaccugcacacgugaaaucauugcccgugggucccgacaucuggcgaagcauauucaaggauggcagaacugucagagcuggcaccucugguuccuugucauguggcauuaccuaguaauccauuuuaugauagcaauggaaacucauuucuucaacaaacaccugaguggcugccgugugccagccgucuggggcccuuggugagaauggcaugguggugcccaucagggccugccuagcccgugcucuggacgggcuccugugugucaggaacgacaaugcugucaugacggugaaugauuuuuuuuuuugccaucacuccagccgcuaacauuugcggagcucuuccucccgcacccccaccugacaaggccaagggugaccuuggccccacccuaggcggccaaggucagagguuagcuggcuugucugggucacacaaaaugcagcagagguugaggugagcacauguccgugaccuggagccugacucccucucugcgagucuugacugcucuugccuagacucuguccuccccgagcccaaacgccagucaucuucccuuguggguguccuucagccuggugccaugcuggugacucagcagccguccagggaguggaaacaauugaguguguggguucccugugugggcaucucucuucacggcgaacacccucuggguguugcccacacgaugucaaagcggcucuuggaagggguccuucuccuuugugggaaguuucagcugcugggcuaacuugaauuguaacugugguuuugugcucaggcccagaucccccuaggcaaguguugugccaucaguaaucaaaugagaaauaaucauuuugaaaagcagauccuaaggcaggauggucauggacacucacucccagcucuuugugcacucaugcuuucuggaagauggccauccucugugaagguuuucagcgcgucaugcuugguacccacguauccagagcaugucguuuugagguauuugcccaccguugugaaauccgugccacccgagagcagguccugauguggggcuuucagaagugggaccuggggccguacgcaguccuuagggaggggccguguggcguugugcgugugaggggauagcacagggugaggugggggcccaagaaggaagugacccacaaagaacagccuccucuuuugguccuuguuccugggauggcugggaguggcuucugugucguccggccauuuccccugcggagaggcuccuaccacugccgagaaccucaucauuccacaaaaacaagaggccgccuggccauccagcgcuccaugggaauucuguguccccauagucuugggcugaaggagggugacauuccuugcugacuucugcaggggucuccucacuguuaaagagcagauugaaagugaagaacgugggcuaaguguuuaggucgauauuuaacccugcuagguuuuggauacuaagugaaauugaggccauuuugguugaaguugacagaaaccacuaucagggauccccaagacuaccccaggcuuuucuagaaagacucucagcuaagauguguuaugguaaaagcacacaaaacaaaaucagcaaagaaaauuagcaagggcagaggcccauggggcgaugucccgaggacaccaggcuugagcuuccagaauccucucccagcggggucgugcaggacgcacuuaacuccccgcacagugagccgugacagcgcgugugcagugucgucgccaggaaagcacacuagagacucggugccaggguuuuuacugggggcugggcacaugggcacccucugccugccucgugcccagacucuggacucccggagggaaggcaaguucucagcaccaacccuggugcccacacaagcagcugagcacagggagccccuccucagugaggauggugggcaccgucccaacaccagccaggggccagccuugcacacaggccucucaggauggucuccggccugcuguguagucucuucugcacacaagcgugagggcagcgcccccgccucggcuguggggaggagccacugggacgugagcucugguggcaugcagcagcuuuugucugugugugccuaggacaaggccguggcggagccugucagccgccugcuggagagcacgcucaggagcagccaccugcccagcaggguuggagcccugcacggcguccucuaugugcuggagugcgaccugcuggacgacacugccaagcagcucaucccggucaucagcgacuaucuccucuccaaccugaaagggaucgcccagugagugggagccuggcuggggcuggggcgggggucucagaaugagcugugaaggaagcagcaucacccucuccaagugcccaggcuccuggccagauggcaggccagguaucagugggaacccaggugggugccauggcugaggucagugagacgcaagagcacaggugcguccuagaggcuuccucgggcaccuccagcgagcuggagcucucgccucugcugcugucucauguggcgcuuagcacacucucccacgugcccauuccugacucugcucucgaggccaucggcucucauucucugcucccagaacccuguuauuacccaggcuagccuccucucugcaccuuccccgcccuggcccaguaccucccucuuguuuccacugugauuccgaccucaccuuaucuuaaagcugcuggacggcagguucuguacacacguguccuugacaaagcacggcuggugccgcaaccccucagcgagcaagucaagcucuucacagcgaugucuuacaagcgcagagggcucugugacacccuggucucaccgccacucuuccaaagucgcagaggcuuuagcagagaugggcccagccucucugagucauaggcuucugcacacgggagcugucuuuagagggaggguggaauuucaucagccacccacaugggggaguugagggcaagaauuaggagcaaagaugggaaggggucugggaggaauggccagugauccccuuugacaagugggcaggaaacgggggcuaggucaaaguugaguggaagaccuggagggagacgggaaggucucuguaggcacaguucagacaggagggaggugugagccagggcacaugccgguggccgucuggcaggauuugggacaugcuggagcagggacagcggcucaucaggggccauugcccucauccaggccagagugucacaagcccguggggaggcccuucucgccugucauccuugcugggcagugggugcugugcuagcaggacaggcggacggcuggcaacugucucugcaucccuggagccuggcauagggccaagucacacggggcacaggccugcaaaucaggcacauauguuggugcagugacgugauuuuggggggcagccccagaacaggccccagacacaggccaaagcccugccugugcugguguguugggcuguucuauggcucuugcugugggcauggaggacucagggaaggagaguugaggugguccaggaguugcguuugggaugcagagagcuuguggcauccagguagaaauggugcguggggcugaccucagcaccaugggcagaggggccgugucacgugccuccgagguggaggugggaccacguggugacagauauacgcaucacugggcacguuuuuguggguguuggggggcaucguauuggcuccucuguucacaguggccacucauucagucccuggcuaccagguccucacugugccauggggaaggccggcgcugucgggggaucacagaaggcagcacgucaugauggcaugugccaugaaggaaaagcacagggcacucaggaaguagaggggacuggccuggggugugggaaucuagggccucguugagggacagagagaggaagugugugguggccagcauggagguggccacaggggaggcugaguuaggccgagagggcagggcguuggggagguagacgggcucagccacucagggaguggucaagcagaggcugaagggucaggccagguugcaggggccugggggagccacucaggguaggcgcucccgggagcccgccuggcccauagcucuacacucccgcguggggccggacaugcugugaagcccucuccacguuggauggggguggcugagccuggaugcugucucccguuuucagcugcgugaacauucacagccagcagcacguacuggucaugugugccacugcguuuuaccucauugagaacuauccucuggacguagggccggaauuuucagcaucaauaauacaggugagugggcccuggcugucuuccucugcacacggggagugggcuucccuucucuuuuccuugcaggaucauaccagugggccaguuuugacuuggucgggaggaggcaugaacaccugagacugugcagcgauucuuugacacagaggccuuucucccugugcagauguguggggugaugcugucuggaagugaggaguccacccccuccaucauuuaccacugugcccucagaggccuggagcgccuccugcucucugagcagcucucccgccuggaugcagaaucgcuggucaagcugaguguggacagagugaacgugcacagcccgcaccgggccauggcggcucugggccugaugcucaccugcauguacacaggugagcauguacacggugcccauaaggccagcccaaguccuguucaagggaggcaggagcaugcucacucaagggaccucgacuaggugcccucugauuucacacuucugguguugccccaagccggccccaucaccuugcaagaaaggcucuggagcccccagggcuggaguaccuggucaggguugaccgucccuguggucacucaucccauguggcugagcugggcuggguccugggcaagcaaggggcugauaucaccugcuuucagaucuccagggacucacuggaccccuguguacaaagcacugucuacagagccuauuggguuguauagagguaaccuucguacugaacacuuuuguuacaggaaaggagaaagucaguccggguagaacuucagacccuaauccugcagcccccgacagcgagucagugauuguugcuauggagcggguaucuguucuuuuugauagguaagaagcgaagccccaucccucagccguuagcuucccuagaacuuuggccugaagcugugcuuuugugugugucugcugauccccuggcgcuguugcuggaguccugccagugauuccccaccacagccugaccaugggcugccuuggcucaggguuccacuggcgagcuggugguccuuggaccccagcacucagguguagcguugaccaguuccaagguugucccagugccugcccaucucuccugagggcucagggacaguaccuggcaguuggggguguggcagggggcaggaaugaccagccucugggaggguggggcagaagccuguacagugaggaggagcuggcucagccuggcugccuaucgugagaggggagcccacggggcugugggaggggggccguggugccugugagcagggugaggagcagcggcaggaggaugaagguggaacccacacaugcaucuuugagacccguguggucaguggcuucugccccccaccaccccccacugcugugcgugcauagaauuggcuucccucaccugcucuggaaguggguuaggagcuugguagggcuuuuucucaaggacaagggccccugauuugcucucaggccucaguccuggcgacaugguggaucuggagccuuguugcacugccuugccugugcucuccaaucaggguggccaguggggagccauuuggcuuuucucaagagcauacucagguggaccuugcuccacuguuugaccagaugaggcauucugaacagccaagccugugcuggucuguuuucauguugauuuuuuuuuuucuuuucuuuuugagauggaguuuuucccuugucacccaggcuggagugcaauggugugaucucggcucacugcaaccuccgccucccggguucaagugauucuccugccucagccucccuaguagcugggauuacaggcacacaccaccaugcccagcuaauuuuuguguuuuuaguagagacgggguuucaccguguuggcugggcuggucucgaacuccugaacucaagugauccacccuccuuggccucccaaagugcugggauugcaggcgugagccacugcgcccggcccccaugucgauuuuuaaaugcaccucugcaucguucuucaguccccauaugcucacugagcaccacugcgacuggcagacgggcacagggaggcgccacgaccaguccuggccuucaaggggcuuguggucuagugggcccaaugcuagguggcgagugcuccaaagaguguggugcacgccuuccgcuugaccgcucuccagacgccacagggaggcaccucgcagcugaccacagauuucucucuguggagcagugucuucagagcggcugccaugccacugcugggcgagggucugcgggcggguagagccaggagcaccugugaggaagugcacugccauuuucguagcugcuucccgugugucucaguuacacacggcuggcaugugugcacugaugagacgggaacgugaugguugcuuuucagcacugaaagggauacugcucagggggcguguuucaggaucugguuagggaagaagcagcgagagcacagauggggcccugugugguaacaagaaaaaaguccugguugacaacagugccacgaagcguuagaacacauagggauguuuguggagcauuugcauguggaaagcagcaaaaacauaaugggaacggguucuuuuguuaugauuuuuaaaaaucucuuuuguaacauccuucccgcugcgccguuucugcauauuccuuuauguagcuuucaaacuccucuuaggaguucuggucccuacagggcgugggagcccaggcuuuacguagcuuucaaacuccucuuaggaguucuggucccuacagggugugggagcccagggccugugccgagcagccugccuccacgagcuagacagaggaagggcugggguuuugccuuuuuagucucaaaauucguacuccaguugcuuaggcucugacuuuccccacuuggaaagucccucacggccgagggucccucccagcccugauuucacaucggcauuuuccccaguauuagagccaaggcccuccgcgggcagguggggcagcugugggagcuggugccagucucugaccugcgucccuccucccaggaucaggaaaggcuuuccuugugaagccagagugguggccaggauccugccccaguuucuagacgacuucuucccaccccaggacaucaugaacaaagucaucggagaguuucuguccaaccagcagccauacccccaguucauggccaccgugguguauaaggugagguugcaugugggauggggauggagugggaaagccuggagguggaguugccuccgacuucccagcagauucgccagcagagcccagcuccuccgcuuuaaagcagcaaugccucuggcccccaccccacccccgccacccaggcgcagcaggugcuucccguccccccagcccugacacucaggcaccugcuugcuccuugcagguguuucagacucugcacagcaccgggcagucguccaugguccgggacugggucaugcugucccucuccaacuucacgcagagggccccggucgccauggccacguggagccucuccugcuucuuugucagcgcguccaccagcccgugggucgcggcgauguauccucucugggucccuggugcuggccccguuucccuugucaacaccgaggcucauguuucaugauaagguuuugaaaccuaaccuuugcaaaaaccccacagaugccagggugacaggcccucagccccagggaaguaaaaugcugacagggguacagaaaggagcacguccagacauuugcugaccagggccucucagaggggccgguguauggcaggagggucgcagcugaggggccuuucuguggagggccugggugaggggagcgagggugggcgguggucucugcagacgucccgcccacucgcgggcucuguguggcugggcuucuccugacacugcuucucauuagcuuuggucauugugccucgaucgcccucucggggaaaggcuuaaguaaagauccaguucccacccccagaugcuggcugccaggaguuucccuuuccacagcccuuccccaagacagaccacaagagccuccaagcagcacaguuguccuggugcugacagcacagccuugcccggcgugccuggcacggcucugcccucacugcauuggagcagggcuaguggaggccagcggaagcaccggccaccagcgcugcacaggagccaggccaggugagugcugccgagugggugcccugccugcagggcauccagccagccaaggguugcaggaauggagguggaggcgcugaugcagcuggaggcauccagguggcccuuccggggcucugcucgcucuccaggcucccuggaccccuuuguagacuguuucaggagaggaacucccaggugaggacagggaggcagcauuccccucauuugccggccuuuuuccuuaacuccugcaccagccucccacaugucaucagcaggaugggcaagcuggagcagguggacgugaaccuuuucugccuggucgccacagacuucuacagacaccagauagaggaggagcucgaccgcagggccuuccagucugugcuugaggugguugcagccccaggaagcccauaucaccggcugcugacuuguuuacgaaauguccacaaggucaccaccugcugagcgccauggugggagagacugugaggcggcagcuggggccggagccuuuggaagucugcgcccuugugcccugccuccaccgagccagcuuggucccuaugggcuuccgcacaugccgcgggcggccaggcaacgugcgugucucugccauguggcagaagugcucuuuguggcaguggccaggcagggagugucugcaguccugguggggcugagccugaggccuuccagaaagcaggagcagcugugcugcaccccaugugggugaccagguccuuucuccugauagucaccugcugguuguugccagguugcagcugcucuugcaucugggccagaaguccucccuccugcaggcuggcuguuggccccucugcuguccugcaguagaaggugccgugagcaggcuuugggaacacuggccugggucucccugguggggugugcaugccacgccccgugucuggaugcacagaugccauggccugugcugggccaguggcugggggugcuagacacccggcaccauucucccuucucucuuuucuucucaggauuuaaaauuuaauuauaucaguaaagagauuaauuuuaacguaacucuuucuaugcccguguaaaguaugugaaucgcaaggccugugcugcaugcgacagcguccggggugguggacagggcccccggccacgcucccucuccuguagccacuggcauagcccuccugagcacccgcugacauuuccguuguacauguuccuguuuaugcauucacaaggugacugggauguagagaggcguuagugggcagguggccacagcaggacugaggacaggcccccauuauccuaggggugcgcucaccugcagccccuccuccucgggcacagacgacugucguucuccacccaccagucagggacagcagccucccugucacucagcugagaaggccagcccucccuggcugugagcagccuccacuguguccagagacaugggccucccacuccuguuccuugcuagcccugggguggcgucugccuaggagcuggcuggcagguguugggaccugcugcuccauggaugcaugcccuaagagugucacugagcuguguuuugucugagccucucucggucaacagcaaagcuuggugucuuggcacuguuagugacagagcccagcaucccuucugcccccguuccagcugacaucuugcacggugaccccuuuuagucaggagagugcagaucugugcucaucggagacugccccacggcccugucagagccgccacuccuauccccaggccaggucccuggaccagccuccuguuugcaggcccagaggagccaagucauuaaaauggaaguggauucuggauggccgggcugcugcugauguaggagcuggauuugggagcucugcuugccgacuggcugugagacgaggcaggggcucugcuuccucagcccuagaggcgagccaggcaagguuggcgacugucauguggcuugguuuggucaugcccgucgauguuuuggguauugaaugugguaaguggaggaaauguuggaacucugugcaggugcugccuugagacccccaagcuuccaccugucccucuccuauguggcagcuggggagcagcugagauguggacuuguaugcugcccacauacgugagggggagcugaaagggagccccuccucugagcagccucugccaggccuguaugaggcuuuucccaccagcucccaacagaggccucccccagccaggaccaccucguccucguggcggggcagcaggagcgguagaaagggguccgauguuugaggaggcccuuaagggaagcuacugaauuauaacacguaagaaaaucaccauuccguauugguugggggcuccuguuucucauccuagcuuuuuccuggaaagcccgcuagaagguuugggaacgaggggaaaguucucagaacuguuggcugcuccccacccgccucccgccucccccgcagguuaugucagcagcucugagacagcaguaucacaggccagauguuguuccuggcuagauguuuacauuuguaagaaauaacacugugaauguaaaacagagccauucccuuggaaugcauaucgcugggcucaacauagaguuugucuuccucuuguuuacgacgugaucuaaaccaguccuuagcaaggggcucagaacaccccgcucuggcaguaggugucccccacccccaaagaccugccugugugcuccggagaugaauaugagcucauuaguaaaaaugacuucacccacgcauauacauaaaguauccaugcaugugcauauagacacaucuauaauuuuacacacacaccucucaagacggagaugcauggccucuaagagugcccgugucgguucuuccuggaaguugacuuuccuuagacccgccaggucaaguuagccgcgugacggacauccaggcgugggacguggucagggcagggcucauucauugcccacuaggaucccacuggcgaagauggucuccauaucagcucucugcagaagggaggaagacuuuaucauguuccuaaaaaucuguggcaagcacccaucguauuauccaaauuuuguugcaaaugugauuaauuugguugucaaguuuugggggugggcuguggggagauugcuuuuguuuuccugcugguaauaucgggaaagauuuuaaugaaaccaggguagaauuguuuggcaaugcacugaagcguguuucuuucccaaaaugugccucccuuccgcugcgggcccagcugagucuauguaggugauguuuccagcugccaagugcucuuuguuacuguccacccucauuucugccagcgcauguguccuuucaaggggaaaaugugaagcugaacccccuccagacacccagaauguagcaucugagaaggcccugugcccuaaaggacaccccucgcccccaucuucauggagggggucauuucagagcccucggagccaaugaacagcuccuccucuuggagcugagaugagccccacguggagcucgggacggauaguagacagcaauaacucgguguguggccgccuggcagguggaacuuccucccguugcgggguggagugagguuaguucugugugucugguggguggagucaggcuucucuugcuaccugugagcauccuucccagcagacauccucaucgggcuuugucccucccccgcuuccucccucugcggggaggacccgggaccacagcugcuggccaggguagacuuggagcuguccuccagaggggucacguguaggagugagaagaaggaagaucuugagagcugcugagggaccuuggagagcucaggauggcucagacgaggacacucgcuugccgggccugggccuccugggaaggagggagcugcucagaaugccgcaugacaacugaaggcaaccuggaagguucaggggccgcucuucccccaugugccugucacgcucuggugcagucaaaggaacgccuuccccucaguuguuucuaagagcagagucucccgcugcaaucugggugguaacugccagccuuggaggaucguggccaacguggaccugccuacggagggugggcucugacccaaguggggccuccuuguccaggucucacugcuuugcaccguggucagagggacugucagcugagcuugagcuccccuggagccagcagggcugugaugggcgagucccggagccccacccagaccugaaugcuucugagagcaaagggaaggacugacgagagauguauauuuaauuuuuuaacugcugcaaacauuguacauccaaauuaaaggaaaaaaauggaaaccauca

SEQ ID NO: 191467 - RNA, 243023 nt, Homo sapiens
gugccagcucaauggggccgccgaccucgaaguuuccgaagguaagcgcgggcugcagggcgcccggccccgccgcuccggagccgccucgcgcccaccccgccucacccccagccccgcaggaccucacccugcccggggacgcggcccucgggugcgggacucccgcgacuggaggagagggcgcgucuucgcgggccagaagcgagacucagagagcccgggcaccgaccccggggcgguccuggggcagggcuggcucugcuaggguccgaagugccggggucccuccggagcgcgugcucucggggucuugagggaacccgacagaaccggcuuggaacccugccuccagcacuugcucgccgcgcgagccagggcagaucgcuccaccggugucagccacagcgucucggccgagaaccggcgcgcucgagcccccccucgcugcccggcugaaggugcgggcgcgggguccggcucggaguccgggguaagacccaaugcggcggaguucagucccggccgcggguaccauccagcagcgucuacgcgcuccucccgcugcccgcgccggugggugcugagucaggcccggcugcugcucugguuuggagaagccuuuuuuuuuuuuuuuuggcuggcagggacaguccaugacaguggcgcgcccagagcccgaagagcguuggugggauggacagcugcucucgcacccugggaagugacccggguuggcuuuuaugcggagggucccagggacagggaccacacacucuguggcccgagacgcugccccgccuggauugaauccuagcuucgcccugaccggccggguggccuucagcaaguggcuuacucucucagggccucaguuucucuucugugaaauggggaugacguugcuuagcgggcaagguuguggcagagauaaaagaagaggccuaugggggguacuggugagggcccaggaaucuguuuuugcuuucuucccuccucccuucaggggcccagugaggugggugauggaagguacagagggcugguggaccgggguagggugcuggucucugucacuuuauauaacaaacacacuguuccaagagcuuucaaauauccaacccccccccccgacuccguugaauccuccccacauuauccccauuauaggauaaggaaacugaggugcagagaaguuaaguaacuugcccgaggccacacagcugccagugggagagcuccagaggcuguggcgaguccucuuuggcaugugcucacacugucacgggaagacaucacagggacacugucagcaacauggaggggacgggcuguggcagggaguggggcccguugcccacaggugagcuccucugucagcugucagugccccacaaucugcugcagcugccuccucagucucauugucccccgcacucugaccacgcccuggucgccugcucaugcucagcucccuccaggccccugaaugugucuguuuccuaccucccugcuguggagugaggguuuccgcccaccugggaugccuucucugucccagguguccucaccccugggaauacccucaccccuugagggcagggacuauauccggucaugucugcaggacacugacugugcuuggcaaaucgcagcuucucaguguggaauuguugacugucgauuagugagugcgugagugagugaaugccacauggccuuucucugcuuuucagaaaagggguaggcaggcucgauguagaaccuucuucagcucucuuaggacucccuagagccugcuugcggcuggcaaugggucacggaagaucuuugggcugggagucagucccuggguucuaaacgccaguguguguauguauccauguauguaucugugggugugucuguguaucuguguguguauccaagugugucuguguagcucuaugucuguauaggugugucuguguguguguuugugucucucuccguguguguagccauuaagcucuuuuuggaauaaaaaaauugcaaaaugaaugcaugaucaccagcaucuuggaaaaacaugaaacaauauggaaauaguuggaguaaaaggugcaaguccuccccucccccuccccccaccuccuuccgacccaggaccagcuacauaauuuguggggcucagugcaaaaugaaaaugcagggcccuguguucaaaaaguaggggaaagugugguuaaaagugcucacuuucuccugcacucucucuccgccugucauggugguuuuauuuccuguguaacaucguguuccuuugggcauggggaugcuugcagggugagugcagacucuugcaagacgccugucuucuggccagggacagggaaguugagugucgagucaggcauuuccccuucccacagguccacaggucgaugccccaauccauggcagacagguaccccacagggcauugcagccuugggguugagacaguugguaccugauguuccugcugaacugcccaccgaacacacaguggcacugccagcccagggaagggcggucaccgccaugauccaccccaggaugcacuggggugcauacacuccuagacccagaccccugccaggggaggagggcagcagugacacugagacaaggcacaaagaggaggaagggugggguccagggugccagaggccaggggagcagucagcugagaacccagguuggggagguggcaggaggcaggagcacacgcuccaugcucacagcacaggcucugcuguuccaucagacauugcuuaggaaacacacauucaaagauucagcugucaggaauuuuaugacucugcagagccuuaaaccccaagcacgagccccuuccaagcaugaggccuguguggcugccugggucacacacuugugaagcgggugcagcuccaaccccauggcuguggauaggcacagagcuccaguaacagcagccaacacugagaggugcuuuguaggauccagggacgcuuccagugcuuccuagguaugagcugcuuuccuuccgccacaaccuggugaaaugggugcucuuguuggcuccguuuuacugaggcacagagagauuaagugaucugccugaggucccacagcuguuaguggcggagagccuuucaguccucccccaaggcuuguccuuggucacucuaccccaccaccucucaacaagggccuggagcucacugcugcugucagaaaaaaagcaaaucuuauuuuuuucauuugccaguauggaaacgccccuggcuuggaguugcuuccagaagaacauagaaguuccagcccuuagucugguagccaagagccugggugggcugggccuggggggcugugcacuguccccugcuugcccuccuccaggagggucuugcaugggucuugcauggggcugcucccugcccuggggcaccccugccccugccuugccuggcuaacgccugcauagccuucaagggccccaggaugccucuuccuuggugggcuuccccugugguucccccaacaccuuaagggacaugucaauuuugacguggaauccccaggguuugaguugccccuuggggucacacaccacauguuugaggagugaauggaugaaauggccugaaaucugauuagcacauggaacacaguucaggaagggagcugucuuaguccguuggggcugccguaacaaaacaccauauagccugggcagcuuaugaacaacacagguuuauuucucaccguucuggaggcuggaaguccaagaucaaggcguggcggauucagugucuggugaggaccugcguucugguucacggauggugccuucuugcaguacccucucaggguggaaggggcaaaugagcucccuugagucuauuuuagaagggcacuaauuuccuucuaauuguuuccccagggcccggcuccucauaucucacauuggggguuaggauuucaacauaggaauucagggggacacaagcauccaguccacagcaggggggauuuuggaggaaguuaugcauggggcaagaauuggguuaagguguugggaguguaguuggcacagugaucacagaugcugcguguugcaaauuugcagcccugggugaaguuuaaucucuuugccucuguucugugugugugugugugugugugugugugugugugugcuguguauuuuuucagaacugccauuuauugggcacuucugugagccuggcacugcacgggcacuaugcacuauacacucuaucucacuuauccucaagucaacuugugaggguguggacgugcccacugcccccgguuuuacagaggagcacacugaggugccagugaugugcuccaggcugcuuagcagugagagauggaucugaaccuaguucuuccugccuuggcuggacugcgagcugcucucccaguguuuaaauuuagguucuguucugugauuccuucucaggaaacugcuauugucagggcugccugcucaucagagccccugucucagcgcaguguuccccuggcauugcagagccacagagcugggagccacuguugcugucuuuccugugcacuccuggcuggaggcuggugucccaucagagccgcagggcuggguggugaauucccaggaugggcaccugugagggugcaaggucagaaaaaaagaugacgcugggcuuugggggcugugauggagacucacuggguggggcaucuuuagaugggaggccaggcagggagacacuguggaaauccuuuccugggucuggaguggaccgguugcccaggucuucauuccaagcuuggcucggugcagggcuccauguugagugggguguggcuucaugguggggacacuguugcacucuuugcuggcacuccuggucagaggaugguguccaucagagccucuuccauuguguaguuccuggcugccaaagaaucuuucugcggcaagaaucugaaauccaaccuaguuugacccaagcacagaguugaucaggcugaguauugggaaguucaggggaugcccugauauuuuaggaggcugagcacagguggccuucuccuuguuaggaggcagccagagguggcagguaaaggcucacacaccugcaggucccaggaggagagaagagggcucuuuguaagcccugagaaaggcuucuccuugaccuugcauggguggccuucccacugcagguacaauuucccuguccccauggauggcucucccaagcaaggggauggggccccuuaagugacagccccaccagcaccccaggucacagauggcagcugagaguaguguuaaucuucuuagcuggcacuuauggagaacuugcugcaugcuuggcacaggcagagccuguuagguguaucaggcgcucacucgguguugggaugcgaucaucacagccacuuugcaggugaugcugugacauguggugagguugggagaagucacugccccaagucucaccgccaggggcuguccugcugggcucgggcaccuuuaagaggaugggugcugaggcugcucagaagcaccuggccgccuccuuccuccugccuuccuguccacaggggaggaggagaggucugggguggggcuggggaggguuugccuggagucacgcagcaggugagaguagaaccagggccugugggaugcaccucacuccaggccagcguccguugugcccgcccaugucaucugggucuccagugcccagguggggaauauucugcaguagcucacccucagaucugccuccucuccuucuucaucucuacuaccccaggucaagccauugucuccucuucuggacuacuugagggccucccaauccagacuccccuuucaacucccuaaaauaaccaugcugaccucugcugugcccaucuccacagcgcucacuacacagcagccuuuuucccgaccuugguacauccugggcucucuccugucccgggcccuuugccccugcuauucccucugcuccuggugcuaacccagcacucacucuaacucauccuucaggucgcagcuuccauguccucucuccagagaccuuccuugccucccagcuaaauacgucccacccagggagucuccaucacuguacuccggguccaacgucaucaucuuuucuuuucuuucuuucuuucuuuuuuuuuugcugaccuugcacccagcaucuccugacuauaagaucuguaagaacucaucuguguucucggagccuggcucauaguuccuguuguuguagauguuguuguccuaaugcaucagguguguuuggauaacaccaaugagugguucaaauauucuucccagauucuaaugucagugcugcaggaccacaauacagugaauuuaaagugacuauuucuacucuuucucaggaaaggaaccuauuagcaaguacaguguaguuaaaaaugaccuccuugaaggcugguaccuugaauccuccucgguaucuucuaaggaggcuuguaccccuuguuccuuuccagccccagcuucucucugcccuggucugugccuggaaccugauccugucaaauuuaccaccuggaucucugccggggagucuuuggguggguuuugcccacaggaggcauugccaggagcugggagggcagguggagagagaaguaggguugccgccuccuucccccuucccuccuuuggaggagggugcaguggcugcauccuucugugauaauaaccaacucaggggcaccccgagagaugcuugcagauucucccaggaggcaaaacuucagggggagaaucugguugcucauguugcuggggaggaaccacagccuggaguagggaucuacacuaaugcauggguuggcaagcugggcagggcucuggaaagaacaagguugcaggaugaugacaagguggccuggggaagagguguguggauggaccucucaaaugacugcagagcaugagguauuugugcccuguaguagucaggguucuucagagaaacagggccaauaggaucacugcacgugugcgcacacacacgcacacggaauuggcucaggcaguuauggagcugagaaguccccugagcuccauccggaagcuggagaacuaguuguucuaguuugaagguuugagaaccaggaaggcugauguugcgauggugugagugccaaucccagggcaggagaagacugaugucccagcuccagcagacagacagagagagugaauucucccuucuccugccuuuuuguuccauucaggcccugaacaaacugggggaggcccauccacagugggauuacuuagucuacugauucaaaugcucaucucuacuggaaacacccucacagacacaccuggaaaugauguuuagcaugauaucugggcaucccguggccccgucaaguugacacauggaaugaacccccacgugccccaugcggaugcuccccagaggcauccuucacgcaggaggcucucggucacaggauagacacgcuagccugccugugggugcugggcagacucuuuccagccaccccagggcucacucuugggcucacacacaaaauagggcagagauggggaaacacacaggcagaaaauauggccuucaacucuccagggcugagcuggccacugccacagcugaggucccagucuccaacaucaggggacaacagugacuuuggguguggcagcauuacccgaggagaccagcaagcacccggggggcagguugguucccuuguucucaggggggcggaugcauaagccagauacagaaucgccuucccacccgcuucugucagcagugucauuguggaauuccuaauucacagucaccgucgcccacaagcaucacaucauucaaaggauuccugcgguggugcagagcugcggcaaagggcccucgcccgugggguucacucucaucacccagaagcagggagaagggccugcggcugcaggccuggcugccacaccggccuccagacaacacacagcagguggggccuuguccuguaugccuuagaucagcggcugacuguuuugugacugucaccugcacagccacauacacagguuugaggaccaguggauggaguuaggaggagcccuucacuggcuuauaaucacuagggugucaaauaauuuaucauccaaagugggguaccuuagagaaugaaaggguguguuaugaaugauugcacagggcagccccagacguggccacuguguuaguguguuggggcugugugguggucugaauguucccaucucuccaguaguccugugcugaaaucuacccaccaacagaguauugaggguggggcuuugggaggugauuaggucaagaggucaagaggguggagcccuuauaaaagaggccgaggcagauaucuaccaugugaggacgcagugagaaggcgccauccuugaagcacagagcccuugucagacacugaaucgaaucugcuggcaucuugaucuuggacuucucagccuccagaauugugagcaauuucuuuuucuuuucuuuucucuucucuucucuucucuuuucuuucuuucucuuucuuucuuucuuucuuucuuucuuucuuucuuuccuuccuuccuuccuuccuuccuuccuuccuuccuuccuuccuuucuuuuucuuuuucuuuuuuuuuuuuuugagauggagucucacucugucacccaggcuggagugcaguggcaugaucuuggcucacugcaaucucugcuuccuggguucaagcgauucucgugccucagcuuccucaguagcugggauuacaggugugcaccaccaggccuggcugauuuuuguauuuuuaguaaagacaggguuucaccaugcuggccaggcuggucuugaacuccugaccucaaguacucugccugccuuggccucccaaagugcugggauugcaggugugagccacugugcccggccagugagcaaucaauuucuguuauucauaaacuacucagucuaagguaucuuguuguagccgucuacagacugaggcugccuuaacaaagcacuacacacagaguggcuugaagaaaggaaauugauugucucaugguucuggcagccagcagucugggacgaagacgauagcugggucaguuucuauggaggaauuagagggggaaucuguccuguaccccucucccagcuuauugugauuugcuguccaucuuuggcauucuuuggcuuguagauggugucaccguggugucugccuuucucccugugccugucugucucuguguccaaauuuccucuuugaugagggcacccgucauuuuggauuggggguaaacccuacuccagcauggccucauuuuaacuaaugacaucugcagugacccuauuuccaaauaaggucacaugcugagguauuguggguuuggacuucaaugugaauuuuuuguggggagagcacacaguucaacccauagcagucacccccugauaaccccuugaacuaauuuugcuucuaguucauuaggcgugguguguuuggggguccuggugccccaagaaggaaggcuuccaucagggagcagggccacagucugugaaaguggacacugggaccgaggccauuuggacuccugcugcugcuggguggccugguagagaagggggcacugggaugaggggugacugcuccuagcuaccaaggauaaaugaggucacuucuuggugguaucuggggcccagaggauccacggggaugcuucuuagcacugacaucugauaaaaaaggucuacugagcauggcagcccugaacauagagaugggagcaugacagacccagaucaugggugaaaacuugggucguucccccaggugaagaaccaggugcucuggcacaggcaaggugccuaucgguggguggaggaagaaggacucgcugcugauuggcccuuuuuccccugcccucaucucuccuggccaccuugaaugaaggcuaccugugguggacaguguggugcuguaggcucaaggcaggcaucugaaguggcgucucccucaaugauaccguugcuggugggaccccgugccuuacuguguugggcugagaguuucuucccggauagggggacgaggauguuugcugaguggccacaguggacugcgcuggauuucuccacuugacccguagaucuauuuuucaccucucuguccaguguggugcccuggaggcugcaucaccuguggucccugcccuaaggcucccguggaguuuggccagugggaggcaccagucagagcuugcagggcaggagggagagggggaacacuccccguucuucucccugcgguggcgcugcaauccuagggucggcugugcucuccauggucacagcuugugccaguggauccugucucauggucccaguucucuuccccugcaccuuucagcccagggaguaacagccuccuguccuugcccuuagucccuaugugccccaaaugcuuccuuggucacuuccuguaggucaccucuuuguuuacuucucuucuguugaacuaucuggggugaauucugccuccagugagaccccaacaucuauggaggccauuggaacuggggcauguguguggccauucauccugaaacuggcucuugccucugcuacucacaugacaucaggcaauggccccaccuuccugagccuuauugucaaauuaggacaauaaaguccacuuuugcaggauguuugugaguguaguggaaagaauaaugccccccaaagauguccacauucuaauccccagaccugugaauuuguuaccuuacauggcaaaaggaaguuugcagaugagauuaaguuaaggcucuugaguuggggagguugaccuggauuaucuggguaggcccaaugucaucacagggguccuuauaagagggagguaggagggucagaaucagagaaggagaugggaugacacaagcagaggagagaaagaggaagagagggagaagagaagagagggagaaagaaagaggagagaaagaggaagagagggagagagauuugaagaugcugagcugaugguuuugaagauggagggaggggucaugagccaaggaaugcggacaccuccagaagcucgaagaucaaggaaacggauccuccccuggggccuccagcaggaaccagcccugcccacaccuugacuuuagcccagugaggcugauuucagacuucugaccuccagaacaguuagagaauaagcuucuguuuuucuaagccacuaugguuguggaaauguguuacagcagccauagggaacuuacacaaugagaacaaaugaaaaaauugcagggagacugccugcauuucagagcaggugccauggaaaugauuacugcauuugggaacagugggcucaggucuccccuuguggcaaaaguggaccuguaggcucagauguguagcacacacagcaccugcugucuuugcugguccuuugcugccacuugucucaucuucacucacaucaucuuuuccuuccacuuccaaagucucuccacuuucucuccaguuaucuguggcuuccuaacaaaugaucccaugaugugccagcugagaauggccauuucauuguguuucaugguuuuaagagccaggagcugaggaagggcucagcugggugauucuucugcugcauguugccuacaccgaggucgcuuguugguguucagcuggaggauggacugggcuggguggcccacaguggcuucccuguaauuuauggugccuugguggggacagcaggggcugagcucagcugggacugucaccugagcccugacauguggcuuguccagcauggcagcccaggguggugggacuccuuccauggugcucaaguuuccuggugcaauguccagggaacaagauggcaguuguguggccuuugaugcccagcuuuuggugucccagagcuucauuucugcuaggcucuugguugagugggucacaggcccaccagacucaagaggaggaggcauagaccucaucucuugauggggggacuuguggccauaccacaacacuuuaccucuaguuuuauuuucuccuuuuccagcugggaguuucaguuacuuuucucccacuggacuccuauuggcuuuguucuccaugccacguguuuguucauucauucuacaaauaucaccugagcacccacugcaggcuguggucugugcuggaaacccagagagcacauuaggagcaugugacauacaugagcacucgugacuugccaggggcuuucuaagugccuucugaggccaaguagccuccaaucccccuggaaggcagguauguuucuuauccccagcuuacacauguggauacugcagcacaaaaggggaagaggcucaccuguggcugcugagcuaaccugugggagagugggcuuugagcucgggcaaccuaacuggagaggcuugugcauaaccaccaggcuccauggccccggaggcgaggaagguauggcaauugaccuccaggaggacucucuuucuagagagagaccaaaacaaaaguguugcucuagcugggcacuguggcucaugccuguaaccccagcacuuugggaugcugaggugggaggaucacuugaggugaguaauucaagaucagccugggcaacagugagcccuuaucucuauaaaauauuaaagaaaauuagcugggcaugguggccugcaccuguagucccagcuacuuaggaggcuaaggcagaaguauccauugagcucaggaauuugaggcugcagugagcugugauagugccagauguggagcuguacuccagccuggggaacaaacaagcaagacuccaucucuaaauaaaaaagagugucccccuaagaugcucugcgaaauauuguagacugguugcccuggagccucaugcagggagugaggaggggccaggucugucugugcuucccagaguagaagauauuaagcuagaagaaugaggggaaagcauucccggcagaggaaacagcacguguuucggguuggcguuguaggagugcauggcuuguuagugaagggugaaguucugugcagcugggcguagccuucccgggaggaagcagugagagcugaggcugcagaggguagugggggugucuuggcaagggucucaugugcuggccugagggcacuguggggagggggcagacuugguaacugggcugggggcugauugugucugugcuuugggaugugccggcugguggcugugaggaggggaacaggaagcuuggagguggagaagguggguugucauccaucucauuccaccagugggggacggggaggcucagagaggcugagugacucacucaaggucaugcaggcagugagcauggaggugagacuggggcccaggcccgugggaugagccauuggcugucccccuaccccgcugugaccucagcugcaccucgugcugcggugacaaggugacagguuaaaaauaaagcacuguggugcugccagaccuuuauuggcacagggugagggcugguuaugucacuuuaaagaaauacuucucugcaagcaucaguugagcauguuucuccccagauauucaccugggaacugagucucgagaaauaacguucguuacagcugcugucccauaaggacugucagggcaggcucaauaguggccaccacugaauaagugccuacugugugccaggcccuacgugggaaaguagcucauaccuuaaagcucauccgugggcuccagcuacugcccgugcugcaggugccucccguuauccucccuagggaugaggagggguuacgugaggucacacagccagcaggugucaucagagcccacugcucucagggcugcaaaccuguggccacucuacaggagcaggaaggagccgguguuaucagucuggcucugcagguggagaaguggagggucgugcccaggaaggcacaggugaggggcauuucacuccugagggccucaccuucugugauucugccugggacucccuucccuguaucuuugucauuauucaggucccagcugaaaagucaccuccuccgggaggccuccccggaccacccuccaucuggaguugucugucacuggauccaggugcaaagcucuggaaugaaaugagccuggcguguucuguggcagcaaggaggcugguguggccaaagcagagagugggaaggguggggguggagguggaaaaacgacgugguccaauuuccauuuuuacagcgucagucugccugcuguauggggcauggacuuuguggggggcaaagugagaaccaggggaugacuuuggaggcuacugcaguguaggagugagcaaugaugguggcuuagaccaguggcuuagcuccagaggucuggacaggauuaaccaauuuauucaacagauauuuaccagacaccuugcacgugggaggaacugagccaaugggggaucugucagugaagggacaaacacauaaacauucaagagcauguuggggugacaguacugcuaagagggaaggcggggagagggcugccaagggacgggcacuguucauuuagggaggugggcagaaggaggugcgaggcucagaucccccuucaagaaagacuuugcuguccagccucagggcaggcagucgcuugacugccucuggauuuuggcaucuucaggaucugccucucccacugaaccaaggcuguucuuucuggcagcccucagccaaugacugcccccuggagggauuucuagggccugcccauuucugcacacaccaggacucuggcaggcagccuuugcccuggagcuugcugucgguuggcugagagggucagucacacuugcauggcugucgggaagcucuaccugcccacacuggcucuucuaccuuuuaccuuuaacaagugugaccucccaauaaaccucuucacuccuaacugacucagcauccaaauacagggcuguuuucaggagucgcugugcugucuuugcauccacagaugucacgcacaaggguuccaggcgcucugcacccucaucagcccuugugucugugcuuugggaugugccggcugguggcugugaggaugggagcaggaagcuuggagguggagaagguggguugucauccaucucauuccaccagugggggaccgggaggcucagagaggcugaguguuagccauccuaacaggugugguugugccccauuaugacuucuucuucuucuucuucuucuuuuucuuuuaagacagagucucacucuguugccccggcuggagugcaguggcaugaucuuggcucacugcagccccugccucccggguucaagcaguucuccugccucagccuccggaguagcugggauuacaggugcccaccaccaugccugguuaauuuuuguauuuuuaauagagaugggguuucaccacguuggccaggcuggucucgaacuccugaccucaagugaucugccugccuuggccucccaaagugcugggauuacaggugugagcuaccgugccuggccccauuaugauuuuaauuuguaauucccccaugguuaaaaauguugagcaucuuuuuaugugcuuaucugagacuuuuaaaagucucaugguuuuaggcuucacauguaggugugugaucuguuuugaaccaauuuuucucugagaugagaggccugugucccguugcguuuuugcauauggauguccgguuguuucagcaccacuagcugaaagaucacccuuugcaccugccccaggcccauugcagacgcuggguccuuuauccuguaggagguccugccuucuggguguaucuauggcuucccuguggugucccugggcacuucucuccugccccucuauuuucauaaucagaaauccgcagagcguuuauuagauugagccucaggccuguuuuucuuggcaggaaugcuugguuauuggugaggugggcuucccagugcaucccgccagaaggcacccaguguccaguguucccacggguacuggagcacagggugaccagugaggucgagggcgagaaucugcuauuuccuugguuagcuuccuuaucauaccuucuuaugguuucaccgagacacucaggaaaguuagauuagggacucuacuagaugauuccaagaagcuauuguugcuuuguuaggugugauaauggcauuuugguuauguaaggaagugcccauauuuuuagagaugcaugcugaaguguaagggcgugauuuuacuuuaaaaucuccagugaagaaaaaauaggcaagagaaaaaaaagggagagaugaagcaaguguggcaaaaucuugauaaucgccgaaucugagugacugcauguuuugaagaugaguaaauguuuucagaggccgaggucuggcuugcacaaguuucccccaaaugcucccccaaccccagguuaucaggugaaugugagccgcugggagcauuuagaggcugucugcuaccugugcuugggggccguuagcuguugcucuucuucccgucucucuuuccuccccucuuuccuuuucuccccucuuccaucuuuuguccccacccuuuuccaaagauuccgggcugacccucggcagagcccccgcuucacggccugcccuuuuucauaaggaccaccagagggcgccaugauuuaagucugucgcuguucuuggugcugaaauucugacagcggguggagcacaugaugggcccgggagcuccugagggcuucagcccuguuuucuguuccuuugaaaacgaacacaccuuugggucuaagaaauauacuguuuuauauucccaauaugugguccccaaccuuugcaucccugagguuggaaagagaagggacggcugagaugcuuagugaagggugcaggccugagaaggcuuugucagaaucuaccacucaccagcuguguggcccugggcuagucauugcacaucccugagccuugauuuuuucucaucuguuaagugggaaugauaaccacagcuccuuuaagaaguuauugugaggauuaaugagaugcugcagauuuuaguaaucucaagauacuauuauuccuauugcuaugaccacuacuaauacuuuuuuuaaagcacaugcugugugucaacggccccuccagugcacccccucccaggugugaagucaggagaugugauguccaacucaacccugccuugcccgugaucaccgguuugacucuggcuguacugcagccacacuugaaaccuuuugccuuccucuuauggaagauccugaccauaaaccugaccuugcagaguucccauggauaugucuccaaagcucugaauacaguggccagugcaccauugaugcuaagucagcgacagcugcuauuaucguucucagggcccuucucguuuagccacguguugauucugugcuuugugggucccaauaacuccaucucuccaugcuucucuggaaacugccccacgcaacccccccaccccccacccagggaacuguggugcuggggcauugccuuccauagcuuucuaccucuauucccacaacccuuuguagcuaaaucaacaguagauguuggucagcgaaauacugauuuugcuacaauaucuugcuugaauccaugugauggcccuaagagagaagcaaacguugccuuacuguguuuaccuuacagcugaagaaacugaggcccugaagaaugaaacugcccacccgaggugccccagcuaacaagagucaggcagggaauuggggauucuuagaaaaagaggguugcucagagauucuauaggagaaacugaugucagagaggugcagccacugguucagaauggcugagugcauucaugucugagcugggaugggaaccaggcccccugaccuugucccagagccucuuccuuggugucugguucucugccuugagccucauggguaucauggaaaagagacuuauguaaaagaaacaugccuggcuuuaugacaccugagacuuaagacaguaauuuuuggugauuagucuucuggcauaccuggucccucauggccugcaccuuuuaggcauuugauuuuguacucacuugugacucuaaagcaccuuguuaguggagguaaauuaacuuauugauuuugagcuccacugcuacuaugauaaauuauaacacgauuucagucauuuuguuguuuacuuaggcaguuguugaaauacuggugcguugguagaacuucugaaaugaauuuuuaacaaaucccuaaaaacuaugugagcuuuuccaaaaugucuggaggaggcaauaggccugacuuuuucauuaauaacguaucuccuggugcugguauggugagggugagcccgggagagccccaggcuguggggaccccuuugagaaccggccuggcauuaggcagcaggcacuggaaaaagucgucauccuuccugacacugcauuuacacucuuggggauuuauccugaggaaauuauaaaaaaaaauuuaagaaaucuccuucugccuaaauucacugaagaauuauuugacaguaggagcaacacaaaauaaaccuggaaucaaccucacugugcagugacagggacauuguuuuccaauuguagcauugguuugcuucugggaguuugugcuaauuugcuucuuuggggcauccacaguugcagagcacagggagaaggguguuagcuggccagcaguuucuauuucaagaggaagacucuugcuuaugcuucuuccuuuucugcccgagcacagggggacacuuugugcaaauaaucacauacaauuuaggaaugcuuuuggagccgggugugcuggcuuauucuuguaaucccagcacguugggaggcugaggcaggaggaucacuugaggccaggaguuagagaccagccugggcaacauagugagaucccgucucuuaaacaaaaauuagcugggcaugguggcccacaccucuaaucccagcuacucaggaggcugaguugggaggaucacuugagcccaggaguuuggggcugcggugagccgugaucaugccacugcacuccaaccugggcaacagagcaagacccugucucuaaaaauaaaaauaauaaugauaauaaaccaggaaagcauucaucuacaaguaggaggaaaauugacuagagggacuuccgguagcuggaacugaaagagauagggcugcaaaaacauuuucaccguaaaaggcaaggggucugccauccagagcucauggcuuggcugggugaggccaacaggaaccaggcuccacugucuuucugcucugccaagcucagccuuggaccagacccucuuucuuugagucugguucuuguccuucaguaaacaaauggggccagggugaggaugguugggguaggggacacugggcuucuuuuuccccuccuugugggcaguccacucuggggacuugagcgucuuccauggaaggcagauccuuggaugagugaaggcugcuguguugacagcucagcucgggggccgaaagucagagaugagauuccucauggguguuacggagagcagacccacguaaaagaaacaugcucggcuuuaccacccccaguacugcuuggggcuguaucuuagguguggguuucuugcucauggucaugagguggcaacuggauguccaggccugggaugugaggucauagguagcaggacgggcagggcaagggagccuguuuccuggcacuccgcgcucacgcuuuaugugacaagcuggguggccccuagcugcuucuccgucuccaugucagccgcuugguuaagcaugguucucaggggucccuuggccagcuguccugcuagcagcugacaucaggggagaggccagcuaauuuuuguauuuuuaguagagacgggguuuggccagguuggucaggcuggucucgaacuccugaccucaugaucugcccaccuuggccucccaaagugcugggauuacaggcaugaaccaccacgccuggccugguauuuguuguuguuuuuuuaaccauugccauuuuuuuuuggugaccauguucauuggcugcccugguuggcccauaggaggcagaggcugagcuggguggaauucaguguguggggugucgauuaggacgugcucuugggguccaugccugauugaugagggaaggcagcaggauugggcagagggagagcugagccgaguuguaguccauugacagcuguggcugacugugaggagcucaggggcugcgguggugcauccacgccguccugccuugggcccagauggcugcuucuucacgcuugcccagucacaggaggcgauccacccugcaggugucuccugacagcaccccgccugcugcggcaaagaucccuccuugcggggcgucuggguggccccucucugaguccacucuguuggccaaacaugcuucuguucuuugaaaugcaggccucccugcuuuuuuuccuguuggguugucuuccaaaaauugauuacgacaauuuuguccuucuaauauauucugcacaugaauccugaguucaaauggguuguaaauaucuaagguuguggcuuuuucacuuaaacuuuacaguggaagcacaaagucugguuuucuauuucuucucgugucaguguuagugagcuguauuuuucuagaaauuuaucuguuucuucuaaguuuucacaguaaucuagcaugaucuuuuuuucuuuuucuuuuuuuuuuuugagacagagucuugcucugucacccaaggggaguucaguggugugaucuuggcucacugcaaccuuugccucccagguucaagcaauucucccugccucagccucccuaguaucugggauuacaggugccugccaccaugccaccaugccuggcuaauuuuuuguauuuuuaguagagacaggguuucgucauguuggccaggcuggucuugaacuccugacuucaggugauucgcccacuuuggccucccacagugcugggauacaggcgugagccaccgcgcccaaccauucucgcguuaucuuuuaaaucucuguaauguguucuguccugucaaaugcauucuuccuuaguuaauguuguuggagguuuguugacuuuauuaaucuuuuugaagaugaucaugagguuugggggagcauccccuaggcauaggacuggcuucugccuccaguguggccucugucugcggcaugccuuguuuagugcagaucuccagggguuauuguugggcgaccagggacagucacagcaccucucugggcuucaguuuguucacaugguggcugggagugagcgcacugcucccuaagcucuguagaaugucacugucccuuuuggaggguacuguggucuuucauugugaucacgagugcauuugacuuagcuccuggauaaaggacaggaauuugucaugaaucccuuaaaguacuuggcagcuuagcccaugcuaggucuucgagaaauauuuguuagaugacggaaccuaugcagcgagggaaucaguagcucagucagcaauuuccugccuucucagggauuccacuugguuccccuccucccuuuuuuuaaaguuagaaaaugacucacauggcugggcacaguggcucacaccuguaaucccagcccuuugggaggccaagguggguggaucacuugaggcuaggaguuugagaccagccuggccaacucuacuaaaaauacaaaaauuagcugagcgugauggcaggugucuguaaucccagcuacucuggaggcugaggcaggaggauugcuugaccugggaggcagagguugcagugagcugagaucgcgccacugcacuccagccugggugacagagugggacucugucucaccaaacaaacaaacaaacgaaacaacucaugauccccugcgagggucuggucuggucagggcaggguuuuugaggaucugaccacucuguccaccucugcuccagcgcuccugugugacagggaaccuaugugguggacagcaggcagagagaaacagauauuaauuaauuaauuaauuaauuaaucuugaccuguauucuaguaacucccaaaugcugcaacccucagguggcagcuauuuuggagaauggaggauaggacagugcugguugucuucccaauauccauucuuccuggauuucuggcuaacagcccugacuuaaaucagggggcuguguguccagcugaaauucauauucccaggucuguaauucagcagagguggccaugggacccuguucuaaccaaugggacauaagcugagaucacuggguggggcuuuugggaaagauccuccacagagaaugacucagcuggccccugcccuuucccuuguuuucuucuugucuggaaugugauggcuggagcaauggcagccauuuuguaaucaugaagugacuugaggacaccauaugcuauggauggagaagcagauagacagaagggaucuggagccuuaaccacaacacagaguucugcuccagugcuggauugcuggccucuggcuuuauuuuauaaaagagaaaaacccuacauuucuuccuagcuuucuaacacagcuccuaacugauacaggcugggaagcccaaauggagauuuuugcuuucuucccauguauccccaucagucucucccugaugcacaaggaaagaccauucugagcacacccaucuucaugcagaaaccacauguguggagcccuuaugcacuguggugggaacgugaaaugguguagccacuuugggaaguaguuuggcaguuccucaaaagguuaaacauagauuuaucucaugacccagcaauucuacuccuaggcaucuaccaaagagaauugaagacauccauccauacaaaaaguugcacaugaauguucauaguggcacuauucauaguagccaaaaaugaaaacaacccaaauguccaucaacugaugaauggguaaacaaaauauggucuauccauacaguggaguauuauacagcccuaaaaaggaaggaagcccugccacacgcuacaacaucaaugaaccuugaacacaucauguuaagaucauguuaagugaaagaagccagacacaaaagaccacauaguguaugauuccauuuauaggagauguucauaaucagaaaauucauagagacaaaaagcagauuagugguuaccaggggcuaggggcuuggggaaugaccauuaaugaacaugugguuucuuuuuggggugaugaaauguuuuaaaaguaaaucauggugagggcugcacagcucugugaauacacuaaaacuacugaauuguacacuuuauaaaaguaaagugugugguauauggcuuaugccucaauaaagcugugauuaaagacugcauaugcuuuaaagugagaagcuuggugucauuggagccaggcgacagaguagggcagggcuaacugcaggguccucacgggccuggggcagguggccacguggccaguuucugccuucucuaguggaauagggugguguggugguuaggacccagaccccucuacccacacagcugcacgggcuuggggagaucuaguuucugugccucaggggccucacuugucguauggggagacuccuguaucgcccgcaagguuguggugaggcugagcgaggguaaucgggaaugccuagugcagcuuccgccugcagggacacucagcaaaccccagaucugauucuuccauuuccccacgcacuugccacccuugaccacugccuggucggcaggcgcuucuguagucugggcuugagaagaacuuucagaaugguagauuuuuuauccuuuauuuuuugaaggggagaaggaaagcaguggcaggaaucguccucugugauguuacaacauauuauaaagcucagucauugaaauagucuggaaguuacacuagacuugggagagagaccggugaagcgugacacaauacaugugugagugcccuguggccgccagagcaaaguccacagacuggcugguuuaagacaacagaaacguauuguccccaguucuggaggcuagaaguccaaggucacagugugggcagggcuggugcccucugaggguuauggggggaaucugucccagccucuucuccuggcuucugguguuuugcccacaaccugugccacucccuggcuuguggaagccucaucccaaccuccaccuccauccucacacggcacucucccuaugugugugugucuguguguccaaauuuccgcccucucucucuuuuuuuuuuuuggaaggacaucaggcauauuggauuagggacucagcuuaaugacgccaucucaaugcauuucaucugcaacuacccuauuuccaaauaagaucacauccugagguucuaggggugaagacugcagcaugcagauuuuagggggaagcaaucuagcccuuccugguggaaagucagaagcagguuugagcuguauaauaaaucacucacuguguaacgggcucgauauuuguggagcaccugcucugagcagguaccgggaaacagcagugauacaccgacaagguccccgcccacgaguagcucaagcagcagggccgggaggacauuucaugacggugcgggggagcggccagcuccacgcgucugcugccuuuguaacgagaacaaguuagagggacagacugcauuggcggccggcucuuucgugaacguagcacgugguguggguggugcaaccgcuccaagccugaacccugagccccuuuggccaagggaacaucugcugccacgguggaugacuugagguuuuauuguauaauuucauuugccguguuauuggcguuuggaagaugacgugaccucaucucauuuuccuuugccuagugaaaauagcaggggauugauuuuguucccuucccaccauuggguguguucagcaccaucaacacagauuguuaaaucauccuuguauguuuccguuuugcucugaaacgcuugcgucgcuggggacgaugaacuuggcucaaugcaccugugugucgguggaacuuggcagaugggcggcgggcaccucuccaugccgauaucuguaccccgaggaagcguccguggggugggguaaagagccaggaagaggggaaucuggguuugauucccaaaucugacgccccagcugugggaccugagacaagucauucaacuuguaggggugcccgccucagugggccguugggaagauuaaauggaaugaugaaugcagaacuuuuuuuuuggauuguuuuuaaugugguaaaauauacauaacauaaaacuaaucauuuuaagcauuuucagugucuaauucaguagcauccgguacauuccuauugucgugcaaccaucuccacgacccaucgccggagcuuuuucuuuguacccauuaacaccaacucuccauaaccccagcccugguaaccccuauucugcuuccugucucuaugaauuugacuccuccaggacuucauauaaguggaaucacacaguauuuguccuuuugcgacugguuuauuuuauuuagcauaauaucuuuggccgggcgugguggcucacaccuguaaucccagcacuuugggaggccgaggcagguggaucacgaggucaggagaccgagaccauccuggcuaacauagugaaaccccgucucuucuaaaaauacaaaaaauuagccaggugugguggcaggcaccuguaguuccagcuacucggaaggcugaggcaggagaauggugugaaccugggaggcggagcuuacagugagccgagauggcaccacugcacuccagccugggugaaagagcaagacuccaucuccaaaaaaaaaaaaaaaacaaaaaaucuucaaguucgucuacauuguagcaugugucagaauuuuauucuuuuuuucaggcugaauaauauuuauggaaaggguuaaucuguaaauugccaugccacuaaaaacaaaguuuuagaagguguguaaaaaucaauguuugaaccaaacagaagaggugaacugaaaggcacacucuccuuucccuucaaccccagagccauuccccauguaaucgccugugcauccuccagacauuucucugcacugaugagcauuuauguguguguccuuuguuuuuagaccuccaugcuaugaaccuugauuuuuuccccuuugaugucauucuuccuuuuuuuuuugagauggagucucgcucugucgcccagacuggagugcacugcagcgaucucggcucacugugaccuccgccuccuggguucaagugauucucuugccucagccucccgaguagcugggacuacaggugcccaccaccacgccuggcuaauuuuuguauuuucaguagagacaggguuucaccauguuggccaggcuggucucgaacuccugacuucaggugaucugcccaccucagccucccaaagugcugggauuacaggugugagccaccucaccugaccugauaucuuuccauauuggcacacacacauagaaaugccucauccuguucaacaguugcuuagcauccacugauagauggccaugucuuauuuccccagguccaugcugauguccauguaugucguuuaccaauacuugccauuacaaacaacacuggaaaugauuguucuugacagaagagugagauuuacaccugaaucccuagcagacaaggggccugugcauugagaagccucacauugucaaauuguccccuguggagcugcccccuucuccacugcacccacccugcacaggaggggcuuuccccacugauaacacuccugcgggguaugggccacagggccuuuuuuuggucacugccauauuugaaaagugcuacguuucugguuuaauucacauucuuuuaaaaugaugaguggacacaccuuuuuucacuugccuuucuucuuauguggauuaaauaauuauuucuuuuucuuucuucguguguguuucuuuuuaugugaaugacuggugagucuccuuuucucacuuuucugcagagcuuuucaucuuugucuucuuguugauuuguaagaguucuuuacauagugaggaaagugcacugugcaugcuaguuguugaaaucuguucaacucagggucaucucuaaacaucuuaccuucuuugaaguuacccauaaaacuuugugugccccugaaacagcaauguuuccuuccauaaucccggguuuauaguuccuauccuucaccuugaggcugagaggcucuccuucagugucuguugauaauuuaccuaacccucaucccuuccucaggcuacacagagugagguggggaaaagaugauggucagaugcuaaggaaggagcuggaaagaagcugucagggguggggguggugcgggacuaacacugugauaaaggcagccaagcaaccucaagguaaguauuaguucaguggacugcagcgugggguguugucccugccacagggcaucagggaaggcuuccuggagguggcgacaguucagcugagccacagugggaccucaguggccaugugcucucauccgcaggcucagaaguuggccaggaaaagcugucccugugccugagugggcugugggccuguaugggguggggcggggcuucuaguuccauguuuuuaagcgggagugaccuggagucccuagugagggauuucguaggcuguggggaaauagcugcugcggggugaaguuugaagacaaacgacagacgggagauggggaggaguaaccccauuuggggccaaaauagcccgaggggaagguggugugucguccccauuucacagauuuggaagcugaggcucaggcggcuccugcagccgggaggagggaggcauuuccaacccuggcccagggcuggcuggagcugugccgggcggcggccagggcggccguggguggcggugcucgcguugcaugugguguguggcggcgugcaugcaccaaggcucuuugauuccucaacuuuaguuuuuuuuucugauuauagaaguaaaauagaaagaagaccuuuuuugaaaugaccuguguuagucaccucucucaggaugcgugaggcggacacguugaggccaccucagcugauggaaguuuccgguaagaagcccguucucacagccgggcagcagcgccggugagcuuggggacgugggcugugggucacaggcgcccgacacagcgccagccugacagcgggaagccgaccccaccgugcugggauccggucccuccccugcucuggccccugggcccccgacccuggcuccugccgccugggcccuggccccaccccaccagcccccauugccgccccugucucccaggccgaugggugaggcccccuucaugcgccaccuccuuguggacuguggcagggucacuuugucaggcagcuggggcaggagccaggagcguuguuuacucacugggccaacaguguugagugcccgcuguggccagcacugggccggccccuggggucgcagcagugggcaagcggacagugacuccugaggcucacacugagcggccgacccagacagacagagucagucuguuaacuagaccccgacugggggcgagugccaugagaaauccaccagggcagccaugcggaggcgggguugucacugcgaaguacagggugcaggaaggcgcccgagggagugugcgggccgugcguguugggggguguguguugguguguaucucuuuggggcuguguguguugauauguguguguucauguauguguugauguguguguuuaggauguguguguuguaugcguugauguguuuguaugguggggcauguauguugggguguguguauugauguguuuauugauguaugugugcuguauguguuggugugacuguuggaguauguguguuaggguguguguguugguguguguuuguugauauguguauguguugguguguguguuguauguguuguguguguguugguguguguguauguugguguguguuaguguacguauugauguguggcauugauguguguugauguguguuuuuugauguguguauguguugggguguguguguugggauaugugugugucuugcuauguggugugcuuacuguguguguauguguguugguguguguuuguugauauguguauguguugguguguguuguauguguugauguguguguugauguguguguguugguguguguauguugguguguguguuaguguauguguugauguguauguugguguguguuuuaguguauguguugauguguauguugguguguguguguugauauguguguuggugugugcuuguugacauguguguguugggguguguguauauugggguguguguguguuugggguauguguauugggguguguguguguugcuguguggugagcuuauugauguguauguguuuguguugggauauguguauguuuuguuguauguugaugugugcguguauugggggcguguucacacauaccuuuucaccgagcagccugcuauguaacggccacccgggucgacgggccuguagguagauccucauuuauugaaccaauuuccuguguuggacauuagaguguuuccuggugugcucaguuauaaauaacgugcugccaucuuggguuucuacccuuacuuaaggcacaaacaacaucuucagagagucuuaaagucugcaauccugcauuuggacggcaaugucaacugcagacuuacgguccccaggcagccuuaagcagcugugcgucauaggcauuaacgacauaaaacaguauguuuccuuaggcccagugccggccauggggugcugagcccuggauggcugguaucggggcuguggguaccaggcccuggcaccccacaguuguucugccugugcuggggcaccuuuuguuuggggcaggaggacaggucuuugugaggaauuacagaagggacucucuucucugcuggagaaagaccuuugcuguuucauuuuacagccuuguuugagggaggcugggaggcucugcaguuuagaauccuguucaaagauuaugcucaugggccuaagaggauuuggcugugaccaacuuguauuacaugggcuguuuguuuuuacuccugccauguucucuucugggucucgggcauguguucuuaggauuacuuucauuuacagccugagaugauugugaauucuucaauagcauccaccuuuuagaaauaggaagcuuucuaaagucacguuugcaagcccagccuuuccgaauucugugucauuaacucaagaccagagccgucucucaucccccugcuuaccccugccuccaugcaccaugcugagggcagagcgugggcuucaccgugcuguguaaacugugaagugcaguacccccuguguugagcucgccucccacucugugaauagagcagacaaugcuggggaugcgucucccagccucccuugcagcuagggcacagauaccuggccccccggugcugcugccuugggacuugacucagaauguuggcuggcaaugugaggaacagggaccgggggccaugugggugauggugguggcagcggaggaggcagcugcagugauccagauggcggcugcuggguuaauuugggaagaacaggugccuucagacacugcuucaucuucuaagccaggggcuggacacugugauccuuggacauuucuguuccuuguuuuuaaugcuucugggaagugucuuuauuuugccuuuuaaaaacgcagaguggaaugugcauuuaagggaaggcaaaucccgcuuuucuaguggaaaugagccugcgccuccccagacagcuagaucuggagaugcugcugcccaugaguucugccccuuuguuucuguguuuggaaggccuggcccaaaauggggauugggggugccccagucuggucugggaugggcaggaauuauuucccagcaaggucaaggcugcucaacacugugagaacccuggccugggcaucaggaaacauggcuuccucuccagcucugacuuugcugggcaacccuggacaaagcccucacccucucugagccuucacggccccuucuauggacuggggaugaugaucaugaccaaggcagucgugaggaccauagaucgcacuugccauggccaggccaucuguaaaguggaguguucagguuagagaggacaaguugguguuauuggagggaaccuguggugaugggggagagggugaccuggugacacagcccuugauggcuaaaccuuccugacaaugucacagggccagccuccugcccuuugcaaagcacuggauccucaaagaauaauuuacacuccagaaaauggaauccauacuggguggguucuaucacguguagccuugggggaugagaccugggaagaccgaugugaauacaugcaggacggggcauccggugucugccagcugccaccugcuccggaccugggccaccggcucugcugccucagccucuucacuugcuccauuuuaaucacagcucacucaucagccuucuuuggagaaugcuggggacugaguggcaagguagggagacuccgggcuuuaccuuaaguggacguauguuggaacaguaacuucgcccccuaauaaugauaauaauaacagcaacugaggaagagcugggguucacagagcaccugcucugcaaacagccugcaggaucuuucggugaaaguugugaaacauggacauuuaggugcuccauaaguguuagccaaaaaaaaaaaaaaaggaaaacgggaaagaaacacagacaugauucugcucauucccgcuuugcucccucaagucccuuggaggggcguuaucugggcuaccagggacugcuuguuuccuggcgguuguagcugcccucuccuggacgcgcuuccuuuugguuugggcacacuugguggucuuccugcaccucggccuuuugcucuggacagauggccuuugcugucacggguuggcucugacguccuuuccucugugagggugcacagcaccccugggccccugcagccugccucagccccuccucacugccaucugcacccucagaacaugagacuuggugggugcuuccucgagggacugagaggccucgaaggacacugcccuggagagcggugccggcugucucagggugggaagccuccuuggugacacugugugaauggaaccccacccgcccuugcugccuuuggugccaccaggcacagcuccuggccccaggaggggugaucuuucuuggggaugccaagcuggcucuguggucccugucacucagagcgggcuccuccccuccacacacccauuuugagaccccagagcacagugaugccgcagcugcacuuaacaagcaggaaugugucccuccuguuggucaacauuuggggccucacugugacaggugcacagcagccugguggagaaccacccuaugcgccuguagaaagggccagauggcaggagccaccuugcguuuugccuugagguuuaguugggauggccacuuacaguggucgcagccacuguucugagagcuuugcauguucaguggguacaaaucucaugguugccuaggagguaggggauggggcaguguccauuuggcagaagaggaaccugaggcugagagaaguugauucccaaaaacacagccuguuguggggggccagggucccagcccagcaguccagcucagagucacacccugcugucauguuguuacccggacagcgggcagguucaguugcguggugggugacaguccagcgaccacagccacggagggcuuaacaaggggauuguaggacuugcagcaaguaaggaggacaccagggaugguccccaaagcagcgccucccgggcagaggggaucccaggguuucacggggcugcugggcugagccaucucaugggggguuaaagucagugcaggugcgguggcggaucacgcuucuacauacgucgcgugcauggaaaauggcggauaagcuccucuccucccugggugggguuuuuaggaugggcuuggaccuuuucugaaacaaggagaacucaagaugcaguuacaagugggugcuuuuucacgguguguaccucaaaaccccaaacccgggaccccggcuuaagacgucauauuccaugggcggugcuaagggcagagccuggcccagaguaaacccucgagaaucguuacucuuguugcuuuccugggguuccuguaaagcaggcguggugccuugugguuugugaaucugugucccuaagacacacgcuguggugaaugauucucugggacucauccagcugcuucccccagcacugaguguggccucacagugggaauagugggcuccgucacucgugcgcucuagccucuccucccauucgcugcuguccccucccagucuccuggccauugucauccugggggaauccuugucaugggaggccuucccaagcagagaagugagugguccucacccacuguucuucauuucacauacauuuauugagcaucugcuguguacccagcccugggucaguggcuggggccacagcagugggcaaagcagaccuagggcucacggucuagugggcagagagaugugggcccucucagccucgccaauuuucccucugggaggacugugccagggaagagggaugggggaugggguaggggcuuuggagucaguggagcugcaugugaaccgcaacccaguggcuuuccagcacuuccaugggggcacagggcugagcuucaagaauccucaguuuucucaucugcaaacuggagguguuggcacccaccucacuggguugucuggaggcuaaugguugauacguuccauggggcccaugcagcuuggcucauggugugcacgcauugacuaugagcccccugcuggcucccagccuggccgcuuaggugggcggcucagguggugccuagaggagaggccagggcugcaggggagaggccagucugaggcucuuugucgugugugaaaucccuggguuaaucccuggcccugcccagagccugaagugggagcuccugcgucgcuuccuugaccgugagccuuugcuggcugacuaggccucugcuucugcugccgaugaggcugccagauguucaggccuacggcccagcagccccucguccuccagcugcccccuucccugucccugugaggucccagccaagccaucugccuauggagacaugaauaggccagcucugggcugcucugaaccuggugauggcaagaaauaaaguaaguuuagugcgcguccgugugaagagaccaccaaacaggcuuugugugagcaacaaagcuuuuaaucaccugguugcaggccggcugagucugaaaagacagucagcaaagggagauagggguggggccguuuuauaagauuuggguagguaaaggaaaauuacagucaaaggggguuguucucuggcgggcaggagugggggucacaaggugcucaguaggggagcuuuugagccaggaugagccaggagaaggaauuucacaagauaaugucaucaguuaaggcaggaacaggccauuuucacuucuuuugugguggaaugucaucaguuaaggcaggaacuggccaucuggauguguaugugcaggucacagggauaugaugacuuagcuugggcucagaggccugacaguaaggaugggugauacguugggcuuugguggccagaucuguuccugagucucccuggcugucagaacacacuggcucucagacgccagggucagaucuggugacuggggcuccaggcaguuugggucgaguggaggaacgcucucugaugauucaugagaccuugccuaggucugcaggauccugaagauucugaggcagggcgcucaccagcucaggcagccacccuucagcugucccaccuugccugggccugagcacaggcccuggaagccccuguucaggacauguucacaggcaggcaggaagggcccucccggcccgagccaacacccuucaccccagcuccccgcacaagcuggccuuccggagagccagggcgggcuuugcaggccgggaagaggaagagauguuugcccgggcaggggccgaggacuucccaggccgaggguacagggcaggcagcagccugaaaacacgggccaguuucacagcccguaaccagguggucacacagggccccgaacucagaagggcccacugggguggaugcucugcgcucaccguccugagauucuucaucgucuuauccugggcuugguguucuauaaguggaguugcugggaccguggaucauguccuggggcuuggagucugggcucacgggcugugccuccuuugucccuuccccagcuccugggacagguucucagcugcccgcucuccuccugcuggggccccaggcccugccuucuguccaggguggcagccaggucacuucucggguggccauugcucagggguggccuguccuccaugggcugaggugguggggccugugggaagggggccaacaucucuguucccggcuggggccccauauuuugguuuugcaccgggccuggaaaauucuggagccagucuugccugaagagaggugcauucuggaaauggccggaguuccauguggccagggcauaaggaagcugggguggugccuggaggugggguggggucgggcgggguuacccaggccuuggcaagucccuggcaagcuguugaggaguggggcuguguucucaugguauucucauggcacauguugguuggggcacuuggcagguccaugcaccuuggccacagaggcugcauggcagggaggugacucaccgucuggggcaccaggagaaagagagagggguguucuguuccgccuggcacugcucaggggugcacagcagcucuguggguuuaucucacaccagacuuuucuuagagccagaaaugggcaaggacuggaggcagcuuguccggugcauuccuucuagcgggguaaaccgaggcccugagaggggacagauccccgcucccuggccaaggucgcucagcgaguugguagcaaauagcuaauauuaagccaguucguuuggaauucuaggcaggaauggaaauauuucaauggcacagauaaaaaaacugaggcucaggguggcugaggcugccugggaucaagcgauuuacaauggagcugagauucaaaccugcagcucccgacaccagccugggcuccuucuccuccgcauugaagccgugguuggcgucucccacucuuugggauccuggaguaggcuagugagcagcuggggaacucggggcuggagugcgaggguggauggguggguggcagggcuguaacaaagccuaccgugauggcugucccccuccucagggaaucaggccugauugcacuuaaugaggcugguggggagguguugaguuugcauuuucugcucagugggagguggccaugaugcauauucauuuaugcaaaaccaggguugguucucugcacccucucaccccucuaccucuuucuuccuccaauugggucgcuggagcccaaagaccagcccccggauucucucccuccuuugccagcuuucagccccaguaacaggccagggagauggauggacauucucgcugcccagggccaggcaggcacugcgcucagggugcccucaacauggagcguucacgaccacccccucuucuuuucuuuucaccaauuuaaccauuuuagagugcacaguucaguagcauuuaguauauucauguuauacaaccaucaccacuaucuaggcccagaacauuuucaucaccccaaaaacaaacuguuaaacuugucagcugaagaauugccaggaccacacacugagcgccgagagcuuucuuccucaugaagggcugcagccugcaggcuggcuaaccucaggcugggaagcauagccucuggcaggagccagaagcaggcauuuccaggaagggaauuuaugaugaacggguuagcuaaguauauguauucaacaggcuauaggaagagcuaugaauauucacggagacgugugugcauuugucauaagcuaacauguauguuacaugcauccuauguugacuuugggguagagacuuaauauguaaguauuacagucagggcccuacaugucagaaggugaagcagaggacgggaagagccucugugcagccucuguagaugagccagaaccauuucaagaucaggacucuuaucaagaaggaaugcugggcugggcaacguggcucacgugcuguaaucccagcacuuugggaggcugaggcgggcagaucaugaggucaggaguucgagaccagccuggccaacauggugaaacgcuguaucuacuaaaaauauaaaaauuagcuggguguggugacgagugccuguagucccagcuauucgggaggcugaggcgggagaaucacuugaacccgggaggcagagguugcagugaguggagaucgugccacuguacuccagucugggagacagagcaagaccuacccucccccauccccccaaaaaggacagucuguguugaaacugaaaaagaaaggggcagcccugagugguugguuggaaucagcaguagggcaaggcuuucgaaagggcugguuucugcuuaacccuuaagagggaaagcauaauggcauuuagcgaaggaggggguauaaugcagugugucugaccuccggucccauuguggccuggaacucagguuuuuuuuuaagguuucucuggaguccguuuggccaagaggggguccauuuagucaucugggggugguuaggauuuuauuuauuuauuuauuuauuuacuuauuuugagauggggucgcacucugucgcccaggcuggagugcagcggcacaaucuugccucacugcaaccugagccuccuggguucaagagauucuccugccucagccucccgaguagcugggauuacaggcacaugccaccaugcccggcuaauuuuuuuauuuuuaguagagaugggguuucaccauguuggccaggcuggccucgaacuccugaccucagaugauccaaccaucucggccucccaaagugcugggauuacaggugugugccaccacgcccagcuuuuauuuuuauuguuuauuuuguuauuuauuuauuuggagagagugucucacccugucacccagguuggagugcaguggcaccuucauagcucacugcagccucaacuuccugggcucaagugauccuucugccucagccucuccaaguagcuaauuuuaaaaugcuaccauguguggcuaauuuuaaaauguuuuuguagagauggggucuugcuauguugcccaggcugcucucaaacucuugggcucaagggauccucccaccucagccucccaaagugcugggauugcaggugugagccacugugcccggccuauuuuuauuuuucaaacuaaaugaaauuuagccugaagaugccucuguacaugaauccuuucuuaaugaacugcaaccuaacuuaguuugugauuaacggaagccugacuuaggaggggcucuuguaacaaauaggugaagcucggcccaaccacagcagcugagcaucugucaauccagucccagguggccaaccauucaaauaaggcaaaggcugagcuguaaccagucaagcugucuugacccucucuuccguuuuguguccauaaaugcugccugaucacggugcagacguggauuccuagacccuguucugguucugagagcagcugauucgugaaucguuuuuugcucaauuaaaccuuaauuuuaacuugucauacucaguaagcagucacucccauuccuccuccuucuagucccuggcaaccaugaguccacuuucuguugcggugaaucugccuguucuggacagugcauggaaauggaaucaugcaguucacuuacauucagcuucuuucauuuggccgaguguuuucaaggcucauccaggauguagcucgcauuagaacuucauuccuucugacugggcacaguggcucacgccuguaauuccggcacuuugggaggcugaggcaggcugaucacuugaggucaggaguucgagaccagccagaccaacauggugaaacccugucucuacuaaaaaaaaaaaaaauacaaaauuagccaggccugguggcaggcaccuguaaucccagcuacuagggaggcugaggcaggagaauugcuucaaccugggaggcggagguugcagugaaccgagaucacgccauugcacuccagccuggucaacaagagcgaaacugucucaaaaaaacaaaaacaaaaacaaaaacaaaacuucauuccuucuccgggcugaauauguuccacuguaugaguggaccacauuuugcuuauccauucgucuguggauggauggauacuuaggguguuuccauuguuuggccauuaugaauaaggcugcugggaacauucgcguuccaguguucauguggauguguguuuucaguguuccgugauagacacccaggaguggaauugguaggucacaggauaauuccagguuuaauuuguugcggcgguaccaagcuuuuuuugcgguggcccugccgcuucaccugcccccagcagugugugcaggucccgcgucucucccaacagccaacacucgcuuugcauuuggauuccagacauccucgugggugugcguugucucauugugacuuugauuuggauuucccuaaugacucaucacguugagcaaccuuuccugugcaugcugaccauucggugaaauguauguguccaaggccacugcccauuuugaaauuggguuguuugucuuuuuguuguuaucauccaugaggaaaacaaggaucagagagggugaguaacuugccccaggccacacagcaagaaggagggaagacagccuuagaaacccagugggccugacucugaagucuuguguucuuucuuucaaacauaagggagcuggugguuggggcuagggaaggccuuuauuuccucuggagcagcugcuugggaugcauccuggauuucuugccccuccgcagcacuugccccucugagggcacaguccuuggacaugguucucaacaggacacuccuggggaaugugaucaggaggcccuggaaccgcacuuggagaaacacuggcuugggguuugccauaggacguaugacuucuugacccaaggcuugaguucggagccuccccgguccaccccugccaggcugcugugcaucugcggccugccccucucccugccucagcuuccucaucuguguaauagugagagaggaaugggaucccacagugcuuagaaagccauuaggaguaucaggggauggucccuauuggugugucugucuguuugucugucucccuccugggcggagugccuccaaagugggagcugugucuggcucagcagauauuagccaagaaccaggggccaaggagaagggccccagggcagaccccugcugagaccucagcauccugugguaucagaaacuggugcagcuggucccuccgugcccuguggccacuucugggugcucacgcagccagccccugggcccacauuugagcagaacucagugcucaaugugguuccugugggggaauccaccaugcccggugacuccgggggccccagcccugccauccccguguggggaacauggggcuggagggaacacagggugggaauucuuggagcucuggaagcaggugcuugggaagcaugagggucuuggaaucucaggucuggauucacuuguguccccagcuguggggucugggggggcacauuguggaccucgccagccucaauuucccaccucuacagugaggauugguaaugcccgggagugcucccagcacggcugggguuauguucauuugaacaacuacugaaugacaucagccuuccuggguacuuacauuuuggggucucagaaaaggguuaaaggcagcaacuuucugccucuguuggagucccagauacccucuuccugggguagggcagacuccaggccaagggaccaggaaaggcagggagaaggcaggagagugggugggagggagcugugaguggccgggagagugcaggcaggagcggugcauuucacagagacaggcccaucgggugagguuuggaaacaacacuucucuguucccagagcucaguggcccccacuugucauggcccccaaagccauuggcuuaggggcccccuugccucuuggggagaacagaacccaauaagagcaaaguagucaccgcuggaggcagguuuaguggguggcucuggaggcagauggccuggugugcuucccggcucuuccgugagcugugccucaguuuccucauuuguaauaugaggguagcaauaauuccucccucauagcuagcucuuggaugguaguaaaugcucacaaaugggcuguucugcagaugcaguguguggcaagggagaguggcccccuggaaaggggaccgguggccaguccaggggaagcgguaccagcuccuguguaagugccuccuacguaugaacucacaucaccucgagggaggagaggagggcccuggaggggugggacguggguuagggcuccugagacgacuccuaagaagugcauacgcagggagaugaagccacacugaaugggugggcuccucucuggagcacugggaggaagccacuguguggggugucccuuguuagggccuugagggggcucaaugaauggcagaagcuucuaacccaccugaaugauacauugaaguccccgcuuucuggcuagaucaugggagaggggagcccuggugaaugagaagauccuggaggcaguugguaaagagugcgugucuaauugaugguagcucaugugagcagugguuuacgaccagcugaacacaacauacaaguggcaggauaaagccccaaaagcccucaccagcagguuugccuagggcacagggcuggaacugggugcuguauuugcacauuggaggcauccucuuccuucagacaacaugcaguggugggcacccggcuuggagucagacagacgcuguggccaccgaugcuguguggccucaggcugguuacuuagccuuuucgaaccuuacuuuccaagccuugugcauuucagacucugcuaauugagggaauugaauuugcuccucaucugcauucuguccuaucaggauaaggagguauguaagccccagaggucauggugauaauuaacaagaacaauggacaaagaauacagaaaucagucuccauucggccacuucccagcccugggcacuuugccuccugcacuucaguuucucugugugaaacauggcugauaacuccagccuugagaguugcugggaagaaucugugacccgaugcagggaagacugcaggcauaccugggcacguggugggccuugcauaaaugacagccacaccacagcucccaggcuccaagcucagugcucuccugucccucucagccccugcauggcauccugucuccaaaguggaggugaggaaggcugcuguuggggaguguggagcugcgaagcucaugccauacaccccuuggacuugaaucacacagggcugccaguuuuuauugguuuugggcugugcuuugugcccuggggauggcccugucaugcucuguuucaggcagccccucgccugugugugacgugggucauuugucacccugacaguauugacagggcugcugcuggccugggauggaauccacucugcucagggcagugccugagagaucuuguccagaaggaugugggacagugagcugcucggggacagaguugcccuuuuuuuggguauagaccaugcuacccccugcgguaauguuggcuguugacagaggacugcugugagcccagcccgggccggagccccgcuugcugaguguccacuccgugccucccuccuccucugcacaucucccacccuggggcaggcaccauugucauucuugagguucuuaggaccccucucaacuccccagcguaccccuucauccacucacccccuguagccagagccauuggucuaaccuaugaaucugauccugucccucucugccuguuaaagcgccuugggggcucccuggggaauaacacccagcccguccugucacucuucuguccccucugaggguaucaugcccucauuucaaauaaccaggcagaauugcaggggcaaagcagcucaccccagguggugagauauauaugagcaagccaggacuucugguuaccugacugcaagcccacacccucaucucaggccacucugucuccuccuuccuuuucugcaguuuugugucucuguggaucacuuucagguccuucuugcucucccacacugguguuugaggggcuugguugcuggcacacagcaugcauaucaguauugccuggaagagggcaggaucucccacccucucccuguuagcuccucuguuacccaacuugcuuauuuauucauucauuuaaugaauaucauuaagugccuguuugugaauaggugcggacagaauggggcugaauguacaugccucaccacugaguaguggaggcacagaauuaucaaaugggcaagggaacagcagaugcaaaggcccuguggcaggaggcagcauggcccagaggccuguguggcugcagaggagagggaggcugcaugacgggagcuggggcuggggagcuaggcaugggccugucccguggggccuggguggacuuuuaggguuuuagcuuucucuguggcucucaaaagcauggggccuggcucuguucucccuccucauaccacagggacuauuuuggcuugcacugugauuuaucucuuccuaccacaguucccuucuuuccuaggugccgugggggcucucauaugacuccagcacuaggcaagcccuguaaccuaaggcuccuagaaacuuggucucccaacauagcugggggcccaacacagcugguauucuaggggagucagaaggguggaugguggcagaaugcuccccucucaggagucugcucacuauccucuccauucugucuucugaaagagaugguggagaauugcuauaauuucuuccuuaaauauuuguuagaauucaccagugaacccaucugggccugguacuuucuguuugggaagguuauuaaauuguugguuccauuucuuuuucucuuuucuuuucuauucuuuuuuuuuuuuuuuuuuuuuuuuuuuuuuuaagacagagucuugcucuguugcccaggcuggagugcaauggugugaucuugucucacugcaaccuccaccucucggguucaaacaauucuccugccucagccucuuggguaguugggacuacaggcgugugccacuaugccuggguaauuuuuguauuuuuaguagagaugggguuucaccacauuggccaggcuggucucaaacuccugaccucugaugagccacuugccuuggccucccaaagugcugggauuacaggccugagccaccacaccugggccauuucuuuaauagauauaggccuauuuagauagucuauuucuuauugugugaguuuuggcagauuguaucauuuaaggaauuggcauuucaucuagguuauuaaauuugugggcauagaguuguucacaguguuacuugauuauccuuugaauguccauggcaucuguagugauguauccucuugcauuucuaguauuaacaguuguguccuucuccuuuuuccuuguuagccuggcuggaggcuuauuaauuuuaucgaucuuuucaaagaaccaguuuuugauuucauuaauuuucucuguugauuucuuguuuucaauuuuauuuauuuaugcucuaauuuuuauuauuuucuuguguuuacuguggauuuaauuugcucuucuuuuccuaguuuccugaaguggaagcuuaggugcuugauuuuagaucuuucuucuuuucuaauauguacauucaauguuauaaauuucccucuaagcacagcuuuugcugccucucauaaauuuugauaaguuguguuuucauuuuuaauuaguucaaaauacuuuugaauuucucuugagacuucuuugagucauguguuauauagaaguguguuguuucaauccucuccauucugauacugucaggugggguuuuugcuucuuuuuccgcuuugcaugacagacucccuucugccuggagacagauuuucuggccucaccugggacugugcacaagucauuagcugagccucaguuuuaucaucuguagagcagggggcaaaguaccaacuucccagguaauauggaccuggagaguuuguagguaggggaacugguauuggaaccccugucuaccuggcuuccagaccccaguauuuccccuucuucccacacugggcuccaaggugggccuccaggcucagcaugauggacuguugaaaugauaaaugaaaggaagaggugcaucaggggaggggaugcauuucuguaggaagacaucccaaagagccgcaggguaauuucuucugucuuuuuuuuccuaguugugcaggccgggcccucucaccucuuagaaccucaguuucuucauuugcaaaauggggaaaauauguauuagagauggauaauaacagcagcaccugacguguagggaguacuuugcacaugccaauuuccacugucacugagaucuucauguggcuucugggaaguagucccucuuaucauugccacuucacagagaagagagugaggcucagauaggcuagguaacaugccugggcucuccuagcuacugaguuguccagccagguuuuggacccagauaggcugacuccagggugagcuguuggguugagauucaguugugugcccagcauggugccuuucacacagggcaggugccgggcaaggugugguucuggggagucagcaucacaggggaagaucaguccugucccucacucagagaccccugucuaccuucugccaggcgagcaaucuggugggcuugcugggaaggaggccacauauuggcaucagggucucccucccgccuggggcuggugaaggggaaagccacucacaguuauuccugggagugugggcgugggaggaacccacugcagcagggcuuuuuaaagaaaacucugccuugucuauaaauauccuccugacguguccccaguuccugagcuucugggacagugaggcagugcccugccuacaugccacucgccaagacugcugagugauuucgcagugggagggagcuuggggucagcuggggcgggguuucaugaaccagugacaucucccacagacacucaaggggacugcauugcgccaacuguuuauauugccaggugaggacuaaaaacaggaucccuuaugaucacucucuugucagauaugaaauguguuaacgccaaagcauguagaaaaguaaagugcaggcuagcaaauggaauauuuucuuuuaaaugaaaaacucgcugcaggguccaugcuguucuaauuccuccagaauuuuauagaagccacgacaggcagcacacgcucacagggccugggaggaggagucaugggcccggcaguacugcccacaccuggggcaggguggacagauggacggauggccugguccaggagcugggcauccuaucaggcccugcggauggggaguuaaaggcuagccaggcccucucugaggugcagcuugcucagcugcacagaggaguggugguccucaccuugcaaagcagcacugcggguaagacgaggcaacgggcaggaauuugcugugcacacaguccuugucaucauccucuuuucaggcugcaaugccaagaaacucucccaggaugguccuggagcccccagggcaggguucuggggauguguggaggacgaugggcagucaggaccacacugugguggguccuaaggacgccugccagaaaaacaucacgcauguggauaggaguugaauugcaucacuccccucacccaccaccaaauacuuguugaaguccuaauucaguuucucagaaugcgaccauauuuggaaauaaaguauuugcagauguaguuaguugagaucaggucauacuggagcaggauggguccuuaacccaacaugacugauguccuuauaauaagaggagaggagacacaaugacacacacaggagaacuccuugugaggacagaggcagagauuggaugcugcagcuacaggccaaggagcaccaaccauugcuggcaaugccggaagcugggagaggugaggaagaauccuccccuggaucccugguggcucugccggacaccucgaucuuggacuucugguuuccaggacagcuuuacaguacuuuauuauggcagugcuagcaaacaaauacaagcaccuaacuuagugcuggcaugcaguuggagcuugauaaaugcuugcugaaugaaugauauuuauugagugcuuacuacauaccaggcaauaggcaaagggauuagaugauaguuaaaauuucucguguguuuauaugcaaggcauucuuguaagcacguuagaaguacucacucauuuagucugcaugacagcucuuugaggugaguacucugugguucucuuuuugugcaugagaaaaccaggacacaaagagaugagucucuugcccagggucacauaaacagcugaguugagauccaaaccccaucaguguuaacuuccaggcucuugcugguuagcccugcaaugcugccucccagccuuuggccuggcacagaguaggugcuugggaaaugcucaccauccaguacuuguugaaugcucuucccagcugugccaagaagguucugguucuaugagaguguucgguugucaaacaagagaaguauuuugcucucuuccccaguuugccagagccuccaguugacugguuaagauuuaaccauuaagagcugauuugauucuaccuuuaaagugaccagccgccaccuguauuagcauccuguuguggguggaauuguguccccucaaaagauauguugggguccucaccccugaugccugugaauguggccucauguggaaguugggucuuugcagauguaaucaggugaagaugaagcaggaccuacuagauuagggugggcccugauccagugacuggcauccuuagaagagacacagucauaccaggagaaggccacauggugauagagacagagauuguagugaugcagcuacaagccaaggagugcccaggcuugcaggcaacaccugaagcugagcuaggcguggagcagacccucuucuggagccuucagagaaggcauggcccugcugacacuauguuuucagauuucuagacuccagaacugggagagaauaugauuccguuguuuggggccacccagguugugauguuuucauggcagcccuaggaaaugaauauccaccccaggcauugcagagcugaccugugcuuguccugcacuaauuucuaucccacauucuuugggcauauuccagaacccggugucugaaccuccccagcauaauaguucagaccauuggaacaaucucuuuuugaguucagagccugugggaggugaguccuacaaaaaccaagggcccuggggccagccacugggggacaaauacucagcuccacuccuuaucaaugcugagaccuugagccagccaggucacaucuuugaucaccaaucaccucuucuaucaaaguggccauaacaaaauugccuugagaccugugaggguuaaagggggauagauguacaaauaccugggcaguaccucgucuuaccugguccucaauaaaugcuacuugaauugaaccaaagagaauaccaacuccuccacuugguucauuuaguaaaugaaaugaaauuucuguuaaucucauagguucacaaaauugaaaagauugguugcacaacauugucaccugcuauuuagauacauaggaaaagaauagcuaaauuauaccagguuuuguaccuucugaaaaaaaaagucaaaggacgguaaauuauuuuuuccuuacauaaaaugaauucggugcacaugaacaugguucugcuuuuguauucuucagcuuccuaaauauaugaggcccaauuauacaccccaucuguauuugaacauuuuuagcaugccucagaauuaguguugauuuaauuuauuuccaccagagauuugcaaaauauuuccuuaaguuauucugaaccggaggugauucauucaaggagagaguggguggugucuucagagugggugcuccccacuggagaaaacugagccaaguggggaggagaugggggccucugggggcccuucccuggccugcccaccaccccuucugggguguggcccagugcacgcccuuuucaugggucugcacugcugaugggggagcacagcugaagcucccugguugggcacagaugcccuuaaugaacugguccaggcuuguucacccucauaccugaccugucccuuucauacucacccuaccuacuugagacuccuccagcucaucagggagcugcacaaauagggucugugcauggcaauugcuggcuucucaggcugguuggcauggccccucccucgcagugacuggcaagccucuuguuuccugggaagccuuucuguggcucacucuucacccccuguuccaccccugggaggacccuucucuggggcuccccagacacacacugucucucugccucugcccagagaccauggcuuccucuccaugcaccagcaccacugcuccuugaaaagaaaacagcaucucugugcccacucuuuggacugacuccaucguauuccagggccuauuuguuaaacuggauggaaaaccaaagccuguagggcuguaauuuauucauuaauaucuuaaguuuucaagauuaaacauauuuacuggguagaugcuuauuaaaugcuugugaaugaauggaugagugagugagugaauguauaaauuacguguuguccuuugguaaauuuucuagcuuuaugauauaaucaaauuauccuggcugcagcaagucuuuaaaaagcccauauacuuagagcaaaauuaauuguauuguuaaauaaaauuccccaagaugcaacaaagugcagugaaguauuuuuuuuuauccugauauguggaccagcuaaugcuguuaaaucagcauuuuaaaugugugguuuuauugggucugauuucacuggguuuuaucauaagaugaaccauuugcuuuugaacugaauugaacugaaaccuacagcuauugggcccuuaucauaaaagugucaagugccacccuggacacuguuauguacauuauaucauugugcagacccuggcccaggugaggucuuauccucacugccaccauuggcaucauuguaauuaucaacacucucaccaucaucaccaccaccaguaucaccaccaccaccaccaccaccaccaucagcaccaucaccaccaucaccaucaccaccacuaccaccauaaucaccaccaccaccaucaccaucaccaccaucaccaucaccaccaccaccaccaucaccaccaucaccaccaucaccaucaccaccaccaccaccaacaucaccaccaccaccaccaucaccaucaccaccacuaccaccauaaucaccaccaccaccaccaccgccaccaucaccaccacccccaccaucaccaccaccaccaucaccaccaccaccaucaccaccaccaccaccaccaccaccaccaucagcaccaucaccaccaucaccaucaccaccacuaccaccauaaucaccaccaccaccaccaccgccaccaucaccaccacccccaccaucaccaccaccaccaucaccaccaccacccccaccaucaccaccaccaacaccaccaucaccaccaccaucaccaccaccaccaccaccaucagcaccaucaccaccaucaccaucaccacuaccaccauaaucaccaccaccaccacccccaccaucaccaccaccaccaccaccaccaccaccaucagcaccaucaccaccaucaccaccaucaccaucaccaccacuaccaccauaaucaccgccaccacaaccaccaccaucaccaccaccaccaccaucaccaccaccaccaccaccaucaccaccaccaccaccaccaccaacaccaacaccaccaucaccaccaccaucaccaccaccaccaccaccaucaccaccaccaccaccaccaccaccaccaucaccaccaccaccaccaccaccaccaucaccaccaccaccaccaucaccaccaccaacaccaccaucaccaucaccaccaccauuaccaccaucaccaucaccaccaccauugccaucaccaccaucaccuccaccaccaucaccaccaucaccuccaccaccaucaccaccaucaccuccaccaccaucaccaccaucaccaccaccaucaccaccaccaucaacaccaccaccaccaccaccaucaccaccaccaccacccccaucaccaccaccaccaccaccgccaucaccaccaccaccaccaccaccaccaucaccaccaccaccaccaccaucaccaccaccaccaccaccaucaccgccaucaccaccaacaccgccaucaccaccaccaccgucaucaucaccaccaccaccgucaccaccaccaucaccaccaucacugucaccaccaccaucaccaccaucaccaucaccaccaucaccgccaccaccaccauuaccaucacuguaguuaucaauacugucacuaucaucaccaccaucaauaccaucaccaccaccaucagcaucagcaucagcaucagcaucagcaucagcaucagcaucagcaucaccagcggaacgacuaacauguacugagcacucacgccaugccaggcaucguucuaagcauuuugcguguuuuucucauguaacacucacuaaaccgcaugcaaugggcgauuauuaucuccauguuacagaugaagaaauuaagagaaggacaaauucagggacagcuagugaguguuggagacagaaaucaaauaaaguuccucuuauucauucauucaacaaacauuuucuguuuuuuuuuuuguuuguuuguuuuuuuuuguuugagacggagucucacucuguugccgaggcuggagugcaguggugugaucuuggcucacugcaaccuuugccucccggguuccagcaauucuccuaccucagccuccugaguagcugggaauacaggugccugccaccaugccuggcuaauuuuuuggauuuuuaguggggacauuguuucacuguguuagccaggauggucucuaucuccugaccucgggguccgcccaccucggccucccaaagugcugggauuacaggcgugagacaccgugcccggccucaacaaacauuuucuaagagggccuccuccguaucaggcacauuuccaggggcugggcguuguugggcugagaagacauucuggugugcgugugugcgugcguguguaugugcaugugugugccuguuugugugugcaugcacaugcauguggggcggggcagggacacagauagugaagaauaaaugaacagaaacaauuucggguacauauaagcaccaugaagaaguuaaaacagggugauggauagaaggugaugauggagaaaggccauuugaggcuggauguccagggaagaucagaguaggugucauuugaaccaagaccagagaacaagggugagaucuggggauggaguuucagggaaagggaugguaagugcccagcuggucagccuugcuccagggacagaaagaggcuagugaaucuucaggguccugagcagggguggggguggugggagguggugaaagggggccaggccaugcagguuggaguuugggcuuacuccauguaagaugggagggauuugaagcagguggguggcaugauccuguguagguuuuguaaggccauuuguucugcugaguggagaauggauugaguggggcaggaauggagauggggagaccagucugaaguugcaggugagagauguggcuggccugacuauggugguggcuguggaaugagaggacguuagaagcaccugggacacuuguggaaaugacauagacaagaauaacaaaucaguuacacguggagggugcaggaaagggagggcccaggacccuggugacagcccccaccaagugcacuuacugcucaugugcauugcguggagucggccuugugacagcccaggaaggugggugccauugugaucaccauggaaaccuaaggagggaacuaaggcacggagagugaaagccacccagcuagaagguauggagcgugacucacaggcauuccaugaguguuuguugaacggauaagugaguucaggguggcauagcucacagcuuugugaaugggcacaagggcaggguugagcucucugaaaggguggcuucguuggacuagaggcagacacagccacuuaaaugagaucgugguaaggguagauuaguuugguuggauuucugggcagauuuauuaaacacaccauuuccccugguguaaagguuuaccuccucacuuauuuauuuauuuuuuuuuugccagaggcucaauugauuuuuuucauugcaguuauugauuucugaauaacauuucgacuuuuuuucccccugaauaucucuuguguuuuagcuaauaaaucuuugacauguugcacuggcucuguggguggaggguuaugggaagugcugagaugcagacugagaugaagauaccacuucucaagaagggcugccaggcaaggcuuucagauuuccuccuuuguuuucaagcuggaguguuucagcuuugcuauuguucuuucccaaccaugggaaaauccagcuucauguacaguuugcugucugagaaguucaagcuguuuuaaacacugcgguucaaacaaugaucugauuauccuuaagaaucaaauacuguuagcaguggcaaauccgugugggucugcagcaacucagugcucaccuccuaagaggaaaggauucgucugaggggcaaaaggcagagugagagacugaggcaaguuuuagagcuggagugaaaguuuauuaaaaaguuuuagagcaggaagagggccaagugugcuguuugaccuaugacuugggguuuuauacguuggcaugcuucugggauuuugugccucucuucccuugauuuguuuuuuggggugggcuguccauaugcgcaguggccugccagcacuugggaggggcugcgucuuaauguguuuacugaaguugugcgugugcucauugagucguuuuucccuuaccaguggaguuuuccuagaaggucauacuccaguuaaacuccaucauuuugccucuuagugugcauguuugagcccacucgcccaacucagauccugucaggaagcugcuggucaucaccuucagguguuucuuuuuucuuuuucuuuuucuuuuuuuugagauggagucucacuccgucgccagggcuggagugcaguggcacgaucuuggcucacugcaagcucugucucccggguucaagcaauucucuugccucagccucccgaguagcugggauuacaggcacccgccacuaugcccagcuaauuuuuuuuuguauuuuuaguagagacaggguuucaccauguuggccagucuggucucaaacuccugaccucgugauucgcccaccucggccucccaaagugcugggauuacaggcgugagccaccgcaccuggcccccagcuucagcuguuucuauugggagacugccuuucccugaugccagcuguaaccaauuauuauuuuagagagaccguuuaauaaccgccugaccaucaccugauggucaccugacauuccucauuuggggcaggcucuccugcccugcucaguucugccuaacuaccuacucuaacaauacuauguaguuguuuauuuuuauuuuuagagacuggggucuuacuauguagccuaggcuggccugaaacuccugggcuccagcgauccuccugaguaccugagaccacgggcaugugucacugugcucagcaucaaaugcuacaucauuguuuuuugcucuacagcucauccuaaauuugauuugucgucuaaggauuuucagagcugaaagguauuucagcaaucauguucaacccucccauuucauagaugaggaaauuaaauucuaaggaagaaacaugauuuacccagagggucagagcugaucuugaaggagacugguuuagugaagacaugaggagugggcaauugaaucuuauguaguguauuaguuagcuauugcuguauaacaaaccaccccaaaauucaguggcuuaaaacaaccauugauuugcucaagaguuugugaucugggccaggcuuagcuagugguucuucugcuggucucaccugaggcuacuuagugacuuuuagcagucaucuggaagcucaccugggccugggucauccaaggugccucagcugagcugguuagaacagcuggaggcuggcucggccucucacuccacacauagagagucuaguaggguagcccaccuucuuuacaggguagcccagggcugccagagggcaagaguggaaacugcacggacuguuaagucacacaguaacuuccaucucuuccuauugcucaaggcuuuccugcgacguugcugcagcaucaguacauuugcccaaggccuugauguucccaauguugcauguagucagaggcaggaaggucuuccgagaucacccaggccaaaccuuuuaguuuauagcuggggaaacugaggcucaggccucauccuugagcaccugugcuuuuguucccagcugcagcuugacauucuguuagaugucuacaccaggcauugcaaacuuaacaugacugagauggaacuuuggaauuuucucuucagcccucuuccucacuggcauucccacuguccuggcuggucuuuccuaucuuaguucugcaggcccgacaccuaggagucauccuugauccuccuccuaggaugucugaggcugcaucauaagaagccauggagcuuccauccggugaucuggugaucugggucuuuugaguuugcucuuaagaugcucauccugggggaaccagcagucauggugugagaauggcaacccacaugggaggccauauguugacagccccaagugaacucccagcugauggccagcaucgaccaccagacaugugaaagagccaucuuggacauccagcccaguugggccuucagaugagugcagcccccacugcugucugcaacuucaugaggaacaccaagaaggaacagcucagcuaagcccagucagucugcccaaccacuauagcagaugguaaugaauuguuuuaaggggcuguuuguuacacaacaguagguaacuggaacaccuacucagaaucuuugcuuuccuaucuccuguguccugaaaguucuuucccuggauauuuucaugacugagcccuucucauugauugcucuuugaagucacuucucagagaggccucuugugaccucagaguugguuuaguuuuguggcuguguccuguuuccaugugaauaagaucuguuguggaauguuggcauagcuguguuccacgugacguuuguuuucugucuaaaugccaaaaucauaauacagagacccacguaaacuuacaugauuuaauaauuuuuaauugagguagcuauguuccguaaaguguacagaucuuacguguucaauuugaugaguuuugacaaacauguaaccauuacacaaaauagauauuggaaguuuuuaucaccucagaaaaaaaucccuugcuccucuuucaaucaguuguccauuaucuucccagcaccacaccugaagagccaauuauuucugcuugcugaagagccaacacauuauuuuagaaggucaugugaguaggaucaugugguguguacucuuguguuuggcuucuuuugcccagcaugccuaugaaauucauccacauuguugcaguaagcaguauuucauucuuggauuuuauuuuuuauuuuuuuaauuaaaaaaaauguuuuugagagggagucucacucugucacccaggcuggauugcaguagcaugaucucagcucacuaaaaccuccaccuccuggguucaagcaauucucaugccucagccuccugaguagcugggauuacaagcguguaccaccacgcccagcuaauuuuuguauuuuuaguagagacaagguuucaccauguuggccaggcuggucuugaacuccugaccucaagugauccacccaccuuggccucccaaaguggugggaugacaggcgugagccaccacagcuggccuuauucuuggauuuauaaaaauugcauuuuaauuuaucuaugagcuuuuaaaucucuaucucugcauuauguuuuuaaugguugcucugggauuauacuauacauccuuaacuuuucauuacuaugaaaaguuuauuaauuuuccaccacuuuacauaaagcauaacaauagguaccuguacuuccuccuucauccuuuugcuauggcuaucgaauggauuauauugauauauacuauaaaccucacaauacaauguaaugauuuuugcuuuaaauaauuauauguauugaauggucuuuuauguuuacccacauguuuaccauuuccaguguucuucauugcuuccugaaaaucuguguuuccauucugaagaacuuccuuuggcauucuuuguagugcaagugugcuggcaaugaaucccuuuaguuuuuuuaaaucugaaaaugucuuuacuucaucuucauaauugaaggauauuuucacugaauauaauauucuggauugacaggcuuuuuuuuuuccaagcacuuuaaagaugucaucccaccgccuucuggccuccauaguuucugaugagaagucaguaguggaucaagucauuguucuuuuguuuguaaugugucauuuuucuccggcuucuuuccagaguuuuucuuuauacuugguuuuuaguaguuuaacuaugacgugccuuuaugugguuuucuuuguguuuuuuucccugcuugagauucgcugaacuucuuggaucuggaaauguauguguuucacaaaaauuggggucauuuucagccauuguuauacuuuugugccucguucuuuugucaccuucuuugacaacagucacacucaugggagacuguuugguguuuggcccacagguuccugaggcuggguuauuauuuuaacuucccuccucuguuuuucagauagaguaaaaauucugucgaucucccuucacuuucacugacucuucuggaauuuguuaucugcuuuuuaguauauccagugaauuuuuaaaauuucagguaguguauuuuucaguucuagauuuuccauuuaauuuauuauuuaguaguuucuauuucuuugcugagacuacuuauuuuuaaauucauuaugauuuuauuuuccuuuacauucuuaagcauaguacaaauagcugcuuuaaaaugauugucugccaauuccagcauuugggguccaucucaguugauuuuuuuuuucuuuuggguuuuauuuauucuuacaucaauuaauuuugauuuguacccugaauuuuugagcaguacauuguagacacucuggguucuauuauguuacucccaagaguauuguuuuuuuguuauaggcaguuaaguuggcuguacucagacuguaaaaugucccccuugcagaagguagcagcuaaauccuccauuuaauucuuuuagccuuugguggacuguuugacaucuguccugagaagacagagaucuggguugacuucauacaugggacuuggugcuccucaucuuucuuccuccucauucccugccagauuccaguagccaagauugccccacaugcugucagcuacuucuuaaggccacuaagaugggagauuucuaucacaguuguagcucucugaauggugcaggaggaggacugcucucaggccaacugccacaaagcaugaaacauuuggugcuuuucccuucuuacaugaguuggccccuccaguacccaccugcuuuugauugcccuuaggugccuuaggugguuacuuuuuauauuuuguccagaguucaugguuguuauuugugggaggguuggucugauaggaccuacuuugcauuucuuagcauugcuagaagcagaauucucaguuuuuguuuuuuuuuuuuuaauugccaaguaguauuccacuguuaugucuaugcaguguacuuguccauucuuuugcugauggauguuuagguuugcuuacagguuuuugucuguuaggaaugaaguugccauaaacauuaugcauaagucuguauggacauaaguuuuuuucucuugggucagugucugggacuucacacaaaacugucaaauugguuauuuauggggucucccaugagccuguaaauaggggauacaagggcuaccguucacagggaauacugucaugaacaaaacacauacaguaaauagaaacaggucccauuggugucaccuauacuaugcuagcagaugcugagugucagggagaaaaagaaggccaagaaaagugaugggaggggaggcaacugggcaaugggcuucuacugaaaacuggcugggcaggggaggcuuugcuaagaaggaauaucaagggacuccagggugguggcugagugaaugugugcauaucugagcaacaacauuuuaggcagagggaacaguggcugcaaaggcccugagguguggcuggaguggggugggcugaggaagggaggaggucaugagguccgaggagugcuggggcaggccauggguggaugaccuggggucccugggccacuguguggaaucuggguuugcugcaguggacaggaagcuguuaaagucugcagcaguggcauggauuggaagauuuggacauuaguuuaaggagaguugcucuggacagguguugagaacagacagcagugaggaagggcugagaagugggagccagugaagacgcuucuggaaugugcagcccagggugacagcaguauagcagaggggaggggugcagguggcaauagcggccgggucugggauacuguuugaaggcagagccagggcauuagaugugggugugagagaaagaggcauccaggacaucuccaagguuuuucggcuccagugacuggaggccugaaaauuagaauagugcaaauguuggguauugcucggauaaaaugaaaauagacccucauuggaaggagggggucaggaagugugcaaagucccucuauccuauuacccugccuggucuuuuccaggguaucuggaacugauugauugauugacuaauugucuuucuagcccccuagaagaaaugccaggaccuagcacagguuggguguggcaugugugggaacucaauaaauguuauggaauaaaaggaaggaaaaaggaaggaaggaaggaagcagggaaggagggagggagagagggagagagggaaaaagggagggacagagggagggcaggaagaagggaaggagggcaggggagggacucacccggggcugaggccacaccacagucaccauccuucagacacccugccuguguuugcuuguucaguccacacagcugcaccguacaucacagaccagaggggagauucgcuuguuucuuuuaaggugaagucccagaggauuuccccggcauauggaaagccccuguggacuucaaguuaggcucaguuguggcuuggcuugacgguccccagugaccaagaagcauagcucccgaaggugggacucauuuaccccacccugaggggcucugaucacagauaugcuuauucuuacauggaaaagaaacacauugcauccauucguccucauccccuagaaacccacucccuauccugcuccagaucgcguggaacaggcugguuccuagugcuguuugguggcccuuuagacaccugaggacagagacaugccccugggcaucuuuuuuccagaccaaauccucuuccaucuccaauucuucauuuauuuguucagcaaaugcuuucuaagcaccugcuaugugcugggcuuucugcugagcucugggaccaaaaagacaaagauacugggucucucuccuuaugggaccugucauaggccauuguuuggaccaggugcuccaucuguccucuggaggcugagguccucgugguugagagagcagacugagggccagcagggccagguagagagugaguaucuggaaggccaggccacccuaagccauggcuucuucgucuguaaaaugggccaacacgcaugccuuccucaugggacaaggaccuccuuucccccauugcuuccuucucuagaugcuagcccagugucaacccacugaaugaaugaaugaaugaaugaaugaaugaaaguguuacaaggauuaauggugcuaaugugcaucaaccucuaagugcccaugagauucuccucccugggggauuuccgaaggggcauggucccccagcugacccaucccagucaaucuugagaacugggcugggaaacucggagggucuccgucagcauuuucuggauugagagggggugugauuucagcccccauuccuguauucuugguaucugcuccaucccugaugcagaugaggcuugucuguucacagggugcacccugugccagcccaucaggucccacuaucagagugguucccaggccugaugggugauugccucaucuguuuccagugucugccaauuacauuuuauggcagcagcuggguuagaugugcagcaaucggaaaacagcauccuaggcacagagcaaaugcagaguuugggcuuacauuugucacaaaacagcaucccagaucacugaauaauuuauaguuaauuauuccaacuuaaaaaagccuuggaucacaaugauucucucuucccccagaguugcgggaucuguuugggcagcuugccuggcuguguggcagcaggcaggcauucugccgucuugcccagagaggcuuccugcucccugccucuccuguguggaugugugccgugcgacggcuucgcagcccugugguuaauguggccacucuucccgugucagcuuuuauuaucaugaacacccagcucccucagggcccugcaggguuuuagauaauuccucagauuagagcaauuuguccccagcuucaggguguuugaaccguuaauccuggggcaccuacaggguauguaccaugcaaggcccuugggcuauuugucauuugggguccagggccccggaugcaccccaggacuuggcucaaaugaaccccccucuuuccuuccuggucacacacaaccaugaaagcagguucuuuggcaauguccugggucccuccugggaugacucuggccaagguggggguccccugugaugggccccuuccaaaugaugguagguccaaggccgacagcuuggaguggaugagaucaaauaggguuagggugacuccugucuucucaucuucacccuucuagaauaccuucugcuggccgggugcaauggcucacgccuguaaucccagcacuuuaggaggccaaggcaggcagaucaucugaggucaggaguucgagaccagccuggccaacguggugaaaccccaucucuacuaaaaauacaaagaucaucuggguaugguggugugcgccuauaaucccagcuacucggaaggcugagacaagagaaucgcuugaacucgggagguggagguugcagugagccgagaucacgccauuacacuccagccugggcaacaagagugagacucugucucaaaaauaaauaaauaaauaaaauaccuucugccacugcaaucuuaauucauuucauguugauuaaggaccugguguuguuaggaacaaacauuucuagccuggggacacaguggugaaaaaagccagaaguuuccuccuccugaagcucacaacuagugggagcaggcagaaauacauggaucaacaaauaauuccugugucuaaucacuggugguguaaaaacuuggaagaagaaaggggaaggaagccuggaaggaggaaggagaguggcuugguggggaggggcauacccuugcauuggguggucaguggagaaagggaccuugggcgcaggcagcugaaugaaguaaggagggagcccagcaggugucugggguaggaguuguuuuuuuuuuuuuuaugguucaaugguccauucuguuuauucagaacaguaagauaaauauaccuuaaauauuacaaauuuuuauauacagaaaugaccacuccgcagcaaguuugaaaagacaaaaaaaaucaucuccuccugcuuuauaaaacccuagaugacccauuaggcagaacugagcccuugaugcauuuucgucagcacacuuuggccaacauuggagggaaggacaagaaugugggaggaaaacaucacauugaaaaucccuuuccaaugagggugccaagcgucuggucuugaaggaaguacccugccuaggcaggugugaagguccagagguaggacuguguguggccugucggaggcacugcgagaggacucaugcagccgaagggagagaaggaugggguggggugaggcugaagggggcaggguugcgcuccacagugcuccagaauguacuucaugccuaucugauucccucaauauuuccugagccagacaccugggaggacuggagaugggugagucaguccuuccccugggcugcucauaguuggguuuuuuguuuagucacucaacacacccaagcacugaauggaugaaggagucccagcuccugagguccccagccuagugagggcaccugaaagcaggaguagccgccugguuugcuuuuccccucccaaucugccuugggcaccacguccuggccacuuuugccugccagacuggcugugugguccgcuuugcccugagcugucuaacuuggguaugucucccaaguuagaugaaguuccagagggagagggagagggacggggagagaggagagagaggggagagggagaagaauaugauacugucuagcugccuuuucugucaccaaaaagaucagagguguagauucagggacccccauuucaauaccagccccaucaagaaacauggcaauguucaaggcuugagaagaguccuuuuccccauugaugacuguuugagucacucauguccccgugcaggcccuagcacagcccgggagcucacugggcucaguggguggguuugccgucugggugagugaacuguugcuccccaacgucaccgugcauagacaccagcuccuccaccuuggagcucgcacugcagggugucaccucccaugguccccuuuccaaacugcugacccucauuaguauucacggcacacccaaugaauuaucuccaccccauugcuauuuuuuuaauccuugauacuuuaaauuucuauuuuuaugcauuuaaaauuaugaaauauuugauacauacaacagacuguaucaucauuuguguagguuguggagcaugguaauaaauugcagcaucuguggauccgugcuuagcauugagccuacuauucucugaguuucucccugcccaugaaaguaaccacuguccuaauauuaauuccaccauugccugguuuuaaguugcaucacaaagauauaggcuuaaaccaucuaguguugagcugcgcaaagauuuuggauuuuuauauaauggaacaugcuguguguguucuucaggaaccuggcuuccuucauuucguauuccuugucgauguguguagggugaugugcuaauuucuauggcugugcccuguucccuuauuugcacgaucgugucucccaagauuuggacucuaagaguuucacuaggguguuuacuggagagaaauugcugggguuugggugugcacgucagcuuuacuguauguacuggcaccaaagccaacagcguauggaugcuguaaguccucgccagcucuccacauucgcaggcuuuuagauuuugccaaucuggugacugcuaauggucucucaugugauuuuaauuuccauuucccugcagagccuuucauauguuuuaaggcacuucucaugaccucuucuagaaaacacuguucccugauuugugcaaacccucuuuuuggguccuuugacuucuuguugccaucuugaagggccuuguguacuuucucuguuaaucauuguucauuuuagcuguggcaaaugcauucucccugcauguagcuugucuuuucgcuuuaugaugauuuuaauguagcagaaggcaaugcucuguugaugguuuguacuuugggcuugcugaagaagucuuauccuagcccaggguuauaauaacaaguuuucuauaaugucuugcacaaguuuuucaguuuugcuuuucaugguuaaaucuuuaguuuacuuaguauuuauuuuugucuaggguuugagguagggauuuuaauuuuuuuuucuuuuccaaaaggaaaacaaucucccagcaccaccgaguaaaugguuuaccuguucccacuggucuggaacauccucucuguacucugccauuuccugauaugcacaguguggauuccauuuuguucugugggccuguuugucuguccuugcaccaauaucacacggccuuaaguauugugacaaccuugcuaucugguagggcacguuuuccccacuucccugccaccuccaucuauuucucuucugaaaauaaguagcuggccacucuuccucuugcacccaugaucacacccugcugcuggguguccugccggugcucauggugcuguuuccucaguuggggugccuccucccucuuuucccugaaugacugcugcucagguguggacucagaucaagcauuguccccuuaaaggccuauggaacuucuccaucccucaggaagagagggcaguuguuguuuggcacagucuauggaucacgcucuuauaccugcccugcuauuuacuauggcccucccacccccguccauacguauggcaucgucacacucccuguguccaucacagacuuuauuuauuuauuuauuuauuuauuuauuuauuuauuuugagauggaguuuugcucuuguugcccaggcuggagugcaguggcgcaaucucggcucacugcaaccuccaccuuccgggcucaagugauucucaugccucagccucccaaguagcugggauuacaggcaugcaccaccacaccuggcuaauuuuuuguauuuaguagagauaggguuucaccauguuggucaggguggucuugaacuccugacuucaggugauccacucgccucagccucucaaaauguugggauuacaggcgugagccacuguguccagccuaucacagacuuuaacgcacagaaggugccuagggaauauccaugauuccaaauggacucacaccuagacuuggcucuucuuccccuaacauggcccuucccuccucccuucaucacauguugauuguagguggguguucacuggaaaugcaaggauggguguccaagcaaagccucuguugcguccauuucacagaucagcucucaguaaaucccauccucagaggccugggcuggugggguccagaugggaugauucuuuggucugauuauuuucacacuaugaauguguuucuuucaaaguuaggauuuucuuuccauaaauagagggcugaacuuugcccccccgcaaaauauguccaagaucuaauuugcaguaacugugaaugugacacauuuggaaauaagagucuuugcagaaguaauuaaauaagaucucaagacgagauuguccugguuuugcucucugguaacugguccuaaaucccaugacugguguucucauaagagaaaagagagggggguuagggagauacagaggaggaggcagagacuggggugauguguucacaagccaaggggcaccaaggagugccgccauggagagccgggagggggcccugggacagagucucccugaagcuucuggaaggcacuggcccugccaacauuuugauuuuagcccucuaagaugcauccagaacugugagaggacauguuucuguuguuuuaagccacagacuuugugguaauuuauaauggcagccugggaacucauacaccacgcaaaaguuauccagcaggagaaacucggaagggccagccgaagagccuccucucccucccggcagcaguucuguuucaaagcgccuuggcaucuuuuagcugauuuucaccacauccccuggaggaaggcucagugaccuacuaucuccauuuccagguggagaaaguauccucaccucacugucacccucgugcaauguugcuuucucuuggaaucacugccagagcaugggaugaacccagaccugaucccgugccuguucccucaccaggaggacauagagugugggggcgggcagggacauggcucaucccaggugggauccggcagcugucacacucauccccagguugcgagccccucugcaugccagguacugugccaggcaccggugaucugggagugcccgggacacuguuuucgugggugcuggucugcaugggccccaggccugccccagcugcuguguucuggggccaacuguccuuccagccuccucgauagccauauggcauucccugugccgacgauggcuugaugucacuuggguggacccagguguggcagacaugcgaguggcagaguggaccaggcuguguggcccugauacucaccccacacuguggcucucagccugaggacuucaugcuggcuguggaggccacguagccccuuggcagggcaggcuggauggguaggagaggcagggcccucagcugugggaugggguguuggcaggcugugcccaccagcuuguuggccuccccaaguugcucuuccuccagcaaccucgcugcguggacagcuuccccugucacagggacagcagaguccucccaacaguauguuccugggccaggccaccaccauccuggucucagggcagccucuggacagggcagccaggagaguucucugaauaaaacccuuuuacucagguuuccccuugcuuccacccuggcagcagcagcugggugcaguugcaugagcguuggccccaggcucuccagccacacuccaggaagggccaaguauggccuucucccuucccaugcaucccugaccugugucccaggaugccugucugcccugcucccagcugaugccucccugugcccggggcucccaccuggacggcgugccgcgugugcuuggugcccugggugcuugcuggccuccaccugggcugugagugucugaguuaggggcuggguuugugucacucccucuuguauucugggcaucuggcacccgugugguccagguggcccuccgucucggagaccagugcuucgguguuacauucagcuccuugccccaguaggaugcaagcucuuugagggcaaggccuggcaugcgggaggugcuguguuccugucuguugaauaagugaaugaaugauugaauguguuagaggguccaauguggggagagugagggauuccccuggacaccccggggagggccuucacacccauauuaacccacccagcggaccagguugacggcgauuuggggaccuaugguaaggaaccaggaucuccugcguccccuguguuucuagauacugcagggcugguaugggcccccuggcuguagggcugagacggaggcauucaggcuagaccaauggguccugccccagccgugucagcagagccugccugauccugucccuggguguuggccagagugccaagaaagcacaaaagacucaggcggaaaaaucagacagacccuaaggugguuuaaaaaaugugcaaacccagguacgcugcaggcucgaagcuggguguagccgaggcguggggcaaaugagcauguuuggauuaaaaaaggccaacgcaucuaacagccaggaagguuugcuuuaacauuccagcauguucuguugauuuauggcuguugcuagguaacagaauacaccgaggcugugugauuuuaaagcuacggcucccgacuaaagagucgacagaaagagaaaaccauuaaucagggugggggcugggcguggauuuaaaugcaaaccagaagacagggaacuguugggagcaaugagggcgaagccagguccaccccuccgugucugccguccuucaaggguguguuccgcugcggguguggagagcuggcuacagacacgggcuucuccuucaggaaggcacuggcauaaauuuaucuuucauuuugcacuagaucgaucuaguaugugucagauuucuaacacagcacuguuaguguaccagauguacggagugugucaucuugaugggcaggaugcauugugccauuuuuauguugcacacaacucccaccucuccccagcaccaugccuuugcuaagcugugcugcuaccuccuguguggccugcuugggauaggacagugaaaaagacagaagcccccagacucuccuccauguccacacgccccccaccccagcucccugaagcugacauucugauugagggagacagacaauaguccugauaaacaacgaauuuuaaagcaaagcccagaaagggggaccaggagggguguguguaugugcgcgcgcgugcgugugugcuuguguguggguggguggauggcaggcgugcugguugcaauugcagguagggggaaccugguuggccucauuaggaaggugacauuugagucaagucuugugcaaagugaggggccgaggcuugcagguaucugagggaagaauggcccaggggaggaaauagcagaugcaaaguccccgaggcaggguaugcauguugagcuggaggaacagcugggagguugguguguuggaauggagugaggagggagacuggggaggggaagcagauccuauaggguccccaggccacugggaggacaucauugucuuggcaggucagaauccuaacccugaaguucagucccauaccuggggcccaugccuuugacaggccucccuccugccaaaggcuggcuugcuccuuuuggagcgguaugcaccugugucauugcuguguguucuccaaaccccaggucuccucucuguggugucucuuaguuugcauuccaugaaaguagugccugagccuggcaugugggugcaggcaguuuauuugggaugagauccuagggcacaucauucgagucccugcuguagggaugagggcuccagucuacugagaauuauacagagggcuccagaacugaucucuaaaaaacagcaguaguucuccagggauuaucaguucagaugggugggggguuggcguggggccacugacuuucacucacacuugagcaugcgcuccaggcccaguggugugggcagaggccuuggaguggaaugcagaaagacgccagagcacucggggggaggcucuuauagcauccccuaccccaucaagucuucagcaccacgacccuggacaggcugaagaccagaccucccugucugugggguuggccauggguaggcaggggccccggcugacccuguuggaguccauccuggguuuuuggauugcaguggguggugauaccuucucuggcucuggccaaggcacugugggacauguccuuggagcugcuacuggcuguguccaccccaugagagaaacagagaggagaggcagagagggucccauggaguuuaagccccagggcccacugucagggccuggaauuguguccccuuuuuugcuaagcuaauuuaggcuggcuuuuugucacuugcaaucagaggauccugauuaagccuccuuauugucccugguguuaccggucccuggaggacaguaguuuacucaggcccugcagcagagccaguggauggagcccggcuguauuagucuguucucgcauugcuauaaggaacuaccugagacuggguaauuuauuaagaaaauagguuuaauugacucacaauucugcaggcuguacaggaaauauggguaguaagcuucccucaggaagcuuauaaucguggcagaaagccaaggggaaguaggcacauauucacauggccagcaggagagagagagagaagggggaagugccguaugccucuaaacaaccagaucucaugagaacucacucagcaucaccagaacagcaagggagaagucugcccgcaugauccaaucacuucccaccaggccccuccuccaacauugaggauugcaauuugacaugagacuuggguggggacauagagccaacuuauaucacuggcccaguuccagccuggcccccuccagagaccugccccaugauggccuggccuugccacccuccuguuugaaccaaucaucacuucuuugguucucaaggccuuguggguucugauagccccacuggacucaacccucugguuccccaagggaauaccuggacugguuccaccacccuacauggcccccuggcuuggcccaccaugacauaccccaguagccugccccaucuuccaugcagaagcucauuggccagccugugccaccaucaugcaggaggcacagagauguuggggaggggcaggaugaggggcugaccaccugagccacuuacuggccuccuugaucauccauucauccacaaauucacccaacaauacaaauuccugccacacaccaggcacuaggguacacaacacagugagcaaaacaggcaaaaaucccuguccacagagaugacauuacagugggggaaaugggauaaaacagaucugugagugacacagagcagggcccuggagcauuggggcuguggcagaggguuuacgugggguggugccccgcguucaggagaggucuggggcacagcucugcagccaggccuccuggcgucaggucuuauccacugcucaugugugaccuggcugagguugcuuaaccucuuuaagccucaguuuucccaucugugaaagggagacacuaagagucccuacccacaggguguguggaaguggagugaaauccugcuugaggaguguuugcccagggugcggcaugggagcggggcugcaaccucggcuucucgccauggcugauguuccuuuucagaauaucuugagagaugcagagcuucccuaacacugugcccugaugcguccgcucucccuggaguggugagacagcaugggucuuccuccccaccucacucuaggggauguggcugaugugguuugcagucauguuuccccauuccucugucccaccugucccaucugguuccccuguccaucuguuucucaggacuguggcuuccuggagcccucaaggcacgauugggugcuguucauugguuucugcuccaguauguccuguaguccugauauuuaauuugugagcaaucauuuuuaaaauuaaugaauaguuaauaacugugguauggacuuaaugaugacucgaagcacagaaguaaucaaggaaggcuccaugaaggaagugucaugagaggauggcuuggaaaugccagugggaaagaugaaugccaucucccugcugaaggcuggguagaguucauucccugcagucccuuuauagauggaggacauaagucccagaugagcgcucccaggaaccugcccacaaaaggcuuggagucuuguuuuccugacauggccaggcccaggugggagguggggaugagcaucaggccuuugggcaccucuugaaagggcugaaccagcuggugggagggacggaugccugggggcugcacacauggcuggcaagugcugugaauuauugaucacuagagagcaaugugcaggcggaggucauuuuccuccugggccaaacugcucgaucaugcuuaauugccuguuuuccaaauuuccccaaggcuggccuaggggagggauuagcucuaugcccauuuauuuuucuugaauccaguguaugggguaaaaaguuacaccauccauuucucuuugguauuaaguucgaaaauaguggaugcaauuaauucaggugguaacaggugguuuccuguccuaccugguauggcaaagaggugcuucucugugaaucucaauccccacaagacucggcucacuuguugaguaguggacuggcagaaucugaaaaaguuaagggcaauagagacucccugagcacccaugaugugccaggcgcuagguauaucagugccuucaauucucacugagauaaccaaauaaaauaaauaugacacauuaaagugaggaauuaguugaagaaguauuuucaaagaaaauugucaaaaguuuguugcaaggaugcucccacucuuuacugacaggcaggguaugaaaggguugaggggugcauaauaaaaggaguuuuguggagcauacugcuuuggagagggcuaugcugggaaucccaucucugcaugaggaggaauaggagguaccugccacuuaccugaagcccgauguggagggaggguucagggcuuaaaauggagcugcuaggcuucuggccaaaauggaauaacagggaccagacuuagcuucucaccuuaaacaaguaaaaaaaauggcaugaaacaaaugaaacagggauuuucaagcaauuggacaucagacaugaaagugaucauugaaugaugggaaauaaacaaggugaggccaaggacugcuccagcuuacugccuugagagauuccuggccacguugcagggagagguugcccacuggagucugcuggaacccccgaguugaaagaaugagcugagucuggggagaucaaaguggcuggauuucacaggcagacuaauggaauggagagagcugcaaagaaagacagcucuggaguuaugcagaaguccaacuugagugcucaguugaguaaugaucagcacaugcaugcaaggaaauuacacagucagggaaagaacccccaaaaggaccugugauaccaguacuuagagcacgcacacagucaggaguagugccugcucuuaccagccagacuggaaaaucuuguaauucacaggaaauuggguagacaacucaggaaagucuugccucaguaggaggaaauuauuaguccuagauugauaauuucugcaagcauccuuagcaaaucaucaaagcaaaacuuuugaaagggugaaacuguuucauuuuuguuuuuuuagacaggguuuugcucugucacccaggcuagagugcagugguguaaucauggcucacagcagccuugaucucccaaguucaagccauccuccugcuucagccuccugaguagcugggacuacaugcacaugccaccaugccuggccaauuuuuccauuuuuuguagagacagguucucacuauggugccuagguuggucuugaacuccugggcucaagugauccucccaccuuagcuucccaaagugguagaauuagaggcaugagucuccaugccuggccaggaucaaacuguuuauaaauguguugacuacaucucagaacaaggcucaggaauauuuauaggaauacaaacaaauccagcacccuaaaaggcaaaaaucacaaagucuggcauccaguaaaaaauuacuagccaugcaaugaagcaggaaaaugcaaaucauaaugaaggaaaagucaaucaguuaagacugauccagaauugacacagauguuaaaauuagcagacaaggucaucaaaacacuuauuauaaucauguucuguauguucuaaaagcuagaggaaagauuggacauacaaucaacauggaggauauagaaaagacauaaaucaaacuacuacagaugaaaauuacaauguauaauaugaaaaacacacuggauaggauuaacagcagagaggacauugcagaacaaaagauuagcuaacuugaagacagcaauagaaacuauccaaaaagaaauauagagaguaaaaagauaaaaaaagaacaaaaauuuuaaaaagaaacagagacuuucucauugaguugagacaacuuuaagaggcguaauauauguauaacugggguuucugaaagagaggagaggaagggacagaaaaauaucugaagaaauaauggcuggcaaauuuccaaauuugaugaacaugguacacccacagauacaagaauuucauugccccacaagcacaauaaaaaugggaaaaaaccacacuaaggcacauuauaauuaaauugcccaaaauaauaaagagaaaaucuuaaaguagccagagaaaggcgugggguggggaaaacauguuauauacaaagcagcaaagauauggauuacagcagauuucucuagaaaauaaugcaagugagaaugcaguggaacaauauccucaaagcaugaaauuaaaaaaaaguagucaaacuagaguucauacccagaaaauaaucuuucaagaauaaaagcaaaauagacuucugagacauaacggcuuaaagaauucauaacuagcaggccuguaguacaagaaauguuaaaggaugugcuucaaacagaaugaaagugauacuagauggaaauauggaucuaugcaaaggaucaaagagcagaguaguaacuacauaggucggauaugauauuuucucuuauuauuuuaaucucuuuaaaguauaauuggcucuugacacaaaauaauaaccauguagugugagguuuauaacauauauaaaaguaaacuguauaauagcaaaaaggcugagaggggagaauagaaguauacuauuauaaguaaguauaaguaucuuaaucuauauuugacaugcuauaauaucaccugaagguagacugugauaaguuaaagauguauacuguaaaccuuaaaauaacuacuaaaacaauaagaguuguaacuaagaagccagaaaguagauagaauggaauaauugaacaaugcuuaauuaaucccaaagaagacagaaaaggagaaagaagggaacaaaggaaaauggaauaaauggaaaaugaauaucaagaugagagauauaaaccuaaucauaccaauaaucacuuugagcagccauggucuaaauaucccaauaaaaagacaucagaucagaugaaaaggcaagacccaaauauaugcugccuacaugcaacccacuugaaauauaaagacaagaguuaaaaguaaaacaaugaaaaagauauauugcguuaacuaacacuaaucaaaggaaagcugcaguggcuauauuaaucucaaaguagaucucacaguaaagaauauuaccagguuaaauaaaguaauuucauaaugauaaagggaacaauuaauuaaaaguuaaugcuuaugcaccuaaucagagacaugaagcaaaaaugauagaacugcaagaagcaauagaugaaucuacaauuauaguuggagguuucaauaaccuucucuuacuaauugaugaaacauguaaacaaaaaaauguguaagaaaauagaagauaugaacaacacuaucaacaaacuggaccuggcuuauaucuguagaacaugcuacccaacaacagcagaauagauguucaaguacacaccaccgaacauucaucaaaauaggccauauucuggccacgaaacaagucucaauaaauguaaagggacucaagucacaaaaaguauguucugucauaauagaauuaaauuagaaaucaguaacagaaagagcucuggaaaaucuccaaauauuuggaaacaaugaaacacacuuuuauauaacccauguguccaagaaagggaaauuagaaaguauuuuuacgugaaugaauaugaaaacacaguguaucaaaaucuaugagaugucgcuaaaaccauacuuagagggaaauuuacagcacuaaacauguauauuggaauagaaggaaguuccuaaucaauggccuugaguuccaccuuaagaaacuaggaaaagaagagcaaauuaaacccaaaguaagcagaagagaggaaauaguaaggaccagaagagaaauuggcuaaauauaaaauaaaaacaauagagaaaauaaauuaauccaaaaguugguuauuuauugguuaaaaaguuaucuaagauuuuuaucaguaaaaucgauaaaccucuugccagacugaccaggacaauaagagagaagauaaaauugccaguaucaagaaugagaaggugacauuaguauauauucagcagucauuaaaauaacaauaagggaagauaaugaacaacuuuuugcuaauaaauucaacaacuuagagggaaugguuaaauuccuggaaagacacaaauuaccaaagcuuacugaagaagaaauagauauccugaguaguccuauaacuauugaguaaauugaauuuacaauuuaaaaccuuuccacaaagaaaacuccaggcccagaugacguuacugaugacuuucaguaaacauuuaaggaggaaauaauacuaauucuacauaaacucuuccaaaaacuugagaacacuuuccaaaucauucuguggggcagaguuaccuugaucucaaaaccagacagacauuaugaaaaaauucguguccucauguacaugaauuaaaaaauuauuagcaaauucaaucuaacaauacacaaaaaggauaauacaucauagccaaguggguuuaucccaggaaugcaugguagguuuaacuuucaaaaauuaucaauguaauuuaccauauuaacaauuuauaaaaaccuaugcuaucaucucaauaaacacaaaaaggauuugacaaaaccaaccuuuauucuugauaaaauugauaaaaucugucaggaaacuaggaauagaagugaaguuccucuacuugauaaagagcaucuaugagaaaaaccuacaggcuaaaugaaagauugaaugcuuucucccuaagacugggagaaggcaaaaaugucuacucucagcacacauucuucucgacguuauagcuagugcaauaaagcaagaaagagaaaaaaagauguucagauuagaaaagaagaaguaaaacugucuuuauucacagaugacaugauuauuuauguagaaaauccaaagguaucuacaaaaaagcuaccagaguuaauaaaugaguuuaacaaguuugcaaggcacaagcucaaucagaauagaagcuuaaaaacuaccaguuaugauaugagguaggaaggaauacaucugauaaaagacaugaaagacuuaugcacugaaaauuauaaaacacugaugauagaaauuaaagaagaccuaaaugaguggagagauauacuaugggaguggauuggaagacucaauauuguuaagauggcaguuccccccaaauugaucugaaauucaacacaguguaaacaauaucugaacagguuuuuuuuuuuuaagaaacugaaaaacucauucuaaaauucauauagaaauacaaaggaccuaggauagccaaaacaacuuugaaauagaagaacgaaguuggaggacuaacacgaucugauuucaagauuuauuauaaagcuucaguaauuuauacaagugauacuggugucaagauagauuaacagaucaagggaaugcaauacagaguccagaaauagaugcaugcauauauggcagcugacauagcugauuuugaauagagacucaaaugcacuuuaguggagaauauuuagauaaugggugcuaaaacaauuguauauguguagaaaaugaacuucaauccauauuuuguaccauauacaaauauucaaaauggaucauagaucucaauauaaacccuaaaucuauaaaacuucuagaagaggaggugaagaauuuuuucuuaaaggaccagauaguaaguauuuuaggcuuguaggccauauggacucuguuguaaugauagaacucugcuauuguaguaugaaagaagccauagaaaauacaugaauagauauggcuguauuuuaguaaaacuuuguauauaaaaauacgcagcuggucugcaagcuguaguuuaccaaucccuguuguugaagaaaacagaguaaaaaccuuugugaccuucaguuagucaaaaauaucuuagauaugacacugaaagcagguugcauaaaauuaaaaauuaauaaauuuggccucaucaaaauuaaaaacaucuccuuuuugaaagacacuuaagagaaugaaaagacaagcccuagacugacagaaauucucuguaaagcacgugucugauaaauggcuuguaucuagaauauauaaaggauucucaaaacucaauaguaagaaggcaaacaacccaauuaauaaguggacaaaaugucugaacagacauuucaccaaaaugauauacagauggcaaauaagcacacgaaaagaugagcaacaucauuagucacggggguaaugcaaacugaaacuacaaugagauacuacuauuacauaacuguuagaauggcuaucauuaaaaaggcugacuauaccaaauuuuggugaggauauggagaaacuggaacucuuauauacugcugaugggaacguaaaaugauauaaccacuuuggaaacuuuggaauaugaucucuauaauaacacaaacuauucuauaaaaacauaaaaaguggaaguucuucaauuuaugauguuaguacaaacuugcuagaaaauugcaagaaaagaaaauuauuaaucaauaugacuucuaaacauaggugcaaaacucaaagauauuagcaaaacaaauauggcucuaucuaucgucuaucuaucaaucaaucaaucuaucuaucuaucuaucuaucuaucuauccauuuaucuaucagucaucuaauuaccaugugaaguucacccuaggaaugucaggauaguuaaagacaaaaaauguuaacuuaauuuacuucuuuaauagauuaaaggcuaaagucauauucuuauuaauagauaccacaaaacaaagcaagcagccaaacaaaaagcauccacauuagacaaauuuuaauacuuauucuaaggaaacgcucucagaaaaccaggaaaggaauuuacucaacccgagaaagggcaucuaucaaaaccugauagcaaacaucauuuuucaugaugaaacuuugaaaucauugcuagaacuaagacaaagaaaccuaccaccacugcuguucaauacugccuugcauuggaacuaacgacuagacagcaaguggguuaaggacagcaaggaaaagccaaaauuguguuuaauugcagaugacauaauugucuacguagaaaauccaagagaaucugcucucaaacuauuagaagcaugugacaguucaacaaaauugcuggacacaggacaacauagugaaaucaauagccuuccuacugaacaacaguaccaauuagaacauguaagaaggggcaaauccuauuuacaguagcaguaaaaucuauaagacgcuuaagagaaaaucuaacaaaagauguaccagcccuuucggagguaguauaggagagugguucagugguucacagcagaggauccuaauccagauugucuggcuucaggucauggcccuacugcuuccuggcuugggaaaauuacuugaucacuuggugccucaguuuccucauuuguacaagggagauaauaauaauauucaccucacagggaagcugggaagauuaauugaguuuacaaauauaagguguuuagaacaguagcuggcacauauuaacuucuauauaaaugguuguuauuguuaugaagaaaauuauaaaauuuaauugaaggacaugaaagaagagcugaauaaauacagagauagaccauauccauugaugggaugauucaauaucagaaaggugucuauuuuuuccugguuaauuauaagcuaauugaaguuucagugaaaaucccaacaggauuuccuuuuuacuuuuuuuuuuuuuuuuuuuuuuuuuugagacggagucucgcucugucacccaggcuggagugcaguggugcgaucucggcucacugcagccucugccucccggcuucaagcuauucuucugccucagccuccggaauagcugggacuacaggcacgugccaccaugccuggcugauuuuuguauuuuuaguagagauggggucucaucauguugaccaggcuugucucgaacuccugaccucaggugauccacaugccucagccucccaaaguguugggauuacaggcgugaguuaccaugccgggccccaacaggauuuucaaugggaucuacaaaacugaaaauuugcauaggaaaaacaaaaguccaagaauaaccaagacaauuuugaugaaaggcaaagacugugccauuugaccuacuugauauugacuuguuauaaagcugucucucuacggcaggguaguacugccacaugggccagacagaaagaccaauggaacagaauagagaauccagaaauaaaggcacauguauaugggaacuucguauagaaaagaaguggcauuuuaaaucagugggaaaaggauggacuauucaaugaaugauuuggauauuauuuucuucauauggaaaaaguauguaauuugaucacugccucaccccaaacagaaaagcauacuguaaaugagguaaguauacguccuaaaacauaaaggaaggacauucuguuuacuaccuuuauaacucagcggguagacaaguauugguaaaacagaacacaaaaggcaaaaugccugaaagauaaauauugauacauuuccuacaucaaaaugaaugacuucuguaggacaagaauaccauaaacaaaguuaagacaaaaacagcaaauuagaagagaauguuugcaacauagaaacagacagaggauagguuugcaacacauauaaacagcagaggauacaauuauaucaaaagcucugggaagccaauaaggagaaagucacacaauccaauggagacaugggcaaugggaaaagacaggcgauucaucgaagaggaaauucaaauggccaaguggaaagauucccaaacacuaggaaucaggaaaugcaaaguaagcaaucaucacauacccguucacccaucaacuucacaugaauuuaagucuauuccaagugucacuugagaaugugauacacugcuguaggaguguaaauugcuucucuauuuggcaaugaguaggaaguuaaauauguauauauuccaguaugcaugacccagaaggaaugucaccaguaugacucaguggucucgcccuccaccuguccauccuaggaaaccuuuacacugcaggcuaugaggaacuaaguaaaaggauguaccugcaguguuguuugaaauccaaaaagguuagaaacaaccuaaauauuauguggguggguggacagcagguagaagaaauaauacauuaaugguaugcucguaaauauuuaacaaccugcuauccaggaaaaaaagccuuaauuuggagaauuugccaauuucugggauguaaauacucugccauggcugaugucuagcuaccaucgugacaucaucaaacacagaguugggaaaagauaugcaugaucagcucuugcgagaagguucuuggggcaagcuccggcacaccauugauuguuuucugccagcuugcaagaucaaugaagaaacuaggguagagcugaaaacauaaugcuuaggaaaaaaagcaguuuguaguauggugugaucaauaugaucagguuuauauaaauuucuaaauuacauaaaaugguacaaugcauguauguauguuaaggaauagaacauaaauaggaagaaagcacuacuuuggggauaguguuugccucuggaaagagaaaggaaagaugaggacuaggaagggauguaaaggaacuucagccauaucucuguggucucauuuuucaaaugaaaagaaccgaagcaaagcugggcacuuuggcuuguguguguagucccagcuacuucaguggcuaaggugagaggauugcuugaguccaggaauuagagacgggccugggcaacauagugagacccugugucuacaaaaaauaaaauaaaaguaaaaaagaaagcugaagcgaauaugucaaugcuaauauugauuccuuuugaaucaauauucaaaagguaggggauuguaauaauacauuuuaguccauuuaaaauaugucacuaaaacaaauaaaauacaaaaaaaaaaaggucugaucaugauuauguaaaaacaaaacucuacguugaaaagguccugggauaacacacucuaaaagguuucuggcaauuacauuuggacucaggaccauaacuuuuauauuuuccuuuacuuccaaauuuucugucacaagcaaguguuacucgugcaggggcagaaauucacuaaccuugaggguguugggcuggauuauggcucugggcccuuccacacagacuucgucuucauuugcugggucuuggcauauuucagaauuccaagacauuuucucuccguccagaggcauggcgaccuggguuguggguggggugggugggcuuucgucuuaucauuucacuggaggaaagauccauugcggcacuauuugcccagccucuaugagguucaaaguggucgaacaagccaagagagccaccuggaagcuugguccugggaccugggggucauggaggggaaugcuggcagagaagcagcuagguuaggacagcuagcugcuguauuauaccagcugguauaugggcugacuauaccagcccuggaaucacagaccuggguacaucucuggauugccacuuaggagcugaguaacuugggagaaaggugcgguuuguucauuuguaaaguggguccugugguuggcuguguuauagugcaacguauuagcagccccauccuggagggagacuguacuugcacgcuccgcugaggucacguggccaugugacccucagugcccucccugcccuuacugaacuugcauguggugguuuugugaauuguuugggccagcgacgcuguagagugagcucaccaccccugucucucucuguuaccucugcacaaagccagccaugugcagcuccaucagccggggucccgggaagaagauaacaggggucagagcuguagcccacucgagaugcacacgcagcaggagugcgaaauagccuugaagccgcugcguuuuggagggucauucacggcuguggucuucuaguucauuccggcugaggcagggcugucauguguugaggacagaaugaagucaccuaugugaagugcucagccaccagcuggcaaagggggagguagcaggcagguaggugaggaugugcugcugucaccaacaacccacaacucucagugacaaaacauaucacaugcguguuucucacucacucagcacaucgaacagggcccuguuauuuguacucaauuaaggacucgggcugauggacaaucucucuugaggagugcuuuuccaagauccugagucagugaaaaaaagaauuugucaaacccuacagaggccacugaagcugcacucagaagagacgcuagucacucaccucaccuuguacucugcaaagcaagucucaugacuacaccuaauauuaaaagggaugggaaagugcgaaucuaccccaggcacagaaggaggcgagaagcaggauguguguggucagcacuaaugaccuccccuguggccauucaauaaaugcuagccgcugcuagagucaccauuaaucauagcauuuaggcuaauuccaaauggagaaaaggugagacguagggauggcacugucggcgggagcaugagugugugcagauguagaguuugggaagggcagcuguccagggaagaagcaacggggcacacagggaguuggcuggagacgcaguuggggccagacugugaagaccuuugagcugagauguugucauauggagcugggagccuggaaacaucugaaccaggaaggggaacacggaccacaugagggaggggugaggcucugaauucuggcagagugaggaggcuggcucaaggaggggaagggcuggagagcucugugugagugcaugucgacagggcuggaaggaggacaggcuguggggggugaaggcgugggagucgggaugacuccagugcauccuaagugcagacaaagaggagguccaguuccaguuuuuuuuuuuuuuuuuuuuuuugagacggagucucgcucugucgcccaggcuggaguggaguacagugccgcgaucuuggcucacugcaagcuccgccucccggguucacacccuucuccugccucagccuccugaguaguugggacaacaggcgcccaccaccaugcccggcuaauuuuuuguauuuuuaguagagaugggguuucaccguguuagccaggauggucuugaucuccugaccuugugauccacccgccucagccucccaaagugcugggauuacaggcgugaggcaccgugcccagccuccaguuuuaagagaggaugcuggguuuggcguuagaggugaugaauggcuagaaucaaaaugacaauaccucauuuaagaagguuguggaucaacagggacaaucuucuguuaccucuuugguaaacugguugacguccaugacuaaagcuaaacaaacagacccuaucacucagcaauuccuagaauuucuuuugaagagaaucuugcuguguggcccaggcuggagugcaguguggcaccauccuggcucacugcaaccccugucuccaaggcucaagugauccucagcaucccgaguagcucggaccacaagcaugcaccaccaugccuggcuaauuuuugcauuuuuuuaguagagacggggucucccauguugccucggcuggucuugaacuccugggcucaagcaaucugccugccucagccucccagagugcuggugauaugaacugcugcacccagccaguucccagaauuguguacacaugaaugcugagccacagaauuguuguucauaauuagccuccacacugaacaaacaaccuaugugcccaacaacaguggggucagcugcaguguauuucugccauagaauauuacacaacaaugaaaaaugaauaaauuacaguuacauauauauaaauaacaugagugcuucucagaaaaaaaacauugugcaaaugaaagcaguuaugaaaacauuccuaccuuacaauuuacuaguaaacuaguaaaacuacaguguuaaaagucaagauggggguuaucuuugggguggugucuuagucaguuuggacugcuagaacaaaaauacuguagccuggacggcauaaaccacaaucuauuuuucacaguaauggaggcugggaaguccaaggucaaagugccggcagauccugugucugaugagggcuuccugauuuguggauagccaacuucuuguuguguccucauaugacagagagagagggagagggacagagaggggaagcaaacucucucacgucucuucuuauaaggcggcuaaucccauuaugagggccccacccuugggaccuaaucaccucucaaagaccccaccuccuaaaaccaucacauuaggggacaggauuucaauauaugaauuuugggagucaacagcuguucaguccauggaaguggagagagaggggagugagggaggccucgagagguggcuagcgcccuuuccugacuuggugguuagaugaguguuuacuuuguggucguucuucaagcugaacaguuaacuuuugugcagucggcuugggcugccauaauaaacaagauaggauaaguggcguaaacaacagaaauguacuuccucccaguucuggaggcuggaaaguccaacaucaagguucuggccaaucugguucauggugaggccccuuccugguuugcaggcggccacugucucgccgugugcucccgugagcaccuggggagagagugggcaagcucuuuggucucuuccuauaggggcacuaaucucuccaugaagaccccacccucauggccuugucuaacccaaaucucccaaaggccccaccugcaaacaucaucacauuggggguuagggcuucagccugugcacuugaggggacauggugcggugcacagcacacuuuccaugcauguucucucugucaauuacaacaaguugggggcacagaagcacagggagacauagccugguggggccgucagaaggaguggagcauguaaaccugcugagaaguggcagcgaaagguggugccacugaaguaaagggaggcgcaugguccacagggugagaccacgagaacucagcauagagagaggccagcaugcguccacugguuccaggaacaggaaagucauucucaugccgucugacacaaguuucuuuucuggggugggauggauggcaagaagccagguuggagggcacggcagugagugaggagauggcgaguguagcuguacccuuuuggcauugugguugugaauggcagaaaugcaaugugcugguggcugaagggacacggagugaggauagcuuuugaauguggaagagacccaagcaggcuuacgcugugagaagcaucuggagagaugcugacaaauuucaccuuauugagcuuuccucuacacucaccuuuauaaaauggcaccuccuccuccccguuccuuucuaucuccaucuccauccccgccuucaucuccaucuccauccccaucuccauccccguucaucuccaucuccauucccgccuucuccucugcaccagucauggcccacacaguacaugcucacuuuaugcuguccaucucaccccacugggaggccagcuccacgagagcagagcauuucucuauucugucuuccacacuacccuagugcugggaacaugccuacacauaguagaugcucaauaaacauuccucauugaaugaaugaaaguacagagaggagucuguacagagaggcuggggguggcaggaucuggagcucaggcucugucagcgggggcagggcugugugcagauacagaugaggaagcagcagauugugugauuuaguggagguggggggugggcagggggcugagggagaguccucgguugugcuggagggggagggcuuccaggaaauggaggagacaguguggaggagcccagacacugcuugugguggggguggggcaggaugggguggugaggggugaggaggggauggaugcaagccuuggggcccagucagguuggaaagaccacccacugcaggguccccagcauggcucagaagcugaugaaagggaugauguacugugucaggccagaguggggcuguuuucauuguaguccaggacaucccgggagaugaggcugaugccagcauaggguggguguuuuggcaggauugacagauagggagaggggacuucuccaugaucagagagggaggcugaggaacaugcgggagggugggccucagcaugauaacaagagagcucccaggaggccugaccccugcugagcaggacuggccaccccaacccaguggggccacuccugccaucacauccacuuuacagaugagguugugccugggcccccuuguggucaggacuugaacccagccugucuuucucccagcauagccauuuugcuggcuccagcuagagaggugaggggguguggacagagaguggggggcuggccuuaggaugugagguggggggcaugugagcagacaggugagagagagagaggagaacaugccaggugggugggggccaaugugggugucggucacuuuccuacgggguagaaagugacaaagaacaagcacauccuuccggcccuugcauuuaccugguccuugaauggagucugcacagcugggagauuuuggcuuguuccacagugaaaagguagaggcuggaacagggcagggcacuugccaaagcaggugcuggcagggccccagggccucuccccaggccagcccuugcaugacagccugcagagugcugguggggcugcuggggggcuuucaucuccucauagguccauucuggggauuucaaaggcacgaaagcuguagcuucaaaaacucccucucaaucuccaagaaaucugagacggcaucaccuucccucgucuuucccacagccccagucucccugcccccaacgccuuuggacucuccuaccuccacugcaguuuggggagcugucuggaguucccccagaaccauuugaaacaaguggaggccauuacagaccagcccccaccuggagcauggcuccacugaugccuuagacccaagagccccugcagcucuggucaccccacugcacuuaccccucccaggcaagccacagagucccucgcuuuccaggaaggcucuguugagcuccuagggagggcugaugguuccucacccacaccucugaauccccacuggggcuugugucccgugcaggggacugugauucauuaggcggugggucacgguggaggagguggcagcuuggcaaaacaggaggcaaauauuuuuugagggcccacuaugugccaggcugauuaccagagggagguuccuguuuggcagagcccuggguuuggaggggagggagggaagggaggagggggacgcauuuuccagccugguuuuggagguaccuagcucuguauuucuuuaacuuucucacucgucaggagaggugggcaugaggagagaucucagagcccugccugggggaggcccaaucaccccuccagccauuucauccaguuuugccuugucggcugcuggacccccuccaccagcuucuucacauguacuuaaugcucccaacgggccccagaacuugcgcgacccacccucuucuacuaaugaagggagacaguguccuuccccucccccgaguccccauucuccaggugcgcccucuucaacugcgaccccacuccuuccuuccuaguccuuucugccuucugccugcgaggcugcucuccuccugcccccuucccagcaccccggcucuuggccuucucucccauaacuggagcaccugggcacccaagguacccuccccccaagcucagcugaucacccucuccccgcaagcuggcggucuccuuccucccucccccguggcgcacccagcaccaaggugcccaccgcgagggcccgagcacggcggugcagccucggcuugggcgccggcuccaccugcagggccgcgggggcggagagcgggcggcgcgagggaggggccugcgacagcggcggcggcggcggccccagcccgcgcagcccggcucggccccggcuuggucggcgcagcgcagcgccgcgcgcguccccucgccgccgucgccgcagccaggcgcaccggcaccaggccccgccgccgggcgcacggacgcagcgcgcacgggccggccgggaugcgcgccugggccccggcccgcccgaacccgcggccgccgcccgcccaccgcgcgcucgcuugaccgcggcgcccgcccccggccgcccccgcccgucccccugccgcgaugcccucccuucggggccccggcggcccgcgccccugcuaggcugcggcggcauggcccgcgcgcccggcgcgaccucugcggauugcaucgguguguggcggcggggcaugcccagagcaccgggcacggccuucaaugggcgaggacacggacacgcggaaaauuaaccacagcuuccugcgggaccacagcuaugugacugaagguaacguacguguugucugagaccccuccggccggccgcggcguggggaugccgucgcaccgaaugcccuccgaagguuuggaccgcgcgaugugugucguguccccccgccccaccccaccccaccccaucccaccccaccccaccccaucccaucccacccugcccggggcccaggagggagggagcccgaggguaccggccuccgcugcccagcgccggcacagggcagcgcccuccuccgcgccgcccuccgggaggcagcuuuccucucccaagccagguggcauccugauucggcccugaccauaauuuuuuaaaaggccacggcuguggcuaaucuggugaagaaaucucggggaaauuuaaugguuuaaauccuggauuugccauuucagcccugcccaaagcccgcagaauuuucuaggcugcccucucccuggagaagaagagggacccggggggaaaaaaacauaauccauugccagauccuccugggaggcccgccugcccgggccccucccuguccuccagaggcagggucccugagugggagggagaaggcggcugguuuggggcuggccuuuuuauuccuggugaguuauauugagacaggagcagcugggcuaacugucgggauuuuccaaaaaagugggacaugccaucccaaacaggcccuguuuaaaauccccuaaguuggcccuacaagcccaacccccacccccacccuacccccgaggcuggugggucagcgccccucucuuacaggccuggaacuuccgggggcccccuggucugccucgcuaggggaacaguggggacagcuuccgugcgcaggcagggcccgcggagugaccccgauggaggauggggaccgggaggucugggcucggggccgccugugcuggagcccugcccgagugcggggacugucagccgcuaacccacgggcuggcggcccggccgcagaagugugcgcggauuccccgggugggugccccagugggaggggcccugggcacgggucccgcggggcaggugcgcgugggugccugugucagggagaccgagugggccaggcggcggagaccgggcuccugcggcuggguccgccuccucgaagccuggcucugccggaaaugaggccgagcggagccggagccccgcggaggcccggggagcgcagcgcgagcgcgggcgcgggcgggcucggggcgcccuggcccgggaggcagaggcugggcgugggaccugggcggagggaggcugcgggggccgcgcccgcucccggcgggagaaccgcugagucacgcacgcuucgccgccgggugugugcgagagaggggcagggcugcccgggccuccgggccgguggggcucugacccggccgcggcuuugggaggcccggggagcugagagcgguccuuugucgccugcuucggcgaggcugagucgggaucagcguggguccgggaugugguuucugcucgcagccugcagcgacagaggguuggaggaagccgccggguugcuggcccgugccucgguggccuggcucgggccgagagcggaucuuggcagguugccccgcugcucccaggcucgcuguggucuggcuuccuggagcaagccucuguuugcucaucucuacguuggggaugacggugggauggggcgcagggcucguugugggaccaggcguaaaaagcgccaugguggacauuuucaaacauuaauucccucugcacccugcccguccccuuuucuuucauaaauucaccagcccucagcagggcacaggaacggggacggcacaguucuggaggucagagcagugcuauccaauccuucauccagacacgagauauuuaccgagcaccugcugcaugccgggcacuguuuuaucccuggggacuggacaaagacucccugcccuugugcggccugaauucuaucagggagcuauaugaccuugaggucugucuucucaccagggcucagucuccccaucuguaaaaugggagugaauccugccuacagggucuggagguuucugugaggagcaggugcaacgguguugaaggagccguucagagcuaugcauugcuaacgugcagccaaaggaugcugagcaccugcugugugcugggaccucauacgaaggcucaccuacgccuuauccccaccuugagaugaacaaaccaaggccuggccuugugccugguccagaccgagugccagugugugcagggcauagggcucaggugcugcggaugcagagagcaggaucggaacaagaaacaauaauaaucauuauaauagguagaauucuggccucccuaaugaaaaacacacuuucacacuguugcauccugacuauauuucaugcucagagcacagggaaggucacagauuugaaugucagaaugucagacuugaaucauguuaaaguccugccucugacuccugacugcugugcagccuuggacaaguuacuacaccuuccugagcuucacuuucccuuuguaaagggagaaauaauaacgaccuuucauacaggguugcugggaugaucagugauuuugcuaauaucaaaagugcccagcacagugcuuggguuguuggaggcauugaacacauggcauuguuauuauuuauaugccuuguaacuggaagagccugugggcaaacaguggaugcuaaaauucaguuugcggaagaaccaggugcacaaacuccuguucuaccugugguugagucuacacucccccaccacaccccagcugcucugaucuaccuccuguuccuugagcaggccauuuucuuucuugcuucagggcguuugcaauggcuguugccuggaauacccaccuccugccuuucucaccacugacucuuucucauccuuugggccccauguccaaugucaucuuugcccgugggagcccugcuuggguuccugagucucuuguaaaaucucaaacaucuuaggaagaguuuagguuuuguuagucauucacaucuuggugugaauucgucagagcagguuggauuuuuuuuuuuuuuuuuuuuuuuuuuuuugguggcagggcuggguggcuuacucuuggcugggcucaacugcauugaggguuauggugaugauuagguguaccugcaggccaccugggggcacagagaacuuugcaugaauggggucaggguguggggagagcagugcagcugauagggcacugggcccugggcccuggacccuggagggugcuaggaagucuccaucuaguuagacauuucucaagagcuggauaugguuccaggaaggacucuuccuggcucuguucuuucucuuuuugcggcaggccucaguacuuagcuuuagagugaguugaauaagcacuuccagacuagacugaacuuacaaaacccauccauccuuccuuugcuuagcaccauuugccaagcacauccugcccugggcagcagugaugaccaagacacaggagcucagccaaggggaggugguucaggcugaccagguagauccuggcagugacugggucuuucuggggagcaacagucacucucaugugccugacagguaaggcacuuccggagcacacuuuucagcugaggccagaggcacagcuuccccuuguuugagcaucucagccaucacacacuguuggacacucaugcuuuuugcaucugcauaaaggauguacccauguuuuccuaacucccaucccuggauguccugugugauuucagaguagucuguuuauucccacagaguuguccugauuuuauaguugaggaagugaaggaugcuugggaauugcuaaggucaucaugggguccugaggcugucugaacgcagcaggcaggcagguuuuccugcauggaauugucugcagguuuugaacugguugugcccuggauaccaucuacuuucugcccaggaaaccacacugaagaggggaugcugcuugugggagacucagcauucagugaaaucugcacccuuaugguggacguugcagcugaucuccacaacaguuagucucucuucuuccaaggagaacacauaugguuccuaguaagagaucucaggccauagcuggaugugaucagugcaaggaugaucucauuccccuugcagugacugguuccagaauggaugugggagucaguucuggagguugaguggaaaguagggagaaccacagguaguuggucccucucuugugaugggaacagggaaaccuugugguggcuggcagccaucugacaccaugaggggagcaagucuuaggccaccaccguugauggcagggcagagagugagugagauccaggacauagaggccugauguccaggccgccucugaacuuccaguuacaugagcuguuacuuuuccuuuucguugugcacuuucaagucuccguuacuugcagcccauagcaccccaacucguacagcccugacugcuuaucaagaaaaccaggaggcugaucuguaacccacagcuaagacucgagauacauaaaacccagagggauuuuuguuugcuuucuguuuugagaacccucuuucauuucacucaagucaagguugccaauuucugguuuucccuccucaguccuauugaggagguauuuuuggucagauaagagagccugagaucuggcaucgggagaucuggguuccugguggggucugacccugggucuguaauauugggcaggucacacggucucucugagccucaguuuauucuuaauagaucaguaagugaugaugucuauucuuuaggggccagaguuagacuagcccuuagaacugucaucagacuggcuagccuaacuuccaccccaaccuauggggaaacugaggcuaagaggggggacauuagugguggcacagagggagauuagggagagucagccuuugacuuuugaaaaucaagauguggacuguucagauucuguguuccuuucgcuucuguuuggaaacgccacuuacauaagcuucccuugggcuucacagcgagugugggcuccauuucagugcuggggugcccuccaucaaaucacaucacuuucugagccucaguuucccugcacugccuggugcccuggguugucaugaggcuguaaggagccaagggcauguggacucugaaguucuacacguguaaaaggcgacugcugucaauuuccccaaauuguaguguaggccaacucccacgccccugcuguaagcaaugugcuccuuucuuuuuaaucaacccgaacuuaaagcuuggcgcagucacagagcacgguuuuucucauuuucuuucuggaagaugaaaaucaaauucuaauaaaauuuuuccacuccaucuccugacuguugucauuugcuacacuuuuuaguguuuauccuuaaagcuugcagagcuaagggauguuugguaagaaguguuuaggccuugagacuggaagagccgcuguaugaagcgcuaggcuccauggagagugugauggggaguaagagaaggagagugaacuccugugaguccaccaagcagagggacauacucucagcaacugggguauuuccuuccagucuuuuuuuaaugcccaugucuguuuuuaaugaaaacuguaaucugucuguaucaacaauuuugaaggcuacuuuucuaguuuggcaugagauuauaggaauuuuccagggcuuugcuccagggcuggcuucauggauaugcaaccuguguggucaucuagguccccacacucagaaggaccugugcuuggguucauguucugcuguuacuaucuugaaauuuuuaagaauuucacuuuggauccuguguuuuguaagcgaaaucugaugggacgggggagccugggaaugagcagagggguacguguggcaggcgagucugugguuacacauauuggcucccacagcacgcuacccuguguucacuugagcgucugagccccaugcacaguggacagcucaugcaccuucucagugcgucuguaguuucacaggcaggggccaugcuuucaaauaaugcuccaaggcauugauguucucaugcagugacuucuaagaaacaugaaugacgcaggaacccuaugguguccuuucuuaacguguguuacgugcccauauuugccaaucgcugacacugaaaaugauuacacagaagggaagggaaaaagagggcaccuauaguuccuuuuccuccuaguccuuccuuguuuauuauugaaccaaggguagaggguguuggaagaauguacacauauccagaaaugaaauaagaacaguuaaguuaguuuccucugcucugguaagaacaaaauccauaugcgaaauauaacuugugcauuuuggugagucuacauuccaguuacgugcucuuauguuugcauuuaaaauuggaggugcacacuagaauggugagugauaaaaugcacgcuaagaguuuaagcuuuuuuuuuuuuaaauuugaauugacauuaaauagcaaauaacaccaugacaaaauauggaaggcaugaaaagguuuuguaucuuagcaccuuuaaugaugcuuuuccuuugcuuuuugaauaagaggcucugcauuuucauuuuucccugugccccacgaauuauaggguuggcccugcucugcuggaacucuggguagggugaacuccuuggcccugccuucuaccuccuuggcuuucgugauugguggaaauggugagagccugccauccauugggcagcucuucccuauggggagggguuacaauauuaaauguccgugcuccucucucacccauuggguccaugggccucugacuuccagguugcucuacaggggagaggccaacaguuaucuuauuuuacaagcuagaaguuagaccuaccucuccccgcaggaccaagggguggggaggugaaguagggguccauagcucuuuuuuuuccuacagguuuaccauuaauaaagcagauuuuuuuauuccugucuugcggccagucuuuucuguguaaucccaagucccagcaaggaagaggggugacugguuaccuuggccccgcccccaagucacacaguacacguauugacaaccaucauuucauuggcugcauacuauuccugugauacaugugucaucauucaguaguucaauuaaucauuuccuuauggcuggauauuuaguucccucccuucccucccucccucccuuccucccuuccuuccuucucucucucucugucucucccccacacacuuucuuauuuucauaacuaacacugcaggaaugaacaccauuugugugugugaagacccccuacucccaucguucccccuuaaccuugggaugaugcucuucagaaggaauuccacacgugcuauuucauauaaagaucacuagcauuuuuaauguuguugacacacauuggcagauuauucuccagaaaguuuuucucuuuaaccacaugcugaucaacauuagguagucuaauuuguuugaccuuugcaaauaucaaagaugaaaaauauuuauuguaauucacgucugcauaccaaugagguugaacauuuuuuccuuuuguucagcggguauuggcugaucccuguuaugugccagggugacauuagauucuagacauacaaaguugaagagcaaggcugugucugccuugaaauguggacucuccucucccagugucuugggugccacugcgggaccuagcuacuucucaggagagagucugaagcugcuggaggagucuguacaucccucagcacccuggggaguccuguuaguuacacagggccuugcaaagacaggcaucucaccauuaagcccuugagcagaaugauccaaguggacuuuaggaugaaauaauuacaaaacaaacacaauagccauuauuaugauucaccauuuauuggcuauguacuauaauacuauaugcuggacaugaggcugcgugcaucucauuggagaugccccagaccugauguuguguauauuauuuccccauuuuacagaggagaaaacugaggcugaggugcuuguucaaugucacauaguuuguaagggacagagcugaguuuugaaugcagccugccaaacccacgcuccugacugcuacauuaauuggcugggacccacagggcaggguuagguggccuguucaguucugauuaugcaccacacuuaggagauuuugggauuugaacuagacuaccuggcuuggugcucuugcuaucuguguugcgaugaaaggcaaucgagaggguucagcaggaggagagacccccuucacggcacagguagauggcaguggcagaggccacaauuggacacgugguccagggacugaagggcagguggcauuuccagguuggggggugaugaugugcugggacaugguauucuagcgcauucugggcaggaggaacggugugugcaaaguggcauaacacuuguccccugacaguguccagcuccucugcuugagaccaggaggcaguuaguuaguugccagccggcccgggagcaggacacaccugggggccccugugcugcccaggacaggcacugcccuccuugcacagugggggccauuguccuccagaacccagggcugaaugucccauugaggcagaacaaaggcugcucagagguucccagcuggggugugggcugccgcaagcagggaugggaucuccaacugcaggccaagggccuccuccaggcuggccuggccuccugcagccccacccccaccccuccucaggaccaggacuguugcugcuggaggcuggaccugggcuugggcucccaggccugugcucugggucuggcacagcugccgugcccuuggcagcuucuucauccccugggcaauuuccccaucuaugaagcagagagagagcgagcucccaaccagcaaggcuuucaggcagaauugaaugaaauagugcacacucuguagguuaaucucaauaaaagggagcucuuucaugaucaugauuagcuucugaauguuuuuuuacaauuucaaaaaaguuuugaugcaaacuuucaaauuugugccacuucugggccaaaguguuuaagaagggagugcaccuuccccccucccucugucccagagaagggagagaugccgcucccuggagccccucaucacucuguggaagggacugcuggccaacuguuacaagaggagaaacuucuuugcauuugugagaaaauagucuauugaacugcuuccaaucuaucaagaucuugcuguacuuccuucauuuacucuccccugcuuuuggaugaagaauuuuuaggcaaauccaagacuccugucauuuccccguuccaucugcaggcaucucugaguguugagggcauuucuuguagcccagugcuguuaucccaccucacaaaacauauccugauucuuuguuaccuaaauucugguccauuuuaugaacguccccaguugucugagaaaugucucuuaugguugggugguuuggcccaggauccaaaguccugcaccugcguuuggcuguucugucucuugucuuuucugaccuagacucagccuccauccccuuuucaggcuaccaacuuguugaagacauuuguuauuauuuuauuuuauuuuuuuuaagacggaguuucacucugucgcccaggcuggaguacaauggcgugaucuuggcucacugaaacccccgccucccggguucaagugauucuccugccucagcauccugagcagcugggacuacauacaggugcccaccaccacgcccgacuaauuuuuguauuuuuaguagagacgggguuucaccauguuggucaggcuggucuugaacuccugaccucagauaaucugccuucauuauuauuuuagagauuacagugucacucccacugucccuaauuugugccuggauuccauuugcccugugggucuggaaggcugagaggugguugcugggaccugggcaucggccuuggggcugccccucucuccuccaggaccccuuucugcagaguggugcccucgccacucccuggcugagugaucuugggcaaguuguccagccaggccgugccugggugaccacaucugagcugggggugagcguggcugcaccauccucucugggaugugguggguguugaaugagauggugcaugccacgugcuccgugggccuggugccugugggucccugucuuacccccaugauggggauguggcaggaacugggguagccaccgccugcccacacagugcucacuuucuguaggggagacaccccucagcuggucacuacauacagcaggaccagcacuuucugagggaagagggauguucucuugggaagucuggaugcugaagacaguuuguuacucugauuaauaccaguuacaaagaaauccccacauuccaggggcuugaugucauagaaguuuaucccuuuguaacaguucauuguggaugaucccaguuggcccaggagucucuuccacagagugaugcggggcuccagacccuucucaucugucagcucccauguccucuccauucuccggggaagaggguauggggaaggugcacucccuccuuaaacacuuuggcccagacauggcacuugugacuucccucacauuccauuggccagagcuagucacauggccccaccuaaugcaaggggcucuaggaaauguagucccuggcugggcagcccaguggcuacucugcagugggaagaaccugcaucuugguggaugucuugccaucuuugccacaugaccccacaaaacaaaccuuuacauucucaguccaaaaaacccuacuaagaauccugugcuggagacacccucacucaaccccugacccuccccucucccugcuucaguguccacacgugcacggugcugugagaugcagaguccagagucaugcgguggcuaggaggucagggacgccuuccugggagaggcgaugucugagcugagucugcaaagccaaauaggugaugcccagguggaucagguaggagagggauuccgggcuucggcugcagcagggguaaaggcuggugucuugggagagggcauccuguguagagaggggucugugggccacugagauuuagaggauguguguggggugggguggagugggagaggagcuggagcgggaugggaagugggaggcaggacuguuugugaaaggcuucaaaugccgagauaaggaguuuggauuguauccuauugacauuguggaaccagauggagauggggcauuucccuuuguuugaaaguauuuugauuucuauuggcugucuuacuacaaaaaacauauguagucauagcaaaaaguucagaaaauuuagaaagagaaaaggaggaaaagaaaauccuaccacugaaaauauuuugguauauguguuuuugccuauggguauacauacuaucuagguauauauauauuccuacauuuuuuuauucacugaaagaugguuuuugagcaucuacugugugcguauccuauuuuguaaucuuuaaaauuuucucuuaaugauaugggagcuuucuagcuuagaaaauaacacagcccauuuucuuagcuugcugggacuucuauaacacagugccacauaccgggcaguugaaacaacagagacuuaccgccucacagugcuagagcuugggaguccaagaucaagguguuggcaggguugauuccuucugaggccccucuccuuggcuuauagaugaacaucucccuacugugucuucacauggucuuuccugugugugucuguguccuuagagggacaccaggcauauugaguuagggcucauccauaugacugcauuuuaccuucgucaccuuguuaaagguccuuuuugucaaacacagucacauuuugagguucuagggguuaggacuucaacaaaggaaucuuggggagggggcacauuucagcccaaagcacccgucaucauugguaauaucagucacaugcuucuucuauguauuuuaaagaguuccaugcugguggguaucagaaguuaugguugguuuaggaucaugagcaguguugugagggcaucuuugcaccuuuuugcgugcauauuugguuauuucccuaggguguggaauggcugcuucugagaguuuggucuuucugaaguaucuucaucuaaugucaacuuuuccugaugaccaaacuugguacuaacaacucccuuuccccagagcauugcuaguggcgacuagauccaacauauuuaauauuugccaauauuaugguaaaaauugcuguuuuuuugugugugugugacagaggcuugcucuguuggucaggcuggagugcagugucgugaucuuggcucacugcaaccucugccucccaggcucaagcaauucuugucucucagucucccaagaagcuggcauuauaggcuguguucuuuuaaagcauuuuucagugagauugaacuuccuuuauuauauuuauugaccauggcauauauucaauuguaaguuuuuuugugcaccguucuuggccuguuucucuacuguaauugucaucucucuugcaaacacugacccuugguuuguuguuucugguagcauugauuuuaugugguuagaugucaugacucuuguccugcugagcauggaucucccauuccacaaucaugagaagaaccaacaauauggaggaggugacaccguguagcuuuggaggcuaaguaaaaaauaggucaugugcuucugccuuggagccagccaccauauugugaggaagcccaagcaguuuguggagaggcacaugcagagaggaaccaagguccugguugagcugccugccuaauauccagcaccaccuugccagcaggugagugagccaucuuacagguagagccuccagcccucaggcaagccauccauauggaacagagaugagccauucccaccaagaucuacccaaacugcagauucaugaaccaaauaaaugguuucugcuugaagccauuaaguuuugaagugcuuuguuacacagcaguggguaacuggaagagucauggauuccugacauugaauuccugguccuccuccuucucaggcuacuugucuagauguucuguucucuccaugauucuguggaucccucagagccuuccgguaacuuccuucuuugcuuguguuagccugggucaaucucuguugcuuauaacugacagacaugggaaaccagccccagcaaugagaggugacccagcucagaucaugagacaggacaggaauccaggccuuucugaaacauagcccagggucccaucccacaacgugucaguagacaccaugccugcugggucaugccugcuuccgcugcacccugccagcucagcaccugcuaucuuccaaaggccauugcugauugcuuguacacaccuguuaguucaugcacagacagcaaagcauguaguugugcugccuccuugccuuccugcuaugaucugaauguuuaaguacccccuccaaauucacagguugaaauccagacccccaaugugaggguauuuaaaagguggggacuuugggagugaugagguugugaggguggagcccucaugggugggauuagugcccuuauaaaagaccuuagagagcucccuugcccuucugucaugugaggacgcagcgagaaggcacuguuugagagucaggaaguuggaccucaguggacaccaaaucugcugugccuugaucuuggacuuccagccuccagaauugugaggaauaaaugcuuguuguuuauaagccacccggucuaugauauuuuguuauagcagccugaacagacuaagccacucccagugaugagccugcaugauguuuuacacaaacagaucacugaaagaaggaauuggccagcaaagaugaugcucagcagagaugugaaagauguuaaugcuggaagugaaauuuaaauuggagguaaauggagucauagaagaaauccaugaucuugggaagcugaagcuacccuucaagaagcucuuauaugcagccagaggaguugagugaaggugaacacacugauguaaaccaggaaaggaguugugccccaaagcauggagaugucccagaggaagcgaggcugggaaaaacguuaaaggaacucuugaagauauuucacaguguugaaagugcaaaggauaaaaucuuggaagcuggucuggagaaagauaauucugcaaagcauagaaagggugcuuuuuugguaucguaagguauacaauaacaguagcgagcacugugcaaacucucuccauaugucuuuuacaaagaaauaaagcacuugacaucucaauguuucugaugcuuuaaauuacauuguaccaaauaaauauuaguuguacuauuuuaaaaaaacuuucccgguugggcauuguggcucacaccuguaauccaagcacuuugggaggcugaggugggaggaucgcuugagcccaggaguucgagaccagccugggcaauauagugagacccugucucuucaaaaaauaaaaaaaaauuagccaaggaugguggcauguaccugcagucccagcuacucaggaggcugaggcuggaggaucacuugaacccaggagguugaggcugcagugagcuaugauugcaccacuguacuccagccugggugacagagccagacccugucucaaaaagaaaaaaaaauucccagugcauucccuauggacauuuguaacuguccauaaaagacuuuuuaaugucuugacaaaaaauuuuaaaggccacagaagaauuguaauuuccucauugauuauuaggauggcuuuaaaugguuuuagcuuucaugcucuauuuuuuuuuuuuuuuuuuuugagauggagucucgcucugucgcccaggucgggguacaguggugucaugucagcucacugcaacuucugucuccugguucaagcaauucuccugccucagccuccugaguagcugggauuacaggugccugccacggcaucuggcuaauuuuuguauuuuuaguagagacggaauuucaaccauguuggucaagcugaucuugaacuccugaccucaggugaucugcccgccuuagccucccaaagugcuggaauuauaggcgcaagccaccgcaccuggcucaugcucauuuuuauggauccacaccacccguacagcaaggacugccugcacucauuccaaguggucagaguggucaccgcaugggcccuccacguggccaggccacagugauguuucaaacccuggcugggggauugcauucaauauccccuuauuaaaggcggcagcucaagaauauuaaaucaugggaauuccucacuguggaagugggaaggcagcccgugguucaccgugaggggcacccagagcucccccuccacugcguucagugugcagcccuccagccagccugucugcuucgggagcaauccaucauggaaugaacugaccgaaggagcgaggggcugaaugaugugguuccuacgccgacuuucaaugugaaaggugauaaaaacagcccugaauauuuuauggccccaaggagagguaaggcucuuuauugaagcugugaaaauauaauccaucaugauaaugugucccauaucgucagacucugcgagcuaaguuguguguauguuaaggugcucuuuuugagaagaucuuaauuuuauuucucuauuuuauuucauuacagaaacguuugaacguguagacaguagaauaaaggggggggggggaaauaacauccuucauuucacuacuccagaaacacugcucacauuuuguugcauuuccuucuaacuacccccugcagauuguacuauguuuugugucuuuuaaaauauuaaaugcacugucaacauuuucccagaucauccugcacucugaguuaacaauuuuuauuggcugcauaauacuucacgauguagguauuauuauucauucaauaacuauuuauggauucauugauccgauuaguguugauugucuauaacaggugugugggugggguagggggauucaggaagaaggaauagggcgcagcuccccccccccaggauuucuggaaugagggagacauaacagauggcugugauccggugugaggggcagggaugcagugggcccguugcagccugggagcagguggucagagaugcaaggcugugggcagcagugguuggugguccacagcaguaggcagcagggggagggggcgacauucauggcaggagggacauuaugggcacagcacggcgugguguguucaggguugguggagcguucacuuacagucuugcagauccuggcaggugugguggugaucuguccaggcaggggagggagagggaacugagagucaucaaaagucucugggaguuuggaaaggagaguagggggcucagagggagugugagcacuuccagcagaggugagaaagcccccagucaguugcccagggugggcaguggaagggaaguggaggugaacguugugggguggagaggguuuucaggcaggcugggagcugcccagugugcuggaggaaggcugggucuccuugaaugguguuuggucaaugcaagaccacaggagugugacuagaaggcugggggugcagaugguggcagguggaggacagagagagcuucucccacugcugaacaacgacugccccaacuuuaugggaugagcauucuuaugaaugcccauuguccuguauuccagauuauucuugugucuguccagguagggaugcaauuucuugauguagggcuauagguguuuuuaagggcuugcauaaagauuugaauaugauguugucuaguagaguaaaaaucaaauugggcaaaacauuuuuguuugggugauuuuuggaagaguaaguccacgaaugcaacgcagcucuggagucaucuguagauuacagcaagcccaucagucucuaugucucuugcuuacaacaaaggauugauuucagcuccagcacuaggugacuugugcuguguucauuaucccuugauaggugucugacaggagauggggcuugggcugugccagggaggagccguguggugcaccaccuaucucugcaggcauaacuauuuugucuucauggcaaaauaauagcgaugauggugaugaggagggaagcuaccauuucuugacugcuccuguguaaugacauguuggugaucacauuagggcuuuauguccacucugggagguggugagaaugacaucgcguuugcacaucaggacgcugagccucagagagguugagucccaggacgaaggccacacagugagugccacagguaccauuaccaccuaacaaaugacucuggagcucagugaugugaugagaaccauuuuauucugucuccuggauucugugagucaggaauuugggcagagcuuggcugggcaaaccuucugcucuaaauggccacccaugagucuuccaagcugguggguggacugaucuggggggacugagauggucucacucacacauuuucugcgggguggggagaguuggaaggcggggcuccccucuccagcgugcagucucagggcaguuggacuccuucgauggcagcuggcuuucccgaaucaaguauccccagauacccagguggaagcugcuuggcccuuccugaccccugggacaucucagugucaauugugucaccuucauuuaguucaagcaagucacaggccggcccagguugaagggcaguuggacucaaccuuugcaugugggaagggccagguuacaugguagaaaagcagaugggauaggagacugugcucuggcccucccugggaaacacggugugccacagacgcccugggcagagccaagacccccacugggcucugucugaccuuggagccacugccccgcuccugagcaacacccucuugucccccugaacagucacaggaagaacgggucccucucuccaugccauuuuccuguuaaaaaaugcaaaaacaucccauacuuuugcucauuuaaacacagaggaaaggaggugagugaaagcuuucuuuagggguagauuagaugugaggcagaccgguggcccugggugugcaccggguggaaauuauucuuacaaacagggccgggugggggugcagccugccaccgccccucuggccgucugccuccacaggaggcuugcaggugcccacaucagccaacguggcccucgguggggcugugcuugccuucuugccagggccacugcaguagggaggagugcagagcagaaacaggugagcugggcugaauuuucugcuuggcuaauucaguguggcuugacuccaagaaggacacaccgaccuccccaucaucuuguuuguucagccuugcagaagcaguuuuaugagaaaccauuacagccccgguggucugggcccagacccggugcacaccacgugcccgcacuggugcggggggaccauucucggugaauaugauggaugcacaggaagccgcccugccauucagugagagcucaccaugugucugccccuggggugggguggggugggcaguuuccagccuuugcccaugggauagagcugcuggaagucuccccgagcugaggaggcagagcugggguggcuggggcuggggguugccauggauacuuccugcaaguccugacgccgcuccuuccucuuuggggaucugucucccauacugucccugcugccuuuacaucuucaggguggagagggacucuggccauccuggggccaaccauccugugucacugcugguguuugugaccugcggugggcccucccucaacuccguaucuccagcucuaagccagagacaagaauauccucugugggggggucccuucaaggguggauggagaugaggcguuagguguauccgaugcucaggaacggccccgcaccugcucaucuuuaugaugagcagugggacugcgggcagagggagccacacgcauccauccuggcucucagcaucccagggaaagauguucugcucuauccugaucagccucgcccuuuaaccaaccacaggcugccugcaguguggccguggggagcuggagucaggcaugguggcagcccuucuagacaguaggcaguagguaagccugcugaucacggagccgagauucucugugggacagagcugguccccagcaucccuguggccuuugggccaagaacucagucggcuacuuugcuuccaggcuugggaacacucaggguaggcugggaguccccuggucucacccugugagccccacauaagccuguggauagcaccagcucagcaggugacccccucaucaaaaccccaaacugggaugcuucucuggcuacauaggcauggccacauggggacagugggaggacaugugauaauuuggggcagcggcugaaagccuagggguuagggcuacuguguccuucuaagguggugcagggcgcacagcccucugggccucaguuuccucuucugugaaauggggacucuaucuuggggccgcaaaugccagugucuucucuggaagaaagggcgacugcugagggaagcagcacacaggugugaggguccaggccccagacgggaucccacaaagaccuaggacagugagccaagaguggagagaggggacgaggguggacuggggugggccccaggagcugggaagugaggaaaauccagcuguguccugaggguuagacuccacugccaauguucacaggaucuggagcugaugggaaccugcggugucacccugaagggacagauggcccccaggcuagcaggagguggcaguguccguuuggcagcaacauuugacaagcagaaggcaguuggucccuccugcuuccuguccaggcucuuggggcugggaccccacucccagcccuguccuccccaaccuccccacacuuacacaggccacucuggggcagaggaggggugcugugauuuguggguuugggagaaguuggaagcauaaugggucaggccugcagcucgguccacacugccugugccagguggagcaggugagggcaucccuggcucugggguggugucacuguucacacuuuguccuauagccaggcccuucuugggggugaggguuccguggagcccuccaucugccuggcucugccgauccaacucuuuucucucucuuggggguuucaaacuuagacaggaauaggggugucauuuauugggccccagacaaccugaccaggucccucagagcacugaggccgggaggaggaggguggaaggagaugggaagaguuuccuuuguccucucucccuggccauccccaaaccuccacacaaaccugggguggcugagcauucauuaugcuuugucuuuguaaauaggcagcuauaaaaaccuaucagcuugcagcaccuucuccauaacacaggcuggauggauuuauaacccagguccccuccccgagagaagcuggcaaagcagaccccagcccgcgcuggcugccaucacccucccugccccugccccaccucaugcaagaaacagaagggaaagcacauugaguuguaauauguuuucgauggaauuugucacaauaagaaacuggauuuuguuggggcucaugggauguuuaggaaagagccagagaguggugcaagcugugggccgugccgagaagccugggcuacaggagggcaggggcuggaguguuggcagggucgcacaguggcucaucuggacaguccacagcggauccagcccacacugugucaggcacuuugcugggacugggggauguggcuguggguacgauugacaaggucuguguccugaggagcccgcagagcagaugagauggacauguggucagugaugguaccgugucggguggaagagacaauaggcugagcugcccagagcaucgccugaccagcuugggugguggcacguccaggagggcuuccuggaagaagugaauuuauucaacacauguucacuagagccagugaugcuuaggcacugagaguguugccagggauacaggagagaaugggagagucccugagucauuccagacuguggggcugaaguguccgccgauggaggugugggaagggcacagcggcuucccacgugagcaaggagcuaugcaauguggcagguggcagggccaggcggaggugccuccaccugucuccagaccccacccccuacccagguauggaauuguugucuccaguuggcagagaaggaaacugaaauggggguuucaccucucaggaauggguaggccaggauuuuaacccaggccugcagacaccaaaucuaucccucgcucaggccugcacugaccuccgugcaccucuggggcuccaggcagcugccugggugggugcugugucuggggucucuccuggcguuccuuaggccccuccccuaucaccguccuucauuauucacuuggaugccuugauggucggggcuggaaccccccgagcugacccaccaugcggcucaucuuccuucuccuuccagugcuuggugaucuugagagugaggcugaaccguugcuugauuuuucugugacccagaugaagagcuggguaaccauuugcucaauaaagugagagaccccauguucugguuaaaguggaggcacugaggaccagcgaggggaaggcaguacuuguauuugucagccuggaggagacgccagauaccagccagagcaccccagccuguaucucgaccaccaccugcaguuggugcugaacccccccacuccaccccauagaugagacaauugaagcccagagaggccaggcuucuugccgagggcugcacagccggcagggaugcuggaauugggauuuggccccagccuugucugacuccaaagccaaugcuauuuccaccauacccagugucucccagagcuaauuuugcggcuggaacugcaacccgcaaagcuaucuaggacaggcaacucgaugaaagagaauuaggagggaauccuagaaaaauggggcucggcagcucccggggaagccuggagaggagguggcgccgaagccucugccagcagauugggguggggcuguuuucaguccucucuggcgagguguuuugaagccuccucugggaaccgugugccucuguccaggacuggcugucucucuggaaaucauacccuggcagcauuuggcuuugggugaaaggagaagagaagauucuggccauucagagcaggcccuugugcgggauggaacccauuuuccagaacucuugggacagggaccaggguggcaggcaggggcccguggacugccugggggaccuggugcuuggggacuuagagauuuguuuuccugcugaauauauugcuuucucgugccugcuuugugcaaccacgugaggaugugggggugaggauggccgacaggacacgggagucccucccgacaggggccaggcggcggcggggguccgcaugucucacgucagcauggcucuguguuuucacuccucuccagcacauauuuaguggaaaugaacucauuuuauuauuaaaaauuaaagucaugcauucauaggguaaacaagauugagagcauguggaggugcacugugaaagugcaguucucucggaaugggcacuuagagacgcgccuguucucugcagcugccgcaggggucucaucuuguugggacagaacacgguugauucaugcaauuggcuguugaucaacaucagguugugucuaguuuuguuuuuuucccguuucgcacggugcugcgaauucacagcugugccaguguaucugaagguaaaucccacgagugggccuuggagagucagaggauggggccuucuacguggacuuggugugguugggugugugaugccugcguggggcuauguguuuuuagcccuuccuucugacagguucuggaggccuccucugugccugccagccaugcagccgcugagccgagcaucacccaaggcuugccugaaccuggccugggucccaaaggaacacugcucuggggcauggagguuggcugguugagaacuaaagccacaucagcaggggcacugcccccaccugcuggggucagcccccgcccggaguucagcaggaccuccgugagccuucgugcagguggcucauugcagcacguccccuuggggugguggccauuggcuugugguuccuuugcucacuggggggaggaggacagccaggcacaggugaaaggggcuugcgggugacgauucuaguccuuggcccggggaaugucccugggcuucugaggccucaccucccuggguagucaggaggguuacgaggguggggccuggcccuggggacuccaggguguggcagcagugggagugaggaaacagcccugagacggagggagagaagggcgauccagauggcgguggccuccucaccccucggccagugaugcaugguagugguuuugacgggcugaccucgagggucugccugggagccgcuuggaacucucuggagguggggccggcccuggugggggcaggaaggucccagagcagcuuguuaagugggcugaggacaagugucaggagaccugggucuggaucccgcuccaauaccccucuccgugugaccuccaagggauccaccugccuuggccucucaaagugcugggauuacaggugugagccacugugcccagccugugcccaguguacccaucaguaaagcagggaucaaacaguucuuaaauccugcagcgguggugagagccaccugaggaaacgaugcaaagggcuuugacggagucuggcacagagaacgcacccaauaaaugacugccgugacgaucuuucuucucgcccucagguggucucuggaagcuccucugugcgggguuuucucauuugccagcugugcaucccccggucguagugcggcucccacggggguguaccaggagccucugcuccuccuaugcuuccugaaaaagggcccagagaauauuuccaucaggaauaacugagugaaucccagaaacuuccuaucacauuuagggugauuaggcagaugcauacgauucucacugugggaaaggagcuggcgaccucgauggguugugguucccgcagggaugugcuugcgcugcuguuacuccagccguagcugaggcacgggagaaaacggagaccccgagaaguucagaggcuugugcaggucacgcuguuccuacgagguagacccugacuuugaccccaggcugugucccugccaagcuuggagccucuuucucaaaagggcgacggaaggauguuguuacagaugugguugccaguuuccuccuuuucauuaaaucaccagggaaauggucucuugcaaccccccuaaagcagggggaaggaggaggacaaaggucaggucaccaucuuugcuggcaugugagugggguggggguggggguggggagcuaggagaccuggcgcugggcccuugaaauauccacauuuccacaacauucugggugucagugagccccugccuuccucccucacauuuauccggagcucuuccuccgcagggaagaacaacagcccgagaugggguuauuucaaggggauuuccauggaaacgggagggugggagguuccucccagcacuuguauaaugggaguuggcugagguggcagcguguccccacggaagggugcgagggaccuucucugcaccgcaggccuccucagagugggaggcaccgacccgagaguggcuggcuccccuuucaugcucccacccucucuacccagcucaagaccccggggcuccuuggugagagugagagccaggccagcuccccagggacccccaaggccugguccuucccauggucucuuuucucuagcaggucuuugucuugggcugcugccagccacagcuuccuggcaggaccuccuggcaggaccucugugcuuugagccgcuguugcucugccaagaccuugccccgcaccguggucugaaucagcccagcaccccuucgccucuguugcagugcucacauuuaucccucacuccuccauccagcauguuuuguuuuuuuuuuuuuacaagcagacacuuugcuuuauaaaagaauucugcugugagcugccguauccucucugagccucccuuuugucaucugcugaaugguaacagcagcgccugccaugccugcuuggugaggauuccaucaagcagggagacagugggccguuggcggggagucugagcagguguaccaguauuuccagucagcugauggcugauggacauguucuuggaggcagggaacucggaggccugcagacgugccccaggaugacaagauucaucaguuccuacaagcccugccugggccucaugcuuuucaguguguccugggcuuucccgugugaaaucuuaccugauuuuuaugccaccuugagaagagugauauucaucuccguuguacagaugaggaaacugaggcucagggaggcaacgugaucuuugcaaggauccgucuguuccccccguggccuggcugccccuccuggcagugcagguggaguuaaaaccauacaggaguuaaaaugagccucgaugggggugggaagcuacgacuggaaaacguccgaugcucucccaagucaaauugugcuuggugucugugggugugucggugugggggagggaagcucagcccuuuugaaaaguggggggugguuugacgacgcugcaggggcagcuccgaguucuagagucucagaacgugguucuaggcgguucauguggaucaagugcuguucugagcacuuuaauauccagcgugaccauaaggauaagugccacuguuacuggcuuuuucacagaugaggaaacugaggcacagagggauuagguaaagugacuggagucacucagccaggaugugaaucacagcccacacccaugugcaccaggaagccuuggcuuucaggguccuuggagggugugccgggcagucgccuaagcugggaaaccuugggcuugucuccaggccauguggccaugugagauaggaguccuccuguguuauguucugcgacacugugggcagagggcugaggaccccagcccucccuuagaacaucauguuggugugagacauuuagagccaggccucccugcuuagaaagcaccucuugggucacuugcauuagugaaguuauacauuugaaacuccauuuauuuauuuauuuauuuagagacagggucucuccuugucacccagacuagaguaccguggugccaucauagcucacugcagccucaaacuccuagacucaagugaucccccugccggggccucccagagugcuggcauuacaggcaugggccacagcaccuggcugaaacucccuuuucaugaaaagaaacagcuucaacuuugcaaucucaucugucugucuaugaggcugugccuuugugugagaugagagcagucacugucacuugcucuuugaauauuugauuaacagguaaacagccugaaauccauuugacaucuuauccuuuugcaaacuuggcuaaauucucuuaaauugguuccaguuggauuaauuaaaugcaugguugcuuauacauguguguggaaaugauucuggcaggucaugucuuagcuagauagugaacauaagcgucuagaauauucucagcuguugcagagacugccaggaaugaccuugaaaaaguuugggagaggguuuuuuuuuuuguuuuuauuuugcuuuuguugagacagggucucacucugucaccuaggcuggagugcagugaugugaucucagcucacuguaaccucugccucccaggcucaagcgguccuccugccucagccucccgaguagcugggacuacaggcaggcaccaacauacccggcuaauuuuuguauuuuuuuuuuguagaguuggggucucaccauguugcccagacugaucuggaaccccuaggcugaagggauccaccugccuuggccucucaaagugcugggauuauaggcgugagccacugugcccaggcuggagagguuuuuggaugcacugggccauggaugugaaggugaacacauggaaacgaucccugccaccugcuuguguguccaguggacaugucucugaucuauccagauuguuacacugucaaagugaaaacugcugagaguagagccaucugccuggccaggcaucgcuuggaagcgugaagacacuuugccuuuuugucucaugauucucucuccaugugcagcuucguuggcuuaaaagaaauuaagaaacugggcccccgcuuaggaccugcugaagugcagaguuacugucuuugaaguggugggguagggaaaaauaggaaauaaggggucugaucauuuugagaaaccucagggagauuuacaccugggcugugcgaggaccccggagaguggcagaguguauuuggaauuuccaguaguccucauuccucccuuaauauccaggggaucuggggccucagucuucuuaucuguuaaaugggacaaguaacgacuaggcuuugggguugucaggaagacugaauaagaaaauggguaugaaaacaguggucacggugccuggcccuccaucccugucuccaccaggccuaccugucuggcccaggccucccugaucuccgcgggagcagaccuccuguaauggugucaaaggacccuuguucuauuuauccaucugauuuccauuuucggggccacugccucuagccauguuaggcacauggugagugucugucccaucaauccuugucgauucugugguccugggugggccauagcguuucuaaccuguccacucucuccuaaucaggcauuuggaccuguuuggguucccaaacucugucacgggcagagggcugcaggaggcuacucacgggccaggguuguuuggaccugguuggguuuccaagcucucucgcagucagggggcugcaagaggcuacacaugggccaggguugggcugcugggcugcugggcugcugcuguguuggagcugccuagcacuugcuucguugcugcaccugagaggcugugugggcugagacagccagaaaagaugcaccgggagccaucuguuugcagcccuuggaccagaugcucugcaaggacuccgggggggcggugggguggggagggaauacauuugcugagcacccagcaucuuucagagccucagcacagcccuacaagcugggcauugccaucauguuuauacggaccaggaacacgaggcucagagugacugagucacuggugacagucacccagccaggaaguggcauagguggggcuugaacccagggcuuccugagucccaggcuaguguucuuugccucaggcugcugagguuccagcugaauguugcggcagagugacuucugagaaguaccacggaagggggugacucacgccgggguggucuggcuucucugcccagugccugaggacacccaggucccucugcggccuuggggcuuuacccagcgucugcauggcaucccgcagcacccugccucuggagcgcacccuguguguauccuaaagugcgcuuugccuagaaaaccuuucuaaugaaacugguggaagauggagaagccaaauucaguuuucagagaugacacuaauccuauuaagguugauggggccagagcauguguggaauuaguccugccaggcggcggccgggcaccugccuggaaggcuggaggggauccuaacaagaguggugccgaggagagagagggaaggggccucaucucucccagagguuuaaaaaaacugaggccacuguagagcuugguucucccagguuccugggguggaaaacagggcuucccacagcagacggaaaugggaggugggcaguagucaccgagcagggaggcugugaaguagucauuuaggucgggaaagucacgcaagaucuccaagcuucagucuccuuagcugugauggggggaaugggugccccccuugggcgacuugugggacccagaacucaucacgcagagcgucccacugcugugcagccacuagcugcucggugcuggggcugugguaugagcauggacucuggagucagaauuccugccuucaaagccccacuccucaccuugcuagcuguguggccuggggugaguugcguaaccucuccaugccucaguuccuucaucuaugaaauggggagacugaaacuguaccccacacccuagggguguuggaacuuaagugaguuaauucauauaaaacacggagugagugccugguacgcaggaagugcucaguuccucuuggugccugugauuauucccauaaucaucacuggugucaccuugucgccucucccagcccuuggggccaugcuauuugugguaggaaauggggccugaaaccaucaaacuaaacuggacugaaugaucaguccaccgaccaccacagucacggcuugguggccccacggacugaagcacguggccaagggcaguuuucccuucucuguguggguuccacuggguccaaguacauuguuccuaagcccaggccucuggccacucacccaccuccugcugagagcgggcagagcugaugccccucucugggcagaaucagcccacggcugggaggggaggccaggccugcugcugggggugcagauaguggggagcugcaggccagccacuggaaaccuggccugugugcugagacagcacauuggacacagucugguggccuucccauagaucaggccacagaguccucauccuggguccacccaaggcacuggccauuuccagaucaaagagcagguggauuccagggugagacgguccucucugcuggcugccuucccccacccacggacaccguuuggcuuugauggggcuguguccuaggcuugacccagguggucaggagccuuccacuaugcagugggauaugcugcaggaguagggcggagaaggaagggaauggccgguggugaacagcugccaugccccaggcauuuaauuuugaccgcagugcuggggggccauacccaguaauacagaugaaggacugagacucaagggucagugcuugcucagagacccacagugaagaguggggccaucguguugcauguguguggcugggccccauccccuccuuucuacagcaccaccccucuauuccuuaucaaguucaccuuuaaggcuccuuugccccucacuggggcagucaugagaggagcagaggccucggaucugggcauggaugaggguagagcccuggcuguguccugcaggugacacguacagagcagaaggugaugcuggaaccauccgccagggaagggcuguccaggaagaggucacagccugaacagaggcgagguggagagagagugcucguguguggggacugguggcagcucaggagggcaagacugugacuugcaggcugggaaccagggaggcugcaggugauggaggccccauggggcucauggggcgggcugaggagcguggcuccuccccugcagcuggaggggccaggaagggcuuuaagccauggagugagggaccagaguuggguuuagaagggucacuguggugucgguguggaggggcuugaagggaggaguuuggagggaggggcuguagcaauguugagauucccuaaucacuuuaguguuuucaugcaugagggcccugaggugcuuuuuuccagagccugcacugagguucccuguuggcggcuucccucaggcugcuggaacccccuuuuccugugcaccugcagagcuggagguuacuggaaacucauguccucugccagagucagcccucacccagucacugacaggugcagugguauaaauaccccagcucccucccuccugaucaggacacuuugagaugggaccuacacuguccccagagcucccaugggacugagcucaagucgcacuccuugagauuuuuccuguuaucacaccccacuuggccuccuucauguccuggccccacuucccuacacccuuccuggcuuucccagcaacacuuccuaaucacuuccagaaaaauguuggccucagggucugcuucuggagaacccagccuagcagagggcagcaaagguguugaggcacuaggagaaacauggugagauacagacucaggcggcguccaucagcuaugccaggaggcucugagacgugccagucagggagggaggugcugaggccacagcaaaccgggggccagaaguaagcaccacagacagcaccaaggcugccaggguccaucaucuugggucucccaauugguuggguccagagaccagccugcuggcguuuacggagccagcauguuacaucucucuguguccccacugcugaaagccucuggucagugccauggugcugagggagcuugggccucccuuagagguugcuaagagcccccaacaccugcccugugaguuguuggccccaggggacucugaguuucccuguuucugguuuuccugcucaugggauugggagucugaccugagcuugcugagacagauaacugaucauucagauacaaaacucuaaagguuagaacucuuuucugauaacuuaaauagaaaaugaauucaugcaacauguacucaucuguccaucugcgcacgcauccaacauguauguaucucaguugauugcugauuccaugccaggccuuggggaucuagagauggcuuggucccuauggucauacccaugugaagggagauagagguggacagaaagacaaccauaaugucauuuugacaaauucugggaaaagaugggccacccagccugugagaccuguauguagugauggagggauggggaacgguggaggugucagggaagcuccccaggggagcuguuccuugaggugguuuuaagagcuuagcaagaguuuucuacgcagugaagugaagacguagggcagguggaguggaggguuggcaccuaaagguccugaaaaggaaugguguugcaagaggcagcaaauagcauggggugggcuaagcuccagcugguugaguuugggucagaaguguggacuugguugguaaggacuccugagagugucauguccaggcacuuggacuugaugcugaaaauacagccauucaacagagaaguauguaugucugagugugaugugguuagaucuuuaguuuaggaagaccucucuguucaugguggggagaguggaugagauggggguggacuggaggcagaagagcagaggagaagagcagacuuucuaggagacgaagcgggaggggcugcucccagggccuggcugugagugguacugaccagagccauccaucagcccagaucaugucucccuaauuuagaagaaaaugagaggaaagagccuuuucaucucugccucuucugggauggaaaugagcuauuuugaaucacgcuaaaguuagauuucuaguuuuccuuuuaauccgugucucauuuagagcauuagaaacuggaaaagcacccccguaugaauguagugucauaaaucagugcacgucacaaacugcagaaggagucauuucuacaagagugugcagccuugcauuuaugauaaaucuaaugcuuuaucuuuuugggcuucagacuagaguaauuagucauuucugcugauacuggcaaaccauugcaugugcaguguuaauggagagcaaauguauuugaacugcuuuugcaauugcuugugagcauugcuguguaucucuucuaccuguuucuagaggggaaacauccuauauauuucauucuugccuauucuaggaauaggugugguaauaguaucagguaacacuuacuggguuucuuccacaucucuggcacuguucagagauucaauaagaaaggauccuuuguccaaauggaagcugccguguguguguugagguccuugggucaaucugaucaugcucugucuccugcucugugcccgcacugugucagggaacaccuggauaccacucauguauuauucaccuaauagguuucuuuaaauguuggcccucuaccauaaauggaaaaccagcaaaucaggccaaaaauagaaguaaccaaagacaagcgcagguguuucugcucuaaugaaauagagacauccugagaaacuucucauucugcaaaaucccaaacaaaugacaucagagcugauggacagaaugggguugggacagaugacuggaagucuaugcagugugucaccagacacucauaaaaauauuaaguuuuagaaaaaucuggcacaaugaaagaaaaacauauuaauuccuguuaaagaaacauuccaaccauuauacaaucuuaucuugaaggaaaaagugaaggucauuuaauggaaggggcugaaagggagggagcugaauuauggcugggacauggccuggguacagagggagacccguccaccaaacucuuccaaacugagcuaagagguaggugcgcagggaaugagucuauucucuugggccacauuccuuugaggcuugauguucagccauuaguguauuuugcauucaguugcuuccucuggcuggcacaaaacauuaacacacugagaaaggcugcguuugaaccaaccuaacuuuuacauuauacugacaucauuccccuauguacaaauugcauacgaccuacuuugcaaaggcaauggucauaguaacuguacgauggugagugggguuguuaaaugcagaccagauacugcuguaauagggcugugacucaggacuaucauuccaguugccugauaugaaaaaggacaugaaggagaagguuuuaugagaacucuggcaaagacccaugaaaccacucuucuuugcccuccagaaaaccugguaaaacugaaaguaagccagcagccccacggguuugggauugauccagaagacugaaggaauaaaaacaagcuaauauauuucuauccccucccuucuaaggccuguaguugguuccauuaugaugagacagcagccgaugcacguaaaaacagaggccaugcaucuacacagggguguugaggauugaaugagauuaggucugaaagaacacacaguggagacaguguugucauuguggggacaaagauuucuuuucacaauuugagugacacuugucauuucuauaggcaguuaagagacaauaacugcauacuguuggccgcuguaccuuuccugugcacugagucccugagcauauucgugagucuuuaaaaguacauucuagucaauguagaaaacagauaguaagggacaugacucuaccuagauuaagcucaguuuugaagcagggccuagaggauuuagaagugacagaguccuggauuaggugacauuugauaagagcucugucccuaacuuccucuuaauucuggacaagccacuccccgcucuggcuguaguucccccaucuuuaaaaugaaacaguugaaucagacaacuacaaaaggacuugccaggccuucugucucagauccuguguuguugaagggaugucugaggccagagaugcaguuuacuucugagcaauuacaguuguauuucuuguguucagccuagcccuuuaccaagcuuuguugaagaaauggagcaagauccuuguccuuugcuucggugguuuuuaaaacuuggaugccuaaagaaaccaggaaggucauaucagugagcaaaguacaaaauguauaagcaagacacagugcaccaugacgcugagaguggcaaaguaacaguccaaccaugcaucagggagugguggggacuguggcgugcuggcaagcauagccuugugggauucugcauuggacagcucuuacaauuucuggagagaaaucagaaauucaggucuacauguugaaucuuuuaauauugaaauguucacuuggcaauguguaaacaucauuugggucaaagcccaucugugaaccaaguuagucaaagacaacugggcauuuggaccucagcuuuauagucuauauaaggguugguaaacuauggcccacaugcuaaucugacccaccuccuguuuuugugaauaaaguuuaaaugaagaugcagucacaccuauguguuuagguauugccuguggcuacuuucacacuacaacagcaggguugaguaguugugacgguaguugagacaguguggcccuguauuuauucucuggaccuuuauggaaaaagguugcugacccuugguucaugucaaugacucauauggagcagcaggaaacauucugaauuuggagcugaaugaccaggguuugacgccuggcucagggaacucuaguaacagaguagagaguguuucucuuuucuccuuuuggaaaugauccugaagcaacaaauggaacaaauggaaaugcaaaugccaucuuugauggaaccauagcuucuggaaccucauauguggggaagugcaguaaaggucaaaaaugggugcaggaugucuccaaagggaaauaaaaugcccauggcuguaaagcucagacagagcaaacaaagcagaauuuucuacaccuucuguggugggcucagauggcaagaccuauaguuccucucauggagcaauaagaacaagugcauuggcuggugucuuagucuguucaugcugcuauagcagaauaccauagauuggguggcuuguaagcagcauacuuuuaucucucacaguucuggaggcugggaagucugauacccagguguaacagauuuggugucugcugaggaccuguuuucuuguucauagauggugccuucuugcugugugcuugcguggcagaaggggcuagggagcucucugagaucucuuuuauaaggguacuaaucccauucaugagcacuccacccucuaagaccuaaucaguucugaaagacguuacuuccuaagaccaucacauugggggcuaagauuucuauauaugaauuucggggggacacacauucagaccauaacaacuggugugggagccuucccagaucuaguuuugcacaaagugaaaucagggaagucuggggugaacaaggucucacauggacaagcuauauuuucaaaaagcagucuacuagagaggcaaaguggagaaaaggggcuguguuaugugccagccuguggcaucugaucuuaacaagaaagaaguaaaggccaaaagaacugacucucacucacaagccuguuuucuaagaacuagauuacucuuuuggacacucuggugcacgaaucuuguauaaauagaugguucaggaagaacucaucacauucagagaugaguaauaauuaguaaggaccagugcaagcucuaucucaagauccuccaaaaaugaagaaaguaacagaugaaaaauaugcgcaagaaaacauuugccauaaaucagaugaaaauaucaacuguacauaaugccuuggacuaaggaaaaaaauaauugagcaaucacaccucuaaacaagaguauaaaguugagauacaagaacucaggagaggugguaacaugacagaagagagugaaaccugauaugaugagcuccacaaaguagauagauuaacaaauaaacccaucuaaaaagugaaguaugcaauggaaugauuaugacagggaacacagaaaacacaguaagagauauggaagaugagauugggaaaagcaagauaaauuaauguaaagagagagagagaaauauuagaacaugaugcagaggacagauaaggggauccaacauacacauaauuggugucccuggagauaagaaugaaaauaauuaaauaaaaaaaauuuaaggcacaauuccagaacuuucuaaaaauaagauuugaauuuauggacugaaaggaaauacagugaguggcugagaaaauauugauauggugaggucaacagaaagacauagagaaguacuaauuuccucauaaaucaagaacccccaaaaaaauucaauagaagaauggauaaaggaugugaugaggagaugguuuacauaaaaggaaauagaaauaucuuuuaaacacauaaaaacucaaccucacucauaauaagaaaacuccaaguuaagauacuguuuuuuuaucuaucguauaggcaaggacuaaaauagcugauauuaccaugauggugcagguaugagggaaacaagaacucucagaaacauggcuauggauuucacuucuaauccuugucugauggaaguacacaaguaagaggccaggugugguggcucaugccuguaaucccagcacuuugggaggccgagauuggcagaucacuugaggugaggaguuugacaccagacuggccagcaucacgaaaccccaucucuacuaaaacuacaaaaauuagccaggcgugguggugcaugccuguaauuuuagguacuugggaggcugaggcacgagaaucgcuugaacccaggagguggaaguugcagugagccgagaucacgccacugcacucuagccugggugacagugugagacucugucuccaaaaaaaaaaaaaaaagaaaagaaaaaagaaauacgcaggugagaaaugacauuuauccacauuugucauagcauuguugguaaugggaaagaauggaaauaucuguaauggccaucacaggggacuguuuacauaaauuauuccagagcgugauaguggauagcaaugaaaagaacgugacagcucagggugcgcugauguagaaugauguuuaagauucuuuaggugaaaugagcaaggugcaaaauaguggaugauccaugacaugcuuuaugauuaaaacaugguaucuuaugacugcuuguguguagacuccuucugguaggaugaugcaccugaaagugcucauagugguugccacuagacaggagagcugagugagugggagaagggccuaagggagacuuauuuucacuguuagcuuuuuugugcccuuugcauuuuauacucauuucuuaaccaaaggcugcacagcuuagguugugaccauaagcucuagagucagcuguucgaguucgaacccugacugggcugccuacucgcugugugaccuuggacaaguuacuucaccucugugggucucagaguugucagauggauguaacaauggugccuguuucauaaguuguugaggaugaacugagucaauucaagggaaagaaugaggacagaaccuggcacaaaaaaauacagucaaauuagcuauuauagugacugcauguauaguugaacccagggucuggauuuggaacccguaugccuauuggcccaaugggggggaugacuuggccacagaacagccacagccaggcaguaaagggcacagggagggggccuuagccuggggcuucagggaagcugcccaggggaagugaugcugcugggucuuacagaaugaugggaaaacuuggcggcaccguuucaggcgacgcuacuuagaucugcaaaacuguugaugucuuacaauaccaaguguagggcggggcuggagaaauggaaacucaugccaccacuggaaauggauaugaaagcaaaccauuugcaaagucauuugccaauauccagauauguccaagcagccccucuguuccccuucuagguaaauagcagggaagccuucagcugugcacagagagccauucagcaacagagcagacccucgaacaacacgggguugggggagccaacccccugcacagucaaaaacccacauacaacuuuugacuccccaaaaacuuaacuaauagccuccucuugauuggacuuccaaaaacaugaacaguugauaaacauacauuuuguauguuauauguauuauauacuguauucuaauaaaguaagcuagaggaaagaaaacaucauuaagaaaaucauaaggaagaggaaauauauuuucuguucauuaaguggaaggggaucacuauaaucuuuauccucguugucuucauguugaguaggcugaggagaaggaagaggacggguuggucuugcagucucagggguagcagaggcgaaagaaaaucauguauaagugacccucacagcucagcucauguuugagggucaacuguauucuaaaauccaagaggcucugaaagccuaaagauuuuuuccuaacuuauuuggcagugaaacccaaccuaaauugaugugaaaccauuuauagcccuucucuaucccuguagugugaaguuucauauguuauguacagaaauagaaaugcguaugcguguugucccagaagcccuugggggugacagauguccuaggugaccugugcaccauauuacuguacaguccaaauccucuauccugaaauacugggcccacccuuugggauuugggagaugacagugaagcugguguguguucagggaauuccagguuguugaaggugcuggaguagaggggagagggggaaacgaggcagcaggcgcugggucccgacgguccuuggacaccuacugaggauguggguacaacacuuguuucaucccuggggcucagagaugucugcugaaucagucgaggggccuucaguccacugugagccccagaaggcagagcuguggccuccuccgacuuguuucucagaaaggucacuugggcagcaggugaacauggcucaggagaggcaagggaggguggggacagguaggaagcagaagccacuuacugggcaaagaccauagccaugaggauggggagggacugaguagccagagaggcgcucaucaaagccuacugcugucaucugaaggucugguuucucccaaauucguauauugaaauuaagccuuaaggugaugcguuaagagguggggccuuugggagguggucaggucaugaagauggagcccucauuuaugggaucaguggcuuuauaaagggaccccacagugagaagauggccaucuaugaacuaugaagaggcccuccccagacacugaagcuucuacaccucgaucuuggacuucccagccucuagaacugugagauguaaauggcuguuguuauaagccccccgagucuguaguauucugugggagcagccccaaaugacuaaguccacggcccauccuccacccacugaggccauaccacugggaaggguaucagaggcaggguuggggucuuagagguccagggucucuuguccaggcuccccagaggcaggccccgagguguggacuagaguauaagugguuuaucaaggaaguguacccaggggagguccagauacaaguaggaggggcucaagcacagaggagccagggaagggggggcucuggaccgaaaccauguccccuccacagcuuuggacuuagccccuuggggacacagacguggcuggggaugggucacaaaguaaccagggugacugccagccugaacucugggcucuccagacuucuggggaccguagucucagccugagcagcuuucuccaaggaggguccuggaaaccuggggccugccccugauuuuguccugggagcagggccccuccaugguguucuggagccccucauauuagcuuuugagguugauugcuuaauuuucaguuuggagagccagcagacaucuuguugguaguuugaaauuggccagggcagggguauuuauaccauggaagcuggcaggggcugccuuccagaaccucucucccuccaggugcagggaaacacggaccugcacacccugguggcuuucacaccuuccccuccucaggcggcucguccccuugcucaguuauacugauccuugggcuugcaggcagaaccaucucugucauccagaaucucccuaguaaccccaaccccaaaagugggcugccggaagaggcagauggcagugucccagggcuauggaagccacugauaaacaucuuccaacaaacaggaucagggaucugcaaaguuuuuuuuuuguuguuguuguuguuuuuuugagacagagucuugcucugucgcccaggcuggagugcaguggugcgaucuuggcucacugcaaccuccgccuccuggguucaagugauucuccugccucagccucacaaguagcugggauuacaggugccuaccaccacaacuggcuaauuuuuguguuuuuaguggaggcgguguuucaccauguuggccaggcuggucuggaacuccugaccucaugugauccacccgccuuggccccccaaagugcuaggauuacaggugugagccaccgugcccggcuggaucugcaaagcuguugaaaggaggaguggauaggauuacaaaguuggccugauucugcuaaaugaacauuucaacauguuuccccucgugcaccgaggaggcgugcacucuccucugagggucugaggcuuucuucacggagacuuuguaaaccacuucuccccagcacucuggagugggggagucacguagggaagucauuucucuccucuuggaccucucaguccccuuuggcuucucgcugauaccaggcagucagguggaucagagaagacauggacucuggagcuggaugucuggugcaggcaguguggcuucaggcaacuugcuuugccucucugggccucagcuuccuccuggaaaaucaugaugcucauaccuaggguuucaugggggucaggcaggacagugcaggugcagguaugagcaccaucccaucaaggacauaguccuggcugcuuucagugaucuuggugcuggggaaaauggggcugauucucauggaagaggaaauggauucaugugcccacuucuuaaauggaaauucaaggccuugaucguggcccacuuaugagguggggacuagugaggcuucaggugguguccuaagauuagaaaacuggagcauucaguugggagucagaccucugcugaugugcugugugacguugggcaaggugugugacuucucugggccuuguguucaguagaagcaggucaucuuucaauagaccuccuucccagacccucucggaugcugugggcauccagcuggcccccaugccacaccuggcuucucggggacuggccugcauucucacacccguucuuucuggcaacgaugggcauuuguuucuccccugccagcaaacuccuuuggaccaagaauugaugccaugguguuagcauacaauaaagcuucaaggagcuggugaaacacucugagacggucauaaaauuggcuuuucaucccugucggagcuuucuuauuacagacaacaagcagugucagggagcagcacgguagaugcugcuuaacccagcagcaggcgagacugagggggucucgugcuguuugucaccaccgccucucugagaucauccccaacccauacuguugacauucacugggauaccuggcuaccuguuuuggguuuccuuacaauuuuuucauuuguuuaauaguuuuuauuuuucaaagucuuaaaaaacacaagucagugaaaguuuuggucuuuguuacugucuuccuaccagguacgagggccugaaagucacuguuaauugauuauugauuaucugauuagaaccguacauuuacuuuuuaaggaaaugugaaaaauaagccuagaaaugaaaucaaaagugcgguguugaaguuagaaauggcagcgucacggucaggaauuaaagcugcugcuucucugucacaugguauaccacagggggugguagcuacagcccaugggcaaaacuuggcccagugccugucuuuguaaauaaaguuugauuggaacagagucaugcccauguaucuacacauggcauguaucuacacauugucuguggaugccuuucugcuauaauggcagaggugcagaguugccaaagaggacauaugucccacgaagccuaaaauauuggcuaucuggcccuuugcagaaagaauuugcugacccuugguauagaggaaaguuaguggcacaaguuuagaucgccuauagugaaagaccuugcaggaccaggagucaggcagaccuggguucgaaacccgcucugccacuuccugguugugacuucaagcugcuugccuuuuccucucaggguucuguuucugucucugucaaaugcagccaaauacugcccaguuugcacagcuguuuuuggagacagagacacucagcaagggguccagccccuggugggugguaucccaaugucacuguuggcauuugcagugucagugaugucuggcuuauucaucaggcccucuugaguuugccccaaacgagucaacccuccagggcugugaaacuucugcugccuugauacgaugugauuuccgaaccagaaaaauggaggaggcccuggccccuaaugcuuaagucacgggugacucugugcaauugguuucuucccugucuccugucccucuaaaaagaaccaccugagcucccggacugugcuauauccaggccuaaaggcugguggaccaggacacagucaccagcaaucagcuuucaucgacuuggcuggaccuuggaaacuuaaggcuugcccugcccuggcuucuugcggugagcaggucuuauggaguugcucuaaccacuguccauccaggccgggguuagaggauccaaacacagccauguugacgggaaccuggaggcaaauagagggcaugagacccuccucuccugaaaccuuucuggccuucuuauuggauacccaccaaacagucuugaucuuaaaacuuugugcaaagcaauaggaugaacuuguaggacaugcauaaagaggaagguauggauugugacaugcggcucuuagggaugcuccuccuacagugcugagugacccuccucagaggcacaggugugggcacagcuuguucuuucaaauccuggcaccccagcuguucugcugucuagcucguucccucauugacaaaacaggaauaacagugcccaccuccuugggcuguuaggggaucaacugagaugcuaagucauccaggagggggagccucuuucccagaguccugccugugcccgguggcugugcagaccugauacccgcagccaucuaccucuacaccucauguguguuagagaacaccacucugauuucagccucucagacuggggguucagucacuggcugcuaaaagcuuccuaaagccaaggccucuccuugccuccaggggcuccgugucuguuagauguguaaacagauccaucaccgagcauacugaugaguccuggccuagggacaagcauggccacaagugaggugucuggaaagggcucacaggggaaggagccacugaggagggcaagaagaaggcuuggccaggaagaugggguagggcucauuccuggcagguccagccuaugugaagcccagagacccagugaggggcuugcccauccuuuggccuugcuggagccaagggugugaaaugggagcugagaguaggauguuaguagcaguggcuuccugggaagggcccccacgugggagccucuggccugguugcaaauggcaggaccaaggaggucguuguugaguuaguuggaaggcacuguccugccaggauuucccacguccucguuugagcauugagaugcugaacguuaaacuguccuucauucuccagcucaguucuuuuauucauccaacaaacacagaguagcuacuguguaccagauacuauucuaggcacugggcauacaguggggcccccagcucguccuggccucccagcccaguggguguggagcagugagcaggaggaccucgagugucacacuugcuccccuugguacacauuggcacauggcguugccaggucagauauucucuucuugggguucaccagcaucccccuuggaugugcccuccgugguauguggccgcuuccaucucagucucaggccgauggaagauauuuucaaaauuaacuuagcuuuuggaauugguuccuccccauguuggugcucaaagacuccccagugagacagcugccuccuugagcucugugugcaaaacuuggggagcaagacuugcuugagccaguguuuggccuggcccaagcuguugggccugcagagccucaccugccccuguggcucagggcuuggugucugaaguggauggaggcagcugaacugguuucuccagggccccauccagccugcguuucccaggcugcugucccagcucugcuccacccaagucuacucugccguccccugauacugacacugaguguguuucugaacacugcagggggugaggaauaaggugggcauauuguagcuucaggaggugaugcuugugucugaaauacaaggaccacaauugccaugcagguguaaauaucuccagugauuacacauuucccugcaccgaccgaguggcugcacccagucuggggcucugucucuccuggucagucuguucuuccugaagccaggaacacaggagggcaaguuucucuccaucccuagucccacccuggagccagcacacaguaggcugcaggaagugcucguggaacaaacacaggcagcaauggaagaauccccaccacugggauuuucagcagcugaucguagaagggagcuggacugcaaggccgucuccgaccgccucccucucacugcccagcuggcuagggugaugaguauggacgaggauggaggcaggcuguggcugcugucucauccaaguagccuuuuccugacaccccaaggcugggcagagggacugaguuggucccagggcggagccugcugggaaggaaggcuguuagccgcugccuugcaggugccauagcaaugccaggcagcccaccugcuccuuggauuagaugggggaucagagccaugagggaagcaggccuguacccaggaacaggcucaucccgccccugcccuggcccgguacugauggaccuggagccauagagugccucuccccgcaacacacaugcacaugcaugcacgugugcaugcacacacauacaccacauacacaccacacacacacaccccacacauacacacauaacacacacaccacacacacacacacacacacacagccaagcaucgauucugggcccuguucuguaugcacaccaauuuuccugaacagacucuccuugucuucuagcacccgggaggauucagaaguguccuggcugcccuguggugauggggauggcagggaccugcauuuuugugaguuccugcacgugaugaaggggaaauugcaacugcccaggcagccugugcaaaaaggcaguggguuucaaguguggucauaaaccaaaagccucagguucacacgucaugggggaggcugaggggaacacacagccucugagcugugcucucgggcugauucugagcucgugcugguggggacacccccagacuuccagcagcacuggaugucccuggauccucacaugacucaugaggaggggcuggcauguuccugaacuucagguguugacucugcagugaggcgauuuggaucagagagacugugcaggugcccaggacacacagcaggugaggugcacagccaggcuuggcuagcaauugggcucuuaaugaugcucacacuggacgugucagagugccugcuccugggcgugcacagccuugugggaggggccgacagguggauagggaauuauaggguggggggacagggagcugugcuggcuguuguggggacaccacagggaaggcccccugacucucauguuccagcauugccacuuccugucauccucucggcaacccuauaugaaugggaauaggaguaagugcucuguaaagacuccucuggcugccaggcacgugcuaagcucuuugcccacaccacucaggcauucuucaugauggcccuaaaaguagagacucuuguguccccauuuuacagaguaggaaagugaacccuaaagaggcugccugcuguucuguggccacacagcugggcaguggcggcauugggauuugaacccagaaacucuggcuguacggucuuagccuuggcucacucucaccuccaagaaauagacucugagcagugaggugacgugucccaggucucaugggggcugagggaucugggaagggugauuugcccccaccccugcaucucccacacggucccaucccugaacccuugcacacacggccccucugccuccaugcccuuccccucacuuugucaaaccccagcagcuguucagcaggcacaccacagccgccucuggaggaggcauuggcuggucuccugugucaauguaucgacacugccuggcgaggucuggcucuccggccucccuguguauccacaggucuccccagcucugcaaucccuuuagggcaggcucaggucagucaugcuauggucaccccucagugccccgacauggcucagcaguguccgguggcuugaauggaggaccacaaaguguccucucucugcagaggggccccaggucauaucugcugacuuagcaccgccuauaagauuuaaagaccauucuguuuucaccuggaggaaccgucagcucacgcaggauggcaggugguuuuccagggcuccacagugaggucuccaguucaucuuuugaugagggugaugaugggacaguggcccugaaagcacauggcucuagagugcuuaggagccuggugaccugcugcugugacuuccucuccagagcuggagcuccaggggcugagguuccccuucccugggcagccccuuccuccuaauccggcuuucccugugaggaagagccuccuggccuuaagccacauccuuagcagcuucugccguggcccuuccuccagccggggacccuggcagaaugcaugggcaggaggaggugccuuggccccaggacagccaggugggcagugaauggacgaaaucagucugugcaggagggaaacacuaacacuaacccuaacccuaacccuaacccuaacacacucucaaaacauuugauucuaacuuaaaacacacaagggcacuccuuuccauggcccuacuacaugaucuggccugaccugccuuucuggccucugcucauaccacuaccucccugaucuuucaguuccucaaacacaccaagcugguuccuacccucuagcucccucccacugacuccuccucacccugagauccuccucagcuuaucaaaaaaagauucccccauuuucucacuucaacccuuuguucauuuccuccaaaguacuguauuacaguuaaugauuauuuuuugggucuguuuaccuguuugggcuucgccuccccagugguauguaagaucuuuaagggcagggugcauguguguuucuugguuuccaaaauaucccuagugggggccgggugugguggcuaaugccuauaaucccagcacuuugggaggcugagguggguggaucacuugaggucagggguucgagaccagccuggccaauguggugaaaccucgucucuacuaaaaacacaaaaauuagcugggcgugguggugugcaccuguagucccagcuacuugggaggcugaggcaggagaauugcuugaauccgggaggcagagguugcagugagccgagauugcaccacugcacuccagccugggugacagagugagacugucuugaaacaaacaaacaaaaaacuaaaacaagaaaacccccaaaauaucuccaguggguagcacagagccugacacacaguaggucugcaugaauauuuguugaaggaaugaaacagugccuggaugaguguauugcagccccuuccagguagggcacagccaucggggagccagcgugacagaugugagugcuguggcccugggaugcgaugacaaccccuucucacugggguguacccuggauuggguuggugcauguagaauauauggcaugcugcuggcacuuggcaggugcucugucaagguuaguuguuguuacuuaaaaacucuaaucaaguaagcaugacauauacugagguccuacuguguuacuguuaugggcugaauugugucugcuccaaaacucacauguugaaguccuaacccccagcaccucagaaugugacuguguuuugagacaggguuuucacagagguaccuaagguuaaacuggaucauuaaggugggcccugauccaauaugacuguguccuuauaagaagaggagauuaggacagagacacacacagaaggacaacugugugaagacacagggagaagacagccaucugcaagccaggagagaggcuucagaagaaaccauccugcugacaccuugaucuuggacuuccagcuccagaacugugaggaaauagauuucuuuuguuuaaguggcacagucuggggcacuuuguuaugguggcacuagaaaugaauacaguuaccaaauuuaauuuuucaagcucucucuagcagcaaaguauuucccccauauaaaaaaaugaggacgcugaggcucagagaggugaacucguuugccggagccacagggcuugcuggcgggcguuggcacugauaguugaacccugguccacuagugugccuccagagauggugcaggccacgccgucugccuuggucucacgcaaguggcggcuaagcccagaggcacuugucuccauuucagugcccugcuauuggcugguuagaaagucaauauuuuauggagccucaucaaccucccaagucuugggucucaauucccccuuuuggugugagccucugaagacugguugagcauuugugagaaacaaaguuuugacuacucaagacucuaguuaaaaaaaaaaaaaauugcaccaaugugccauccggcugcagcgucucaggggcaugauucgguuuuugcaacagggaguagcucuucuugaaacauuaugggauuucuuuccuaaguugacuucacuuacauucugcucagcacaugcaaagcauuugguuaucgggaggcagaguaagaugacaacccuauuauugaagguaagcagaccuggccuguucacaaagcccuuuuuacaucuuauuucauucuguuaccaacaggguaacugugaagugggugggcaggaacugugacuucuuuucaagucucagaagaugucagucccccagggaggcugggccuccgagugccagugcagguggcucccccucggccguccuaugccacgugcccucuccucgucauucucagcccccucgcgucuggagucaccucgcugguuuaucgucuugugguccaucugcccgugagcauuccagccaggucugugggcuucguuuucacggccgccauuuuggcugcccgcagagugccuggugcaaagcggaugacacucaguaucuagagcggcacuuccggguaauccacaaacacuuaucaaacacuuaggugucacuuggggugcucggaauugcaaacaugaggacaaacccucacuccauuuggggccugcagauucagcaagaguggaaaaaccagcuuuuuaaaauggcagccugggaaucccagaaguaggaagcacaagcuugucuuuggcaggccaggccagcugcugacccgcacggccuucaggggccagccagugcgaccaugauugaaugcacagcccugacuccuuuguggcauuggcuccuggguccaggugggagcaucugauuggcccccacuggucaugugcuaaccaggaaguggugugugaugggcugagccuagggcucauaccugcauguguuuugggggaaacagagagaaagguguggccucuccacuucuguggacaccccaaauaggaagaagggugcacacaaagcaccgcuuccuccacgaagcccuccucaggcacaucgaggagaaccagcugcccaagcucuuggcugcugcccuucugaggccugccugguagguggcguaggaggaggcuugguaagcagaugaugggacaucaucuaccacaucccaucaguaacauccaacaagugugugugccagcacagaccugggcacuggcaugucccagccgucauuccaugucaaauacuuaucugugccgucaucgucgaggucugguuuccaacucuauggcuccauugucucauguuuaaccaguccucuuacugggcaucagcuuuuccauuuuugcucugugagagguuguugaguuaguuggaggaccaagcccauaauuuccuggaugacaguucgugucccgcagauagagcuuaaccaacagugguucccuuuccagaccuaagcaggugggagucagagaugagcauagagaaagggugaaggggugccucuggauucccaaggcagggacauagcugggggagcugccuccggacucgcaaggcggggguguggcagacacuuugcagaaaaaguacaucuguccuuggggcgagaggccgcacaugcagccccaagucccuggaccugugagauccuggcugccugcuguugauagaacgggacagguggggggaugcuuuugauucauguacggugaaugaucuuauucucaccuuuaucacugguggcacauucugauggaaggagacauuggcagugggacugggcaagaaacaggucauuugucauggcugugugccagccuccugucguugcacagccuguccuugggaagucuugcucaccugucauguggaguaguuguaugugugugagugugugugugacugagagagacauacacauaugcacacacacgcagaagugucuguaccucugagaauauaguucuccagaggaugcagaaaaauuggggauugcagacugucgugcguuuaaauguguccuucucucaagaauaauguccacuuggaaccucagaaugugaccuuauuuggaaauaggguucuuguguaugucacuaguuaagaugaggucauauuggauucgagugggccucaaguccaauggcugguguccuucuaaggagaggacacacagagacacagggagaggaaggccgugugaugacagaggcagagauuggggugauuuaucuacacaccagaagccaggagggagucagggagcggcuccucccucagagcuuccagagggagccaggccugcccacgcugugaugucacauuccuggccuccagaacuaggagaggauaaaguucgauuguuuuccagcugucuguguguaguaauauguuacagcagccacaggacacugauacccagacacaucccaggcccuaacaucccagaagaggagucccugauacuccucuuuugcaaaaugaggugugggcucagagcaaguucgauuuucugugaagggccugauaguagauauuuuagacuuugcaggcuguguaaaucucuguugcauauuuuucuuuucuuuucucuucuuuucuuuucuuuucuuucuuuuuuuagacagagucucacucugucgccuaggagugcaguggcaguggcaccaucucagcucacugcaaccacugccucccggguucaagcgauucuccugccuuagccucccgaguagcugggauuacaggcacaugccaccacgcuugccuaauuuuuguguguguguguuuuuaguagagaugggguuucaccacguuggccaggcuggucucgaacucccuaccucaggugauccgccugccucagccucccaaagugcuaggaucuguugcacauuuuucuuuguuuguuuuguugucauuuguuuguuguuuguuucacaacccuuugaaaaugcagaaaacauucuuagcucuugggcugggugucacugaguuugcccuaggggaacccucaccgcaugcgaagcugagugggcacgguuuccuccgcugucaacgggaauauugaugguuucccugagugaggacccaggggaagcacugggcuggugcccgccuccugucucugugcccaggccuacugucugcuucacacuuuacuccccagaaccaggcaugacacuuaguacagggcaggccgagcucgggggagauuugcuugaagaaugaggaacguuucuggaagccucucugaccacccagcaggcaggggcaggucuuccucugagacccaaguccucuaugcuucccuccauccuagcagugacuuccaugacacaccauugucccuuugggagcacaggacucuggcugagucaucucugaagugaggugaacccagcacagggacugauggcuugggaagagcagcucagccuaugugggggguguugagggugcccaggcccaggggcgauuugaucccacccuacccuagcgcagccagaaugcuggggccgagguucaccugggagaugcaggaguuuagagaagaggaggaggauguuuaagcgugcgagcuggugauaggagcguggaguuggagcuagacccagacuugaauucuggcuuugcugcguggcagcagcuguguggcccuugaugagugucuuaaccuugcugggcuuuggcuuccucuccaggagggcauagcaaguccugccuguuagggccauccugaggauggggugaccagagcaugagcagccgggugcccagggcaccugggcaacagcccuguggguaggugggucugaaugguugagccccacguuuuagucaagaccacucuccuugcagagcaguucauguccacuugcccacauccuuccugucccagcaccgucuguagguugcuaugaucaccccauuuuacagaugaggaagcacaugcccaaagaagcaagugacuucccaaggcggcaaggcaaggugaggggcagaaugaggaccccaacccaguucuccccacccccuccuucccuuccagagccccugccugcuggaggcauugucccagcggcagagggucaggccacaucugccagagcuaaggggagucuccgucaucucaaaucauugggucaaaugacagaaaucugcuggcaugcugccuuuugaggcucggcgacuucucugaggcuuuccugauggcugcucugggugucuggaaugagcuguggacgagggccguccucugagugaccaugccccccacgcagccgagguuccccucugccuggcucagugcggguucugagaaagccugccugcccucacuggaggcaccucugacucacugcugcaaggauguggccauggacugggguccccgggggcccccgaaagccucagcaggagaacauguuuauccagaagccugggcaacacccagaggguccuggcaugggugugccaggcagacugggcauggaaacaugccccgugaugucuuugggauccugggagccugaggcuuguucucaguguguagggcaggggcugggugccacccaaggggggcaaacugaggucacagagagggaggcaguacccccagaaaaggugauucuucucauuggaagauucccaaggcccaaggccugggucagcagacaguggaacaaggguaauggucauguccuuaauucacguaaccccgaggugggucccugugaaaaucccguggauggggccuggugauggcuacacuuauauucucagaagcagcauuaccaccuggacccuucccuuuucucuuacucccuccuccucguggggucugcaagggggucugguaaauggcaucccccuccccgcccaggggcuggacccguggagcauaagccaaaaggggcggcaaagagagacacggaaccucacugccacugcccagcugccggugcugcaggaccuggcuuagguucaggggcccggugggcuuccccagugcuggaccccagcaggcagguguggagggagcaggggguaguggagcagaguacaguggccccuggcuguucucccccaggaagagaggagaggcggggcuggacucuuucccaucucccuccccaauacuccagcgucagucagucuccccccgacagggggaagggagagaggccaggagccuuccccuggggcacacacagggagcccagcaggcuuggaagaagugucucccuccuccuccagcccugccagauggucccagcccuccugcaggguucccgaaguggaaggaucuggacucagagcccagugcugcugcuuggcaucuguggucccgggcuggagggcguguuggcagcucaugccuggccagcgcaucgggguggcugcagcagaggaugggggaggggagcagggacaagaggagccugcaggcugcugggugcagccagggcuucugcuucaccccgggggucacagcugcuuucuguugggaaagcucccacuggagguaugggguaggcagugcuggagacccugguggcaagugcugagcuggggcacaggugaggaucaggaggagcugggagggacauccgcagguugugcugauggacugccucugaguauuuucacgggaugguggaaagaggccuugagucagaccuggguucgaauccuggcuccuacucuugguagcagugugacuuuaugugaccuuucugaaccucaguuuucucuguuguaaaauggggaaaaccacacaucgugggggcgguugugugcaccuaaggaagccaccccagggcugggcacacggguagccgauugucauauccuuguuauggaagguuguuauccuuguuaggcuggugggcaggggugguagaggaguagguuguuuuuggaaaaugguggacuuagucuuagacauguuguguuuaaauugcucaugagaaauccaaauagaaagacccagggugacagcagggacugcuaggaacuugggauaaaaaauugguccuggggugcuggucacugauccuguggauaaaggaguuggggugcucuguuuggguccagcuggcagaguuggaccaguugagagaaacuucuaggaggaagguuuagaagaagaaugcuuucaccaucagagcuaucuuaauagcuguguaaugugguagugagcuccccaucguaggagguaugugagucauggcuggaggacuacuuggaggucuguuguagaaggauucagacaccagagaggguuagacuggaugaccuucaguuccccuccugggugaccacagcucuucaaagccccucacugcugcccgcuucugcaggauucaggguugaaugucagaagucugcuggaaugcugucgauugaggcacggugacuuggccaagccuuuccugguggcugcucugguaucuggaaugagcuaugggugagggccguccucugagugaccgugccccccucacagcugagguuccccucggccuggaucagcguggguucugagaaagccugcuugcccugacuggaggcaccuggaggugguuuucaaagugucacugucaccgugacccagacaugcuugagccccaggcugggaaagcuuuuuuucuuugcuuuaaaaaagcagaaacagugaagcaagcauaaauuugccuuugaaauaagaggcuaaaugucugccaaaugcaaauggauugaaacggccgguggucugaccuugggauguuccauugguaguuucagaggggcucugagcccccaggccggcuguaacaguggacaugcuggcgcuggccaguuugaucccuuugaaagccccccgauauucaccuccaagagagaaggcccuggcagguccuccagcaugcggacgaggcgcaugcacugugaggcagcggcucugugggaggacggggccuuuuguccacuguccuggcauuccauggcccuguguccccagauauccgcaccuguuccugacaccaucccuuccugucgugugagcgagaugcucuucuguggaaccuggguuccuauggucacugggagggugacccugaguucacagagaaaggggagcaggcuguucaggaaaacuaagcacauguggugagcauccacaggcggcuagggauggaaggcuuuucauccgggcuuucagaugaggccccugaagcucagagggguuaggcaauuggccugagguugcacagccaggaaggagugauggcguagugauucccauugggcucucccacccccuguuccucccuccauccagcccagggccucguggauacauuaggagcccaacaagaguuccccucccuucucccuugcuucucugagccucgguuuccccauccauauaccaggaggaacccccugcccaucucguagggcucuuugacauggugaaaugagauccagauacuggcugucugugucaacuguaaagugcuguccugagugaccaguuguuguuggugccuguagccauccuugaggcuaaaagagacugcugcuugccugaugcuccucccgccagccuccugcuuucugcgugacuucccucgccccagcaaugaacccuggagccaccugcaaaugggaaagcucuuuuguuaguuuccacagaaugcccaccgugcacaugaucagagaguuugcgagccuagcucaggucaguggaacugguuccuuucguacauguaggaaguaaugcagggugcugccgaauaaauccacugccugccuggccucugaugaacuuaccagcucacgccaguucuagcuccagccaguucuagcuccagccaggaggaggaaaaaggcauacuaggccguauuuuguuucuuucaauguuuauuuaccuguacacacacacacacacacacacacacacacacacacacacacacacauacacaggcaaaacuuauguuacugucccaugcauaauucucuagauuugggccacauagaucugguuuuggccauugacuggcaacauggcaguagccaacugcagagccaccagggagcagccucauucugauugaguauaacgaagacgcugaugggaaagagagacacgggugagcaggggcuguggggcaucaugagaguugggaggguccccaucguggagcuggccagcccugagugggagccccggcacaguccucugcuagcuguggccuuuggccagucuccacuucucagagucucagugaccccagcugccaccaccaggauuguugggguguccaagaaugaaaauaggggucaucccuggcccucaggggauaugugggcuuuccccucaucaugaauggaacaggugagugcuguggugcaggcugagaggcggcaggguguucucucacagcagggucgggucuugcucugauaacugcaccaggacaaacauccccagccucugggaugcacacccaccagcaucugcccggcagguuuaauuaccggcugagauggguuguguugggcucacuaaguaugcuccauaagugaugaaauugggcaaguucucaccucuggaggcucugaccccgaguagcuuugacccugaguagcugaaggaacaggcaguucagccucugcuuaugggcugugugugcacacaugcacgaguaugagagugugucaguguguaucgugugaauaugugugcagguaaguguccaugcauauguguaaguacaugacaaugugugugcgaguacaugacuguguguuuguauguacaacugugugugcacauguauguccgagcacauuggcgugugugugaaugugagugugagagcgugugauuucaugacuguacauguucacucuguuuauucucgggggaaauagcaggcaaucuguaagaaaaugacuguguaaguuucauggguggaggcuuaugauacuguuagagucuaucuuagucuguuggugcugccauaacaaagauaccauagacugggugauucauaaacaacagaaacauuucuaacaguucuagagcugggaaguccaagaugaaggugccagcaguuucggugucuguugaaggccguaugccugguucacagguggcgacuuccuguuguguccucacaugggggaaggggcaagggagcuuuuguaggcccuucuucuaagggcacuaaucccauucaugggggcuccacccucaugaccucaugaccucccaaaggccccaccuccuaacaccauuaucuugggguuaggguuccaacauaugaauuugaggggacacagccauuccaucugugaccguccucaaucagccuucucccugcagggcugcaaaugagggugcugccggauucauaagagaagauacauuguaacauccacagcacacaggcacuagguugggagccuuuuccagcacucagaucaggguucaaacccuaacugugcccuucaggagcugugugacuugggcauuccuucauuuuuuauucaagcacacagcuggcaucuacaugccugcugugugucagggagauagaaauagaggggugagccccugugauauuaggcaggcagcuuucccuuccagggucucauuuuucucacuggugaaaugagggcaggggcuccuccccugggguuacuuugaggggucaguaaggugaacaguuacagucucuugcacagccccugaacguuguuuagaagucaauacucuguuccaucccaucagcuuccucuucccuuguuuugacuggcaaauagucaucaccuucugaagucauuaagagaaggucuuuuuaaacuauuaugaugccaucaaaacugacuuuugauccaaaauaucuuuuaaacaagcugaccauucagugaggauuugccaggcuccuuugugauccauccuuuuggggccagggucuguggggcccagagcuggacaucauggaacuagcucugaggagcucauguucaggugggacacagucuccuggaaucacaguucuaagcacuuuccaacuauuaacucauuuaaucguuaauuacuaccauuucccagaugaugcaccagggauguuaaguaaccaaggaauauggcagggccacugggauagugggcuguuagaaaagucaggguggaggccgggcgcgguggcucaugccuauaauccuagcacuuugggaggccgaggugggcggaucacgaggucaggagauugagaccauccuggcuaacacagugaaaccccgucucuacuaaaaauacaaaaaauuagccaggugugguggcgggcgccuguagucccagcuacucaggaggcugaggcaggagaauggcgugagcccaggaggcggagcuugcagugagcugagauugcgccacugcacuccagccugggccauagagcaagacucccucucaaaaaaaaaaaaaaaagaaaugaaaagucaggguggaguacagacacaaauuagagaacuuaagaggcaccaacaagaguaugggcaguauagggagaaauggaauuagcacggagcaggggcuuccuagggaggaaugaugggaggagacaccuccuuccugcugcuccugcugugugccagccugggcugggagcgucacgccaucagcuccaguauucauuccagcccugugaggcuggcagcaggguccuccuaguggggcugaaaggugcaauggugaggaggaggauugcaggggcuggaguccuggccccaccacuuccuggcugugugacugugggcacguuacucacccucucuggcccuccauuuauucaucauuaaaaugggauuaggggccagguacugguggcucacaccuguaauccaagcccuuugggaggcugagguggguagaucacuugagcucaggaguucaagaccagccugggcaacauggugaaacuccaucucuacaaaaaauacacaaauuagccaggugugguggcaugcgccuguagucccagcuacuugguggggcugaggugggaggauugcuugaaccugggaggguugaagcugcagugagcagagaucgcaccaccgcacuucauccugggugacagagugagacucugucuaauaaauaaauaaauaaauaaauaaauaaauaaauaaauaaauaaaacagggggaauaguagucccuacuccauagggcuguugugaagaucuagugagaucaauguucaugaaggacuuuggcgcugcacacguuucugagaaagggugaccuggccaggcucacuggggugguaaguggcagggaugggcuucuccacgucuccccugugauauuaggcagguguaugcaguugcuucacguccagccacacccccucacacaccugcagaccagccagcauggcacaccagacacauuucugcugcaccuuuccccacacaguaccuaccaccuggcgugccucucugcccauccccaucuuuuugauauuuuaccuuccaccuaaauccgaacugaaaucccagaccucacuagcuggugggugcauggggucucugcucugccacuucuggagcugcuccuagugcaugccccaguuacucacucguggccaccaccccccgagucaggggucgagaguccccuuuguccaugaugggugacgagggcauacccggaacagagggcuaauuaaaucacacgcugagguuuguagaacaugggacgcuucauuaggcucugugugaacaagugcgcccagccugcucccacuacuccagcagacucgagccugguauaaucacagcucacacucugcuucaucagcucgcugaggcuguggggagggcucacaccuuugggcucuaaagagagugggccugaggugugggauccugcuucugagcaggggugucugccccgagccagcuugcccagugguguggagcuggagcccccucugcuuaaguaaaggccucugagggacacaugucaugcagaugaugacaccagacuggcuccucacuuuaaacucuacuuccugagagcagaaggcagggaaggccucaguuggaggugaaaauggaacuuucauccaccagauguuagauaaaagauaggaaggguguuccaggcagaggggaaagucugggcaaaggcuuggaggauaaaagggcaccgcauguuuggggagcggggcauguucccuggggccagagaccugaguucuccucuuggcucuauccccagcuccacccaugacuuggggugaguccugaaccccgaccaaccuuagugucuccagggcugggauauggggggguggcagccucugaucuguggucacagggagucucagcuguggugcuccugugccucccucuugcuacucucuggccagugacgauggcacuuuacucuccugcagagaccuguccccagugccugccuccuccaguccucuuccucaugggcuggcugcucugggcacaucucagggcagccccagaaggugggcugagcuguuauuuggggcgugggguucucgguuccuccgcuccaugcuggugggccuggugccuggcaccacuggcccgucuuccaggaagcucacugacaccauccuggaugggccuuguuuucucucuggccugggagucagcugcacucucgcagguccuaggccaaggugaccugcuuguuucauucuugucuuucuccuuugcuuuaugguauauuuuuaagcauaagauauauuuauuuguaaaauaaaaguucauuauaaaaugaugccuuaauuaccuuccugcaauauaacaauuauuugguuguauaguuccuguucuccguauuuuguguaauaaaauggacccaaugggugcugcacaaugcugggugccacagggaacacacacugcuguuuucuccuggauuuuuaaaauuuuaauuccagcaugguccuuuuauaugugcuuucacucuagcuguuugccuacaucuccacaguuuugauuguccaggguggugaauaaaaugcaacacuuggcaucuuuuaauguuuaaaaaaaucaacaaguauuuuauuuaaaauaaaaugugaauaucuguaauccuaaaaaaaaaaaaaaaaaagccacaggauccuugagaggcccucugagacagugacaccccugaccagcugcagcccccuguccacuccccaggcuccauucucucuacccacugccucugcauccuccgcccuuggaguuucucagggugccccgcagaucaccuguggcccaagugcucagggacuuguuuaaaauucagauucccaggccccgcccaggcuugcaggcagccagggccaaggaauccaaauacuaaucaagcccacuguaauugcccugcaucugaggucugaaaucacucgccugcucuggauuaucugugcuccaggguggccucaguuuacaccauccuaccuccccauugaaaccuuacugcucacgauggcccagguucccacccauccugggagagaaagaugauuggcucaguucucugggaggccuggugauuggcugccucuaggaggguguggcuaccucuugauccaaucaguggagggcagcauggggaugugaucaugcagugaagaaccuguaccggggguaguuaggcgccagggaaggggaggaggagaaaccaguucuacuguuaguaucagcucaucuaacauuuggccccugguggggguuuuugcauccuuuugggggucuaggucucuucugccauuuuguuggcacuuuaauuucuuguuaacaaacccaagagcacauacaacuuaauuuuuaaauucccaauaauuuccagcauccucuaaguuagugcugagcgauagaaauguaacggaagcuguacguguaguuuuaaaacuucugauagccagguuaugcacguaaaaagaaacaggugaaauuaauuguaauaauuuguauauccaaaauaguauaaacuguaaucaaucuaaaguaauugagacauuuuacauucuguuuuucauauuaaaucuuuaaaauucgguguguguuuuaugcuuaccauacaucccagcucagacuagccacauuucaaggguucauuagccacccauggcugguggucccuguacuggauagcgcagcacuaaaugauggcuuuacuuuguauccuuggggaaguauguauuuuugaauccauuuuccucacuuuugaauaguuuaagaacuucccaguccauuugucuaaggguauuugacuucuaaauguuggguuucuuggccgggcucaguggcuuacaccuguaaucccagccuuugggaggccgagguaugcggaucacuugaggucaggaguuugagaccagccuggccaacauggugaaaccccgucucuacuaaaaauacaaaaaaaauaauuagccgggugugguggcgggugccuguugucccagcuacuugggaggcugaagcuggagaaucgcuugaacccagcaggcgagguugcagugagcugagaucgugccaccgcacuccagccugggcagcagagugagacuccaucugaaaaacaaacaaacaaaaaaaccaguuggguuucuagcaauaaaugcucauaaaaucugcuggaguuuuggaggauuaguccauucauccugacuuguguccuguuucugcugggucauuguugacuucccccacuugccucacacuuguaaggccauguggcacaccaucaacauucaucucugauuaaggagcuuguuucuuguaguggcugccauaacauauuaucacacguuugguuguuuaaacagcagaaacuuacacucuuccuguucuacaguccagaaguccaaaaucaugguguccguaggccuacguucccucuguagccugcagggguggauccuuccuucucuagaggcugccagcaucucuuggcuuuauggccacauuacucuaaguucugcuucgguuuuuacaucaccuccuccucuuucccccaugucuucuccucugugugucucuuauaaagccacuugccacugcauuuagggcuuacucagauaauucagaaugaucuucucaucucagaauccuuaauuaugucuucaaagacccuuuuuccaaauaaggucacauucacaaguuccagggauuagaguguggacauaccuuuuguuuuuuauuuuauuuuauuuaauguauuuauuuauuuuugagacagaguuuuucccuguuucccuggcuggagugcaguggugcgaucucggcucacugcagccuccgccucccagguucaauggauucuccugccucagccucccgaguagcugagauuacaggugcgugccaccauacccagcuauuuuuuuuuuggcuuuuucuuuaguagagacaggguuuucauccaacagauguuagauaaaauguugcccaggcuggucucgaacuccugggcucaagcgaucuacccgcauugggcucccaaagugcugggauuacaggcgugagcccugcacccugccaagaguguguacauaucuuuuguggggcaccauucaacccauugcagugaggugucaguguuuugacaggaagaagcagcaaagaagacaaaucagcacuuuauuuuucuaagcuuugaaauucuuaaaaugauaguggguuaagaaagaccaacuuccccauggaaggugcugguccacacuggcuggguuuagaucccuuuggcugagguuuagaucccuuuggaggggagucaauuugaagaagaagcacaucagacacauucaggaaggcaaacccaaagacagcagaaaggcaagaaugucucaaauuguucaaaaauaaauacguuaguucuuguaacgugcuccgaauagggugaggcucaacaugagcacuuaauaaaugcucaguuuaauugugguaauuguaauucucauugguauauauuuauguccugauccuauaccucuguuauuaaugagacugauaauagguaagugaagggaaaaagagaccccccugcugccaggaaacaaaacaaaguaucgagccaaaugccaaauccauaagucaccaagauggguuuugaugacaaaaccuuucuuucuggacucccccugccccuccgcgaagccguuccccauggccacgcuuguccguggcuggcuuuauaggcccauccuucuuuuauaugaucaucaagauggcacuaauuuggguuugcaaaugagguuuucgugauguugucaugucagcaucuggauucaagaggggcugcuucccagacccugacccuccccuguggccugggagcaggcccagccccucccuccaucuaaucacuccccaggaaccugggggauuugcuaaugggcccaggaagccauaaagaguaaugaaagugcugugugacugcucugcacgggguugcccuuggggucccuuccucauaauuaaauucggaauccuccuucugccuuugagcuggaagagaggguuuuauccucccuguggucuguucaucccuucuuccccccauucauuuguucagcacuuauuauccaguuauuuguuuaucaagccacaguugaaugccugcugagagccgguuuagggcacugagcuuccuguucucaacaggcagaggugggagcagccaggcugcugugggaagagcagaguggcuauggagccgcccugagccagcucugcugugcgggaguucugcgaccuggggaacccgcucgcuuggcuuccucaucuguaaaacggggagacuaauauaauagcagcuaccuuccaggggggcugugagaauuaaaggggacgauggauauaaacucccacacacugucgggcacagggcguuaauagcagcccucagucucaugucccacuuauuuugugcccgacacacuucugagcaucuuaugucuauucacucauuuaauuugcccaguaacucuaggaaggaggucacguccaugguucuuauuuugcugaugaggcaguugagguaggcagaggugcggugccuugcucaagauggcacaguggaaggacacggggcagggcggaccugaccgcaguuggcccucccuugccugccucuuagcacgcaugcagcccccucgccugcucugcccguugugucucagaaucuccacugccauuugcgggugcccugaauccaccucgcuuuuccgugccucccugcuuuugugcuuggugcagaccccugcuuccucaugggcaccugccuccuuagaaccccccuuggaaucuguuaacuacagcuuccugggcccacaccagcaucccucugcaacucagaauuuccagggcccauaauuuccuacaggccccucgggugauugcuuucucaguaggcaacuuagggccgucccuccaaaccuuuagagugagaagcgugcuaccugggugcuucauaacugauguugcaaauguucaaccaaguguaggaagugaacacacuuuguaucugcaaagugcugugcauacaagcgaggucaggagcagcuggcacccguccccaaggguuuccaugccucuggcgagauaggguaggaguaucugcaaguagcugccuucuuggccauggaagaacaaguucaacagggcgccucugugugccugccccuugcuguguacaaggaccuugcacuucagggacaucaaggcaccuucagccgggcuuuggggaacuuguguaugggagggggggaccucuaaggaccuuuccugucccaaggagcuccccagaagccuguugcagugcccagcaccccagccucaugguuaagguaggcaguccccaggaguccccuuccugggacaucaacucuccuggugggaacaaaugcugagcaccucagcaugagauggguacagucagggacuccacaggcaggucaugucacagacaaggucacacagcuaggugguggcagguuggagagagagggcaguccccugacucccaucccagugcucuuuucucccaugacagugacgggugaaauggcacaguguaucccugucaggcaggaggggauuuguuguacuuuuuuuuuuuuuuuucugaggcggaguuucacucugucacccaggcuggagugcagcggcgcaaucucugcacacugcaaccuccgccucccagguucaagcgauucuccugccucagccuccugaguagcugggauuacaggcacccaccaccacgcccagcuaacuuuuguauuuuuaguagaggcgggguuucaccauguuggccaggcuggucuugaacuccugaccucaaaugaucccccugccucguccucccagguuguauuuuuaauccuccacaacuaaauacucaugucaguggaaagguuccaagcucuuuaaagacagccucugccagcgugcucccaggggaggccagggaaggcuuugggaagccuccguggggguggggaccuccugcaaccccuggcgcacagccucaccccgcuguaaacagagcugggauugaagugcgauuucgguuucuuuuucuuuuuuucuaaucaaauaaaaacaccuagggggcaggaagcgaggaggaagaggccagggaguaauucuuguugccaaaccaguuucuaaggggcuccgcuccgcucccagcauuucugucucugaggcuccgaccucugagaugaucaauccucccauuucagccagaugagaauugcugugggcccugccuuuucuuaauauuuugcaugagagcgacagcccggccagcggcaguaaucucccacccacguggggaggcacccacuguccugccaugugcauaauugaagucuucagacugcucagugguucuaauuagcccaaaguggccccuucuggccucaguggaaauuacugcccuccugccgccuggucuuacuagcugaucuuugaaggugugagugagccgggagacgugcagagccuagcacucccucugcugcauuggucuuucuuggcaggccuucauggcuuugcagagggcgggcaguugaggccucugucugccguugagguccugccucccuccucucugccaccacucuccaugggacaggugcuccagcugggcgcaugcaugccccucucaccugaaugccucccacuagcagugucucugcucuuucugacccuucagguuaugcagugccuccuccuccaggaagucaucccugauccccaggcugggcccucagaauccccaugucucccuccaucgcagcccuggccaugccauguggugcuuguuuacauccaugacugccccaugagacugggagccccuagggggcagaagccgcuccaugucccaccuacuccuggccuagcgcggucccauaggacaugucuacggaaauggagggcgugagggugggaggaaggaaggaaggcaagaaggaaagaaggaaggagaaggaaaaaggagaagagagaaaagagggagggugggcagguagcaccaugcccauuuugcaggugagaacacugaggagacauaaccgggaaguggcagggccaagcacacccuuggcagcucauuauacuuucccuucagccuagcaaagcuacuguucgauuuggggaaauggggccgcuuguaugaagagccgcaggcaaaguggaaagugccgagggcuggaagucagaugggugugggugcgcagccuuccuguguaccugugggcaccacuuaccugcucugugacccugagcagggcaccuuugccuucgaaacuugaagaucacagucguccagguggauucaaggcgaugaacagcaacagcgcaugcucuucccaaacaguauucuucuuauccucacugaagccccagaagguaguugauccuuaccacaucauuaaccucaaugcgcagaugaggaugccaaagcacagagagguugagcaacuggcccaaagucacacagugcgugagugacagagccaggauuugcgccuggguucuuggcucugauauuagugccauugacuccacucuguugugugagguaugaaggcauccaguacagugucuggcaucggcagguagcuuccauggcagauacccccccucucccaccagauucugcccuuugagcgacaggaagauaaauagcgcuguucuccagugucacuugugacuuuccucugugaguucauugucagggugcuccugagcugagcuguggccaccacucauugguguggucccuggagacacuuggauaaaauugugaugacagagggcucucaggcucaugagaucacacagaggaggguggagcucaaagggcuaucucagaccgggaugcuccagagguuaggucuuggugcuguguuuggcccccagcugcucuuucaggccuuggucuugcccuugcccuuggucucuggaaggcugaauagcugcaucuuguucaucuggaaacucucugggaugagugacuuuagcaucucggauguugccaucguagcccaugugcauaacaacuuauugugcaagcauguacagucauauugaaaauaaauguagaagugaaggaggcaguccaaagacgguuccugacaauacucggaaacagcuucauuagguauuggccagagcuucuauuuguggguugcuuuggcgaaacugcuuccuuaccauuaaccauauccaggagauggaggggaaagucuucaccuggguugguuuuucucagaggggcaggcaagcugaauaacgggaguacuaacauuuccaagaagauuaaugauuaaaauguugaauacaauuugagacuuguuuucauguucauauuuuauaguccagaaguucuuucuauaauguccucauaaauauuuuauuuggccuuagguuaaaugucaguuuccauguccugccacgugccacuugaccaacgugugugggaacgucucuacuuuggacacacugucuauaugaauggaggcccuucuaccccuugaaauguuccucaacucccagcucaguuucccuuccgcaucccuuugacugcaugagcggaagcgaggcauuacagagagguuugaggagccagccagcaagcuagcaacggcuucaguucauuucugagauguuugcauucaggggucccauuggccaaccuuaacuucuccuuugagcucuaggcaucuugugaugaauggcauaagccuuagaacaugggagaggcuuggaugggccaggagcuccaaacacuaaggaauguugcuuacaucaauagacgccuuaguuacuuaggucaauagauaccuuaguugcuuagaucaauagaugccuuaguagaucaaacacccaaaucacccaauguacuuuuagggcaaugguugccaaacuuuuuggucuuaggaccccuuuuuacacucuuaaaaauuauuguggcucccaaagagguuuuguguaugugggcuauauccuucaauauuugccaacuuugaaauuaaaacucagacaguuaaaaagauuuauaugaauucauugaaaaauaaaaaguguaaacccauuacauguuaacguaaauaauauuuuuuuuggaaaauaacuguguuuuguuuuaaaaagugagaagaguggcguguguaucaaucucuuuaaucucuagcuuaauagaugaugguuggauucucacaucagcuccugcauucagucuguugugauacauuguuugguugagguauugucgaacaucuauccucaaacagauauguaguuggaaaagggagaaccccacaauccccugaaaacgucuugggguccccuggagguacuuagaccacagucuuagaacugcugauuuaggugaugggugaaacucaagaugaagacaaaagagaaaacauuucaaccccaagagacuucaaugcauucacaugcauugacucaggaucauuaaagcucuaacugaacccaacauggagacagagcaggaaacacagccauggcuggcuugacuucagccucccaucaaagacccccaucuuuggcucaacugcccccagugguuucaaucagccacagacuucccuuguccagcuggacuggacguucugcauuugacugucugucggcugcccacugauuuucaggcugcugaauuacccauuagcucaccugaaccccuaaugccacaucuaaacgguccucacucugccuuucucagcauccgagaauguccuauaaaaggcuucuuccauggaggugggcagccuugggccucuccuagggucagcucaggcugcccacgcuggcuauggcuuccugcuggccccuggaagcuguguacaccugggagagugaggugaauguuaauuuauucagcaugcaauuaaugaauucuacccugugccuggcacgacucauuucucaugccaaagcuaggguggaucagaccaccuuggacaaaucuggaugggugaacuuguggauugaucaaugaucuuaguugaugaaaaaugcaccaaaugacuguuuccuuuaaugcgauugcuugggugguggacucgauuacguugaggggauuaaauuagcagcuugcuggguuucagaugagugcagguggcugcuggcacuuccucuccccucuuuucuuucuuucccuuuuacugcaaacgaagacuuuucaaagcuuuacuaaguacaauaaaugccauccccuuaaaguguagacuuccauauucuuagaauuggcaagcuauguauauguuugugaaaucacccccauaauuaagauuuggagcauggccuucacccacaaaacguuuccuguucucugugugguccauuccuaucucugcccugcacccuggguagccagugauuugccuuuggucacuguaggauagucugcacuuucaagaauuucauaugaauagagucauagaugcaugcauuuuuuggucuggcuucuuucacucaguguggguauuuugaacuucccccugguugcugugugugucaaugauuuguuccuuuuucuuugaggagaauucuguucugugaauaugccaugauuuauuuauuccuuccccugcugaugaauauuugaguuuuuucuaauucugagcuacugugcagaaagcugcuaugaacacguacguaugcaccuuugugaguuugugagcuuucgugacucuugguuacaaggaugguugguucgcaugguagacccgugcuuauuuucacgcuuuaagaaacugccuugcuguuucccacggggcucuaucguuuuucauucccccagcagugugugaggggcuguuugcuccaccucuucaccaacuccauauuauuagucuuuuuaauguucgccacucugauggguguacacugguaucucguugugauuugcaucugcgucuugugaugacugaugauguuaagccccuugccaugugcuuccugaccauucuuguauuuugguuugggaagugucugcccaaaucuuuugccuauuuuaaaucagguugcuuguguuuauauuauugagcuguaagaggucuuuauacauccgggcuacaagagguuuacuagauacauguacuacgaauauuuucucucauuccaugccuugccauuuucuuuucauaacaguuucuuucacauagcaaagguuuaagcuuugauaaaguucaguuuguccauuuuuuguuguuuuucaugcuuuuugugucuugagaaaucgaaguugcaaggaguuucuucuauaaugucuccuagaaggcucaugguuuuagcuuuuauguuuagguagaugaugcauuucaaugucaguuugucagaugguguaagaguugauauucauuuugcccccagucauuuauuggaaagacugugcuuuccucguggaaucaccugagugccuuugaugacaaucugaguucaccacagacuugugggucuaguucuggauucucuguuuaguuguauugauccacaugucuguccuuuuaccaggaccacacugucuguaucacuguaucuuuauaucagcugggguaaauccuccaacuguguuccuuuauuuauuuauuuauugcaaagucauuuuggcuauucuaggucuuguucuaacaggaacauauuuucgcuuauuuaauccuuaggacccucugaagcaggugugaauauuaagcccauuuuauggauaaggaaacugagguucggagaggaugaguaacuuucccagguaacugaggaggaagugagccuugccccugguaggucuggcagcugcacuugcccuuagccucuaggcaggcugcacugcccucucuguggguuccaaccauuccugguacacaccccuagccaagaacuugugagguucuuggaaccucaugcaagaggcucuugcaugaggccucuuuuccaacuucuguuuauccugucccaaagaggucagugagggacccccagggccgccucuguucccucacccugcaccuuggccgggagacccccgcagcgcagggagcaucccuccggauguuucuucccaggcaacaauauucuguuuaucaagccaggccccgaggcugaggccucccccuggccuggggugauuuuugguugguggugagaagcagcaggggugccugggggccuggcugucaucggagccagcucccuguccuggucucugcugugcgggauggcauggguaggggcuuugugcaggaugaggguccugccgacugggacgugggcuuuggaagggccacgcuucucuuacaggggugcccuuguggcuguaugaggaguccaagcucugagguugaacacugggauugaaggauuccugccagggugcacuuagguggcucacuuggcccagagugagccagagcuggcucgcaucagugcgcgggagucaauaguuacauuuuuaggaauuuuuugagccaguuguuaaacuguggguagcauggaaaucagcccuggcuugaguaggcucgcaucagugcgcgggagucaauaguuacauuuuuaggaauguuuugagccaguuguuaaacuguggguagcauggaaaucagcccuggcuugaguauucaugccacggacuuggcaaaugccgcaaaucagggccuucucucuacccccucccagccccaacccgaagaccugauuguuaacugcacuggcaaaccccuggcucugccuccuggagccucagguuccuuaucuggaagcggggagaauaaugcccacaccuuaaggcaucaucaacacccuuaaaugagaucauggguaugaaaugcuugugaauaguuuugagugugauacgcaagugugaggggugcucaccacccuggccauugccauuguccuccucauggcagcagcuggacaaugugcccaggcugggaguuggugucuccaggaaaaacuggaggaaaggagcccgauaacccaugggcagcagcuggguuagggagggcuccagaccugccuaucuccgucagcccugcugaaugugccucuguuugcucaucuuuauaaugggugcacugaucccagcugagagggguguggugggcuuugggguacaggccacaagguacaaggcauggccugacugcagcuccgucacucucauggcucaggugcauggcugucccacaguggaaggaccaggggcuggccugaucugcacuucauggcaucaagagcacaggcccuggaguccaccaggcacagagaagcagccugcuccuggguggaguacaaguucaacccucgggaguugugguuuccccauguggaagcuggcagcaugccacgcaccugccagggcugccgcgaggguucgcacacacuguguguaaugcuccugugugaguuccccggugacccaggucccacugggguggccggcguguaaccaggacaggaacaucuccaaagccacuccuuguuugcugccugguggcucaagcagaacaucugugccugcagggggcccauaagccuuaaugcccugcagagagggggccugggggaggcugggacucacaccagcuggggaacaaggccugcagcuggggggcuaccaggaugcuccuugccaguaaagaggguccucaggagaucagccacagcucaaucaggagggucugcccauuucacaggggaggaaagcgagccucuggaggcugagcugccagcagucacggggccagcgcacagccagagcugaccacucuguaugacuggcgggucugcgcccuuggcauaccacagcagcucucacaccaacagaggcuggaccugcugaucagcccccgcuguggggggucccgccucugcccacacccuaccccacaccuucacagggguggacugucacccucuagcagacuguccuccagagaccgagacacggagccucuccacaaggagggaggaaagggagguggaaaccagccuuacccuggacaccgggugguccuugcugcauacccaacccucauuggucagacuggucugggagggccuggacaugcccgcgggguccguuucugaauucccguugccuggcauaagcucuggcacuuaguagguccucaguuaauacuugucagauaaauaaauggccuccuuuggggaaaugaagaauguccaggcuggccacggggaaggggcaguguuaggaguggagagcgagagggugagccaggcagaugggaccuuuauucaaagggcaguggggagccauggaagguuuuagggagggccaucggaugagguuuucauuuuagaaaaguccuucuggcugcuggguggauggggucaagaugaagacaggaaauccagagaggaggcggcugcaggcucgcgggugagaggugaccauggccaggccagggcggaggcagggaggugggcggaggggggcugcuggcucugccaacugugaccccagcacccagcucagggaauuauggccagagacaaagcagcuuagagccugaccccugcccuggagcagauaggccugggaagggggcugauggacacgcugaugugaugggaccugagagguguucuugucaccaggccaguuuggcccccaucgcccgccugccggcuggggucuaaaaggcuggcuguagccccagcagagaggacagggccugugggaccccaggugcugggagcacagaagccagccaggccaucuggcccggcugagacucaagugauagguccgcaucagugucaggccuccaugccccccauccugggaugggaacagcacaucacaguuugcagagcccugcggcaggggugacucuuauugccauuuugcaaaugggaaaacugagacuuagagucucucugacucacauaagcaggacaggagacagucgaaccaggucccccagcugcaauuuaccacaucucaaacccuuuuccucucucugucauugauuaaucuuugcuucaauguccacauaguucugugauuugcuuuggguacauaguagcaauaauuauagcaacaauuucuagcaguuucuuggugccagacacuucugucuuuguugccucguugaaucuucaccaucaaccuugaauaugaaacccauuuuagagauuaggaaacugaggcucagagacuguuuauaacuuacugagaaucaggcagccccacugaggugcuuuaccagucuccccuuuaccagugguucucaaaccuuggcacaccacaggaaaaccugucagaaugcagauucuaggccccagcaauucugguccuguccgucugggcagagccuuggcaagcuucgucuuuaggagagaagcccaggugacuggggguggggcuuuccggagccuguguugcaagaaggaaggcagggagcaugugaucuucucucggucucccucaccuugacccugucccaaggccagcugcuggccucaggcugccugguugccuuugaagguccauggggauccgauggaggguuggucgugcugaagccaggcugggugucauccuggcucugagcacaguccagccuggcuagagucaaacccagcagcuugaccggauccugcugaccacagacaaauccacaacuaccccguccaccucccccaggcccaucugccucugugccagccaggcuggcagacacuccaucgggcgggccccaccuggcuuggccagggagaaacuggcagccacagccccuggccuccccgaucccugucccuugugcacugcccaugggaggggcaguggccuuccacgcugggucuggcuccugcaguagcagagcugggugcagacacggguuggaggccggggccaugggggcauucguaggcucaugagucccuucucacucucuucuggggacuggguuucugcuggaagagaaagggaccagccuuaaaagacaucgugauuaaaauggaauuauuauuucagccuggaaaaggaaugauguacugaucugugucacaacauggaugaaccuugaaaacauucugcgaaguggaagaagccaggcagaccccaaaggccacgugcugcuguaugauucuauuuaugcaaaauauccagaguaggcaaaauccauagaaacaggaaguagaucagugauuuccgggggcuggggagaggaggggauagggaauggcugccgacggaugugggguuucuuuuugggguggugggaauguucugaguuucuuuuuggggcggugggaauguucuggcauuagacuguggugaugguucuagaauucugugaaucuguuaaaauccaaucaaguguacauuuaaaaguggugaauuucauguuauguauauuguaccucaacuuuagaaaugcuaaaauagaaacaacaaaaucaucaugaugcaacgccuuuccucauagaccuggagcgaggccugagagagaagccauauaaggcagaugaggggugggauggagagcuuccuuucauucgcugccugcccagugagggucugcuuccucuggcacuuacuuaacaaacccgagagucacccaugugugaggcaugggcugggcacagaaggguccacgcccaccccugaaagugcucguccaugcuagaaagacagaaggaugggguggucauugaaccuaagucagaccguggcuucccagcucaugcagaauaaaaugcucaggccucucccggccugcugggugcaggaccccggcccagcccaccucucugagcucugagcucauguccugccccaucccucucacacgcacacuggccuccuugcuggccugcaacagaucaaacucacccuaccucagggccuuugcucgugcuggucaccugauaucugugaggcucccucucucacauccuucaggucucugcucaaaugcgucucccccaggaagucuucccuggccuccccagcuaaaacagccccucccaccccucccaugccauuuaccauacuauaguuuucaucuuagcccuuauaucucccuccaagagcuauuuauugacaugaaaauuugcuuauuggcugucucucccauucgagagugggcuuucucuggggagugugcacugcugaauuuccaguguaugcaacagugcugaggagaggguaggugcucaguuaaugcuuuuuaauuaaauuuucuauugugguagaauauacaugacauagaauuuaccaucugaaccauuuuuaaauguacaaucaaugucauuaaguauauucacguugcugugcaccugucaccaccauccauuucugggacuuucucaucaucccagacagagacucuguaccuguuaaacaagaacucgccauucauuaauauucuuuugaaugacuaauugaaugacuaaguguauuuccugugugucggucacaagcuaggugaugagccaguaaaccuggcgccucggaggguguguguucccguaucugucucggagauggacagaucgacucagagaggugugaagggcuuugcccaaggucacacagcuggucagggugggauucaaacgcaggucuuucccccuuuccacacaguggcaguucugggggaucacugcaugcaaagggcauagccauggcaccuccaggccuccagccccacccagggcuuccccugcugccgcucccccaagggucacugugucggccacauguuccugguguccucggcucuggcaggcugaccaccagucacaggcacgucuugggaccacacuuggagguuucagcuucccauuucaccuggugcucuugggguggaggccgggaucauggaauccuuuuuccauggccuuuaacacaaaucaauacugugcccaguuuaaauguuuauguaacucaucaucugccggcucugcuauuacggugugcuuuucuuuuuauaaaccaagcucaggggaggugauauuaaguccaggacuugccuggcgaggcccagcgcgugugcagaggauucaauguggcaauaagggcgaguucccugcacagcgccugccauggcucgucccagccuccucccucaucugcuuguguccucuacacgguagggaggagggagagguccagagaggggagguggcuugcccagggucacagccacaaugagguggaacagggauuguuuccaaggugugugugggggugggacccaggcuccugccagaggccagggcggcagagcccugacaggcagauccuggguuccuggguguccagguuacgugggugggcagguggcagcuggcacccaccccauacagacacucucugacaccccccaaaaauacucccaccagccccuucacauuuuccuccagccaagugaccaaagcacagcucagggcccauuugcccuggccacacuguccccacucuccccacccaaccucugaccacaggccugggagcugccccaucuccaccaaguucaggcugcaggaggaaacgucucaccaggcccgcuggaaggugggguggugaugaaauguggggguucuucagcgagaguggaauucaguaauaaggugaucaucacugccgggcggugccuggacucaugaugagccaggacuaggugagugcagagggcuggugagcaggccugaucugugaccccgguggcccugcggcucucagaccccucacauaaaaucccaucagggauauuccguucccuggcccggaaugaggucuucgucuuucugaucgcccuuggagagcccaacggccuuccgucacucacucagugcugauguccagucccggcaacagucugacuccgcccagacuuggcgcuuccccucccaugcgcccgccgcccggcgugcucccugcuggagggugacauggggaggggccuggcugcagcccuuuucaggcagcucuuguuggcugggaagggagccuggggaugggccgccuucuaccugccgguggcugugcccacucugagugugcuuggugggugauuacagcugcucacagcugucaggaguccuucacagggcagucuggaaguuuccuguagagcugucuccugcagaguccuuaccuagggagaccccgcuguauguccuguggccaguagcauccuguggcuuugcucaaucccccaggcacagugugugcacccccagccucccucugcuguguucuccacgccccucugggcagccggcacucaggaccuaaggugguccuaagcagcucuccccuguccccuggaaguacguggagguaaaagcugcaucccuggcagaaucagaccccaaacuccagacccuuuugcugugagucucaggcuagggucucccaccugcaggaaucauuuugggccuuuugagggucucuuucauagacguggguggggcgucugcucagcaccugcuuucuccuucaccaacuccucagccucccaucucugaccccauaaacgcugagaggagaaccaggccuggggggcaaguucaaggacucaggaggcagaccgcuggaauccaaucucuccccugcccuuacuagcugagcggcuguuggcaaguugucuucucugugcuucaguuucuucaucugugcaaugggggugauaacagcacacaagaacaucuuggaguuguuaagaagauucaguaauagguguaaaaugcuaaagcuggggccuggcucccaggaagugcccagaagguguacugugauaaccacagacgccacgucaccccgcuggaccuggacuccgugaggagggggcuccccaucuccuuaucccagugucagcccgcugcuggguaaauucgcucgccaagcccauaccaggugcuaauggcugcaggagccucuuccucucccugacauuucccuucggcagcaggcggaccccuccuuccucgcccaccuccauccuuagcagcccugauaccucugacaaugcuaauuaaaugcaacaaccucaucagaaggcucgagcugggcuugccuaaggcccccucucugcccugagcccugauggaucauuaauggugucagcagcacuuauggugauggacgaggggagcaagucccccgacgugcuggggaggaaguccgugacgagcaucuucaucuccugucugcaggccucggccagaguuuccagggaacguccuaguccacagaaucguuugaauuucacauuuacccugggagaaccauggccaggcagggaugucaauucccauuguauccaugaggcagucagggcucagagagggcaagagauuugggugagggcacacagcugguaaguaguggggcugggacuggauuaccacggcuuugaugaaagcugcagggggcaucuguaagauccaagggcgaugucucccccagguggcacguggagaagaaagccagcaagugccaccggcuuggggguagcccaguucucgggggcuggagccugcacacucucaucucagcucugugucaguuuccuagggaagcugugacaaagugcuacaaacugcguggcuuaaaacaaccgaaauuuguucucucacaguucuggaggccagaagucugcaaucacgaugcuggcagggcugggcucccucugacggcuccagggaggacucuguuccaggccuccccaccagcuucuagugguggcuggcaauccuuggcauuuccgggcauuuccaggcauugggaggcccggcucggccccccaaagugcugggauuacaggugugagccaccaugcccguccugcccuucauucuugaugccucccuucagccucugccucugucuccccauggccuccucccuguaucugugugugcugugucuucauauggacuucuuaucaggauaccaguccuuagaucuagggcccaccauaauccaguaugaccgcaccuuaacuugaucaucugcaaagacucuauuuccaaauaaguucccauucauagguaccagggguuaggauuuuaacaucuuuuugugggaugcaguucaacccacgauaccaucuuugcccaucucuggcucuggcgugcagggaccuguuacugggcgggucacuagggauaccaccucucaccucucugggcacccauugguaggccugugcugugcccagcaccagggggcuggcugaggccuccuuguucaguggcuccugugugccucuccacuuggggguugcccuagagcugcccaggaagggaggaggcaccucagggggggaaggacagcaugaguuuccaugggcuucucgucacccacacagagugacuuggaauaaugcacccaguggcugaucuggggcccugagcucgaggcugcagccaguggcagcuccaggcccugcaguguggggacagcgauggccaaaaagagcacaugccaaaggcccugccacuuaggggacuuugggaaaguuugaccaaguuuccuugucucuaaguaaggaaugauaauuggucgaugggauuguucugagaugaaagugcugguccuugggaaagcuucagcugaaaugucuuuuuauuuugcccuucacucuuuuuuuuuuuucuucacuguugucgcccaggcuggagugcaauggugcaaucucggcucauugcaaccuccaccaccucucagguucaagcaauucuccugccucagccucccagauagcugggauuacaggcgcccgccaccaugcccggauaauuuuuuuguauuuuuaguagagacaggguuucaucauguuggcuaggcuggucucgaucuccugagcucaggugauccacccggcuuggacucccaaagugcugggauuacaggugugagccacugugcccggccugcccuucauucuugacgaauauuucgacugaauucagaauucuggguuuccagguuuuaacauuuucuuucggcacauuaaaagagucuucugggugccauuauuucugcugacaagucagcagucucugaguccuggugucucugaauguaauauguuguuuuuauucuagcugcuuuaacauuuucucauuauuucaguuuccaguaguuugcaguuugaccaggauguaccuggguauaauuuuccuugugcuuauccugcuuggaguuagcuaagcuucuuaaauuuguaaauugaugucuuuuaccaaauugaggaauuuuucggucauuauuuuuuuauguguucuuuuuaguauaucuucucucuccccucccucuacaacuccaaucacauguguguugaaccuuuugauaugcaacaggucuuugaggaucuuuuucuuuuuaaaaaaauuuuuuuucucucuauucuucagacuggguaauuucuauugaaaucaucuucaaguucacuaacucuucuauuuucucagacuuucuguuaagcaauuucuguuaaggugugauuuuuuuucugucucagacaugguauuuuuaaguuauagaauuuucauuuaguucuuuuuuaaauuguuuauauuucucugcugagauuuauucuuucaugaaguaugagccaauuuucuuuacgucuuuuaacacaguuaucauagcaaguuuaaaaaucucuauuugcuaauugcagcggccagcacauuucaggugaguuuccacugacugucuuuuauauuaaguauggcugguuuuccuauuucuuuguauaucuucauauaauuuuggaugauauccuggguguugugaaugauagcauaagagcgacucuagauuuuuguuacuucuccccaaagagcauuuuuguuuugcuuuguauuugcaagcaguuaacuuggcugaaagcaacuguaaaccaucugcagucgugaguggugggcaguggcaggagccucuguucacuucuucuagcccuggcuggguugcagcugcuggaagucuguccugugugugugugguuuggggucagcccaagacaugggcagaguuuauuugcccccucuggggaucugucuugguggcucucuucauuccagaauuuacucccacauuuuuccagcugcugcgagugucucagacucuguuugcugcucuaucaagccagugagacucuggcuuuccgucugaguucuggcagcccuaugacacaggcugggacuuguccucaggcugugaaagccaugagaccaggaaagccaacgccggcuguuccucccaauugcugaccgccugcagcaucugcugcggccucacccuccgaugccuucagagugucauuuuguuguuguuuuuucaaggguuuauagucuauaguuaucugugagagaguugcugcacuaggagcuacuaggcuauuaccggaagcauuuagagcagggccuggcagacaguaaucacuuaagaaaugugaguuaauguggucaaccauagugcggcgcuguuuccucuggucaaggcuagagacaacguggacacagacagcaccaugcaggaagugucaguaccuagugaagagcacacaauggccuuaagacugcacuuguaggccgggcgcgguggcucacaccuguaaucccagcacuuugggaggucgaggugggcagaucacuugaggucaggaguuuaccaaccugaccaauauggugaaaccccaucucuacuaaaaauacaaaaauuagcugggugugguggcaggugccuguaaucccaacuacucgggaggcugaggcacgagaaucacuugaaccuaggagguacagguugcagugggccaagauugcaccgcugcacuccauccugggugacaaagugagacucugucucaaaaaaauaaauaaauaaaauaaaagccugcaguuguaggagagaccacuuaacugggggagggggaaaggggacuauccaggaaggcuuccuggaggaggugguauuggagcuggaaaugucagauaauccaagaugagaagauggacuuucuucacagagguggcugccaaaacaaccaauuuuauggccuuacugaugagaauuucuggcacucaagagaggcaacuuuuccuaaggcaaauccugaagacauuuaccuauaaaaaugaguagacauuaaacauccacuagcuccuucaugggccagaggaagcagugcucaggcaagaggggaucugaggucugguggugguucuguagauguuugcagggagcgacuggcgggacugguaggcgggaccauccacagugagguugggcgcccagauccaucgccacauugcagagcuuguggcugucaauucuguggcagccaggagcacaggugaccgggagcuuuaguuucuguccaguacauuuuggugauucauuauuccuggaguccucgucuucucuuccucccucccagacccucucaccuccuugucucacuugaaccucuaauccugggaaggcuccaccauaagcacacuacagauaaugaaaccaaggcucagagaaguuguguggcuuacccaagaccacacagcugaagcacuggagccaagacuccaaccagcacuucugucugcaaagagcucauggcguagucucucauggagggagccuccaucuccucugcugccaaauggaaaucacaguagugucucccgcaggggcuggcgugagguuaaaggagguagcagauaugaaaaugacauauaaauuguaaauugcccacagacauuaguguguguugccugguaaccacccagcauuuguggacugcauuuacuugggauagcaauaguuauauuggcauuuuaauuuaauagcauuguuauguucccaucauaaaaauaauauacacuguguguaugcccacccucaucaaauuauauacauuaaguaugugcagcguuuuauauauugauuguaccucaauacagcuauuaaaaaaugauguaacuucauuauagaaaaucuagaaaauauggacaaguugaaagaggaggaaauauuauuuuguuccagcuacccuaaagcuaccuccguucacauuuuggagaauucucuuccagcuuuuuuccccacugcccaguuucuuugcuuauuucacauggcuauaaucacugauguagaucauuacaagcauuuuauacccaauuuuauaucccguuccuucacccucaggggguuuuaauaugaaauagcaagaaccagcgccccaucggggacccuagcacagcugggcugggugguucuggcuucugcccagaugugucugggugucccugggccagggcaggcugccccacggagggacaaugucaggacagcugggaccugacccuguucugacuccaugcccggugggcguuuccguguucccacagagcugcuuuucuuaucuugucuuuuuaaguucagugacaugugcaucugucuugauggauggauggauacguccagcccgucaucccacuucuaaccacccucucucaaucuuuucuguugccucaaagcuggcauugacucauggcucagaaggccagggcaggccaggagcuguccuaaaaggcccagacuggaaaaagaaaaggcauuucuuggauagauaucucuggccuggcuacugcauacaggcaccauuugaagccgugaauuaagccugaggcuccugcccucaugaaguuuacguucuggccaggaagagagccuacagaugauaaaagccuuuacagaaagaaaaacaucagauuagguuggggcagggauggucaggguguccuguaugagggugcuggggugcagacagcaguuucagcaaggugauccaagcugugcucacgggaaggcagcaguggggcagaauuggaagaauaggaaggagccaugcugguacccagggaaagccacugcaggccgagagagcaggucuugggacagcagguggccaggacuuuugggaaagggcaaggagccugguguuuggaggggaauaagcagguggagagcaguagaugaggcuggggaaggggaggagguaccuuuugcugaguuaaaaacacgagaccccgugcauacaacaguaaauguuuucaucaucuugcaucugcgauucuguggucugggcuuggcugggcuugcccugcucugugggucaguggggcccugcuggaggcugggcuuggccggggguuggggggguucuucugcacccacucuuccuccucccccucaggggccagugggccagccugcgcagguccugcuccugguaccgccagaggcguugauggcaacccccaguaccuaagccccuuugcaucucuguuugcggcuugucgaauugccguucugcaggccaaagcaaaacacagggacaagcccagaaucaagguggggggcagagaacaggucaccuggcccaccaugggaggggugaagguuuggcuccagaugcggcccaccugggccucggcaggugggggcugccuuuagaacacucugugcuuuucucugaguacacaaugggagccgcuggaggguuuugagcaggggagugccaggaucaguccuggguguuaccagccucucugcugccagucuguugaggcuacgucauagccagggagaaagagcuguggcagucauccagugagaggugggagaguggcuggcaucccgauaugcugugaaggcugagcaggcaggauuggauguggggugugugugugugugugugugugugugugugugugugugugagagagagagagagagagagagagagagagagagagagagagagagagagagaacgagaaacuccaaggcuugggccugagcaagugaacaauagagcugucaucaccugagacuggggaagcugcagaggaugaggcugaggagggaucagaauucaguuauggugaccaaugaaggguuuugaauagagggacacagggaugcacuggcucaggaguuuggucaucacguuggccgccagagggagaacagaggcugggacagggaacccuguggaguguccucucuguggcuacagggagcaacggucagaucuguggcugguuugaaaguagauccauuuugcuaaaggugguaucacagauuuuggagacuacagaauccaggccaggagagcaaagaacgacagaggucccauucacagcagcgggccaucccgggcuccuacuagcuuuugcugcuugggccuauggggaugguauucuagaacuuuccaucuuccaagacauacuggaaauguggauuuuuauaggaaaucuucuacuuuucaaauauuaagaaugacuucaaauuaaaaguaauaaucauuuuggggcugcaguaaaacuuguugguggagcaggccucaggcuucagguuggugagcuguccuccaguggggguuucucuuccaggcuagggccuuguccuccccugcucucccccacucccagggcuggccacccagaaugugcaggccacucaucucugugacucguagaaccugagaauguuggugauggaagggguguuccccuaguucccacaugcaaaaaguggggccuggagauggggcugucuuuuuucuccaaacacuugcccauccaggaaggccagcccugggcauugaagacuccagguaugggggugacuccauaaggagagguuccugagugaccugaagaaacaugguugggaugaagugcagggagggucagggcaggcagggcugagcuucgcuucugcgagcagagauuagagagcgaucccagaggccugccuggagguggggccacagagcaggagucugaaggagaggggguaauucaccucuguccuacugugugggaagcccugagugggccccuagcagaggguugccuugcgcuuaucuauggagauauugggaagggcuucccugacccagguugcuggagcaugggggccuggguggcagggguaggugugggagauucaagacaggaggaugaggccacauccagguggcuucagauaccaccgugagucccauagaguguccaguuacuauaaagucugccagccacuguggucgccccaggccugugccaagucccgagaucucugcccugcagccagugcagagggaagaggagggcaggaggggacagguugguggccccucgccgaugcuccugaccccucaggcucccugcugccuccugcccagggcuguggggccucggggagcggggagcucgccauugcuguggcacuguugagcacccgggagaggcggguucugacagccaccccuucccgucuugcuguuccccucccagcugacaucaucucuaccguugaguucaaccacacgggagagcugcuggccacaggugacaagggcggccgggucgucaucuuccagcgggaaccagaggugcgaagcccugggucuggugggaggugggagggguggggagcagagucaggugggaggcgggcauggugggaggggauaaggauaagggggauaaggggugaugcggugagaggugggaggggacuauacuccaacccacaagagggcuuuuaacugacaggagguguggggugucuugccuggaucacaucucccaggggcauggauuccaggggugggaaugggaugcuuuggaaugccgaggugggaguggcgggcggugguagggggagugcacugggugggcuggcaaagccagguucugagcccccugcccucagccgauguuugcggagagcugccugcaucccaugcucuguccuagacccuggaugaauggucaggauguggcacaggcagcugcugccccagcuugugccuucagugaaaccuuccucugccugggugaccugcguuguccuggccagacuggggagcgggaggacuccacucuugcccagcugucacagcccucagacugagcuaggugguuuuugcucaggccugggcccuuguccucaccccuguccucacccccacccccgggggcuuguuguccagcagaacucuggguaagacagcaguggccuggacaaccugcccaggaccacguuucuggaacacugaaagagccucgggacaaaagcccauuuacugagaacacuugcuaaguauucuggaguugcuucugguuuacucugcacugcucaccuccgagggccagauccacaccccugugacagaugcggaaacucagagaagccacccagcuagugaacagcagaccuggcugcccgacgccaggacaguggccagcaacgucacacaccacccggccucagagagggcgucuccccccgcaaacacggacugugccuggaauuagaugcagaagacauccaggaaaccaaggaggagggaggaggggauggagcaggagaggcaggggaggggaggggaggaggagaagagaagguggagaaggggagguaggagggaggggaggaagccgggggugaagagaggaccugcggaaucaucuuucccccgauucacuccugagcauggcccacgaacugaggauccuugagucugacuuuaucuugguggcucacauaacccuccucacggugacccuguggguguagugcagugcggcuacuccccucauuuuacagaggaggagcccagagugcagaggguuaaaauaguugacaaggggcacauccuagcugccaaucaguuccucaaacacagcacucggccagcaccugugggcuucaccagaugcaccuguggggugucccaccaggcacugcgaagcucagccuucuuuuugccaagcugcagaaagagaucggauugguugaugcgauuuucuucauuuugaauuuuucuccuuuaguguuuucuuccuucuagucccacugaccuuugucauagcgagugcucaugggaagugaagugaauuagaggcaaaaauauuggagaacuucuaagcuuuucaaaagcaagacagggauagaaauauagauacuuaaaaaaauuaccaggaaaucuugaaauuguucuggguugaaugucuccguuucucccugguugggguuucguguugucguaugaguugaacucucuccugggaacguggucccuggcgcacacaguggacucaccaccugacuaugcugggagcuccacggucaagggucuuuauuagaaggagcucugcugccuaaaccaggccaagcacugcugaggaaagccggggacagauuccaauccaggucugacauugccagacauucugucccaauguuaaagucugcucccaaauucauuuauuccucaagucaggccugaguuggacacguggaauccaggagcaagucagggcccaagacacgaggguggccagagccucaagccuuggcgucaggcaggccucggcagaggggugcucgccggagagugaccucacggcucugggaagucacuuccccucugagucucuguuugcuggucugugaaauggggagagucguggugcucaagcagaggaggccuggaggguagaaugcgauggugcggggaggacuuagugggguguccagcuuguagcaggcgcuggggaacauucgcauuagcaaguuagccggcucgggugugaguguuucaugggaccgcacgggagcggggcuugucccuggcacacugcaagucaugggccgguuaagcugcagagaguuucauuugacccucgaauuggaucccuggcacggcucggcacuuggucccacggccggcccugcuggguccccggagguccuagccgucgcccugcaggucacggugcucaggccccuucuccggguuucccugcagaguaaaaaugcgccccacagccagggcgaauacgacguguacagcacuuuccagagccacgagccggaguuugacuaucucaagagccuggagauagaggagaagaucaacaagaucaaguggcucccacagcagaacgccgcccacucacuccuguccaccaacggugaggcgcugcccggccucgcuugcaugggcacaggccguagauguuucuaccaaaugcugguuuguauuucacuuauauugugagcauuuuucuaugucuucagaacgccuagaaaauaauauccuuuuugagcagcauauaaaucccaugagugaguaugccagacccccucagacgcucccugugucuggacacagggcugccccccuuuuugagcagcauguaaaucccaugagugaguaugccagacccucucagaagcuccccauggccagacacagggcugcccccugcugugaauagagccauccgagccaucuuuguaggccuuugcuuuggggugagggagugugauggacaaggaugcaggucgcagacacgggggauauuugacacaaagugaaccccuccuccccacgccgaauccagaccccuagacuggggcugucaccgcggccuugcggggcagugggaggagccuugguuuaggaccccggccggccucuuaauccucuugccucagggaggagcauguaccccucaggcaccggaggcucucggccugacgccugcuucccaggcuccacucugagggaguggcuggggcuguccugcuuggcucaccaugggccugggucccccacucacgcccccugcccauccuccuucaccugggcccccugcggacccaggcagccuggggucggguaggacacaccuggauucuuuuuuuucuuuuuuugagagacaagagucuugcucugucacccaggcugggguagaguggcgcgaucucugcucacggcaaccuccgccucccggguucaagcaauuuuucugccucagccucccgaguagcuggaauuacaggcguccaacaccaugcccagcuaauuuuuguauuuuuuaguagagacgggguuucacuacauguuggccagguugaucucgaacuccugaccucgggugauccgccugccucagccucccaaagugcugggauuacaggcaugagccacugugcccagccaggacacaccuggauucugucccugcccugccucccuugggcagugaccuugcuuuccugagccccagcaggguggacacaucucccuucugggguccgugaaauggugcccacucaacccccugagaacaguaaccgcugcacaagcaccagccaggcuucgaggugcuguccccacgccuuccccgaggacguccacgcuccucagcggggccuccaaggcucucccgaacauggcuaggcgcagcuucugccagcccgccugugccugaaggcuauccucgcccuguaccuggccaacucccuccucaucccauaagccuugcugggugcccgccuuuucugaccucuccacugagccaggcaucccuccugugacacccuggcuccucuuaacuccgguucacccccucucugggcaccugcuguucugaugguguucucccgccaugcaccucaaaggcaggaucuguguccccuaaggggcccugcccagcaaaucugucaccugagccagcagagcaugagagauccucccgaagggcaggcccugggggacaggagccucguccuguccccaugcaccugcuccuuuugaaaauauuuaagaaggacgugucagccacaugcgguggcucaugccuguaaucucagcacuuugggaggcugagauggauggauuacuugagcccagaaguuugagaccagccugggcaacguggugagacucuaucucuacaaaaaaauaaaauauuagccaggugugguggugagagccuguagucccagcuacucaggaggcugagauugaaggaucaucugagaccgguaaagucaaggcuguagugagcugagauggugccacugcacuccagccugggugaugugagugagacccugucucaaaagaaaaaaaaaaaaagacaugucacuuucuuccugccucucuacagaaaaggucaucuuucagcacucccuacacuccgcuccccucaaagcuucccaccuggguuugaauccuggcuucacucuuuccuaauggcagggccuuggguaccuuucagaugcuccacugaccccaguucucaguucucuucccaguuccuucucaucaacauggugcuauuuguuuugacuccuguaguagucaggguucuccagagaaaaagaaucaguaggguaugagagugagaaagagaaagggggauuuauuuuaaggaaguggcucaccugacugcggaggcuggccguuccgaaaucugcagggaggccgaaggcuggaggccucgagacagagcugcaguucugguccaaagccgucuguuggcagaacccccuccuuccccaggaggugccucaugauuucaccuucuaaaguggaucuucucuuccauccggcugcuuaauuaugugacucgcuuuauuuuguucuguuuuuaaagauaaaacuaucaaauuauggaagauuaccgaacgagauaaaaggcccgaaggauacaaccugaaggaugaagaggggaaacuuaaggaccuguccacggugacgucacugcaggugagcuccggugagggggaagcaggcacacgccucuuuauuacaccugaggauuuuagggcuggaaaagccuuugagauuugagccagagucaggugcagacccugguugggcugcuggcugcugggcggccacgggcgucuuccugccccuugccucaguuuccucaccagcagcauacagaugaccacguuucuucuaggcuucuugugagcaugcaggggugguguauggcuguaaagugcuuuucaccuauagcugaggguggagagcaaggcagauaaucccuuguuauaagaagggggaaacugaggcccagagagagacagcaacucaccuaaaacugcucagcugagugaguaggcagaggcagaaagagaaugggucagcagagcuuuguggcuccugaguccuuuacugagggcagaaggaagccuggaccgugugaggccuucagcaucuacaaaggccugaaacagacauacccugaaacagacacacacgugcccagcauccagugagccgccauaaauauaaagcaguagucagugcucuuccugagaagaagaaauaaauguuuaaauacauuggccuaaaugacuggcaaauugcacaaauaaauucugaggaagugggcagccgauuagcuucgauguugaguaaugagggugcuggugcccccugccccaccccccgucccaagaaaguuuaugaggguuucaucuagagggaaggauacagcgaucacaucuugaucacccugguguuuggggcagagccaguggccuucauaaaaauccuguuuaugucccucccagcguuggagauuuuucucuguaagucacacacaucccaagacacuuaacugucacugagaaccugggugcccuggucuguccucauccugccucucaccuuguuugcuuccgauuucacccacgccacgccaacccugcacagcauucuacccacccugcgcaguucacacuggaggcagcuguuuacugaggagcugcuccacgcuaggccccgggcuagcccuuggggcccuagaggugagcaagguucaacucaguaccuguccccaaaguguccccagcccccaaggaaacagacauggaaucgccaucacacuggcgcucagugcggugacagaggaacacagagaggccgugggcaccccaggaggccuuucucuacuuugucaauuuggugaacucccauacaucccauaaaacccuacuggccuucaccucuguaaagccuuucugcgcaggccagaugacaauugugaucuuuccuguguccccucuugccuuuuggauccgacacugucuguccuuagugucuguaucuuccuugccccucaucuugacuagacuguggcuucugcggaggcagcauguuuuacucaugaaacccccaaaccuucagggaagguuuccuuucucucuucuucucuuuacuaaaaaacugguuuugagcucugguuugguggauggcagcaaauggcuggagcacuggaugaacugggucccaaggccgccuggagaaaacagaaagcaauguugccggaaggaagcaggagguggacugagaugccaagacuuugcugggccagugaugcucugcccuucuccagagcagcugggcucccucucucuccugagaguccagggauccccagggugggcaguggcugcaccccgaaggaagggaagguuagcagcauagcuaaaauaucugacacaggaauacgugcagggaggaugccuuggaggagucacacuaacaccaacucccaggcacacaaccuagaagcaaagacacagaggcaacaaugcaagaaccacccagagccaggcugucacucacaccggugcugcgugcacacacacacacacacacacacacacaugcaugcacauacacguauacucagucaugcaugcacacucacaugcacacucauaugcacacacucauacaugaacucucagccaugcacacucccacacacacaggcugggugcccuggugugugggaaaauuuaacgugggcugcagagcugccucugcuccaaaggagcucagugcuugucacuccgacugcagcaccgaggcugucaccucccaucucagcuguucccugagagcucagggacacagcccauucauucauucucucacacauucacucauucacuggagagucucucugcuaggccuuggacugagcgcuagagagauggagagauaaacaagaggugacgccuugcucccguagcugaucccuaguccacugggaaagcugaugggaccaguugacagccucaggguuggucagggcugugcaagggaccuucagggcugugaaagcucagugucugaugccauggcaaggacuccucgcaccaacugucugagaugaaaguucguaugagucaggcuaacuccaccgcuguaacaaaacaacaccagcaguccagggccgagcacggaaaugcauuucucacuaugggaagguucgauguggaugugcugguugggacacagcucuccugcaggauccuuccauccccaucccaugagucucagucccuaaggcuuggguccucaccuuccagguggggaaggugcucccgcugcuuagcugcaucagggccagguaucacuuugcucacaucccauuggucagaacuagucauguggccaugucugggcacaaaggcugcugggaaauguaguccacauguagacagcuguuucccagugacagcacugcauugcaggaggaggugaggaggccuggcagacaauuggcuggcucugccacaguaucuuuuuguuucauuuuagaguugaggaaauugggguauaggaggguucagccacuuauucacagacccacagcagguaagcauccaugccucucuugcagggcuggugggcggcgggcauuugccaucugucacugccuauuucagaccacggaggaucaggauggacgcccaccccuguguuccagccuccgguugggaucacaugcucacggcaugcuauguccugaugccaccaccuggccuucaccucuucccugccuccucauccucugcaggugccagugcugaagcccauggaucugaugguggaggugagcccucggaggaucuuugccaauggccacaccuaccacaucaacuccaucuccgucaacagugacugcgagaccuacaugucggcggaugaccugcgcaucaaccucuggcaccuggccaucaccgacaggagcuucaguauccuucacuguggccuggccagugccucccacgggcagaguagcuuccguugggugguggguuugguuugauuggcagacagcugguuuggggauggcugcauuguuuaacuucuucagugaggcaccucuggcuccuaguaugcgugugaggcccagauacaaaaucaugucacgucuguuucugaaaaccgcaaagucgugguugcugagcauugcacccaucgccuccuccagcauggccaugauccccucauccuagggccucacaaggggccaggaaggagacagaguucaggguucagcugcucuggacgagggacugcuggccuugcucagcguccacugaaggcgccucggggcccuccccacugggacccaaggcaggcuguguuagcauaggaggaccagcacuggggccccggccagggcuucgggugacaaccagggugucagaagcccagcuggguugggguccugagggcccccugcucgguguucuccugugucagggcaagcuaggggaagcagcagcauugacgauucccgccgacugcugggaagagagcuggugaugacaugagcaccagccugcaggcagggcgaggcuuggccugccggggggcuggugggcgggcaggcagguugcugugaugucacuauucugcauacaaccaaugauaauaauaauuauaauaacacacagugagacucugugugccaggcucugugacuaacaucaacaagcauucauuuuaacucauuucaccuucacaacaacccuaugagguagguacuauucuaagucuccuuuacagaugaggaaacugagucacagagcacucaaguuaacuugcucaaagcucacagccagcaagugucaaagcugggccugaaacccaggcccucaggccccagaguccccgcuucuaaccuccauaccacacugcccuuuguggaggaugccacccaggugugucuuggaaggggugggaagacccuccugagagccuccaugcaacuggauggccucccgacuccaggcagccugggcacccagcaguggucaggagugggcugugucccucggagcaguagaagccgggauagcuguggggagcaggggaggcagggagcauuccaggaagggugaaagagaguaacaaauggcuuuuguggucugagauccaggcacagccagagaccccugggcagggagacccuuggaaaacagcgggaagggaacagagcaaagcguuggauguccccugagccagccagagggugcggggcacaugugugggcuucggaggcagaaagucuguuugggucugacugccaccuucaagcuuugugacccugggugaguacacucaccucccucuccgagacuccgucuuuucaaucaugccuccucauagaccuguggggugccgucagugagccccuaugugugaugugccgaacccuaagucagcacuugguggguaucaggaagcaucagcaucucucucccuucucuugucccaaaggcauggagugcccagagcugggaggcuggauugggccagccaggaagguuccaggaaggauugggaccugagcugcuuugaaggcuugaagcucagauuucucuggacauagagggcugggcuggacaucugucugacccuccacugaagccgaaaggacaucgggccccaccaguccacagugcucauagcagcaguugguuagacucuuucugcugcacgagcauguuugauguggauaacuguaagagagcugcgggccagguggcuucaggggcuggagcaucgugggugauggcucucugggcugauugccucugcugucuucuguguuucaaucucaggugccaguaguuggggccccacccucccagaauaaaguccaggagaaacgagaccaguucucucugaacugucccacuaggacccuaaauggcaucuugugggcucuaauugggggugaaugccuuguugugauuggccaggccggacuccuguaccucucccuggugcuggagggagucagcuccgcccccaaccccuggaugugggggaggggcggucuccuagcaggagcuccaggucugcaaauggggaggguguggggcucacugagcggccuggaccguaccguacaguuuacaaaucagccugccguucguugucucacuuggugcucagagacagugguaauuugaugaucaccccauuucacagaugaggaaacggaggcugggggagaugagggacuggcccagaguccccaguuggcaggggcagagccagagcucaugcucgggccuccaugccugguccagggcuuuugcccuggccucggccugcccccugcagcccugggacaguggcagccacccuucucgagcaccugcuuccuuccugccggacuuggguggggaugguaauugcugcucgguuuuccugucugggcugcugugaggauuccgugacacuauggaugccgaaacccuuucuaaagaaccauaaagcccuagaguauggaagggaugcugcuucauuucauuuauucaaccauucauuccccacgccuuucuacucccaggcccacacugagcccuagggacauggggaugaaugggagaaacucaacccuucccuggagggcucaggggcugcugggggacacagccccgccauggcaguggaagugagggagucauccuugcuguagcccagggucuggacaagcugcugugggggccgccaaggaagccagagaaggaauuucgguaggaagcucccugggcucgaggaggcugccugagggcaugggugugcaggaggcggaugcaugaggaggcagaaggugccggagcuguggcacuguggauggugcaggcagggggcuuucucuugggguaggggccccgaaugccagucauucacaaaaccccccacagcugugccugccuccacaugccacgugugcuucccuuuacuuuucccauuuaaaaaaaauuguuuucuuuaagucaaguugcuuuauuuuugccgaaguaauuuucuuuugaaagggaauugaauuucaccaugauaaguuaaaguaucacauaccauaaauaggagguagccucaaccauaacggcugugcacacaaaauggugggaauaaaauacaggcucagcccugucuguuggaacuuucugugguaguagacugcuucgucugcacucauggggcggcagccaccagccccaugugccugcugagugccuaaaacguggcuuggugacugaggagcgacaucguuaauuugauuuaguuccaguuaaucauacuucaaacgaaauagccacauguggccaguggcuacugaacaaggacgcugcagccucucuccagguugcccuuagacccugaagcugguucucucugaaaagauggagguaaacaugugcuucaauguuaagggggagagugcaaaacagagacaucccccuucauucaucagaaggauugaauccugucuccccgucugcaucuauauuacauuacuggaggcugugccgacuucccaccugccugcuuccagggaacgggaaacuaugaagcuauugauguacuguaaacaggggcgugucacuagccagcuuuggagguguguaugucgugggugugugucguggguggauuggauuccagcagacaaggcuggcggcuugggaaccagcaaggagacccggggagagagagugagaggcagggccagagcguggccacgggugggaggcgguggaggaaugagauuguaaggauggaggugucauagauuuggauuguaucauaaccaguuuuggaucgggguggccacaagacauucagacagguuggcuguaaagaagaaaaggggguugguucaucccaggacugcaaaguccucccuggccguuaccgugagccuugccuccugucccgucccgaacacacagauugugcccuguccgcauguugcagagcacaccauuuaccagcagguauuuauuaagcaccuacugugugccagcccucuugggugaugcuggaacuagauaaagauucugccuccaggaguggacacgugauaaaccauugguaaaauacccggcauuggagcaggugguccgugggugcuacagggagucgguggcccagccagcgcagccguguacauuucucuccagccacgccugcugcuggcugcaggccucaggucgguggaggguaagccaggggugugguuuuugccaagugaggauguagacacggagcugauggugugugcaagagagugaaaauaaugauuauugaccaaagaaucugagccaggugagggacagugacaagggaggagugucagcagaucgggggccccuguggauccugggaacaucccuggccgcacacccugccguguaacucagugucagaucucuguguaacuucccauucugugaaaaugauuauuaauucaucaaaacauaaagcacccuggccuuagugauagaggagugugugucuauagcaugaacaagauucugagcugggcuugaggcagcccugauagggcaacuuaggcauuuggcaggaguugaguggagucuccaggggcacaugguggccauggaaaccuccccgauuggaucuauucauuggggaaccucagugcaccuggugcuccccauggccuguugccgcuuggcuccccauggggugcugcugcagugacaagacacagauccagggcucacaccacagagagaagccuuacuuggcagagaaagugugaggacugugggcugcaggugcugcgaugaggacugauagcagccgaguaaugagaggaggcguuucauuucugacaugggaggaggccagaaaggcagcugagaccccaugcggagcugggaauugcucugaauguuugagauaccuucuaagcaagucucagugggguggauucuggcugucagagggugacaguucugaugaguccugacaagaaaaacccagggucaggaggccuguguccgcgcagagccaggggaaggcuugggcuggacuugggguuugcauccuucugaccccugcucucugggguccucacucggcccgaugacacuguucaguccuccgugcccacuggagguuuuccaccaugucgcaucuccuaaguccaaucacuaacacuucccgucucagcaaaauggacuuuuaguaaccauaucaagagaaaggaaaauguuucuuaguaaaggagaaaaagagggcauugcuuugacuauuggacaaugagaaaggugacucagaggacaucucugcuggagggagggagccuggugauacugaggcucugugaccugucucgguguagucaccaagguucaaggaagaggagcccucccagccuccucccucucucucacccucagaauggaaagaggugcccagcccucucuacucuccccagacacuugccugaaucccgcccuguccugcccagagccuucugcacagcugugaaauuggcucaucggaaccucuggucugaccaugucagccccccuuaaaacucucacggguuccccucuggcuucuggaggaagccugagccccuccacagugcccugugccuuuggugaccagccccugcccaccucucgggucacacuggcucacuccuucagcugcugggucccuggcauggggcagggugggguggagcacugccauccgccaucccuucuccugaccaugccaucugccucuuuggccuggcugacuccuguuugcccacuugcagcaucucacagcccauuaucugggacagccucugaccugucccugccacaccccuccuaggcuggucagagccccucuaagccugcggcuccuuggcugcccccggucacacugaguguuuuguuacugugacagccuccuccauuuuaugguggaagcccugagauuaggaacccagggugaggccucucugcauccccugcuccacauaggacuuggcgauaggagguacuuaugaacgguuguagguggagugggcuggaaguucaccacuuccauguggucuuaggauacagacaccuccuuuuugaucugggcgccuggggaaucagagaccccagacccuaaagugcaggagaaggagcccgggcuuugggcccuggcgggccugggcugagacccauugcucagccugcugggccaucagcuucccugaauauaaaaucagaaaauucccuuuuauaaggauauuuguaaggaauaaagaaaucuuucacauaaagagccuggugccuaauuggagcccagcaagaggaugguuuauuuugucucuuaaacaacagcccuucaaacauuuaagauugguucucauaaaaucccugcaucucugaugguuaaaacuccguuuuccacggugcaguuucaacgucuguuuaagcaaccucucgcguccuuuaauaccaacauuuugagacuguuaacacagcacugggugauuuuucuugagucugaugcaucuuaaagguaacaaauugcacaggaggucucagcggauggaccucugcuuuauuuuuagcacccagagaauuuaaaagacgguucgauugauuuuucucucccuuagugauuucucacggugggaacuggcaucacaccaagccucggccuggagaauuucuaauucccauuuacagagcagguccgcacggccaggugggcuggaggggggugcagccauucaccgcaggaggcucagaaccuucaucagcccaugccugccugaagacucagcuugucuucugugcagagaacaaaggagggagcagacacagucccucugcaugcagacucugugcugggccaagggacccugagcccaggcucuaccccugccucugccacugacccugaucagucacucagucuuucugcacccccuuuaucccaugggagugugucuccuuuaccaggagcuguaaagguggaauggccgaugaguauggggccuggugccguguagacaagcaacccucaccagcacaugacccacugucggguaccuuacaggccaccucuucuuccugcccuuggugcuaauuuacagagaaggaaacugggaugcccugcucagaaaugcucuguucacggcaugucagauacauaccacugauggcugggagucuggaccccuggguucuuacuccagcucugccacuaccugcccacgguucugugcauucauugguugauucagcagcauuggccgagagucuucucuguguugagcauuggacuuggugcuagggaagcagacagggucucugccagggccugcgaguacaguuguauggguugucugcugcccaaaagaggugaugauccaagccaagcaccuugggaagaagggacuuuuuuguuuuucaguucugcaaggaagagcugucuuuucauaauuggcacaaaggcacuuucugagugaauggggauccugaugcuauccaggugaacuuucuaggugagcaaaaagauagucuucuucuugcucaagccucgaugaguccugugaucccaucguccaaaugcacccagagcccaccugccugucugcccccagcauguguuuaggccacugucucacucugaucaugauggugaccugacuggccucccuucuuaggucuaggagccagacugccagggcucagaccuuggccccaagacauagggacuccgcggccucgggcagcucacuuggguucucugugccucagcuccucaccuguaaagcgaggaaaagccccugcugacaccauacggcugcuugaggacugggugcuacgaugacaucugggaagccuuuagggcagugccuggcaaaucaccgagcugcagcaucauugcuucauuagcuguguuuccccaggugucuccuuacagucuguucuccuacaacaugagaaaaaaaaaaacgacaagaucaugucacuccuugcucagaacccuucagcaacuucucccaacuggaaguaacuccgccccuuucucuggccuccaaggcccugcaggagcuggcccuggccccucccuggcccacuuccuccucucucccuuugcucccugggcucagcguucccggcccccugcucuucaccauauuuccagccaucuccugcagcagagccauuuugcacuggcuguucccuccgccugugaaguuucuccauccucauccacucaguggacaccuucuuaaagaggccuuccuugaccagucugucggaacuaguccauccccuccaugacucccucgagccccuucccuagaggcuuggccucuaccucguucccuguucauuucccgccucucccuccuggacuggcagcuucuugagagcagggaccuuguuugaucuaccuggaauaaugccugguccagaguagaugcucaaauaauggaacuaguguaauacagugagauggguguuaggauaagguggggaggaccccggccuccuuagaaaguccuugauggaaaggcauugacacugaggcuucuguucuggaccugccacgugguccccuggcaguuugcuucaccuuccuggacaccaguuuccccuucucuuggcuggacugguguccugaaacuggcuuucauuuagacaguugggcuauccuugccgggucucccuugaucuggcuaugugugaccuugugucuugccagcugcuagcaugacacaaggucacacacagcuuguaacagccaggugugcacaucucuucccaaauccauguucauggacaucucuuuggcagcuugaauuuggccauggugguaguauuucuuucuuuuucuuuucuuuuuuuuuuugagauggagacucacugugucgcccaggcugaagugcaguggcucaaucucggcucacugcaaucucugccucccagguucacgccauucuccugccucagccuccugaguagcuggggcuacaggugcccgccaccacgcccggcuaauuuuuuguauuuuuuaguagagacgggguuucaccguguuagccaggauggucucgaucuccugaccucgugauccaccugccuugaccucccaaagugcuggguuuacaggcguuagccaccgcaccuggccuggugguaguauuucuacagauaucuacaaacacuacaaaaucaaucucuccccuccccagaagagaggguauuguucaaguuaccagcacacaacugcucuggggccuucacaaggccaggcaguuggucagucagccuccaacaugacugagggcuuccugcgugccauggcucuguccauggugcugaccccguugugagccauugcgucgaggucagcaucuccaccucccaccccacugucacuacuugcugugucacacgguguucugagcacgcugccgauguuaacugguugaauccucccaacaacacuaugugguaggcguuauuaauaucccccuuuuacagaugaggaaacaaagccacaguaaguuucaguaaucuacccaaagucaaaggggaaagggggugcaggggaaagggggugccagggcugggauucagauuuaagcugucuggaugcagaaccaugcacuuaacugucaugcuacaccgccucucagucaugaugguaacaaccccaguugcagccugccuggugcuggggugaacaaaugcaagaugccgcuguugcauuucagucucaugaccacucgccaggugggggcugucacugucccaacucagcagaaguggagaugggcacugagaggugggcucccuugcccaaggccccucugagccaaguguccuucugauggccugcccagcuuuguugagacagccguauuucuugguucuugcuuuagguccuguggaaagacaggcccaauugcaggauagaugggagguuguuuugcuaugagcauggcugucaguagcuguauggcaguccucacguuugcccugcagguggcaugguagaggugugcgacccuggccugccuccugucccuucuugacagaccucccuggcauuucuagaacucgcucccuguuaaaauccucuugaccccaggccugagccccagaccuuuggccugcuucccucuucaggauggguccugccacucccagccuuaugucaggaccccuccacccucauagcucauacuccaucacccuggagccucucccucccucuuagaacuccucuccuuuuggacagagccuaugcucccucugaguucugcuggcgccgcauccucuccagccuggcucucacccucucugccucccucccucaugcucagccacccagccucucacaccucugagccuugcacucccccucuucaacccccucacccccuccaacacacacacaccccaaacauuuucccacccacuagcucugccgggauaauuccuacucaccaugggcuucggagggcccuucccugacucugcaccaucucagggccucguuauaaaucucugacaugagcaccugugucucucuuaggccaucgaucgaucauggagcuaaaucugcuucccugccaggcugggagccccagcagucagggcggggucuggucugcuccuucucagugcuguggggguacagcugccugggugcacaucccagcucuguccaaccuuggauucccccucucaguucuuggaaaccaaggcaugccauucaccacagacccuccuaguccucccagggggugacaagcacuguaccuuuugcauccugcuuagcuguaugcuuuuuucccagagggagagaaagacucugggaguucuaauuuaacuaaauucaauuuaacuguagccaugugcugggucuuuugacauaugucaucuggugaaauccucauuacagcccugcaaagcagaaguuaucaacccauucuacagauaagaaaagcagagcacagaaaggcugaguuuucaagagaucacacagauguuaggcaguggggcuggacuuucaagcucuggguuuugugauucagaagucaggacuuucuuccuuuuucauagcuugguugauuccuuucuaagcacuuaugaaucaccugaggugggcuauggcagagcugugaagauggacucaccacacagagagcgugcagggcucaguggcuugugcagugagcggugaaauagaacagcaccuuuccuacgguuccagcaagcuggguucugcucccugagaggaauugcauaaucauuaagguguuccgaguggagaaggaaaggaggcuguuacaggcuagauugugucuccuccauccccauucauauguugaaacccuaacucccagaaccucagaaugagacuauauuuggagacagggccuuaaagggguaauuaaguuaaaauaaggcuggcaggguagacccuaauccaaucugacugguguucuuauaagaagaggugauuagaacccacagagagauguuaagaugcaggaauaagaaugugaggacacaaggagaaggcagucaccuucaagccgaggagacgggccucagaaggagccagcccugcuaacaccguguuauuggacuucggaccuccauagcuaugagaaacacauacuguuuaagccacucggucuguagcauuuugcuauggcagccaggaauccuccuguaggaucugacaugccuuggucugagugcuugcagcucauguuuguagucaggucaucuuuuggagauuugcugaaaaagcaguuuuucaagaugaacuccaugugugggaggccuucuagggcaccuccgcauccggcgucccuggugagcucaugcgugaguccuuuuguggcucuuggcagggcugccuccaucccuaacuccgguggcugcuugguugccauggcgacagcuuccuccauccugagagcaggcuccugccgagacaucuggaugagccucacugugcucggugaaaucgguggagcccaaggcugcagcccucuuucucauggaucccugcucugcacccagcaucccccuugcugaggacacaagccaguccagccagccuggcaucaggguccuuggggugcccaccccauggggaaagcugcagaugguguggaaaugcguuuacuccagaacagugggaggaacgcugacuggaaguuagggagccaggauuucaguccuuacucugccagggcucugcauguggcccugggcaaaucacugcccacccugggccucccucuccuccugggugggguuggcacaugggcaguuccugccugcagggguggacuauuugacuggucugugcuaggcauggcucucugggguuauuaccaugucucaaaguucaauuacuugcugugguuuuuagauuagcuugucgugggaucuccacuggggcccaucaugaggugaaccaguauuugcacacugcuuuuggcguuuguggagugcuuugcauacuugcuucucucuugagcuccuugccagaaccaaccagugaugcuucuucauuucacauaccuggcuauauuuccagucagcagagauuugcccuguagaggagcgagcagcccuugguuccugugcccaccuuacaggagaggacgaccggggggcagacuggugcagcuuagcugccauggcuccuggaggugcagccaccuccuccagccucacguggggcugguguggcugagcucgcguggcugggcuccaggagagcaggcugugccucugguagcaggagaugaaggaguuucuuuuuuuuuuuuuuacaggugaaauaaauuuuaaugauaaaauuauuuuaguaauaaaaaucuuaauaauaaaauguauuuaacuaaauauacccgaaauauuaucauuucaacauuggcacuagcuacauuucaagugcuuuuuuuguuauuuaaguucuaggguacaugugcacaaugugcauguuuguuacauagguauacaugugccauguuggugugcugcacccaucaacucgucauuuacauuagguauuucuccuaaugcuaucccuccuccauucccccacuccaugacagguccuggugugugauguuccccgcccuguguccgaguguucucauuguucacuucccaccuaugagugagaacauguggaguuugauuuucuguccuuggaauaguuugcucagaauuaugguuuccagcuucauccaugucccuacaaaggacaugaacucauccuuuuuuauggcugcauaguauucaaugguguauaugugccacauuuucuuaauccagucuaucauugauggacauuuggguugguuccaagucuuugcuauugugaauagcgccgcaauaaacauacaugugcaugugucuuuauaguagcaugauuuauaauccuuuggguauauacccaguaaugggauugcugggucaaaugguauuucuaguucuagauccuugaggaaucaccacacuguuuuccacaaugguugaacuaguuuauagucccaccaacaguguaaaagcguuccuauuucuccacauccucuccagcaccuguuguuuccugacuuuuuaaugaucgccauuguagcugguuugagaugguaucucauugugguuuugauuugcauuucucugaugaccagugaugauagcaucuuuucaugugucuguuggcugcauaaaugucuucuuuugaaaaguaucucuucauauccuuugcccacuuuuugaugguguuguuugauuuuuuuuuuguaaauuuguuuaaguucuuuguagauucuggauauuagcccuuucucagaugaguagauugcaaaaauuuucucccauuccguagguugccuguuugcucugauggccauuuuuuuuuuuuuuuugcugugcagaagcucuuuaguuuaauuagaucccauuugucuauuuuggcuuuuguugccauugcuuuugguguuuuagucaugaaguccuugcccaugccuauguccugaaugguauugucuggauuuuuuucuaugguuuuucugguuuuaggucuaacauuuaagucuuuacuccaucuugaauuaauuuuuguauaagguguaagggagggauccaguuucagcuuucuacauauggcuagcugguuuucccagcaccauuuauuaaauagggaauccuuuccccauuucuuguuuuugucagguuugucaaagaucagaugguuguagauaugugguguuauuucugaggccucuguucuguuccauuggucuauaucucuguuuugguaccaguaccaugcuguuuugguuacuguagcuuuguagcauaguuugaagucagguagcgugaugccuccagcuuuguucuuuugcuuaggauugucuugggaaugcgggcucuuuuuugguuccauaugaauuuuaaaguaguuuuuuccaguucugugaagaaagucauuaguagcuugauggggagaugaaggaguuucuauaaaaaccucugcaugcccgaggacuauacgggaggccuguguggaucacaccuccuguguccucggaagggauggcugcagacuucacucuuggguggaagaaaccccgcuuugcugacucccccaggugcagguucugagcucacagggguggucugaacagcugggggcacccagcaccccuacccccacccaccagggugaggagcuccuuguacuguggaugggggaccgggauaggcccaccugucccuccagggcugcacuugcuccaucugacauugaaccugggccugugugcaguaaagaagggaggcugugugacccaagcaagacugcaucgccuccuguaggccuggggcugugggcggcagggcaaauccacugugcguggggcuuucugugcacauagccauccuuuguuuagcuagcaccucuggcugguuuucuguuacaacagcagaguugaguccuugcaguuucgauagaaauccuacgucuggcuaggccugaaauauugacucucugacucuuugcagaaaacacuugccaacaccugugaauguuggcacuggaaggaaaaggggguccauuucaagacauggggggcugaagccagacaacugccagguccccgggccccuccagggaccugacagccccuccuugcccagcaccucgcugucccugucucaugcccaugacugcagcugugacuuucuccuccugcucccugagccucagaugacacagaguccagagaggcugagacugacccgaggugccacagcagaugaaagggggauuugaggcugggacccagggucccaccugacagccuuucccugcccagcaccucgcugucccugucucaugcccaugacugcagcugugacuuucuccuccugcucccugagccucagaagacacagaguccagagaggcugagacuggcccgaggugccacagcagaugaaagggggauuugaggcugggacccagggucccaccugacagccccucccugcccagcaccucacugucccugucucaugccgguggcugcagcugugacuuucuccuccugcucccugagccucagaugacgcagaguccagagaggcugagaggcuagcccgaggcuccacagcagaugaaagguggauuugaggcuggaacccagggucccuggcagccaggcagaacaggccgcagaccuucucagcagcucaccuacagagcgcccacucugagccugguccuguucucagcgcuucacguggacuaccuuaccccauccucaucugggagcugcagagugcaauugcccuucugaaguuggggaaaccgaggcacagagagguucagaaacuugcccaaagacacauagcuagcaagcggcagagcuggagccacccccagauggucagggggcaaggauugcacucuggagccacggagggcguauggaagacucuggagcccaacugagucccaggccuggucugacccuucucuccuugucccugagcaauuggcuucuccucgccgagccucuguuuccaauguagaaggggcacaccucacucauggaaggcagaggggauuggaugagcuacagaugcgaagcuagucccacccagccagccggccgcacguguuagcugcgacagguacuaggugcuuggcugggguuugggggauauaaacaguagaacaacuuugccuagucaggugaaugacacaagcaggucagccaguauuugcaaccuaaaaagaucucgcucaugggccuuggagcaggugcaguggagaccagaggaagcaguguaggaacaaguucuuccugauggacuucacuggacccgcagcacgugugacgugcuucccagaccacagugcucuuuuuuuuuuuuuuuuuuuuuuuccaggcagagucucacucugucacccaggccggaauacguggcacgaucucagcucacugcaaccucugccucccagguucaagugauucuccugccucagccuccugaguagcugggauuacaggugcccacuaccacgcccagcuaauuuuuuuuguauuuuuaguagagucaggguuucaucauguuggcuaggcuggucucaaacuccugaccucaagugauccuccugccucagccucccaaagugcugggauuacaggcgugaaccaccaugcccggccagcacagcacucuugcguuuguaccgcagcagcaauacuuucaacacgcugcagggggacggcuccuuugaauggccuuugucagugacgauccacuccuaaaaaaccccucacacccuggggccuccuugaccaugccucuuuuuuuuuuuuuuuugugcuuucuguggcuuucuuuuuucuuuuuuuuauuauacuuuaaguuuuaggguacaugugcacauuguacagguuaguuacauauguauacaugugccaugcuggugugcugcacccacuaacucgucaucuagcauuaggucuaucucccaaugcuaucccuccccgggaguugaacaaugagaucacauggacacaggaaggggaauaucacacucuggggacuguugugaccaugccucuuaucucaacuuuaacagcugcuuccccuugagaugguuugcaaccuccugcccccugagcccugaucagaggggaccacaaugggcugauucauucauucagucagcaacuacuuacuaaacaccuacugugugccaggcacugaaggugcagcagcaauccugacaggcaggucccugcccucgcuggggacagauagcaacaaacaggccaauaauguaauaagcagugauuaaugcuugcaaaaagagaaagcagaaaaucuauaauuaaacaagguaaaauaaauguuuauuuugaggggcagaggagauuuacaggagguuacuuuguuaaggagcauugaggcagggaucugaagggcaugagugugagggcccugcagugggaaugugcccaacacgaccuggguugauuggacaccuccuccgugcgcacaaccugcagcuucuucuaaggggcaauggggccuggcuguggggggcugugggcggaggaacccaagcuggauucgcaaucacgcacccgggcucagguaucagcucugcugcucacugacuguggaacccucugagccugucucuggaccuaaggaaagcaaaguggagcaccagcugccuucugcacccuguuaguguguguugggguggggguggggggcaaaugaccgugaacagaguuucuaaauuggaagggcuguucccagggaaagguucagagucgucuccccaucuaauauuugcccacggaucagucaugcagcgaacaugucccaggcaccagcucugggcaggucgugugugaggggugugggggcacggaggugaaucaggagguggagcuggcccuggagccgacugcagggcgggacagauggucacauacacagcacaaugguccugaggaugagcagacggguaaggccuugccuugguguucaggcagagacuaggaaugcuccggcaacuucgaacugcuggauauggcuggcggguauggagggagaagcggccaaggugagacugaggaagagcaggcaggggcagcacgcugggcaaguccgaccuccucgguggggugggagaggccaacacgcagggugguggggagucccgcagcuguuugaggaaguucacucuagcugagcuugggcacggacccccauggggacagagaugcugauggccugggcugaggggcagagcgcaagggguucagauggaggaaccccaggaccugaaggcuggcuggacaagggaagggcuuagaaugaggaagaagcccccugaugccuggcuuggugccccagggcuggggaugaggaaaugggaguucuagagaaggagcggugugggggcuguugguguggggggcugucggugugggggggcugucgguguugggggcugucgguguugggggcugucggugugggggggcugucgguguggggcggcugucgguguugggggcugucgguguugggggcugucggugugggggcgcuguugguguguggggcugucgguguugggggcugucgguguugggggcugucgguguggggggcuguugguguguggggcugucgguguggggggcugucgguguuggggguugucagugugggggggcugucggguguuaggggcuguugcguguugggggcuguugguguggggggucugucggugugaagggcugucaguguggggcugucgguuugggggggcugucgguguggggggcugucacugugggggggcuguugguguguggggcugucgguguggggggcugucggugugggggguuguuggugugggggggcuguuggguguugggggcugucggguguugggggcuguuggugugggggggcugucgguguggagggcugucggugugggggggcugucagugugggggcuguugguuggggggcugucaguguuggggggcugucgguguuggggugcugucaguaugggaaggcuguuggguguugggggcugucgguguggggggacugucgguguuggggggcugucgguggcugcccauagcacuggcauugcgucugcucuuauuucccaacucccaggaagcaccuuggguggguuaguguccuguggcugcuguggcaaauugccauaaccuucauggcuucaaaauacagauauauucucaccguccugggggccacaaguucucaauccagguguuggcagggccgugcucucucugaagguucuaggggaggaggcuuccuugucuccuccagcuccggggcuccagauguuccuguagccaucgcucccaucucugccuuugucuccacauggccuucuccucuggugucuccucuucugucucuuagaaugucacuugucauugcauuuagggcccaccuggguaauccagggugaucucaucucaagaucuuuaacuacaucugcaaagacccuuuucccaaaugagaucacacuccacagucucuggggaucaggauguuauggacacaugcuaugcugauguauuugugggggccauuauucaacccacugcaguggagaaaaauagucugugcucaguugaggcauaugggauugaagagcgauuuuaccuucucuccuuuucauccucucugcauaacuugcuccucucucuggaauuccuaccugugucugacaaacuuuucuugcagggaaaaugacucuuagaugcuagagugugauuggaagggaaacaaaucccaccagacaguuggaguggaauuagaugggaaaacagaagaugaauaauucaagcagcuuugccaggggaaaggggacucuuaaaugagccuaauuaugcuuguucccaagggaggccaguccugaaaugaaccuugugaagcaguuuuucaagcaggauuuaggcggguaucaugaagcugggguggggccaccugcgguuaguccuggaaaggaaagggcccaggcccucauuuugcagauggggaaagcaaggcuugcagaauggaaaugauguuccaguaacagccaagaccagacgcccagccgggggccccgagugacagccaagaccagacgcccagccgggggcccucagcuucugaccuggugcugguccugccuaaguuaaagccaccgaguguggucacugggccaaaugcuucaaagucuacacacgggggagggcaugguguggggcagaaagcuguguucacgguagcugaguuugggcauaauucucgugcuccggaggcuucucccacagcuacuucccuugucaggaguccaucuucagggcccuguguuaugauggauugagggagcaccaacaggggccaccccacuugguaauuaauuccuuuuguaaagggcugggcugcaggcccggguagguccuauggccaccugagccaaggucuuggagaggcggucgcacggaccaggugaccauggacccagcccggugcccacaccgugaagggugcugugcugcccagagguucugggcacggcucugggcccugggauucagaggcucgggacugcuugccuccccacggagaucuuaccguggggacccuguuguggagggccugccgcauuggccgugacagugauuuuucuccuucugcagggugauguggaugcagggccucugugucucacaugguuguuucacagcagccaccguauccgaagacagagagaaagagcaggagagauuccccugugauggcucccccauggguccugacccagguuugggagacuuuaucuccccaaagccaggcccucgaucccuuugccuuuggggacucuguguccccagccuauacauggggugcucgauugaguguccgugccccucagccggcccuggguugccguggcucggguguguuugccacagggcuacagaccuaauggagcccugcauacuuuuauuaauuaauuaauuaauuuauuuauuuauuuuugagauggagucuugcucugucacccagucuggagugcaguggcgcgaucucagcucacugcaaccucugccuccccagucaagcgauucuccugccucagccucccaaguagcugggauuucaggcaugugccaccacgccuggcuaauuuuuuuuuauuuuuuauuuuuaguagagacgggguuuugguauguuggucaggcuggucucgaacuccugagcucaggugaccugcucgccuugaccucccaaagugcugggauuacaggugugagcucuggugccuggccuccuacauacuuugaaaaguucugaaacauccccaggugggaaaggaaagagcguuuggguggacacugaaccugucagggggcucacguuuugcagugguagcaaacaaccugaaggucuccaaggccucaaacacccacuucacaccucccacucacgcugcaaguguggccgucacaggcuggcuuuggugcgaucucauugcggagggaacagugucacagcagaccacgugcuggcucucaaaacuucagccuggaggugacaugccucacuugucuauucauuggcagaagcaaccagccucuggccacucuggguucugaaaggccgaaggagaggucuccccuugggagagaaccuggaauguucagagaacccccugggugucagcauuugacuucaucccaccgaguccuccugcacccacugcgccccaugaguuauaaccccaggaaauacaacgagaaugaguguccugaugacgcaaacagaacuccugugggacucacguuccugggcgcuucuguugccaccaagccuccuguggcuuuugugugucucagggugugcagagagaauguagccccucucugcccugccucucuacugcacauuauccaugggccgucgcacuaaugugcgugacauuucaucaguggccgcacuuuuucucuggaucccacuuuagugaaguucaguaaggaccugagagcugcuccgagcgggcagcguguccuggaaagccaugggaggcauucggccugggagggcugggcugccagguggacgcuggagaaaucagcauggcaggaggagggcucuuuucuugcuuggccuucaguaucauuuuucauuauuuaaucgcugcuucuuuucauacuggaaaacuguaguuuccugggaaaccagccaggcagugaugccuuaacucauuuuucccucucuuucuauuuuuaugugauucucaguuugugguuaaugacgugcuuccgggaagcaagauuugagcacgagcacagagacccuuuuaggugcuuucugacugcacagaucagccauuuuuuucccuggcauuuuauaaacccucggguuuagagaggucagaaaauacugcuugcuugcuuuuuuuuugacagagucuugcccugucaccaggcuggaauauaauggugcgaucucggcuaacugcaacauccaccucccagguucacgugauuccccugccucagccuccugauuagcugggacuacaggcauacgccacuacuaauuuuuuuuuaguagagaugggguuuugcaauguuggucaggcuugucuccaacuaauuucuuuuuguauuuuaguagagacgggguuuuacuguguuggccagaauggucucgaucuccugaccucgugauccgcccgccucggccucccaaagugcugggauuacaaauacugcuuucuuacugagagaggcagcagcuuggguggaggaagagggagggcagauggauuucagaguuucagucaguauuuuccagauagaaaauaauaaaaauggaaacugacauucauugagcucugcaacgcaucaggcagugugugaagggcuuugccucugaugaucuucacagcgaagugauaaggcuauacugcugacucauuuuacagaugaggaagcugaggcauggauagcugggaacucacucagggucacacagccaggaggugacagagcugggauucaaaccccagaccuuccaacuccagggcucacaugcaccugaagagucagagggaacagaccgugcaaagccccaugcagggccggggagaccggagccugaggucauugcugugagaggggagagggccuuucugucagggugaugggugggaucugaagcuggaaagccggagagaagcucgggggugccaguccuugcaugcuccaagagauucugaucugcugcugggcagcagggaagggauaggaaaagagcaggugcuggggccggggagguugugaggcugaauccagccuuaccaaucacaccugggccaccccggacgaguugcucaucuucucugugcucuaguguaacagucagggauacugccuuugcaagcagcaaaguucuugacucuaaacaaaaaauggacauuuauuggcucccacauuuagcagucuggggggaauggcuucaggugcagcuugauccaggauuccaauggcaucaccagaucuuucucugcacucuuuccacugucugccccacccucaagcuccaggguuucuccuuguccuggcagcagauagaagcuccuucuuucuacaccacccagcacagcaggggugaccaagcugcaucccagccuuuucaguauuccaaguccuggggucuggagagcacagaucagagccgagguggggccgacccagaaacccagaagaaccuuugcccaaaggagaaucuccauacuguggucagaagaaggggagcaggugccgggggcaggaaggggagcucccagaugcccacacacucaauuccagacacaauuugaaaagggaccgggaagacuugaaaucauucaccaauagcauccacugcccagcaugcagucggcacaauauaaaugcucuuuuucuucugcuuggcaaccaacaggggaaggaaggcagaggagaggggcuccacaggucagugcuauguguggcuggaacugaugcacccucacugggguggggugcaggugaggggggccgcaggucaggagggaagugguggguccagcuucaugggaacaggggacaggcaccuagaagggguagccagcaggcaguucaccaugcaggucugcagcucagggggacgcauuuugagggucucaggaacagagaggcagcucagacgcgaggguggacgguuuugccucgggagaggugucagaaaccuccgggaaggcggagcauugagggcgcccuucacugccccuuccuugaccgcacugcccccagacaucguggacaucaagccggccaacauggaggaccuuacggaggugaucacagcaucugaguuccauccgcaccacugcaaccucuucgucuacagcagcagcaagggcucccugcggcucugcgacaugcgggcagcugcccugugugacaagcauuccaagcguaagugccggugccuggggguggggggcugugcauugggcaggcgggcgggugggauguccuguccuggugcagcugcugcagggguggugggugugggaugagcauguccuggacuggccaaggugggugggcccauugcugcuucagcgcuggcuggucggggagccuggucuugccaccugcugccccccagagucccugcacagccaggaacagcccagcuuuuaggguucagggcucuagggcgagggucagggcauccagaagguaaggaggcaccaaacuuaaaugucaccuccuguaggaaagcuucccggccuccuacuuuagaucuggauccuccucuguggcccugcagcccccaaagcuucccucuuccaaaacuagccacacccagcaaacuugcugugggcugcccaucuucuccggcuccuuggagcagggucuguaacauguccccucauccuagaacccaccacaggccugcugugggggucccacagggguauccguggaggucuggggcugaacgaguuccaggggacauuuugugacacagcagcccccagcauaacagcucacacugaacacucacucugagcccagcccuuaccaagggcuuuaccugugaacucaucgaaucuucacacaagccccaggagaugcuguucagaagaggaaacagaagcuccaguuauuggcccaaggucacccaaauucaaucguggcagagcugggcugccuggcacuggguuguggccaugggcugcacacugccacagccaucccagaggccccugaaggcgagggaucaggccacggcauccuccuucccagacagcccugcagggcuagcaaggggccaggcaggagguggggugucccccaggcagagggcagggacuuugcuuaucugguuccccucacugucuguccccagcaccuaccacagugucuggaaauaaacacuuguugaauaaaccccagaggacccugacugaagccugggugccggcggcagagggcuguuugggagcgauggggccacacuguucccuuagggugucugguuuugcugggcagucagagacagggugcacaccagccccaggacucaggcucagggcccaccaaaaccuccagcuucugccuccuuccuuggccaaguucuggcccccacauccacccccucaucuccucuggguuuguccacgcuccgugugucacgcucagccauccaggcauucaguaggcgccuauuccuggcaugggugugcagcagaggcccaccgucgggagcuggcgucugcgggggagacagacagugaacacacaccugacgcaugucagggcauggugagcaauggcaccaacacccacaaagucagguacagggacagagggggucagggagggccucccugaagagaccacaguggaacggacacccugaggggguggguggugccgaucucuggggaagaauguucgagaaggagggcacugcaguggccgugacuccacacauugccuguaggucaagggagggacuggguuuuguucuggcugagcugagaaugagaagcuguggguugucacgagauugggacuugaggaggaagaggagacgccgcagaggguccccgggggagcaggcgucagaggucgcugcagggucugcaggaagaaauggugaccccacugaggggguuguugggagguggggcagggcucaccuggcugcccccucuggauguugcuuggaggucgagcuuugccuuguggggcgugacucugugguugguuugagcugugggugaagguggggccguggccuggaacaacagggggugccagggaccagcaggcagguuucagacccgcgagccugaggcccguauuggguuccaaggaaaugggucgaguaggcagccagauauccaggcaguaaugccaccuggagauaaguguggaguuaguggccguggacugaugggaggcuggagaccagcugagauucccggggugcagggggcucggggcugcguccugugcgccacaacaaaggaccacacacuugguggcugaaaacagggcauauguauagucucaguccgcagucccacagccagcucacuggccauaaugaaggugccacgggcugguaccuucgggaggcucuggggagcaccguuuucccugccucuucuggcuucuagaggcgcugcguucccuggcacguggccccucccccauccucccagcccacagcggccaagccucucucacgucucugacccuccugucugucuuucgcguauaaaggcccuugugaucgccuuguuccugccaccccuaaugauccaggaugacuuccucaucucaagguuggcugaguugcguccuugauuucaucuuuggccuuauuuugacuuugccguguagcauaacauagucacaggugcuagggaucaggacgcagccgucucugggggccguuccaccgccuacuacaggacacugcccccccaccuacgccucccgcccauucacucaggccacaugugccuccagcugugccuguguacagccaggucuggguccgaauggaaugggagaauauuggggaagagaggggguucuuccugcuccugguccgcugcugaccccgugugagcccugugggaaggaggauggggcuucauuggcacccuguuguuuauagggguggaaauccagaaacauccucaauaucccaaucuuaaaugcuaagauuauucaacucuucugaaaugagugaggcagcuuuuuguuucuuuuucuggaaccguugguguaauauaucugcuccuugaaguauuaggaaaacuugugugcaaaucuauucggcguccuuuugagggagagaaggaaaauuuuaagcaaccaguuuaaaaugccgagaaaaugaugucgacagugaugacauccauguacuagaauauuguucggucaugucagcuauuguuuuagaagaauuuuuaaugccacagggaagugauuauguugaaagauuuaggggauaacaaaauaaggcuaugaccaccagaaaaguggaaacagagaaaacucuggaaagaaauacacuaaguugucccugaguggugagcuauaagaaacugauggaauauuuucuuuuuauuuuucuguguauuuuuacuuucaugauggauuugaacuuugaaucagaaaacacaugugugugcaggaaggguggaauuuagagagcacagagacgggcauaggacaguuuugugcaccccucaauguuugugugacauuuuucagugggcuagagggggcagucagacccccuuuggcucccgaagccugugcuauccgguuucccagggcagaagcagcggucacauauaccuugcacauuucgugaguccaagcacagacacauccauuucagccacguaauuucauaugccugaugauguaugagccuugugugaaucagccaaugaacucaacagugcgagaaauaugaguguuuucgaugacucaauucaauuucauucuucacccccagcucccagggcugcagugaacguuaacuuuuagggccucggcagauuccacuccucuccggauugcacugagguuccagaaggcucuggcaggccgaggugcggagagagggacauggugucuuccaggccacugaggacuuuugauugugccugggcgaccuuggggccagguccuugcugacaaauccccaagggccuguuggcugugcucagugacucaccugggagguuggcaacaugcugaccucuggcggcucuugcccgcaccagugaucccaagucuguagacaggguggggcugccugugauguacuaagguuuuauguaugcuuuuugcacacacagucauaggugaaguugguuuauaauuuucuuuucuuauacucucuuugcccaauuuuaagauuauucaacucuccuaaaaugaacugggcagcuuuuucuuucuuuuucuggagcaguugauguaauauaucugcuccuugaaaucuuaggaaaacuugugugcaaaucuauuugguguccuuuugagggagagaagaauuuuuuucuuuuuuuuuagacagaauuuggcuccaucacccugacacgaucuuggcucacugcagccuccaccuccuggguucaagggauucucucaccucagccucuggaguagcugggauuacaggugugugccaccaugccuggcuaauuuuuuuuguauuuuuaguagagacaggguuuugcuguguuggccaggcuggucucgaacuccuggccuccagugcugggauuauaggcaugagccaccauaccaggccaagagaagaaaaauuuuaaacaaccagcuuaauuucuuuuuugauuauugauuuaugcaaauuuuauuuaaaauuuuucuagaauauuuuucauuaucaaacucaauauccuguacggaaacuuucucuuucgugccagcaaaaagauugcgcagcaguuuuuagcaugcuuuuacagcuuccauuucuccucauuuaauuugccgcacauuggggcgaguggcugaagugucuguccuucugcaugccuuguccgggcuguguuuuugcucuguggcucucaugggaaaucaagcacgcagccgcuuuccaauuagcagguggcggcuguuuuuaaucugaacacaaauggcuguuauuugagcuaauuuuuuaaaagggauuuggggauuaggauuaguucuucaccucccacuuccauccauguauccaauuacugcucaaaacucagggaguggcugauagugacaccccagagaugugcucacagcaucauuuuccuaacagaaucagaccgcgaaugaagagcguccuggaugcaggaaggugagcauuucugccauuggacagaugaggagaccgaggguccgagaagcucugugacuucccuggaccccuccucuaucagggcagagcugggggcacacaggccacucuguucccucugcagcuucccaccuuucuccgaagcacuggaaauccgcgucuugugacugcuuggcagugugacaggguaaccguggaaacaaccguacaugaguccucaaaauagacaguuacuucugcuuaugacagcacagagccugcggaaagaaagggccgugcccggaacacugggauuucuuagaauugggggugaugauggcugagacccugauuucuuagaaucggggccgaugauggccaagacccuucauaggcccccaacgacgugccuggcccgguguugggugaaauaauaaccgcagcucauucuuugcacaccuagugcaaacacaugcuguuuucaguuuauaucucauuaaauacucagcaccuaugauggguguguuauaguauucauccuacagaugaggaaguugaauacacuugacccuggaaugaugugggaguuagggguucagacagugccugaaugcaguugaaaguacaugcuuaacuuuugacucccucaaaacuucacuccuaauagucggcuguugguggggagcauuaccaguaacaucaacagcugaugaacauuugaagagacugaugucuacguggauuuuaugcauuugugacauaccuaacuuuuucuuuucuuauauauauauguauguauauauauguauguguguguguguguguguguguguguguguguguguguguguguguaucguggcagaucuccaaaauguuuucaguauauuuacugggaaaaucgcacaucaggggaccugcagguucaagccuguguugugugagggucaaggggcaacuguauacgcacuucucauugcugcgggaacaauugccaugagcuuaguggcucaaaacaacacaaaagacuguuguacauucuggaacucgggcuaaaaugaaggcgucagcuggccuguguuaucucuggaggcugcaggguggggcuguuuucugaucuuuuccagcuacuagaggcuucuagaggcugccugcacuccucagcucaucauuccaaccucugcuuccaucaucccaucucuuucuuccaucuuugaccuuccuucuuccuccuauacagacccuugugaugacauugggcccauccagauuauccagggucaccuccguaccucaagguccuucacuuaaugacaucugcaaagccccuuuugccaugugagauaacaggugcacagauucuaggguggaggauguagauagacgccuuuaggggucauuguucucugcuacauugaagcacagagagauuaagacauuugcccaaggucacacagcuaaguagagccaagauagagccucagagagucucaugccuucaaccugcacucuuuuucccuuucucaucacagaagccuugagaacuaaaacucuuacaggaauugugggugagcuggguuuuuuuuuuuuuuuuuuuugaaauggagucucauucuauugcccaggcuggagugcaauggcaugaucuuggcucacugcaaccuccaccuccuggguucaagcaauucuccugccucagccuccucaguagaugggauugcaggugccggccaccacacccgacuuuuuguauuuuuaguagagacaagguuuugccauguuggccaggcuggucucaaacuccugacgucaggugaucuguccacuucggccucccaaagugcugggauuacaggcgugagccaccgccccccaccugaguggguucauuuaaaagggcugugugggcucaacucccagggcucacucuaguaauggaucugcugcagaaagaccagccucagcccagacccugcagcucuccaggugcaggaccagggcaaagcuccccaacagugggaacagcccaugugagggcccuguggcuggauacagaggcuggagagaggaggugaggucagagagguguguggcuggaggaggccucacaggccagagcaagagcuucggguuuccucugaaagggacaggaaccacaaggccgucugaguagggagugggccagccuggccauguguucacaggaucccucuggcugcccaguggggaauaagcugaggggugagguagaagugggggcuggcugggggcuagcguguucacgcaggugagagacgcuggugcgcagagugaguggccggugcagguggggaagguggugggcccugccccccauggcagguggggccugcuggauuugcugcuggauuggauggagagggagggagggucggggauggcuucaggcucuguacagagaccaggcucccgucuguguggagcuuuguggagggaccacaggaaggggacuaguaaauaaguaggugcauuggagugggaagguuuccaugaagggcaucaggagcccucugaugcauugcaccucaggggucaggagaggugucccuggaugagaaagagccugggaaugggggcgggggugccccaccccacaguagugucugagaggaaccuggcugacgucaggacccguguggcuggaacagguggaggggugggcucuugugugcaaagauggguuaaggggagagcgugccgggccugggggccacagcugggcuugaguuuuuuguuugauggggcucgaucacauggugcugggcagggagugacaacugucaucucuucaucagugagcauucauugugcccaccugugccauuguaggaacucccugcucccuccccacuguguacagccucagggauagggaaagaggccgaacaggaggccccuccccaaacaguggcaucaccuggaacccaggagcaagccaguguccaggggugcucggggauccauaacccccaucguccuucuucugcuucucggacccuccaagcuccuccuggagcgcggccugaggugaggccagcuggcccaggccacuccacccucguggauggccuuguaucccaucagaucacaggagggacccguggccaggguagccaggggcgaucacugcccaggaccccauaggccccucccccuccaggccaccuccucccauguuucccaccuccacccaccugcaggucccucccacccucaucuguuucucuggaggccucacugaacugcacuugucccugaaugcauggcucaagcccaugcauuucuacugugugaacccaaucggccuccaccccagccccagaggagugucguccacacacugacaacgauggggguggggcacagcaggugcuaccaagagggccacagagcaagugccacgggcacacaggggccacccccaggcuggcugaggcuucucugccaggccuggaaacugcaguggaaccacaucagguuggggaagaaagaugucagugaggggcuggagcagaaacggcaggcagcugcacaagcuucucucugcucagggagcagggcggggccaugaggcagggucugugcuaggcaggggcgccaagaugaucagugacuaaugaccaaggcaggaccccuggcccaagggagcuuacagccccaugaggggacccugcccuccugccagugccacaggagaagguacccagcggcuugggggcagcagaggguaagcacaggauuucuuuagagagcaugugaacaauaugcacagaaagcagggugugagccugggguucuagaggauguauaggaguugguaagaaagaccagcuaaaaaugggaaagggaucucagggagagaaaaugaugugaaaaauaacuccaggaaucccuccguaguuuuauugagcagcuacugcaagccccacacugggccaucgccuccaggcaugaccucugaagaucccaucgugcuccuucuccagaugagggaagcugggcucagagaggaccaggcccuugccugaggucacacagagcacgaugcauucugcucucugcccagcacauggcggggcaggggcuacgggaggcagggggagaugccuagggcucaacauugaggagacacccacccccagagccuuugaguggaugcagugcccuaggggcccagcaggaagggggcuggagugugcggcagaggggaacuugcgugugugaggcagcagcagcaggcugguugggacccauugagaaggagcuggucagcuacagguaggagccuaaaccuugauccugugggcacuggggagccaaggagggcuucaagcagaaggaggugccgucggcucugugugaggcuggaaaggaaggugggcaccugcucucaggcuucaccuccuguuuccuuugauucacagguccgucagagccgccccacaccuugguugggcuccccagguccccuccaccuuggccugagccagggauggggguggggaaggcucucuguggccacaacaccgugcaacacccagggaggaagaggaugugguugucagggaaccggcucgagccaugagagcccuaauuaugcaaaaucauuaaaaagaaacaggauggagauuucggcugauugagagcucuccaacuuuuaaauaauuagggugugggggaguggguggagaugggacugggcccaucacaagugaugggggcuuugagacauguuucuuuaaacccauggcaggaauaauuacugugaaauguccuuagcgauucagucaauuagaggggagaccccuuaucucuuguuagcgcucugaagguggugcagcgggguguguguguguguauguguguguguuugcgugcguacucgggggcagcgauugauauggaauaguagauuccacuaucuuuuggaaaaaaaucuauuguaucaaaaauuucauagaaacgucuaaaaagaaaaagaggaacuuuuaggaaugguuuuucaggcuuauuaauaucccuuccgaucuaucguuugcauuccuguuccuuguguccuuaaaaacccucagaaaugcccgaguacagccagcaguggggcgacaagggccagcgccguuuggcuuuguuuccacuaucgauucaauuguucucucagccuuugaucuuugcgguuuuuccugcuggaggcugguaggauacuuggccacucguucugcccugugacacccagcaccggugcccccugugauucuggcugaauccacccgcaaguccugcugggaaccuagaccagcccucaaggucugggggagucuggucugagagaccccugagcaggcgaggggguacuaaggccacuccggaagucagccugugagaggccgcccuggcucaguuuuggacucaccuccgccucaccuccaagugacagaaagccuaguucaggccagacaggguucccgccacucaccugggcaggugcugggggccaccaggucccgcugagauucucuuccuuguuuccauccauuuagccaccgggggucccucuucucucaagcccucucccugcuucucccaaauaugagucucuacccacugcuaauggaaaggcagcacaacaucaccccuuuagggaaucaagcguucgaagugauuuucuuuacgguaggcaucagagagaaaagggaacugugguugauccuucuuuggcuuaacaaagaaaaacuacaaauauauauauauauauauauauauauauauauauauauauauauauauacacacacacauacagaaacaaagaugccaauuuaauuauuauuaucggggcacaaaacauuaucaugugagaugaccaauuagaacucagagguucagaagcucaaggugacucccagggagauuuuacuaccccuaccguacccauccuccuccacaggcagggagggguuggagggcucacaggagggagggagggaaggaaggagggagggaaggagggauggagggagggagggauggaagcagggagggagggagggauggaagcagggagggagggagggaaggagggagggagggagggauggaaggagggagggagggagggagggaaggagggagggagggagggaaggagggagggagggagggagggagggaaggagggagggagggagggagggagggagggauggaagcagggagggagggagggauggaagcagggagggagggagggagggagggagggagggaaguaagucaguagggcugcagcacucaucgugcacugggcucacucuguacagcaucuuugcugccugcggcccugccuguacccaggguggugccaggccuggcugcaacccccuccuccugccccuuccugaaaagcgcccuuggcuccuguuguagggaggagcaaggccagggcucagggaggugaaggcguucaaggccacacgaggggcucggggauugagacccuggcagccuguucucucccagcucccucugcgagcggccucacccuuccuucccauggugcugauuuucuuucugguccucccuucaaugugcccuuguggaaagaggaaagcucgggccacugagaagggcgccccugugaacgauggagggagauugaggucgcaggcaggccuggggacugggggcguguggagggguggguugggcuccuggaaagggaggcgccuacugucaguuuugaguuucguuaaacaccugccagccugauagcauucuaauuccaaaauaugacaccacuuauuaguggauaaacuaggcucccucccuccuuccugaucuugacgccaggacuggaaggagcgaccaccugcccucaggauacccggugcagugccauggcuuugagggcagaggugugggguugaaggcugccacugcucaccagaggcuguggagaggcuaaggacagggauauagaucuccugagcuucaggggucugcuucagagacagguguuuggaggccuugcucucaagagaggugggggggaccuuccuccugcugccugcucugauuuggggggauaccagaggcaugaacauaaacgugggagccuuuuccugcccuguaagcagcuucccucccccuccucucaccuccccucaccucccugcaugcaguggccugggaucaggauggugacaccugggcucugcagcccuggcccaccgggugcuggaacuuccuuccuccgucgggaggggacuccagccuccugccugccccucccuaccuccuugacucagauuucauccucccugucucugaacccucaguggcucccguuucccuaauggugacuuccucaccccucuccguggcccaugagauccugcguggguggccccuugcgucccuguucccccugcucacuccuuucucugccugcacggcccuuggcgugucccugccucagggcccuugcgugugccgucccuucugcccagcacaccccucuccaggcaucgccaccaaucucuccccaacuucacucagaccuuggucaaacagcaccucccacggaggcccuguucaccuaaacuaccagcccccagcaccuaucugccugcuggcucuuccuccccagcacuugcugcucccuggcgguggagggcgccacuuaguuuuauugucuguaucugcaaggagaauguuggcugcacaggaacaguggcuuuaugcuggucacugcaucaucccagggccuggcacagaguaggugcuguuugcauugguugacugagugaauaaaugaaugaaugaaugaaugaguccaucagggcauccagugggcccugcagaggggagcuggacaggaguuguauuucuggagaggcaguggccagguacaguguccaccuuggacaggagggagaauggggugcugccauuucccaugaggggauaaggggcugggacagaccugggaggcaggacacgagcccuuguggcugagaggggccagcagggaggggccucucgggagccucagggugcugugaucagcucugcuucccuguuucugggguagagaccagagcaggccagcaggcaaggcugccacucagccgguuuccauggggacagcuggacagguugucauagguuuagguauuuccagauuggcuggugaauggcugucaacuccaccacccuguucucuucccaucguucccugggucucucuguggcccagguccuagggaguuagugccuggcccaacagggguccuaguccccacgcuacuucagccccagggucacugcuaccagugagacagauaccagcagaaaugagcuuagagaccuugucccacuuugggaacuucugcagcucaggaaggccagguuaugggggcaguggggaggggacacugucuggggaguccucauugcccacucugucccagucuauaauuguccaggugggcagcaaaccguugccuuuagggaccagauaagcaacuuccugugcagagcaggugcuccaagaaaaaaggagauggucaguggauggcauacaggagacuguaccaacucuguggcagucagauuugauuuuguuacaaaccccauggcaaugaaacaaaacccaccuauaaguagggcucagccaugccugcccaggacaccaugaacagagauaacuacuggcccaaggucccagggccaguuagugccagagccacaagcagugcccagucugguagaggacauuguccagcacauuugagaaugucaggacaccuuugcaaucuggcauucagcaucaccaguagggggcaguagagggcagcacaucaaguauagcuuuggcuucaaaucccgacucuaccaccuucuuccagcacugacuccccaggcauggguuuuagccagcugcuccuccauuuucuuggcuaugaauggggauaguaauggcuauuucugcacagcacagaaucuuaccaggcuuguucccugguaaguguuuaguucuagguuugaggaaugaaugaaugacugaauaaacagagcaugggcccaggugcaaaacagagucauccgucgugccaaccccaugggcgggagcagcgcagugacggccauugcuucucugucuccacagucuuugaagagccugaggaccccaguaaccgcucauucuucucggaaaucaucuccuccguguccgacgugaaguucagccacagcggccgcuacaugcucacccgggacuaccuuacagucaaggucugggaccugaacauggaggcaagacccauagagaccuaccaggugggcaccacagcaggagacccccaaucccgggucuuuuuucccuaugcugagauccccauggagggggccuuccuagccaggcguggcuuucauaugcccgguauguaggugaagacacggaggcugaagaaauccagcaacucauccccacacguagcuuggcagagggcaggagugcucagucuugccucacagggagcuuuggaugucccugagcaaggccugcaguccagggcccaggggccucaauuccagggaggaaagagaugugggaacagagaugagcgucaggcugggccccaguggagcauguagacgauggcuucccuccccacucccugggagccugcaucggagcuguaccauuaaagaggguuaagcguugcccucccagggugcauccguaagcagugcacgcagaggugaacugagcacauguuuccuuuccagauccucagcacaggccuauaagccuggagucuaggugaagccugggcccuucuuggacaguauuauuuauuaucuugcuauuaucauccauucagauauguuaggggguagacaacaaaacucaugugauguuaaaauaaaauguggacuugaaagaaaugugggauggcuucaaagcugguuccaguuagguggggagaucagggaggcuucuuggaggagguggcauuugugcugggccuugaaggauggguaagaucuggccgugcaaacaugggugggaaaacaccccaccagaaaccccagccgguuccucaccgugucacuccucacacauggggugccacgugcuugacaucugucaccuccauucuuuacuguccggugacaaggagccaucauccuauuugguggaaagggaacucgggcacugagagguagggagaugagggaggugucucucggcugggcggugacagauucagagcccaggcucagagcccuacgcuuuccuuuccuccgugcgaagaccuaguaggaaagcguccuggguggcgcaggccucgcugggaacuggugcagagcucagagggugggcugcucugaucugaccugggccccagaggaacagcucacgcuccuggaagccacacacccacaaggaccgcuauggggaccgccuguuugucagccacguguguuuacuugaguucuugcgacugccccagcuccucccucaggcccccuccucacacugcacaccccaggcaggacucagcccuccucugucccugugggaauggcagagaccccagacuaggagagggacaggauaagcccggcucaagccugcaggagcaacucucuggcucccucuggaggcagcucagggaaaugaacauuuccaacccccuccggccccuuguccggucacuuaccuccaucccugaggucagcaaaggcccaugaaccccugaaacuacguggaauguguucuaugagcauuuucagggggagggggacacagcuuucugaaauucucaugaaggaccccacgaaggaggggaaugacuguucuggagcgugaggccguaagcugggcacuuggcaucuggcccagcugaccuauugaugcuaaaauaauagcaauaacuacauaaaagcagcacaacaaccaacauuuuuugguggcuugugaugugcuagaaauuguguguagcaggacugcguucggcuggugugcggugcuuaacaaaucggggcuauuuuucucccacaacagggagucuggagagggcaguccaggaaggugggggggcuccaugaccccggcagcgccacagugguuccuucugugauccaguccaccaucauuugggcguugguuuuccaccuucacaugugguaccucaugguggcaaaguggcugccacaccuccaagcacuuugccuacauuccaggcaggaaauaggaaaugcacuagaucucaccccuggggucuguugcguguuucacugugauuguaaaaucuuccccagaaugcuucucagaagacuucuuacaccucauugucuagaaugggucccuggcagccaccauaguggcugggaagauuaaugguuuaacagccucugugguugaagaaggcaagggugaaggggcuggggacgguuguugaaugagccacacugagguaaguccauaauaugcuuugccucaucuaagccucccagcuguccugggagguggggccgguauucuccccaucccauuuuauuggaagacaauugaguuaaauggcaaaucugugacagagccagcaagcagcggaccuuagauugacagucuuucuccagagcucuuccucacccugccacuagagggcaggagaugcuuagugcacggcagagagaacagcaugcgcauuuggacgcgugcaucaccaaggcugcugggagcugaguaaggaggacacacaaaaaugcagagccgggggugggacacgaacacuaaaaccugcugccauucaucccccuugauuuuaguuguuacacauacugagccaguacccugugcccaacacagugcuagacccuggacccagagagaaggaagaaccucggccucacccucgagggucccagacagacaggaacacagugacccucagcuugguggggcugcagcccaggggcccaaggggaaggcaagggucaccaggaggacacgggggcuggggagggaugagcagggccccaggcgggagucagguagccuugucuaaccauccugugugcagugaauagcaggcccuuccucccaauccugcuuccccuagugccacucuguuuuccuguguaguccuugccaccauauuagucagauggcucagagaaacagaaccaacaggauggggauagagacugagaaagaagggagauuugaaggaauuagcucacguggcauguucuaaaucugcagagcaggcgggcaggcuggugacccaggggagagugacuaugcgagcccacacgcaucuguuagcggaaucccccgguccucagggaggucugucuuuguucuaucagggccuucgacugauuggacaaggccccccacaugauggagggcagccugcuuuacucaguauaucagcuuaaauguuaaccuccccuacaaaaugucuucacagaaacaccaaguaucuggguaccuuggcccagccaagcugacacacgaaauugacguucacaccacccuucacauuuucuguguucguuggaguuguuaauuucaacuccugggaguugaaaccaggcuccauggcacccaguuaccuucccuuccgcacccagagggcagagcccgugcccuguuguccuggcagcuccagccucagcagagggcuggcacucaugcggcccuccggguacagggcuuguaggaccggcugcagucagguggaugcagguccuggggugucacccucucuccugugggguacgggaauccuggggaaggguccuggucagccucuuagaggcugugugacccugugagccucagugccucgugcuguggauggaugagaaaccucuguggguucccucuuccccuuucuugauggccgccacccuguguucucggagaucauuacccucaaaaggccugcccugcacuuaaugccagaaccacugugagguucgcccucuuaucacuuuaaguuugaagaaacugaggcucagagagaugaaaucacuuguccaagaucacacagcugggagggcagagccaggaucuggaccccaggugguccuggccccugugcugugagcguucuguuugucacaguggacucugcucccuggugcuacucccgucucuggccacagcucagaggucagccgugugccuggucgugggcccccgauaagaugagcagggcuguauugggcugugucacgguggaggucagccgugugccuggucgugggccccccgauaagaugagcagggcuguauugggcugugucacggucggggucagccgugugccuggucaugggccucccgaugagaugagcagggcugugucgggcugugucagagcauucagacccucgcugagaugagcaggucugcgcugggccaugucagggcaugcagacccucgcugcucuuugagacccuucuuguggaagggccaggauggucgggacgccccguccacucaccucaucccuuaucccaccagguccaugacuaccuucggagcaagcucuguucccuguacgagaacgacugcauuuucgacaaguuugaaugugccuggaacgggagcgacagguaagcccugaccucagcccgcaccucaccucaccguagggaggguuucugcccugcaggggucugggcugggauuccggugacccgcagcauggggcuacucagccucaauggguccaggugucugggugaagcccacgcuuuccagagcagguccaacucucagcgcucagauucaaggggcaggacaugaaauucuucaucuucugucacugaaccucacagccacguuggcgccugcccuaugggcaguagugggaacauguuuaguuaauucaggguccccggugaugugcuccccucucccagcuugucgggggcgagggcuauagcccagcacccggucaccaucauccauccacaccuguauguccugagacagcccugcaccccuguggcuuugaccaucggucuacucaccccuccucccaucaccacuacugucucccucucuuccuggugacaccccacucgggcccgcugaggcucaggggcaccuuggagcuccuacacccuccagggcuugucacaauccacaaguccagccgucucucaaccccaccugccuggaaaguggcgccccagugccagaagugaguuccugugucucccuagccugggcucagcccagggcgggcauggacaagggggcuguggcaggggcuccugaccugaccucuacccguggguccuuaccucugugucucuucucugggauucuuccuccauucuggaggugggaaaaucccucuucugcccucccaaaucacaucagcuuugugcucaggguccugccaggcguaagauucugaaauggacaagccuacucuccaucugugaguuucgaucucagaagcugagagguggccucucagugucuccuacagcugcuuccucaaggacaggaugccucuuuguccagccgcccagauucagaagugggucuccagaugauacacaguguggagauaaagacuacacuggcugcuagaucagaauaccaccugucaggagcccauguacugucaccuccuccccgcaguccuguccaguguggugggcaaggaggguggagugagagccagcagcccugacuugggcaucaccugguggggggcuguccacccuguggauggcaucagucaacaugacaggucugggcucucccagaccucugaggguggcuggcacugugguggucaugugagagcugccgcacuaugacucucuguggcucugggcauagggcugggaccaucaggguuggugugugggaugaggggagggcuggacauggcagagacaggaccaggagggagcccccuggaagcagggcuggauccaaguggggggccaagucauuguguccagggaaggagauuucugagagaguugccaacauccuggagcucccccagcccgcaggggucucucagcagagcccgagcucaggcaaggggcuggcauggugaucacagggggccacuaaaggaugcuuagaaaaccaggauggaggcccgacccggggcugggcuggcacagcugggucagcaggacacaggaccuucucucuaggcccugcccccagauagaucccagacacccccagcagacagggcuccucccaugcugcugagcugcauuugggguucccuggugcagugggucccaagagggucuauccaaaucggacgagagggaccugcagcuguaacaagcugauuccagcuuuuaugugcguuuugcgggguagguccccgcuggcugcgacccacugcccguccuuccuucaagcugccaccagggggcacccgcggccaggugaugccugcucccaggacuggagaagccgccaagcauccccaggcugacaguggugucuaggccugggcucuccuguccugccucccacccgccacuuccugcgugcacuuuacacgccagccacgcccuguccuaguggucccccacccgccucacugucucucgcuccacagcuggcucugcucugcccggcuggaaccucuguccuuguuugccucccgcaauggguggggugcccuggggggcuacuaugacucaaccuguucugagcccuucacuggggaccucagguguguccaguggcuguggguguuucuagaaggcauagaggugugccaccucccaguucacuuugagcacuguucugagaacaacaugccccauggucaggggucccaagauaaacagacccuggguccugccuuccagggccucagaggcucaggagagaagcaaggauuccccccagguucccacauccuugcagaccaaagcaaacucgaauccuggcaggcucccaguugcugcccucuuauuccuggugacccccucugacaguugguccggcccgcagagcgccgcugcugccgcgugguggcugcccgauggccccugccguggggcuuccuagcaccggcagaacgcagaugggcagcgugcuguggagaggcagcagcucuccugcuggacucucucagucucugguccacauucuacccucgccaccgugugcuugaggaagccccuaagucagcucggcuggaaagugguucuaggaaacuggccuucguggccgcuuuggggaugagaccaugugugaugccuucagcaagaucccaguucguaugcgcaggggugccgcagugauccugcguggacuauccuauuggcaggccugcccuuccccagguuaccuacccggaggaaucccgcaggcccucccacaacaggcuucaacgcccccuccuccaugaaguucuccuugaucuguccugccuggggggagagauuugugccagccgagcgugcucgggugcgggagucaaacacaccuacacuugcucugaggaguccugggcaaggcucccccaggggcccaugcuguaucccuagggcuguuuuuuucucuccggccguuuucuucucuccaugcuuccccaucuccgcuccucccugcuucuucuuacacacuggccucauccucucccucuucagagaugacccccaaaucauuccccuuuccauuauccucagccagccaaccccucccagggacuguguaaaacucucauggaaggaucugauuggcucugugugggucacuugcccacuuuuugcaccaaucagcauggacagggauaucacaugcccaaguuggccaggccaaggggcgaggagagcacugugauugaccgcucacagggauagggagugcaguggcgccaucucggcucgcugcaaccuccgccuccuggagucaaacacuucuccugccgcagccucccaaguagcugggauuacaggcgccacggguggcgagggcaggagccuuucuuuccccaaaggaaagaggagcggagcacuggggcugaaagcagccggcguuguggucccacaugcagaugaggcuaggagaggugaagcagcuccccugcccuuuucccuguuaagggaaccuucuggaauuuaagaaaccugccugaaugugaggaauggcucucaugguggugcggccuggugcucuaggaugagaggggccccucccucucccccagagcacgugucagcugaauuccacacccgaacagggggaggaucaggaacuguguggguugcaaaugacuuuaauuaugucgcucuccuuccacuaaauggaucagaagaaccagcauugugugaaaucacccagguucauucugugaacuguucccugaagaacaaagggggcugccuccccacugugcuggcgcggggaggguguggccucccccagucagccuguggcgccugggcagggcccuucugugggacucguucacccggccccccucgcaugcugcuucccuugucccaggcucugagucacauauaaagcgggugcggcuuuggucacauggacgauuaggaucgaggaguaccugguaaauaacaagaagcaaagugccucaagcccagcacugugcgggguguucagccuauguccccugauucacgcucaccaggggcugcguucccuuguugaucccaguucuuauagaaaacuaagagagugcgcaugucaggguagggcagagcugggauccggacccaggcggacuggccagagcccaagccccugacugcagugccggagcucacgugugagcuuuuguccucugugcauaaccccuggagacccagggauccaccugguucugucacagagcagugucacccucaggaagcccagcucagcuuccaaaaggaaacaggauuuccucccugaagagccuucagcaggacaacuucuuuauggucgcuuuucguaacauccucuuccuccccaguuaccuugcaccucacagcugcuccagggcccugcagaggccaaaccccaaaacccucccucugggcgcaggcccacagaacugugcuuucucuccugccucuuacuauguggaugaacuuacccuuccucccaccggcaggaaccccuucuccuuaggagcagggagagcagagaaaugguguggaauucucuuuagcgggacggugagggcagcgagccccugcacgucagcacugcucgccccgacccucauggcgaugcauguuuguuuauucgcccgaguccucgggacaggcgggccccuggagggaagcagggccuggugguuuucugucccagcugcuuccaugucuaccuccugcugugguugcacagucuguuuggaaggccagagcuuucucuccuggacuaacagaaauuacaggagggucuuuucuuuucuuuucuuuucuuuuuucgagacggaguuuugcucuuauugcccaggcuggagugcaguggcgcgaucuuggcucacuacaaccuugccuccuggauucaagcaacucuccugccucagccuccugaguagcugggauuacaggugcccaccaccauguccagcuaauuuuuguauuuuuaguagagacaggguuucaucauguuggccaggcuggucucaaacuccuaaccucaggugaucugcccgccuuggcuucccaaagugcugggauuacaggugugagccaccacgccuggccaggaggguauuuucaugaugauuggggcagaggauaaaaaggaucuuagcuccuggccccaaagucugcauguugguggcagcugacaugugaggggguauaagagaccccaagauacaggggaauagaggcaggugugguuucccuuuccagggagugauggcucuguaggcucugggauugcuuuuucauuuguuuguuguuuugggacagaguuuuacucugucacccaggcuagacugcagugguaaaucacagcucacugcagucucugccuccccaggcucaggugauccuccugccuccccaggcucaggugauccuccugccucaaccuccugaauagcugggacuacggucauuuuuaauuuuuuuuuguagagguggagucucgcuauguuguccaggcuggucuugaacuccuaggcugaagcaauccucccaccggggccucccaaaguccugggauuaugggcgugagcccccacaccugggcuuauuucucgagaaggggcuugugcuccuccucaccugaugccucuccuucucccaccagcgucaucaugaccggggccuacaacaacuucuuccgcauguucgaucggaacaccaagcgggacgugacccuggaggccucgagggaaagcagcaagccccgggcugugcucaagccacggcgcgugugcguggggggcaagcgccggcgugaugacaucaguguggacagcuuggacuucaccaagaagauccugcacacggccuggcacccggcugagaacaucauugccaucgccgccaccaacaaccuguacaucuuccaggacaagguaaacucugacaugcacuagguaugugcaguucccggccccugccacccagccucaugcaagucauccccgacaugaccuucacgaccgcaaugcaaggaggggaagaaagucacagcacugaugaggacagcugcagagguggcaguguguggacacaggaaguuugggcccccucccugccccagcuuuccuaggccagaauuguguuuggcaguaauugucuguuuaaaaaaauaaaaaggaaaggaagcguucaccgccacaaaucauaaaauggacaugacuguggagucuuacaguucaggguucuuucauucacgucccuuccugucucggucugcggucuuuaccacaucaauaggacuuuuuaugcguccggguuaauuuuucacuccagugcguccuguugcagggaccggagcugaugggagcugcuucucccccaugccucacuggucccagaucagggcuccagggacagaugaugagucucaaacgagccagccagggguucuuuugguuauaaauggggcaauucgcccugucucagagcugaugaccucaccguuguuuuuuggauggugaauucaugcugagaauuugcagaugcaagcuccucuccuaggucuucugaaugucuugaaacaucccaggucccaggucuggugcgguuucccgagaggagcggagugggguuugucuucugugugccuguguccucaucugauucaccugccauuugcugagccucugcuguguaccaggcguggugcucagcccuagaggcaguugacuuacccucugcagcccucccugccgccucacccuucagcauucacugggcaccuucccggagcggacacugacucccaugcacgauuuuuuggaaucuuccuccugacugugagguggguguucauucauuuccuccauaaacaccaacuucucgaagcgugccaggcucugggcuggaugcuggggauaagcgggaacccuuaggauccccucuguccacgagaagaagcugaggcucugagcggaugcacaggucacccauggcaggugccgugcaguggugucaggaacccguccgggucuucacacaagguucucuccaguccaucucgugggcggcucauguuagagcgacauucaaauggaagguuuggaaaggaaugccucugucuugugaaguaggacauggcagacuuggcgacgacaaggguccaggagaacugagacgcaggauggaagacagagaagaccccccggagcuccucgcucugcuugguggcuucaggaguguggcccuccccaggacuccacuucauccugggcuugcacccuccuugagccaaugcacugaacugccuuugaaaggaaauugcauguucugaccauuuuaggauaccuuuacuuuaaggaccacacagucccagaggacacaucccucgggaacucugccccucugacaaugagggccacagagaaggugguguuuccaugguagaugcuccuguucuggugauaccaaaccugcccaccccucugagucgucuuugcucauggacuugcagcagagccacguaguuuggcauuuugauucagaaaguggggagcagagacccagccaaauccaaacuuuuuuuuugguuuuguuuuguuuuguuuuuuacaagauauaacauaacccaggaaacagacccagcugagguuauucucaguggauuacaguauacuuuuguguguguaaaagcacaaagugcauguguacucacuucuggccauauaacauuuacacagggaaauggaucauugauuuuuuuuuaaucaacgugaaugaagaauguuuguuuauauaucacuauaaaauccaguugaccuggacaguauuauauguacauaucuauucuaauuaaauuuaacaaucaaaggauuggauuacuuuuuucccccuuguaaagagguucgagaauguggucaauuguauagauagcguguuaaagccaaaacccagcucugagggccuuacccauuacuuggauauuugcuacgauccaucucccuuugugagucaaauguuaagagaagaaacuuguauuugcagcuagagguuacugucacaucauagauuuaacauuuaccaucuucaaaguacaaaucuuacauguccuucaaaaggaggucuuaauacaguuccuaguuccuuacuucuguuuuaaacuuuggguaccaaaccaaaaagaagaaaaaagaaaggaaaagaucuucuuugaagaaaaguaugucucuggaucccuggaaaauaaugauguccaaagcaaauugugaagaucaaauguguguuaagaaaaggugucgaggggagggacaaaaccagaaacgguggaaggaccaguguaauagucacagacuugcauccuggcucugcuuacauuuccugguacucucgaauguacgggcguucacauagucauugugaaguuguugggguuuuuuugguuuuguuuuuaauuuagcucuucucugaggacgaagcuguuggugguggugguggugggggugguggugugggauacaugguggucaaguugucagcccugaucaguuuggacucuguaacucauaggugcauucuuuuuuucuuuggugucucacaaauuacccaauuguugaauaaaacuauaaauauguuaauaccagcuuuuuccaauaaaauaacaaauguuacaucaaaaacga

SEQ ID NO: 191468 - RNA, 51029 nt, Homo sapiens
accgggcgcgcgcgccgacggggcgggcgcaugcgcaagggggcgcgccgccucugccccgcggcgagggugucuauggagaggcggcggccgcggcugcugaggcggaggcugaggcaguggcgauggcgcccuuuccugaagaaguggacgucuucaccgccccacacuggcggaugaagcagcugguggggcucuacugcgacaagguaacggagcgcugagccucccgcugugggcggugcgggcggcgauggggagcgggcuggguucuuggggcggccuggccugcgccgcgcccgcagccccgugccgucgccgcgcgaguagccgccugcgcagcugucagcgccgcccgcucccgcagccugcccgcccgcugcgaggccuucgcagagccggccuggccgccgccucggacgugcucucggggcgggcggcguccccugccgagggccuggcggcugaggaggggcgcuaccggcgucacuggccgcccucgggccggccccaccgccgcgcugggacucccgcugcugccucuaaggagagcggcccuaccuccucgaagcccugggugccccggccggccaccugcgguggacucccaucugcaccgaguaguuguucccgucccccgucacucccccgggccuguucggggcucuccgugcagacacccacccauccucugcaccucucgcuggcuuccuggcuggaacugcagcgucucccagcuacccgguuccuuuuacccccggcuuucuucacugguuugauuugggagaaaagccaaguuuagaacugaagaaccuucacucuucaugugucguuaucguuuuccuugcaacuuuuauugcccugaacacuuacuggauguagauuuuguuauaagacagcaauucucucuuggauuucuuuauaugagcucgaauaaagggggccucaggaaaaguugguuuaacugugagaaccauuuugggcccauaauuggugcagcauaagcugaagaggcacuuuuguggagaugguucagggcccuuugcuagugauuuuaaaacaauauuaacauuccacguauuugucaguuuauguuggggaaagucauggauaucugcaaaccucaggcagucccguuucuuguggaaaugauccaacuaaauaaagcauucaaaugacuacuguuuaagcauagaaaucaacuuuuaggaauucucagaaauugcauagcauuaugcagaaccauugucuacagaaaagagggguguuucauagcucagccaggcgauuggaggaugcccaggguauucacuguuaggccacacucaagaccagcaauuuaaagcagugacguugaauuucaaaucuuagcacuccaucuucucccucccuccauucugaaaauuuagaaacacccaguucacaugaguuggaaacaccaggacugucuaggacaaugguuugcaaccuugguugcuuauuagccuuaaacuaaaaacuauuagaaguccugaugucuaggucacuaaaauuaggauuucacccagacaucagguauaaaugauuaaagcucuccauuugagugcaguaugcagcugagggugagaaccacucaucuaggagaagcaugaggaaugguuaagccauuaagcaagaggguauaucccugaauuuuuuacuuagcaguauuauaguguuuuuauccucucuggcuuuugaauaucguucauucagacaccauucuuuaauagcaggaaagaaaaaaaaaauggucucaaaaaucgaaaguggaagugaagacuaacagaauccaagguuuucucuccacuuuagacuguggagagguagccuaggaucaccugaaauuauauggaaaauuuugugcguguguccauuuuccuaggguguuuguagcuuucaucgauuuccagaugauugugaccucccaaaauaaagaaucacaauuuaauuuacuugcagacuaaggcuaagcagccuuauuuuaaaauuuucaagaaguuagucgcucuuuuucugucucuuccuggugguugagaguauuugaacaaauuuugaaaaugcaguugcuuuuuuacaagauaucugagccaagagucuuuucaguaauguucccacuugcauaacuaguuuaauaaagcauuuucaauuugacaugguguaagucaaaauuauuacuaauucugaauuaauuagauauaguuaaugagauuguuguauacguuuaucacgaagauuaaaaguccaauuuucugaacugaaacugaggcgauuuagggaaaaaaaaaugcauaggaauuuuacaucuggauuucuucuugauacugauagccaauggaaaucucucuuaggauguccuuugggagcuagaguggaaaauaaguauuuuguaaugguucaguaaucuuaaaggaauuaaaggaagaguaccuuguuuguuuuuauccauuuaucaucucacguuuugccauccuuugguuguauagaccaaggauauccaaccaaacaguuuacaauaaaacuauauaaaaugagaacuaguuuuuaugcucagacuaaaaagguacaaaauaguuauuucacuguacaaauuugggcucugaaugcccaguuauuaucaagaagucaguuacuauuuucaauauugaacuucucaaguagaauguauuuuagaagcauccauuuauuuacuagcaucaaguaaaccacuuauaugcuuaagccaguuaguauaauguauuccaaaguuauguuagucuacuuauuuuuuagguauaaaggugaauaggaugagaaaauaaauuuucaaaagcugacagauguaugucuuagaccauuuuaaauauugcuguacaauacccgauuuaauacuuugcccauggauuucuuuuuacaucuguaaaaaguuuuauggaaagguuuuucaccuuuguuauccagacaacagugcuuugaguuauguaaagacaagguauuucuguuuuauagcuggggacuuagaggccuagauuagcuaggccaagguuacauaagcagcuagugguagauucagauggaaacccaagucauuguuaggauuccuaguuuaauuuucuuuauauuaaaucauaguaguuucuuacuuuuuugggaacaaucugcuaagaaaucuccugcuaauucacugaccuuucagacugggaugauguuaguaaauauuuauauugaaugacauccuuuuuccauuuuacuucaauuucucagucuuuucuccaguucuccaagguuaacuccauuaauucugucagugagcauuggaguuucuaccgucuacucuguaguagcuuguacuacagaaagacguuggcaaugugacauguggucucuagucucaaaaaguuuacaguccaguauguaauaacaucuaugcuaggauggaaauccaaauaggguauagugggagcaaagggaguuacacggucagcuccacauuaaagugucaggaguggucucuuugaauugauuucugagagaagaguaggcugugguugucaggaugugguuaguucagagauucccaggcuuauauauaaaccaguuauuaaaaacucaagugguggaggccuuaaggugugcccaaauuuuucagguaaggguauuaaaagugcuguuuacuuuuaugaaagaauuuauuuauacauuuauuuauacagauaggacauuuuaugacccaaaacucuuaagugggaagaagcuuagaguaauuugaauauauccuuuuuuaaaaaaugagugaguauagcuuuauugucaguuuuccuuccccccuccgccauuuuucugcauaccuguaacaauuuauugacuggcauuugagaagauuggcuuaguggagaaaauauugaauugagaccuguggaagaaggaaaagggaauuuaaugaguucuuacuacaugucuacauuguuucuuuuaaucuucacgaacuacuuaagccaaauauuauccuucauuuaaaguugaggaaacagucuuagugguuaaguaacuuacccaacucauucaauuaguaauuaguagagccugaauuuuaaucuuaggauuuuuuuuccccuucggaagcccauggguuuugcauuaccuuacuaguucugcuacuuauugguagcucuaugauuuuaugcaaaacaguuuaccugugggucaucauuuuuuccaucuguaaauuugaucagcuacuuacuaagguuucuucacugaguauaagucucccuugauuaaauuaaagcauugucugagugaguagacaaaguaaaaauguauuugggggaauaauauauguguuuuuguuaugccguuuucuuaucuauuuuugaauguacuguaucgucuuuaagugacauaccacuuuugagaaucaguuugaaaccaggcuguaauacuugauuuaucacuguagaaugucugagacagaaagucaguuauagguugggugcaguggcucaugccuguaucccagcacuuugggaggccgaggcagguggaucaugaggucaggaguucaagaccagccuggccaagauggugaaaccucaucucuacuaaaaauacaaaaauuagcugggcaugguggcgggguccuguaaucccagcuacucaggaggcuaaggcagaauugcuggaauuggcgauugcacuccagccugggcgacagagugagacucugucucaaaaaaaaaaaaaaaaaaaaaaaagaaagucaguuauaaauccuuuuaaaauguggaagauaucauguuacuauuuguuaauuaugugcguccuuuuauauauauaaguucuuuguugaauuugugaggcaucagaguauauaacuuuauaggucacuaggaaccuuuauauuuuacuguagaagagugcucuucaaaauguguccugugaccuauuaguaguaggucauaaaucucuuuuguggguccgaaacagcauuaaaaauuuaaaccgaaaaguaaauacuagaguacaucacagauaagagagggaaauacuguucccugaaauuuguuugaaguguuugugaugcgugugaaucuggauugcacuauauuucauacugaaggucaugguuaacaguauuugaaaaacaguuuucuagagcaacauuucuuaaccaaagcauuauugacauuuugaggcagaugauuucuuuuuuaugggggcuguccugugcguuguaggauguuuagccacaucccuggguuuuauccacuaggugucaguaguacauuuccgguggugacaaccaaaacugccuccagaucuugccuuuuaucucugggggauggguagugggguggcaaaauuacugccuuggugagagcuguugcuuuagagcaaguguucuuucugacaauuuacucucuuguaucugaaaagauagcuuuauuaaugggacuaacauuguguauguagaaaagucauagauguuagaguuuuagggacuuggucucgguuuuguuguucacuaguuguaugaugugggguaaauuuucuuccugagacucuguuuguuagucuguaaaaugaggauuuugauaucuacuuuuuagguuguuuuaagaauuaaauauauaaaaacacuaggguaauuucucacacaucauuggcuuccuuccguauguccuagaaccauuaguguccagguuuuuuuucuccauaaagucuauaugugaaggcaaacaauuuuaaaaacuauuuauauaaacagauuucaaaaaaguuaaauuguguauauucuguuuauucuuuucuuucuuucuuuuuuuuuuuuuuuuuuugagacguagucuugcccugucuccaggcuggagugcaguggugugaucuuggcucacugcaaccucugccucccggguucaagcaauucuucugccucagccuccugaguagcugggucuacaggcgugugcuaaccacgcccaacuaauuuuuguaguuuuaguagagguuagcagagaugggguuucaccauguuggccuagaucucuuaaccuugugauccgccugccucggccucccaaagugcugggauuacaggcgugaaccacugugcccggcccugguuauucuuuuaacugcuaaauuuacuaacuuuagguaccggguuaaaaauguuugcacuuuucauguggagaaaaacugaguuggguaguaucuuuaaggacuuuucucucuguugcucuuuuuuuuuuggcuuuguuuucacuucaucaaaucaacaaacauguugaggauuuaauauagauaaaaaucuuauuucuucaaccuguuguacaaaauauuuuguauucuccaccaagaauuuaacuugaucuguugaucuguugaucauuuuuucccagcuuuauugagguauaauugacaaauaaauauuguauauauucaagguguacaaugcaaugcuuugauauacauguacauuguauaaugauuaccaaaaucaaauugacacauccaucaccacaaacgauuacccuuugugugggagugguaaagacacagaggauguacucucagcaaauuucaaguacauaauacaguauuauuagcuauagucaccauacuguaccuuauauccccagaacguacucaucuuagaacugaaaguuaguguucuuuuuucagcaucuccccauuuucuccauccccugccccaacaaccaccuuucauauucucugcuucugugaguucuacuuuagauuccauauauagugagaucauacauuauuuaucucucugucucuggcuuauuucacuuagcugucuuccagguucaucuauguuguugcaaaugacaggauuuccuuuuuuaugacugaauaauauuuuauuguauauaucacauuuucuuuacucauuuguggacaagcacucagguuggcuccauaucuuggcuauuaugaauaaugcugcauugaacaugggagugcagauaucucuuagagauccuaauuuuauuuacuuugaacauauacucaggaaugggauugcuggaacuuaugaaaauuacauuuuuaauuuuuugaggaauuuccauacuguuuuccauaauggcuguaccaauuccuuucuaaugauauuuuauuuuggucugaauacagaauuaauaacagaaaagccuacuaaauaagccuuacagaugccuagguagggcuuauauucuguguucuuuauauuaacuuauuaaauuaucacagguagccaggugcaguggcuugugccuauaaucucagcaacucaggaugcugagucaggaggaucgcuugaagccaggacuuuaagaccagcuuggccaacauagugagaccccgucucuaaaaaauaaaaaaguaacuggguguggugcacaccacaccuguaguuccagcuauucggaaggcugaggccagcaggaggaucacuugagcccaggaguuugagguugcagugagcuaugaucaugccacugcacugcagccugggugucagagcaagacccugucucaaaaaaauucucacaagaacucugugaaguaguuaauauuauuagcccuguuuuacagaugaagaaacugagguacaaagaaauguaaugacuugcugguagaauggauuuacaccuaggcaaucuugcccuagagucagugcuuuuaacuacugugcuagguuagcuggauauagauucuaccuguaauuuagagucucuuuauauaguuacuauaguuaauuugacugucaguuuguggcaugaaacuaaucuuuaccuuaauguguuauuagaucuaaaagaauuucuaauagucuaaugagaauauaugcaaaauucccuguaugucuuuuaauauauuauuuuucuuaacucauguuagggcauuacagucuucccuugguauccuccuauuuugugggagauuguuuucaggacacccaugaauaccaaacuccauagaugcucaagucccucagauaaaauagcauaguauuugcauguaacuuacacauaucuucccauacacuuuaaaucaucuuuagauuacuuauaauacauaauacagugaaaaugcuauguauguaguuguuauauuguuuuuuguuguuguuguuuauuuuuauuuuuuucaacauuuucuuucuuuuuuuuuuuuuuuuuuuuugagauggagucuugcuuuguugcccaggcuggagugcaguggcaugaucucggcucacugcaaccucugccuccuggguucaagugauucuccugucucagccucccgaguagcugggacuacaggugcacaccaccacucccugcuaauuuuuguguuuuuaguagagaugggguuucaccauguuggucaggcuggucucgaacuccugaccucagguaauccacucaccucagccucucaaagugcugggauuacaggugugagccaccaugcccagccuuuuucaauccacaguugguugaaucugugguuucugcauccccacggaggcugacuguguuuacuuuuugccauuaaaaaaauaauaucuagaagcuggaaaccaucauucucagcaaacugucgcaaggacaaaaaaaccaaacaccgcauguucucacucauagugggaauugaacaaugagaacaacauggacgugggaaggggaacaucacacaccggggccuguugugggguggggggagggggagggauagcauugggagauauaccuaauguuagaugacggguuaaugggugcagcacaccaacauggcacauguauacauauguaacaaaccugcacguugugcacauguaccuaaaacuuaaaguauaauaauaauaauaauaaaaaauauuuagcauuaaugguuucuuuugauuuuguacccugcuucuacuaaggcuauuuuuaaguuugccuuuuuuuuuuuuuccaaaaaaugauacaugauaguguuugcagagauuagccaccaauagauuuuauuguaaucuuguggggcauuucuuaugauuuaaaaaaaaaucuauaauauguauuuaaccaaguauguccugccuguguuuuuuguguggcuuaagagccaagcaucacuuuuacauuuuuaaauaguuggaaaaaaucaaaagaagaauaguauuuugugacaugugaaaaauuauaugaaauuugaauuucaguguuuauaaaguuuuauggaaauacagcuacagucauucauuuacauguugucuaugacuacuuuugugcuacaacugcugagguaaauaauugcuacagaccacauggccugcaaaaguuaaaauauuuauuaccuguccuuuuauagaaaaguugccaauucuugcucuagauuauuuacuuauguauugcaguuaacuguucauugucuuauuuaccuucacugaaauggaaacuccauaaaggcaagaaaucuuuguuuuguucauugauauaucccagguaccaaagaacagugccugccucaucauagcuacucaguaaauauuuguauagaguaaaaaauguaugaauuuauaaaaaaugaauauuuaauuuucaaaaugauaauagcuaauguuuauugaguacuaacaaccaugugaaauacagauguuuuauuauauccauuuaacaucaagauuaacacauuaagaaagaaaaguaggccgggcgugguagcuuauaccuguaaucccagcacuuugggaggccgaggcggguggaucauguggucaggaguucaagaccagccuggccaagauggugaaaccccaucucugcuaaaaaauacaaaaauuagccgggcgugguggcgagcaccuguaaucccagcuacucaggaggcugaggcaggauaaucgcuugaacccaggaggcagagucugcagugagcugagaucaugccccugcacucuagccugggcgacaaagcaagacucugucucaaaaaaaaagaaagaaagaaaaguaacuuacccaggguuacacaguuaaguaaugguagaacugguaucccauccuagagaaugugacuuuaaaacugguucacuaugacucuuaaaaugcauaauccgcacuacuuuuuauagaagauaguuaauucuguuauguauaguaggaauaauuuuguuuuaggagcuucuaugucaucuguuuugaugcucugucaucagaccgucauuccugcugauaauaggcaauaagacagcuuagauuauguuccauuuuaggaauacuagauacuuuagaaagcaagucuaggagguaugguguuaguagcuuuuccccuuucaucuacccgucuguuguauuuaaccuaaucaaguuucccucuuuaaaauuucugccugccuguauuuagcauacauauagaguaaugaaauuuuagguuuagaaggggccugguuuaaucucuucucuuuaaagaaaccgugauuugugcacauaucauuuuucugugucaccaggcccuccagaaugcaaaccaacaucuuccuggccuagugcacuuuuuauuauaccauuauaacuuguuaauuuaugaauuucuuuuauuuguacuuuaaccaaguguaagggaaguaugcugugugcaaaagugaauagggauguauuugaauauuuuuuauuugugcauauuugcacguauuuauuacacuuuucuuuuuaaauuuuuauucagcuuucuaaaaccaauuuuuccaacaacaacgauuuccgugcucuucugcagucuuuguaugcuacuuucaaggaguucaaaaugcaugagcagauugaaaaugaauacauuauugguuugcuucaacaacgcagccagaccauuuauaauguacauucugacaauaaacucuccgagaugcuuagccucuuugaaaagggacugaagaauguuaagguaaguugcaaaaauggauauucaacugucaaaacuugugccaucuucugguauaucauuggcaaaacuugucacuguuuuauaguaaaugauguaauguugaaaaaaauuauuuugucacuuguuaaagauggcaaggaagacuauuuaaaaagaacuacugcaguggggaguuugcaguaguggagagagaucagucccgacggugaauacaguaaggacaaguagggauuuauauccaaggggcaaagugggaagaguggauggaaaacuacugaggaaacaucaaggccaaggggauucuugcuagacuaacuauaaaauucuugcugaaggcaagaggauaguaacauauugaaggaucaguaguuugauuagauguagaugcagaucagauacuaaggcugagagauuuuucacuaaaccaauucagcaggauuuuugcugaaacuggacuaagccgaacaagaacagaguauaaggucaggccuaaguugagaagagggcccagaggagccugacucagguuuggugagagucuucaucaguuaccucuuuauuacuguuuaauaaaauuuuauaaugaaugcuacucaccaagucugaaagcuguuuuuguaagucgaaguuuuaauuauaaaauuuuuacauucuguuaacauuugcugaauucuuaaaggaaagcuauccaguuaauggugaccaaagguauaauuauuacuuagaaugaauaaacacuuuaauuuuauaaauuuuuacuuguuuuagaauugaauaccagccaggugcagugugcaguggcucacaucuguagucccagcacucugggaggccgaggcuaguggaucacuugaggucaggaguucuagaccagccuggccaacauagugaaaaccugucuuuacuaaaaauauaaaaauuuagccagacauaguggcaggcgccuguaaucccagcugaggcaggagaguugcuugaaccugggaggcggagguugcagugagcuaaagauauuacuggguauaguuuaggauaaugauguagagagacuuucuucuuaauuacauuuacauauuauaggauuuugaaauuugaucuuaguuuauuucccuucuggcuuggugaagcguaagcuuaaguuacaacucuguuaagccaccaugugcuccucaccuggagauuuauguucuggaaaggcuguucuacagcuuagggaggauggauuaaagauaaagaaaagacuaaaggaggaagaccauuauuaaaaaauuauucuaauaguuucuggaagaauacuuaguagcuacuugguggggaggugugggagguuugguugggguaggguacuagauaguaauauuaauagaagggagauuuacuuuuuuauugaauauucuuucguauucuuugaauuuuguaucauauuauguauugccacaugaauacaccuucgacaaaucugaacuaaagucaugacuaguagaaauaaaggggaggggaucagacuugagaauuauguaggaaauaaaauugauagaauguagugauuauacuuaaagggaggaugaaagaagagaaaagaaauaaaaaugaggauucagccugacuuucuagaguauauagaagagggucaggaaauaaaaaagauucauucuugacagauuagguuugaacugcuuguguaauccagaugggcauuuaugaauaggaggugguaaagauggauuucauggucagaagagugacccaguaugaaaaagcaaauuugauaguuauuauuagcauauaaguaggaauggaagccauguggauaugcuuagggaaaauguguaaagucguaagagaacaggacauuagacugaauauugggaagcaguugaauaaauuaguucuggaaaaagagaccagagaagacuuaacagagauaaaauauuuucauauuuuaaaaguuuucauaggcugggcaugguggcucauccguguaauucuagcauuuugggaggcugaggcgggcagaucacuugaggucaggaguucgagaccagccuggccaauguggugaaaccccaucucuacuaaaaauaccaaaaaaauuagcugggaguugugaugggcaccuguagucccagcuacucaggagacugaggugggagaaucgcaugaaccugagguugcagugagcuaagauugcaccacugcauuccagccugggcaacagagcaaggcuugucuuaaaaaaaaaaaaaaaaguuuucauuauuuuauaaauuuuccacaugcuuugagagggcugauauagaaguggggaaaugugauuuuagguuaugaggaagaaguuuauagcuccuuagaauugcccagaauuagaaugaguuacuucaagauauagugagcaccuugccuuuagaaguguugauauugauauauaugaccuuacaucaaauaauuuuuucuuuuuuuuuuuuaagacagagucuugcucugucacccaugcugaggugcaguggugcaaucucggcucaccgcaaccuccuucuuccagguucaagcaguucuccgugccucagccucucgaguagcugggauuacaggugcccaucauuacaccuggcugauuuuuguauuuuuaguagagacaggguuucgccgcguugggcuggcuggucuugaacuccugaccucaggugauccgccugccucugcgucccaaaguggugggauuacaggcaugagccaccgugccuggcaggauaauguuaacagguacaguugacccuugaacaacauggggauuaggguugccaacacccugugcuguugaaaauccacguauaacuuuugaaucucucaaaacuuuacuuacagccuacuacuguugacuggaagccuuaccaauaacauaaaacaaucgaauaacaauuauuucauguauuauauguaaaauauauauacuggauucuuacaguaagguaagcuagagaaaagaauguuacuaagaacaucauacggaagaaaaaaaucuauucacuauuuauuaaguggaaguggaucaucauaaaugucuuuauccucauugucuucacauugaguaggcugaggaggaagaagaggugggguuggucuugcuguugcaggggugggagaggcagaagaaaaucgguaauuaagugaacccgcacaguucaaaccuguguuguucaagggucaacuauauucugaguuuuuuaguggaggagacacuagaugaccauaaagggauucuguaaugauacaguccauuaggcuuggagauacauuaagagaacugacauguagaaauuauauaaauguauauaauuuauauauacaucaauaaaagcugugggcagauacgugcuauuuuuagacuuuuuaugauauuuuaaaaauaugggguuacauacauuacuaaaguaauucaaagcuuacuguuuuauggguaucuuuuauguuaaaaguacagagaccacuuugcaauuugucuauuuuuuuuuccccggagguuuuaugucacauuuuaaacuuccugggaccagacauaauuaaugaagcgaaacuuuuauaaaaauguauuuuuuuuuugguuuccagaaugaauaugaacaguuaaauuaugcaaaacaacugaaagagagauuggaggcuuuuacaagagauuuucuuccucacaugaaagaggaagaggagguaagcauaauuuuucuuucgugauuuagauuuauaacauucuuaaaauacuauuuugcuuuagagacucuucaaaauaaugcauaggaagauguaucugguugauggagagaagaacgcaguucuuuuugggaaaaaagaaaacccaagggaaaaaaaaaacguuuguuuuguuuucucagaaagguuguugcuuuucauugaauagaugauuuaauuaauuuacucaggaaauauuaauuuucuuuuuuguaaauggcucugucuuaaauauuaauaacuuaugcuacccuaaugucuuuucagaaccuuuagaggauucuuuaaacuuuuaaauauuuuuuuguuuucaugcuauguuuaaagauuuuuucauguuuuuuuuuuuuuuuuucaguaguguaguuuaguauuuaaaugguggcuuuaaauguauuagucuuggcugggcauggugguucacgucuauaaucccagcacuugggaagcugaggcaggacagaggauugcuugaacucacgaguucaagaccagccugggaaaaauagcaagaccucaugucugcuaaaaauuaaaaaaaucagcugggcaugguggcaugugccugucaucucagcuacuugggagcuugaggugagaggauugcuugagcccaagagguugagacugcagugagccaugauugcgccauggcacuucagccugggugacagagcaagaccgugucuccaaacaaauaaacaaaaacauuuauuaucuuaagccuacuguacauguauuaggguaucauugaaugaaugggcaaaacguuuucccuuuuucuucugucucuaauaugggaugaauaucagaguaagaaauagauaaauuauuuuaugaggaacggaauaccuguucagcuguaaaucaguuauuguagugauucucaacuauagcuucaccuuauaaucaaauugauauuuaaacaaacaaacaaaagaaaccccgauaguauuuuaagaccuuuucagacaaauuacaucagaguuaaaucagaggacaugcauugaccuggguauuuuuucagggccccccaacucauuguaauauacagccaguguugaaaccacugaauuucuagacugaccaguguuuuuuaacuguaugauauccaucacaauuaucuguggaagugaaaacaaaacaaaaaaagccuuguuuccaaccucuaaagauucuaauucuguaaauuggagauugagacuaagcaucuguuuagcagaagaaaucuccauagauaauucuuguaggaaccacuguucuaaaauaaugauuugagggaacauuuccaaaauccagaaacaauauugaaaaguuaaaugucucaguagaguucugacuuuuaugguuccacuacacuggguacuacucucaugugaggcagaggcccuguuuggguggaguucaguuacucuaguaccagaaggcaguuaacugaccuaaacaucuaacagaaugauuaagagugacaaauucuauaaagggaaagccuucugguccuuaugcuuuaaaauuguuuuggauugauuuacuagcuggagaaaccauaacaagaaggauuuauuuuauuuauuuauuuuucuggagacagaguuucgcucuuguugcccaggcuggagugcaauggcgcaauaucggcucgccgcaaccucugccucccagguucaagugauucuccugccucagucucucgaguagcugggauuauaggcaugcgccaccacgcccggcuacuucuguauuuuuaguagagauggcguuuuucuauguugaucagguuggucucgaacucccgaccucaggugaccuacccgccuuggcuucccaaaguucugggauuacagguguuagccaccgcgccuggccaggaucuucuugguguacucuucucugcaauuuuuagauaaacuaacucaguggugacagcuaaaauuuuuaucuuuuugagauauauggucauaauacgacauucgagccauuaauaauuuaaaaggguuuagaguaaaucaacacgaaugaagcaucuuuccucgugaauauuuuguuuaauuuagguuuuucagcccauguuaauggaauauuuuaccuaugaagagcuuaaggauauuaaaaagaaagugauugcacaacacugcucucagaaggauacugcagaacuccuuagaggucuuagccuauggaaucaugcugaagagcgacagaaguuuuuuaaauauuccguggaugaaaagucagauaaaggugagauucauauauauaaagaacaauuuauuaguuguaaggucauugacaucuuacugauaugaacuguagauuuugguugaggaauaauucaaguuaggccugcacuguggucaguuaaaggcauuauuuucauguaucaauuuaauugaagacgaugguucucauuuuagaauuuaguguugugcaugauaauuuaacauauacuugggacauauucaguguaguguuucuugaauaaauuuauauaugaaugaaucaaaauuauugaaaaccaccaguacagagcacuggccugcucaaaaucgaucagucaaaauuguugaaaacuaccauuacacagagcacuuuugcgauaucauccugcuuccugagcuuuauugaccauaguggcugcuuuucucuuuccuuguguuuuuuucauugguuuucaaaauuaguuauguuuauaguuuauuuucauccuuuccuauguauuauuuuuucagcuuguauccaguaauauucagaggaaugaguacuagaggcagaguuuuucuguauuguuacucugagaauacaaaugagaaaugcaaauaaaacgugcugccuuuuuuuuuuuuuuuaaaaaaacuaguuccucaguaauuauuuauguucaguagcuuugcuucuucaagauuaguggcagcagugggauuucuguuaaaauagcuuggaguuuuuugaaauugguccuuuuauuuuuauuuaacaaaguaggugaaaugcauguugaaacuaaaauaauuuuacaaguuaagcuauaauuaaucccguaaagcuuauaugccuuacuaugaaauguagcuugugcuuuagauaccaagcuaagacuuguuaugucugguuuaauuguaauuauaacaugggauuuaaaagcaucacacuuauuacauuuuauuuucccacuccuucaaagcaaauuguagcuguauuauauuuaaaauauuuggcaguuuaaaagugguaguuuaaagaaugugaucauagcauuucuauauuuaaguugcuuugugaaacaaaucagauauauaaaguacucaaauucuucauaggacuuuagugaugaaucuuuuauauuuuuuauuguaacacuucauuuucauuuuuauuuuggaaauuauuacugaaauaauacauuauagguuuauacauccauaaguacuuccugcaauaguugcugacaaaaguuucauuaucaaugugaaagaacaucagaaauaucuacauuuugucgucucaccugcaacauaaauaacugaaguaguuuaaagcaucucuagguuaaggcagucagauuucgcagaccucuuguaugaaaugugaaaaucaaagagggaauacaagcaagauuauugacaggagucauaaugcauaaauggaaaaggucaugagauuugugugugucauuaaaaaugccuuggagaucucauaaucuggcugacucuauacuuguugauuuaaagcuguauaaccuguuuuguuccuuuuucaagugaugcugcuuaaugcuacaaagugaguauuguuuuuucugugaugccuuuguaagaggaaguuaauucuguguucauuauuguagcucccacugaugaaguaugauuugggccaugauaguuuaacccuacugguucuucacaaguuuaacauccccauguuaccucuaauacauguuauuucauuuucacaucuugcaagcaggaaggaauugacuucaggcacuggauuuuguuuauagaaauguaauuguaauuucuuauugcauaugcucuuuagccuuuacugguaaaguuuuucuuuuuuauuucagaagcagaagugucagaacacuccacagguauaacccaucuuccuccugagguaaugcugucaauuuucagcuaucuuaauccucaagaguuaugucgaugcagucaaguaagcaugaaauggucucagcugacaaaaacgggaucgcuuuggaaacaucuuuacccuguucauugggccagagguagguaaauggguuuuuaaaauauuuucauguauuuuucuagaugaauauucauuuacauuaaugagcaaggccagagagagaaacucugagaggucaaucaaaaaguagauuuuauaguuagaugauguuuuggugguauauauuuuuggaaaacuagcagugaugaaauucauggguaaauuauaaugaugucuguaauuaaaaaaaauuaggaaaauauauuugugggaggggaugcaaaaagauugacaaaauugauaauuauugaagauaagugauagauacauggggauucauuauacuaguucugcuuuugacuguuuuucagaauuaaaaguuaaaaauucaauuaguaagcuuucaaaacugcuuuaaauaauuauguuuaauaauaauuauaugaauauuuuuaaaauacagaauaaauucuauaaaauuuaagggugauauaccauuauggcuccauuuuggugauggcucaaaauaauugugaaucuguuuuugccuuugaccuaucuuuauuugauugguaaugccacauucucugaaucacaguuucauauuaauaucauuauaguaaauuacuuucacaugugaacaguuaaagaaaauuuucuuuucaucaacauauaaugcaguuauggguuaaauacaacuaauauagcauacauuuuuucugucacugaguuaaaacaauuucugcuaggugaguuuuuuuuuuuuuuuuuucuuuuuuugaggcagaguuucgcucauguugcccaggcaagagugcaauggcgcgaucuugggucgcugcaaccucugccucccagguucaagugauucuccugccucagccuuccaaguagcugggauuacaggcgugcaccaccacaccuggcuaauuuuguauuuuuaguagagaugggguuucaucauguugaucaggcuggucucgaauuccugaccucuggugauccaccugccuuggccucccaaagugcuguaauugcagaugugagccaccagacccggcccaggggaauauuagcuucaaaauuuacauaauuuuuaaaaauuguuuucuguuuaugacuuuaugucugauuuaaaucaugagucugauuuaaaagcaauuuuauucauuauaauaauguauagcacuuuuuuuuuuuuuugagaugggguuuuacucucaccuaggcuguagcucaguggcacgaucuuggaucacugcaaccuccaccucccagguucaagcgauucuccugccucagccucccaaguagcugcgauuacaggcauccgccaccaugccuggcuaauuuuuuguacuuuuaguagagacgggguuucaccauguuggucaggcuggucuugaacuccugaccucaggugauccacccgucucggccucccaaagugcugggauuacgggcuugagccaccgugcccggccacguauaguacuuuuaaaauaagcuguuagauauuuuuuugaaugaagcuauuugaaauauuagguagacuuauaucgucuaaauaauuaguuguuaugugggauaauuuuuucuguuguaggauaaugaaauauuuaguaaaaaggcaaacauggaugcagaaaauauuuuuucuggcuuaaaaauuuuuaauuuuuaagaauuauuaagaauuaugucacgauuugauaggaaugucaaaugugauaaugcugugcuuucauaaauucaccuaaaucucaaauauacugcuuuuuucuguuuuuaauauguuaaacaaaaaguuccaauaagccugggcaacauacagagaccucaucucuacuaaaaaaauaaaaaaaauggccgggcacaguggcucacaccuguaaucccagcaguuugggaggcugagguggguggaucaccugaguucaggaguuugagaccagccuggccaacauggugaaacccugucucuacuaaaaauacaaaaauuagccaggugugguggcaggcaccuguaaucccagcuacucgggaggcugaggcagggagaauugcuugaacccgggaggcagagguggcagugagcugagaugugccauugcacuccagccugggcaacagagugagacuccgucucaaaaaaaacaaaacaaaaaagaaaaaaaauuagucagacaugguggcacaugccuguaaucccaguuacuugagaggcugaggugggagggaggaucauuugagcaugggaagucgaggcugcagugagccaugaucacaucacuguacuccaauccgggugacagagggaagacucugucuuaaaaagaaaaaaaaaaucaauagaaaucgguuuuuauuuauuuauaguaugugcuuugagugguucucaaucaaauugauuuuucccccuuccaggggauauuugaaauaucuggaggcauuuuuguuugccccaucuuuggguaucauauuggcaucuaguagguagaggccaggguuguugcuaagcacccuauaauccacaggacagcacccaaaaacaguuacccagcccaaaaugucaguauugucaagguugagaagccuuaauuuagauguaauguuaagaguucaguaaauuggccaggcacgguggcucacgccuguaaucuccuagcacuuugggaggcaaaggcaggcagauugccugagcucaggaguucgagaucaccccgggcaacaaggugaaacgcucugucuacuaaaauacaaauacaaauaaauuagccagguguggaggugcauuccuguuaucccagcuacuuggaggcugaggcacaagaaucacuucaguccaggaggcagaguuugcagugagcggagacugugccauugcacuccagccugggcggcagagugagacucugucuccagaaaaaugaguucaguaaauugauuccgcauaaucucucauuucaugaucauauaauuuaguugcaguacauucuccaggaucuauaaauuuauaguuuagcuuuacauuaaucuuucccuuugcuucuguucccaucuacuucugaacugcugacugguugacuacagaguagacaauccugcuuccuuuuaguuauuagcuguuaucauaaugaggcuauugugggaaccagugugaaaugacagcaggggaaauuguuugcucaucgugauuucuaaaauuuuaugcaagacuugauaaucauuaagcuuauuucuauaaaaaaguugaaaaacuuuuuguauagaaaguagauacauagcagguacauagcagacucuguacauuuuuguaguuauuauucuguuuccauaguuugaaagagaaagauuuacuuugggaaaauaugaacuuugguuaauugauuauuaucguuaaucgaacccaccugucauaguucuucucagugugucugaaauggaauccuuugcuuauuucaguguaacuuuuuuuaaccauaauuaaauauuucuaaaaaauugcccauugccugggcaaaaacuggaagcauucccuuugaaaacugacacaagacaaggaugcccucucucaccacuccuauucaacuuaguguuggaaguucuggccagggcaaucaggcaggagaaagaaauaaaggguauucaauuaggaaaagaggaagucagauugucucugauugcagaugacaugauuguauauuuggaaaaccccaucaucucagccccaaaucuccuuaagcugauaagcaacuucagcaaagucucaggauacaaaaucaaugugcaaaaaucacaagcauucuuauacaccaauaacagagagccaaaucaugagugaacucccauucacaauugcuacaaagagaauaaaauaccuaggaauacaacuuaaagggaugugaaggaccucuucaaggagaacuacaaaccacugcucaacaaaauaaaagaggacacaaacaaauggaagaacauuccaugcucauggauaggaagaaucaguaucgugaaaaugaccauacugcccaagguaauuuguagauucagugccauugccaucaagcuaccaauggcuuucuucacagaauuggaaaaaacuacguuaaaguucacauggaaccgaaaaagagcccgcguugccaagacaauccuaagccaaaagaacaaagcuggaggcaucaugcuaccugaccucaaacuauacuacaaggcuacaguaaccaaaacagcaugguacugguaccaaaacagagauauagaccaauggaacagaacagaggccucagaaaugacaccacacaucuacaaccaucuucuuucacaaaccugagaaaaacaagaaauagggaaaggauucccuauguaauaaauggugcugggaaaacuggcuagccauauguagauagcugaaacuggaucccuuccuuacaccuuauacaaaaauuaauucaagauggauuaaauauuuaaauguuagaccuaaaaccauaaaaacccuagaagaaaaccuaggcaauaccauucaggacauaggcaugggcaaggacuuugugacuaaaacaccaaaagcaauggcaacaaaaggcaauauugacaaaugggaucuaauuaaacuaaaggcuucugcauggcaaaagaaacuaccaucagggugaacaggcaaccuacagaaugagagaaaauuuuugccaccuacccaucugacaaagggcuaauauccagaaucuacaaagaacuuaaacaaauguacaagaaaaaaaaacaaccccaucaaaaacugggugaaggauaugaacagacaguucucaaaggaagacguuuaugcagccaacagacacaugaaaaaaugcucaucaucacuggucaucagagaaaugcaaauuaaaaccacaaugagauaccaucucacaccaguuagaauggcgaucauuaaaaagucaggaaacaacagaugcuggagaggauguggagaaauaggaacacuuuuacacuguuggugggaguguaaauuaguucagccauuguggaagacaguguggcgauuccuuaaggaucuagaacuagaaauaccauuugacccagccaucccauuacuggguauauacccaaaggauuauaaauuaugcuacuauaaagacacaugcgcacauacguuuauuguggcacuauucacaauagcaaagacuuggaaccaacccaaauguccaucaaugauagacuggauuaagaaaauguggcacauauacaccauguaauacuaugcagccauaaaaaaugaugaguucauguccuuugcagggacauggaugaagcuggaaaccaucagucuuagcaaacugucacaaggacagaaaaccaaauaccgcauguucucacucauaguugggaauugaacaaagagaacacuuggacacaggguggggaacgucacacacuagguccugugguggggguaggggacugggggagggauagcauuaggagaaauaccugauguaaaugaugaguugaugggugcagcaaaccaacauggcacauauauaccuauguaacaaacuugcacguugugcacauguaccguagaacuuaaaaguauuaaaaaaaaacaguugcuuauugccuagggcucagauguuuucucuuuguagagauuuuuaucguaaauagcuuaguuuuucauaauugcaggcaaucugauauuauuuugaaccuuuuacuuguuuauucauugaguaggugacugguauaguggucccgcaacugaacuugauacugaaccugaugaugaaugggugaaaaauaggaaagaugaaagucgugcuuuucaugagugggaugaagaugcugacauugaugaaucugguaagcuuguuuggaauuaaaauuauuacauaguguuuuaauaauugauaauuaaguacuuauaauuauuagguauuagauuuauguauuuuguguuuucuaaagaaacugguguuucuaagccuacuacuuuuuaaaauuugaaggaauaauaaugaaauuuuaaauuaauugaaguacuuuaaagagugcauaggauuauuucucguuuuuauauuaaaaucaaaaaucagaaaaugguaccuuuuuucuuaugaaaauaauguacguuuauuauagugcuuuguaguuuacaaugugauuuuagcaccacuucaagugaucaguugcacagcaucuauugagucaucuauggcuugagggaaauaggaugaaacuguugagucgacuuacucguuuguagauagucuuaauacuugccuaauaagguuauuguagaauuaagaaguaauauacauaaauauuguuuguaaaugguaagggauuacaaaaacuaauguagccauucauuaaacacugugggagaguucaaggauggauaagacuucaucgcuacuccaaacaacucacaaaugagagagaauuuagaaaacauaauuuuuaauuuaaaguauaugauggaaaaaugcugucauacuugugcagagagaugcuauuuggaagugugaggaggaaaacaaauucugucuuggauauucuagauaauaauuauuaaaagaugguaaaauaguaaaaaaugaacagaugagacauucuucuaguugguaaaacugaaacuauaggaaauuuuauuuauaaaguuacuugcuuaaaguaauuuggucuggcgaaagaauuaaauguggaaaaaagacacguggaaaguaacaguguaaguauaaagauuguuguaucagcagcuaaaguaguuuauuuuuaugaaacgcagaugugccacauuuugauguaaagauucaaaauguccuauauaaggaaaaggucuauucuaguuugauagauuuggugaugugcuuaccuguggcaggcauuguuuuagguaugaaggaucuaauggugaacaaaauggaaaaaagcaaaacaaaacuggcgcuuguugagcuuaaaauuuagagacaggaggcaaacaauaaauacagguaaaauauauuccauauuagauggugacaaguguuguagagaaaaauaagacaaggaaaacaugccaagaagaauuuaaaauugcaguuuuaaauugagcgauuaguuaagguccuuugggaaauuugaguaaagaccugaaggagaugagauauuugcucagaugucaacuuaaggaagucucaguuuauucauucuagaaaauuaauucauaauacccgugguaagaauguugaagguucucacaaauucaguguauuugucuccauacuugaagauagccagaggaaagacucaauuuccuucauauugaaaaggaaaaguuaacgcuguaaagauugagccuuuuuagauaauauaucuguugauuauuaaagacuaaacugucauuuacuucagugcuuuuuucgguuuggcugccuugucuuuuuacuuguccuaagaaguuauuguuuuucauagaauguuuaacuuucuuaaagauuucacaguuccaguuaccuugauuuaaucaucacacauuguauacagguuccauaguaucacauguacccccaaaauaugcauaauuauuguauaucaauaaaaaauuaaaaauuuaaaauuuucacaguaaauaguauacauuuagauagugagggccacagaaacaaaagaaugguuugggaauaaaauuauaguagggcucacuaaaguaauuuuuaucuccuuauauuuuaucuucgugugugugugugugcgugugugugugugugucugugucuggcuaaaggaggaauuuaggauaauaucuaaacaaggaaccaugaguaacaaauucuuuuaguugauauccuuuugucugcuauacuuaguuuuguuuuaaaugagacuuccuuaacuuauucuguuaaaucauuuuauguuuaaagacauucaaauuggucuuuagguaagaauaauaacaauaggauccugagaaagguaauacaauacaauuauucauucuuuuuaguguaguguguuuuuuccuuuuuucgaauuggaguuuaugguguuuucaugguggauguuacaguaguacauucuguuguaaacauccaagcuuuacagaaguuauuaaguaaaaccaaaagccaugcucauuuuuagcuucuuagaaauucuaaaguaccuuccuuugcuugauucauuaugaucaggcuaauuuaguugaguuucaaaucuuuucuagcuuugugcccuuuuuaguuauguggaaucagugauaguacguuuuacuauggaucauuuuucuuuugauaucauauuuucuuuucucuugaaaacuuuugcuguucuuuucaguuuucacauuuuuuuccaaaaccuuuucauugccuaaaaaugggaugguuuacauaagaaaguauaaggauagcacaaaguaugucauauuuaacaauuuggugagcgcuugaguagcuuaauuauuaucaguuuaucaaguucuuggacuuuugaauucauuuuacagaagagucugcggaggaaucaauugcuaucagcauugcacaaauggaaaaacguuuacuccauggcuuaauucauaacguucuaccauauguugguacuucuguaaaaaccuuaguauuagcauacagcucugcaguuuccagcaaaaugguauguuuaaauuaacacuaguuuggguauuaagaaaaacagcaugauaagaguuugguuugcucauuccugaguuuaauuaaggggaaacaaacccaaaaaugauuauugagugccuuccuauggguaggcauacacugcuagguuacuuauuauuucauugcaguucucacaacaaucuuuguagcauaauuaucauuaccuauauguuacagaugaggaaacugacuagaagagguuaaacauuuuauucaguuucacagauguuaagugauaaagcccaguuuuaugugauuuuuuaaauaauauguaaggcaugguaagaugggcaaaugagaugaaaucacuguuuuauaaaaguggauauuacgacuuccuacaucagaaucuugaguguuccuuaaaaauguaaaaauccugguuuagucucauaacugcuaaaacagauacuugggcgggugcgguggcucaugccuguaaucccagcacuuugggagaccgagguggguggaucaugaggucaggaguucaagaccagccuggccaauauggugaaaccccaucucuacuaaaaaugcaaaaauuagccagauguaguggcgugugccuguagucucagcuacucaggaggcugaggcagaagaaucgcuugaacccggaaggcggagguugcagugagccaagauacugccacugcccuccagccugggugacagagcgagacucugucucaaaaaaaaaaaaaaaaaaaaagagauucucagggauuugagcccagaauauuuuauuauacuuuuuucaaguauucaagugauuuuuuuuuauauucacaaaaguuugugaacuagauuauguuuacuaauagucaucuguuacuuagcuaacugaaguucugcagaucuuuacagugacaauuucuugccuuuuagguuaggcagauuuuagagcuuuguccuaaccuggagcaucuggaucuuacccagacugacauuucagauucugcauuugacagguuaguuauuuuaaacaauuuaaauauaaugaaaaacuauuuuauaagguuucauuuauguaauugcaguuuaaucauacuauuauuuuuuacuaucaaaucucagucaugucugaguauaauuugauagcacccuccaguucuucacuucuuacucauaggucccagcugauccaaaaaucccaucuguauuaucuugcaaucucuguaguccuauauuuugucuaggcccuugagcccugcugugcaaccauguagauugguauuauauguuuuuaagaaguuuuaguuuuaguugggcucuaagugccauuuggcaaagcucccucuuagauucuucacaguuacucugaaauaguauaguguaacuuucuucaagccaccuucuucccagaguauaucuccuugaccaccaauucucuguauuauugcucacucccucuuucccacccaacuauuuauaucagcaccuuuuuuccugcugcagaggaagagguauacucuucucgggcuaaagcuaaugcuccaucuuccuagagcuuguuucuuauggaucuuccucauuaaccgucgguuauucucuuucuuucauguguuugcagccuuacuucugcugacuacuuuuaggauaauaaacuuaagucuuccaauccuuacgccucucaaauccuacccuucuguuagguuaggaauacuuugacuuccuuauuacucucauugaguuuuuguaucccuagcaucaagaauaguaccuuaacaauagauaauucacuaaauacuuaagugauuauauuagaugucaaaucuuucuucugguuuucaucuacaugcauauagucaaaugcuuuugaaaaauuuaacaauauucauuaauagucuugucuuuuaauuauaguuggucuuggcuugguugcugccagagucuucggcaucuugaucugucugguugugagaaaaucacagauguggcccuagagaagauuuccagagcucuuggaauucugacaucucaucaaaguggcuuuuugaaaacaucuacaagcaaaauuacuucaacugcguggaaaaauaaagacauuaccaugcaguccaccaagcaguaugccuguuugcacgauuuaacuaacaagggcauuggagaagaaauagauaaugaacaccccuggacuaagccuguuucuucugagaauuucacuucuccuuauguguggauguuagaugcugaagauuuggcugauauugaagauacuguggaauggagacauagaaauguugaaagucuuuguguaauggaaacagcauccaacuuuaguuguuccaccucugguuguuuuaguaaggacauuguuggacuaaggacuagugucuguuggcagcagcauugugcuucuccagccuuugcguauuguggucacucauuuuguuguacaggaacagcuuuaagaacuaugucaucacucccagaaucuucugcaauguguagaaaagcagcaaggacuagauugccuaggggaaaagacuuaauuuacuuugggagugaaaaaucugaucaagagacuggacguguacuucuguuucucaguuuaucuggauguuaucagaucacagaccauggucucaggugaguuaucaguuccagaauauuaagaaauagacguguucucauuuccaaauggaauauaaaaauuuugaucuaagucauucuuuucaguugauuuacuuagcaaaaaggauuaaccaagaucugcccuacuucagaguuuuggagcaguguaacuucuguuaucaguaugaaguuucauuucugucaguucaaauccauugugauguauggaagaacauaaauucuaaaguuuaauaaauacuuaguaaauggcuacaucacauauuuuaagguacuuuaguggaugaagaagguacaauuuuuacucucaagaacauguaacaagaaaauaugcauauucuguugcuguguauuauuucuguauguuauaguuuuauacugaggguuuuggaaaacguaggcugucccuggaagucauuuagucugacuacacggcuguuaaguguuuacaaaagccaaagcugagcuagaguuucauauguagcuagaguuuagaaauuuuggucuuugaucaugaucagcuuaccuucuguugcuuuuuuaagucauaaagagaacauguggaagaaguucuacauuuucuuuucuguuuuuuuuuuuaauaagcauaaucuucagcagauuaaaccgacuuuuuuuuuuuuuuuuaaccuccuagaggaaagaagggcugaaggugacacaugugucagcccagacagguagcucuuuucagcagcuagguucuauauguuuuauaggacccaccucaagauuuguuagguuacgaguaugcacuguuggagaaaauaccauggugcacugacuugggagcauggcagacuugauguagauugauuuugcuuuuuucuguaugacuggcuuugugcaaaauacuuaaccuuauacuuugaggcuuauguaagaggaauauauauaaggcaucuaacaaugauacacaauagauuuucaauaaguggaaacugaugugcaguaaucgauuaucuuugacaugagccuuuggaaauuggauacaugcuuuucuuugauaaugggaugucagauauuuuauaaugaagaauucuuccagcauaaaacuuaauacucccuaccauuagaaaagauacuuaauaugaaauuauuacaggccgggugcgguggcucacgucuguaaucccagcacuuugggaggccaaggcugguggaucacgaggucaggagauugagaccguccuggcuaacauggugaaaccccaucucuacuaaaaauaaaaaaaaaauuagccgggcacgguggcgggcaccuguagucccagcuacucuggaggcugaggcaggagaauggugugaacccgggagacggagcuugcagugagccgagaucaugcugcugcacuccaaccugggcgacagagcgaaauuccgucucaaaaaaaaaaaaaacuauuguaaaauuuuuucauaagucauauacaguaaccaaaaguguuuuccccgagguaacugguauaacugugguuuggcugcugugaaucauuucauuaauuuucuguuuucucaaauccaagggcauauguuauaguuuaagaacauaagcaaagauaacuuuauucugaguuuuauucuuuaaaaaauuuuuauuacaugucuguauuccuaacuguaauaugauuuuguuuuugaaugcaacuugauuuuagaaaguaaaagcaauuuuuaguucaauuuaaaaccucguaauucauuuuucauugucauuuuuuuauuacugucauaccuuauugaaauuuauuuauagcucuauucaguuugcauuuucaguaugaccaguuuuuguguuuuuuucaaagaaugaaguaauacaugugaccuuucagagccgcaaugacuucugaccauguggcaguuuccuuaucuuuuaguuuuuuaggauguuuuaaaaaacccagaacuuacuaaaauuuuauauaauuaaaaauugauuucaagggcagucaaaauuuugaugaaucaaaauuuuguuuuuuuugcuuucaaaguauuuagaaacucuucuaguauaagguuuuggaaaacacuagaagggagcacacuuuauuuaaaagcagaauuguaacguuuuguuugaauaccaaagaguuucccuccccacuuccugaaaaggcagagaguuaauuucuuaagagaaauuugaagaaaagcagagaaaagguuuuuaguuguuauuuuaggguaugauuuuuggcacuucauuaacaaauucugauauuaucaaccuuagaacaaaguggauaauuuacugcuguugggauuggaaauaaguugcacuuauucuuuaggguuuuccugaguaguagugaagagcuugcaugugagguauucuugaaaagaaaguuugcguuugaauugaaggaaaaauucauuuugggaacaagggaacacguaggaucugucuuaucuguggcuaauugaaaaagucuugucugagugcagauucccucauuuuaauuaaaccuuaucuugaaggauucuuucuaaacauuuaaauuuucauugagcaccuacuacauuucuugcacuguucuaauugcuagaggucuagaguaacuaagacaauucucugccuucaugcaguuuguaaucuaaugguagaaauagacagaaaacauaguaucagacugaauguucugaagaaaaguaaaguauggguacuuuacuuaagaauacagagaaugccacuucauauugaaugaaccaggaaaggcuucuuugaaaagaaacaggcaucauuugaguagagagagagauaaaauuagggcauucuguguacauuuccugagagacugaggaaauagaaaauaaaaauuuaauuuuuagaagcaacucuuuuugcauucauuguaucgguuuaaaaaguguuucagucaaccaguuacaguaaguacaacuugugucaguagguuugaggaaaaaauacaacucauguaaacauacaacuuaauuuauaggaauagaaauguucagguauaccaguugggagcauucaguguauccugcuuuagucauuauguuuauucaggaugaguagcaugaguuuugacaaguugguaauguggagcuuguuaaaagagcauugaggcugggugugauggcuuacaccuguaaucccagcacuuugggaggccaacgcaguaggaucacuugagcccaggaguucaagaccagcccgggcaacauggcaaaauuacaucuuuaccgaaaagaaaaacaaaaaucaguuaggcaugguggcaugcaccuguaguuccagcuacucaggaagcugaggugggaggaugacuugagcccuggagguagagguugcagugagcugagauggcacuauugcacuccagccaggguaacaaagccagacccugucucaaaagaaggagcauugacuggagaauguuaaauugauaagguuuuaguuaguuugaaaccauagggaacagauagggccauuuguggucuuaauacauuauuuucuggcuuucauaggaaugaaaauaaaucuuggcuguuaauuaaaaauagccucuuaucuaaauuuuuaacuuucuuugggccccucauauaaguggaaucauacaauacuuguccuuuuguaucuagcuuauuucacuuaguguguuucaagguuuauucacaucguagcauguaucagaacgucauuccuuuuuauauaccacauuauguuuauccaucuguugaugaacacugagguuguuuccaccuuuuggcuauugugaauaaugcugcuaugaauguuggcauauaaauauuuacuugaauucuuguuuccauuucuuguuuaauucaguguacaaguccuugguuaaauuuauucuuaaauauuacacauuuugaugcuauuguaaauacaauuuuauuucuuaaacuuuucaaauuguucauugcuaguauauagaaguauaacugaguuuugcauguugauuuuguauccuacuauucagcuaaauuuauuaguucuaacauuuuuuuugugaauucauuaggguuuucuacauauaaggucgugccaucuacagacagauaauuuaauuucugauuuuccaaaauagacugccgagaccagcucggucggggagacccuaacccaguggcgcuagaggaauuaaagacacacacacagaaauauagaggugugaagugggaaaucaggggucucacagccuucagagcugagaguccugaacagacauuuaccaaaguauuuauuaacagcaagccagucauuagcauuguuucuauagauacuagauuaacuaaaaguaucccuuauggaaaacgaagggaugggccaacuuaaagaaauagauugggcuaguuaacugcagcaggaacaugcccuuaaggcauaaaucgcucaugcaauuguuuguggcuuaagaauaccuuuaagugguuuuccgcccugggcgggccagguguucuuugcccucauucccguaaacccccgaccuuccagcuugggcguuauggccaucaugaacaugucacagugcugcagagauuuuguuuauggccaguuuuggggccaguuuauggccagauuuuggggggcuugcucccaacaauagaccuuuuauuuuucuugucuaauuauucugacuagaauuuccagcauuauguuaaacagaaguggcaacacuguuuugauuauuguaguuuuguuguagguuuugaaaucaagaggugugaguuuuccaacuuuguuuuuccuuuucaagguuauuuaguaucugggguuccuugagauuccaucagaauuuuagggucgguuuuuucuauuucugcaaagaaugccauugagauuuugauagggauugcauuaaauguguagaucccuuuggguaaaauugacaacaguauuaagucuuuuaacccaugaaugugggauaucuuuccauuuguuuagaucuuuuuuaauuucuuucaguagucuuuuguaguuuuugguauccaaguccuuuaccucuaugguuaauuucuuaauauuuuauuuucuuugaugcuauucuaaaugggauuuuuuaaaauuuauuuuucagauuguuaauuguugauguauagaaaugcaacugaguguugugugugucgacucuuuaucuuucugaauuuucuuuuuguucuuuuuugagacagggucuugcucuguuguccaagcuggagugcagugacaugaucauagcucgcugcagccuuagacuccuaagcucaggugauccucuugccucagccacccuaguagcugggacuauuggcauguguacuuggccugcugaguuuauguaguucuaacagguuuuaggguuuucuguauagaagaucuuaucaucuguaaauagagauaauuuuacuuacuccuuuuacuuuuuugggaggguggggggaacugggucuuacuuguugcugaggcucaacucaaacucccgagcucaaaggauccucccaccuaagccugcugacuagcugggauuacaggcaugugccaccuugacauuccuuuucaauuuggaugucauuuauuucuuuuucuugucuaauugcucuggcuaaaacuucuaguacugugauaauuagaggugauaauaguguacauuuuuaccuuguucuaaucuuaagggaaaagcuuguaucuuucaccacugaauaugauguuagcugugaguuuuucauguauauggccuuuaucaaguugaagaaguuccugucuauuucuaguuuaaagaauauuggguuuugucacguuuuuuucucaaucaguugagaugaucauuuuuuuccuuuauuaaugugugauuuguugguugauuuucauauacugaaaguugauaaaaacccacuuggucaggguguguaguccuuuuaauaugcuacugaacucaguuuacugguauuagcugaggaauuuugcaucuguauucauaagggacauuggccuguaauuuucuuguuguguuuuuggcuuugauaauacugguuucauagaaugaauuuuauauuuguccuucuuguacguguuugggaagagguuuuuuuuugagacagggucucacucugucacccaguugggaaugcaguggugcuauuauggcucacugcagccucaauuuccuagugauccucuuaccucagcaccccccugccccaccacuacaaguagcugggaccacaggcgugugcuaccaugcccagguaauuuuuguauuuuugguagugaugggguuucaccauguugcuuaggcuggucucaaacuccugggcucaagcacucccaaagugcugggauuacaggcaugagccaccacacccagcccucuuuuggcagagcuugagaaagguugauguuaauucuucuuuuuuuuagagacggagucuugcucugucguccagagugcaauggcacaaucuuggcucaacuguaaccuccgccuccugggcucuagcgauuuuccugucucacccucccaaguagcugggauuacaggcacgugccaccacgcccagcuaauuuuuguauuuuuaguggagacgggguuucaccauguuggcuaggcuggucuugaacuccugaccuuuaggugauccaccugccuuggccucccaaagugcuggaauugcaggcgugagccacugcgcccagccaauguuaauucuuuuuuaaauguuuaguaaaauuuaucagugaaacuauuuuguuuuggucucuuuguugagaggguuuugauucaucuucuuauaagucaauucagauuuucuguuucuucuugaucaguuuggguauuucuugaguuucuggauuaugagaguaugaucuuuuaauuauuuucaucauuauuauauuuagucucauuguguugcccaggcugccuucagacuccuagguauaagcaauccucccaccucagccucuuaaaguguaguugggaauacaggcaugcaccaccaugcuggcuucuuaugaucuuuauuucuauaaaauuagugguaauauccucuguuucauuucugacuuugguaauuugugucuucucuuuuuuucuuaaucuagcuaaagcuuugccaauuuuauugaaauucucagagaacaaacuucugguuuuguuuuucuucauuaguuuuguauuugucguuuaaaaaauuuuugcucucaucuuuauuguuuccccuccugcuacuuuggauuuaguccauguuuccuuuuucuaauuccuuuuuuuucuuuuaacuuccaacuuuuaaguucaggguaucugugugagaugugcagguuuguuacguagguaaacgugugccauggugguuugcugcacagagcaucccaucacucacguauuaaucccagcauuuacuagcuauucuuccugauccucuccuuacucccacccaccgccauuugacaggcuccaguauguguuguuuccuuccauguguacauguguucugaucguuuagcugccacuuauaagugagaacaugcgguauuugguuuucuguuccuguguuaguuugcuaaggaugguuuaccaguuugcuaguuuguuaguuccagcuccacccaugucccuggaaaguacaugaucuuguuccuuuuuauggcugcauaguauuucaugguguauauguaccacguuuucuuucuuuuuuuuuuuuuuuuugagacauggagucucacucuguugggcuggaguacaguggugcgaucuuggcucacugcaaccuccaccucacagguucaggugauucuccugucuuagccuccagaguagcugggacuacaggcucaugccgccauaccugguuaauuuuuuuuuuuguauuuuuaguagagauggaguuucaccguguugcccagucugguccagaacuccugagcucaggcaguccaccugccucggccucccgaagugcugggauuacaggcaugagccacugugcccggccuuguaccacauuuucuuuauccauucuaugacuuauggguauuuagguugaguccaugucuuugcuauugugaauagugcugaaauaaaaauaggcaugcauaugucuuuauaauagaaugauuuauaguccuuugguuauauaccuaguaaugggauugcuggguugaauugcugcuucuuggucuuugagaaauugcuauacuguccuccacaaugguugaacuaauuuacacucccaacaguguaaaaacauugcuuuuucuccacaaccucgccagcaucuguuguuuuuuugacuuuuuaacaauagccaucuugggaaagaggcagcuugccacugcaggcucugugagacagcugaaaaacugagugcccaaagugugacagggaaaugucugccucugaacacaacauccucacuggggaaccugaaggucuagauaacgggagaaggauuugagcuuaccuggagcugagaugaauuuagagagccgggcaaaauacagggguagaggaagcaguggggagaucccugugggcauucuugguccccagggaagucauuucugacuuuuucuugcagagguccuuggggagggcugucacuggaauuggggaaagaccauagggagaaggaaacguccagcugaacuuuguuguaacaguuucaauugaaugggauguuuccuggacagaaucugagggaagggaugaaaggggaguucagauacgagcacagaagccauggcagaugggcaggcaugaaacuugaaagcccugcuugcuuucucaguggggaggcuuguagucugggcaagaucuuagcccugcucaccaguugccugguugagggggcauggugcuguugggggugagaccugccuuuugggcugugugggaacugggugaggccugucacugccagcuuucccccacuucccgggugaccuguaugacagagcagaggcagccauaauguguccggaauugguggguucuuggucucacugacuucaagaaugaagccgcggacccucgcggugaguguuacagcucuuaagguggcgcgucuggagucugucccuccugauguucagauguguucggaguuucuugcaucugguggguuuguggucucgcuggcucaggagugaagcugcagaccuucgcggugaguguuacagcucuuaaggcagcgcgucuggaguuguucauuccucccgguggccucguggucucgcugggcucaggagugaagcugcagaucuucgcggugaguguuacagcucauaaaagcagcguggacccaaagaaugagcaguagcaagauuuauugcaaagagcgaaagaacaaagcuuccacaguguggaaggggaccugagcggguugccaaugcuggcuugggcagccugcuuuuuauucucuuaucuggccccacccacauccugcugauugguagagccaaguggccuuuuuugucagggcgcugauuggugcguuuacaaucccugagcuagauacaaagguucuccacguccccaucagguuaguuagauacagaguuucgucacacagguucuccaaggccccaccagagcagcuagauacagagugucgauuggugcauucacaaaccuugagcuaaacacagggugcugauugguguguuuacaaaccuugagcuagauacagagugccgauugguguauuuacaaucccugagcuagacauaaagguucuccaaggccccaccagagcagcuagauacagagugucgacuggugcacucacaaaccuugagcuaaacacagggugcugauugguguguuuacaaucccugagcuagacauaaagacucuccacguccccaccagacucaggagcccagcuggcuucacccaguggaucccacaccgggguugcauguggagcugccugccagucccgcgccgugugcuugcacuccucagcccuugggugguugaugggacugggugccguggagcaggggguagugcucguuggggaggcuggggcggcacaggagcccauggagugggugggaggcucaggcauggcaggcugcaggucccgagcccugccccgcaggaaggcagcuaaggcucggugagaaaucgagcgcggugccggugggcuggcacugcugggggacccaguacacccuccgcagccacuggcccgggugcuaagucccucauugcccagggccggcagggcuggccggcugcucugagugcggggcccgccaagcccacgcccacccggaacuccagcuggcccgcaagcgccgcacgcagccccgguucccacuugcgccugucccucuacaccucccugcaagcugagggagugggcucuagccuuggccagcccagaaaggggcucccacagugcaguggugggcugaagggcuccucaaaugccgccaaagugggggcccaggcagaggaggugcugagagcaagcgagggcugugaggacugccagcgugcugucaccucucaauaauaccugugggaacauaacuccacccauaccccugggaauauaacuccacuggccugggaaccauaccuuaaucccccacagcagccgcagcaagcccugcccaaggacagucugagcucagacaugaauaacccugcccucaccuaauggucuuuacccacccugguagccaaagaccaaggacauaaucucuugggagcucuauggcccugcccacugccugagaaaccugaauacuuacccaggugaccccagggcaaacuuguacccucccuauacuacugcagcugaugcuuucuugaaaguggcaccuccuggcuggaggccaaccagcacacuaaagaaaaccacaaacaaggacccucacagaguccacuucacuccccuccuaucuccacuggagcaggugcugguacccauggcugagagaccugaagacagaucccaucacaggacucaucacagacauugcccaguaccagccuggaguccaguagcucugcuggguggcuagacccagaaaagaacaauuacagcaguuuggcucucaggaagccccaucccuaggggaaguggggagagcaucacaucaagggaacaugcuugugggacaagagaaucugaauaacagcccuugagcuagaucuucccucugacauagucuaccccaaugagaaggaaccagaaaaacaauucugguuauaugacaaaacaagguuguuuaacacucccaaaggaacacacuagcucaccagcaguggauccaaaugaagaagaaaucucucaauugccggaaagaggaaaucagaaggucaauuacuaagcuacuggaagaggcaccagagaaaggugaauagaaacuuaaagaaauaaaaaaaaaaacaaaaguuauaagauauggaugggaaaauccccagagaaauuuauagcauaaauaaaaaacaaucucagcuucuggaaaugaaggacacacuuagagaaaugcaaaauacacuggaaagucuugacaauagaauugaacaaacaaaagaaagaacuucagagcuugaagacaaggcuuucaaauuaacccaacccaacaaagaaaaaagaauaaaaaauaaaauaaaaugaacaaagcuuccaagaaguuugagauuauguuaaaugaccaaaucuaagaauaauugguguucccaaggaagaagagaauucuaaaaguuuggaaaacauauuauuugagggaauaaucaaggaaaacuucucuggccuuccuagagauuuaaacauccaaauacaaggagccaccuuuuaauuuuauccuauuuauguaaauacugcuuuuauucuucuagggugugccauuagguuuuauuuuuuauugaaauguaauuaacauaccauaaaauuuacugcuuuuuaaaaguauacgauuaauucagugauuuuuaguauauuuacaggguuguucaaccauccaccacagacuaauucaaaacauuuucaucaucccaaaaagaaccccauacuuauuagcagucacuucucacucccccuuuccccagccucugauaaccaugaaucgacuuggugucucuguggauuuaccucuucuggaaugauaauauuaauggaaucauucaauauguggccuuuaguaucuggcuuuuuaaaauuagguuuauguguucaagguuuaugcauguuauacuaugugucaguacuuuguggcugcagaauauuuaauuguauggauguaccacauuuuauuuauccauuuauuaguuaauggacauuugaguuguuucuacuuucuaacuguuaugaauaaugcuacuaugaacauucaugugcaaguuuuuguguaaacaugguuuuaauucucuuggguauauaccugggacaggaauugcuggaucauaugcuagguguaucuauaauuuuuuuuuuagaaacugcccaacugcuuauuagguuuuaagcuucaguaauuuucuugauaauuuuuacuuacuaauacaguuggguaggagaaugaacauuacaacuccaggguucaguacuuccucuaagaauugaguuaccaugauguucuuauaaagaacaguuuuauagauuucuuuauugaauguuguuaggaaaaauguugaacauuuucugaguuaaauguauuucugccuaaggaugagguuaguuaucaguguuuuacagaaauucuuaaauuuucucauuaccauauugaaaaguauguaaaauagugguucagugaaccauaggaauacaaacauuuuuauagauuaguaucuucuaauugucaaauuauuuuucuuacaggguuuugacucugggaggagggcugccuuauuuggagcaccuuaaucucucugguugucuuacuauaacuggugcaggccugcaggauuugguuucagcauguccuucucugaaugaugaauacuuuuacuacugugacaacauuaacgguaaugccuuuuaacagugcgauaauuuugaaggaauuaauuuaaaauuuuuuuuagcaguucuaauaauuuuuccauuuaguuuucuagauuucuaauucccagacuaucuuacuuucagauuuaguuaaauuugauaaaauuuuaaaauuacauuuucauuaauuaacaucuugaaagguaaguuuuucuugcagauguauauucuaaauauccauugugucagauuuuugagggauguaauaguguaaucaaaaaugguaaguuaauagaaauacuaaaauucuuguuaaaaguuuuagguauuccucuagaguuuuguagcacucauuaagaauuuagaacuauuuauguucuagauacacugauuucuuagggauaauagagucuuauuucuuguaagacagcuuuaucaaauguagaaaaaugaggacuuugguaauguggacuuccagaguuucuggaucugaugacaacucuuagcaaagauugaggggagaggacaguauguaguauugagaagagucugagaugcuuuagacaugacuagaauuccuguaguauuuuggaaauugauuccugaaccuacuuucaaaaaucacaagaaauacuucuugauuuuguucuuuuaaacauauucuacccuacaguggucuuauugaacaugcuuuuucaaaguauguucagugccuuuuugcacauuugauagucacugguagagacugaauuucccagaagcauaaaaagcugcucuucuguuauuaguaagcaaaucaaccuccuguauuuauaacuggagaaaauuuuagauggcucagacuacuauguaccugucuuuuuauacugcgcccuauugucuuugagugcccaguucaccuuaagaugacaggaaaaucaacaaaauuuuucucaggcagaacaauugacaggagucaggaagaccagagggaguaaugacauaccgcaaaauggagaaaacugcuauuucucgagauuagguuuuccuuaaaauauauaagaggaaacuggagaugguagcucucuuauuucaggaaucacauuguuaugcaggagaugaccucccauguucuugauauaucagcacuaaguuggacauuucuuuguuuucuguugccuucuguguauaaucaaggaauggccaaagugaaugucaucauaguuggugaaagugaaugucaucguaguuggugaaagugaaugucauuguaguugcaacaugcuaagccuaugaaaacaaaguuugauugaugcagugaagcuguuacuuuuguggaugcuguggauuugagaacggaguuuuguuaacauaaaguuauuuuauuguagguuuagugcuauacuuccacuuccuaaggcuuauaggacauauuaucaagaguaauuaauaagcaauuguuuuuuaucagaaaaaauuuuauuuguauguugcauuugaauuuuucauauugauuucagcauagguuaugcuuuggaauaaaucucacuauugaauucauuauauuuauuuuuggauucauagauguuauuggguagagggaggggacuggguuucaguuuguuuuuaugcuuacuuguuuuauguuuguauguuuuuaaacuuugaaauaauuuagaugaugggauaaaaugaaauaauuaaaaucuuuugcacuuuguccuuaugcauuuccucuaaacuuguuuugaauauauaguuucagaggagcuauuauauuccuuuuguugaauguaaaaguuuuuuuggauaaaugauugauuuuuuaaaauaaaugaauugugaugaagauaucugacuuugaaagauuugaaaggaaauuucagugcuuguauaauccaauauuaacucuccuuuuauagcuuauugaagcaugauuugggggaauggaaagccuuuaaaauuuacagggugacuuguuaaauaacuugugucugaguuccacauagguuguucuuaaagcaaugcucucucauagucuuuuccuuaaaaggauauguggacaaccuagaaaguguuagaaagaaguuguguuguauccaguuuugcaagaugacacuuguuccaguaucuuucaaaacagcucagcuuguacaguagauaucuagugaaugcucaggggcauccuuguuacuauuuuuauuauuucugaaaguaguguguuuuaauacgugguauuagagcaauggagaaguguauuuaggugacaaauuauauuucaaauauuugaaagugacguuuagcuaaaaauauauuuuuuaaaagaaaacauauauaguuaacuaucagguuacuaaauguaaaagaaguuaauacugauaaacauuagucauuaaguaauacaugauaaguaaagcagaaugaucuauuuuccaagcauuagcagagauuuuggagauaauaaguuaguuaucauauauucaaacagugcccaguacagugcaagacacuguacauaaagugucuugauauaaaaugcaagucuagauucuucugaaugauucuuuaugacuuuuaaauuuauuugauaagauuugaaaagucuucuuagccauaacauuaaaaaauuucuuuaacauuuaagaaguguuaaauggaauagcauaguuguagagcugugaagaacauuugagcaaugauagcaaauaaacuuuuuuacugauuugcauuucaauguauguauaauuuauaaauuaagauagauuagcucauaguuuuggaggugacacagucucagaugaugugcucuuuuauguuucuaauuuaaguuaaagaggaauuaaagguaagugaagguaagugcagauauacagcauaaguaauauacuuagaacucaguaaaaacaaguuauucaauaauaaaagucuggagaaauaauagcuaaccuuauacuuccuaucaucugauacuuaaaaaugcuuucuuauaagauuauucuuuaccacgcauuuaaauauuuuaaugauuauucaauuauauuuuucuauuuucuuuauuauuccuuaauguaauuuaggcuuuauauaucuuaaccauuuggguucuguguccuacaucgagauggaaguuugcuggugauaagucaaauauuuaaagggaacuaccuugugaauuaucuucgucuguuaaagcauagcugucuaccuggcaauccaucauaucuuagucauauuucuuucuaguuuucccucaccuuuucuguuguccauuuauucuguuguccauuuauucacuucucugaacaguccuucuguguuacuuaaggauuuuauuguuaauguugcuuauacuuuccaugcuuuggaagguguuagucuccuguuuucuacaaugugauacugaguuuaaaacagugcuugucuucauuuuuguuuuggcucaggccuucagcagauccuuuaaugggugcugucacuuucaugauuauugggaucaaauaccaguaacuacucuuauuauuuaccuuaucauaggauuguaguuuugagucauuuaauacuauaguuacugauuaaguucauauagccuucuuuaaacagauucugcuuucaaauuugaaaacaauauauucucucucuucacucuguauacuuagaaucucacugaaacucaauucuggugaacuuaaaauguauucagaguucuugccuauauucauauaaaaugugucuacucacugaguagacacauuuuauaugaauauaggcaggaacuuuguuuugugauaaauaaggagaugcugacaguagguuugugcuuuuuaccuaauacaggguaaaaacuuuuauuucuacauuuuucuucccccauuaucucugccaccaucccuuagacuucaggagcauaaugacccagguagcuaggguggaaacugagcauguggacccuacaucuuuuggggaggguggugaaaaacugugucaugucagguuagaucugaaucucuaggagaauagcuuuuuugaucuguuugcuccuuugagucucccuuuuacuuuauccuuugaaaaccaauugcauacuucacuuccauugcuuccagauauggcauauuuuucuuaggcuacuguugaaauuuagcauaauauuucucccuuaccuuucuguccuuuuaaaaaaauaggacuauaguaaguccuccgugucggugguauguuuuuggaaacugacuuuaaagaaaacauacaggaaguccucaaauagugucauuucauuauaaugaugcaaacaaaacaacuaccuuuguuauacguuauuuugcuuagagucgcaguuucuaagaaccuaucgauguuaagugaggacuuaaugguauagacauuuugaaauauuugagggaguugcaguuuggaaaaauuguauagagucuucaugucucuucuuauuucuuuaaaaaaauuuagaauggaauuuuaaucugauaaaaugauaaucagauccauuuuggcaaaacccagugaaucuggcauuucaugauggaccuaagggucagagcaggagaauggcagugaggcagggcuugugucuugaggagaggcacuaggugauugguagacaaaacagugggcaguguaaggggugaggaaagacaagcuaagaaggggaauaauggggauuggguggugcacaguggguaaagcuggcauuauauucaaaggaaaaacuugguuaaagauuggcagugggagaagaauuucagaucauaggguugcuucucagggcauuuuuaauaaguauucaauauauacuaaaacauuuuaucuugaguuugugauuaagaugauuaacauuguuucuuauuuuaagggaaaauaauuuuaacaaaaugcugcuuugugaauuuuaaauauuuaacauauuuaacuucucauuuaaagaccagaaaagauuguuauuuugauuaaauaaaaauuggcuuuaguaauucaacuuuauauuuaaaauaauuuuaaacuuccuguuauggaaaaauuuaacaucgaauaauacaacgaauccucauguaccaucagcuucagcaguuauaaaccugugggcagucuccuuucaucuauaccauugcucauucccauaucuacuccgccauuaagcuaaucacaggugucauaucaacuuaaaaauuaauaugacugaaagcauaagcuguuguaguuccacauauuugcguaauguuuauuaguuucuuuccuaagacuguaugucuuaagaaauuugcccuuuguauuuuguaugugccauuuggggaauauaaggaaaaguuaaauuucuggaaauuaauguguucuauguguuuaguuggaaguaauuguuaugguaguauuagcuuacuugcuuuuuuguuguuguuguugcagccgagugcuguuuuagaaaauaaaaaguaaauuuaaaauguguuuuugaguuaagcuagauaucaccccagaguacugugauuuuucaguuacaauccauuugauauauucugcaguaaaauuauauuucauguacaguuuucauuuuguauuguuccuuauaucacaauugcaaguauuuugguuguucuuguugauauguaaagaacaaauuaacuacuccuuauuuguucaugguauagacauaaugaaagacuucaauauaguugaaacaaucuuuuccacauuugccugcuuuuaugaaaauaucauucauucagaguacuugacauuugaauaugugcugugaaacuucuucuuugauauuuucuaauucucagcuauguucccuaaugggucuuguaucuagugccuggguagcauagugugacugggauaaaaugucaguuauuccacagauuuuuuuuuauucuuuguaagugaaugauaauuuuuacuauggcuacaguuuaauugaucacucauuauauauuuaauuuuggaaaauaauuucaucuaacccuaccauauauagauauuuuuggcuacaaauacuaaauaaaaauauggcaaauauauuaaaucuuugucuauauaguuuauuuugcuuuaaaauuugaagauaauauuuauuguaauugcucaauacugacuucuuuagcugaucgauuauaguuagggcuguuuuuugccuuuauuacauuucuagggaggauguucagauuauaagaaucuuuuuauaaguuagcuuggcaaucuugcuucuguggauugucucauuuccauuuuggauuuuuauauuguaaguuguugcuaaaaauuauuuuuuucccuucuuccacuuaccuuuuggaccaugaaggauauauuaauuaaagucaagcugcuauugaguuuugugucugaauaauuucuuauacacuuaucaugagauuuacuucuaucauauaaguacugcuaguaaaaccaaugaauguuuaacuccuucauaagcaaaauuauuuuuaugugaucucuaagaaauuccuccuuucacauuuuucuguuuucauacagguccucaugcugauaccgccaguggaugccagaauuugcagugugguuuucgagccugcugccgcucuggcgaaugacccuugacuucugaucuuugucuacuucauuuagcugagcaggcuuucuuucaugcacuuuacucauagcacauuucuuguguuaaccaucccuuuuugagcgugacuuguuuuggccccauuucuuacaacuucagaaaucuuaauuuaccagugaauuguaauguuguuucucuugcaaauuauacuuuugguuuagaaagggauuaggucuuuucaaaagggugagaacagucuuacauuuuucuuuuaaaugaaaugcuuuaaagaauguugguaaugccaugucauuuaaaguauuucauagauaauuuugaguuuuaaaguccauggaggugauugguucucuuuacacauuaacacuguaccaagcuuugcagaucuuuuccgacacacaugucugaagacuuauuuucaaagacagcacauuuuuggaaacuaaucucuuuuccguaauauuuccuuuauuucaaugauucucagaaggccaauucaaacaaacccacauuuaagguucuuuaggauuauagaauaaauuggcuucugaguguuagcucagugagcuaggaaagcaccaaucgauauuuguuuccuuuagggauacuuuguucucaccacugucccuaugucaucaaauuugggagagauuuuuuaaaauaccacaaucauuugaagaaauguauaaauaaaaucuacuuugaggacuuuaccaaguaauacuguuguguugugauuuuuauuauaaaucucaauccagguuuacuuuaguauagaauaggacuacauacuuugucuuuggaccucccaugaacuuauuacccugacaaauaguuuuagacagauacugaauuuuauugagcugaauuuucuuuuugaaaugaguuauucaguagucaaaauuugaauccguaaguauaucuacuuugcuuuguuaaaacaucaugagaguggaggccugccacccagaaaggcacauacuagugccuuuuaguacaauuuuaugucauguagaagaaaauggcaauguuccuccuauugauacagauacaggcauaugucaucuuauugcguuuugcuuuauugcacuuugcaaauaaugcauuuuuuacaaauggaagguuuauggcaacucugcguugagccagucuauuggugccauguuuccaauaaaacuucuccuuucaugucucguauauugugauaauucuuggaguauuucauaguuuuucacuauuauuaaaucuguuguggugaucuguggccagugauuguuguuacuauuguaauugcuuuggaaugccaugaacugugcccuaauaagacagagaacuuaauugau

SEQ ID NO: 191469 - RNA, 9888 nt, Homo sapiens
caaacauggcggcuccacuaggggguauguuuucugggcagccacccggucccccucaggccccgccgggccuuccgggccaagcuucgcuucuucaggcagcuccaggcgcuccuagaccuuccagcaguacuuugguggacgaguuggagucaucuuucgagguaauauaagacaugggcgucuuugucccuagccuucccuuuuuucugaaacgugaacugcgcguacgcguaucuccuccagggauccgagcaacuaauucacaaauggggaaacugaggcuuaaaguaagucacuugcuuuaggcuuccccguggcccguauucaauucaggucugcuggcgggggcgcguaaacucgacguuuguggaaacgugaacccgaaguuugccuaaaccccaaacuuggaacccuuccagauucccagccgguccuuagucucauccccgagcaccguuucuugcaucccugcauguuuaguaagaggcucaagccuuuucggagcugagaguuucacugcuguauccuguauccuuuccgcugggcuucaccuuuaaacgauccuaaagggacucuuaagagcggaaauugacuuaaguuaccaggcgcagcuugguacuaagagcugaggaaggaggaaugcuggagguuagggagggagggaggcacaggugacccaaucucucaguuuugcccaaggaguuuaccuuguagcaagaaaggugaacuguauauugagggaagauagagaggugaaaauaagugcucuggugauuuccaguagucuuuaaaguggaagaugagcuauuccuguguaguaauaaaguaauguacguucaaauuggaguuaacuuuuccacauuuuaaaucccaguuuugccgggcgcgguggcucacgccuguaaucccagcacuuugggaggccgaggcuggcggaucaugaggucaggaguucgagaccagccugaccaacauggugaaacccugacucuacuaaaaauacaaaaauuagccaggcgugguggcgugcgccuguaaucccagguacucgagaggcugaggcaggagaaucgcuugaaccugggaugcggagguugcagugagcggagaccgcgccauugcacuccagcgugggugacaagagcucgacuccgucucaaaaaaguaaaauaaaauauaaauaaauaaaaaucccaacuuugugacuuuuguauuguaucuaauagcacagugguaaaugaauauaauuugcaagcgauuauucagacugcauggacaaaaugcuuuuaccacacggauguacaaagauuuagaaauaaaugauuugagauggagucucacucucucgcccaggcuggaguacaguggcgcaauuucggcuuacugcaaccuccgccucccggguucaagcgauuuuccugccucagccucccgaguugcugggauuacaggcaccugccaccaugcuauuuuuuuuauuuuuuaguagagacagggcuucacuaucuuggccaggcuggucucgaacuccugaccucgugauccacccgccucggccucccaaagugcugggauuacaggcgugagccacugcgccuagccagaaauaaaugauuuaaaggacagaccguuuaggaggaggaggaggagacaccuuugagguggugcuaagugguaaaggaaggggcuggugaacuuuagagcagcaucuagcauugugcuugaggggagcuggcucucagucaugggcacuugcugaaagacuggcccuguacaagucuuagccaaaguugacucccagcacccugcugcuuaaaaacguacaguggcugcuuguugcccuugagauaagaucaagauguuuaguguggucucccaggcuuugcauguugcguucucuccuucagacucguuuccuuacugcagccacacaagacuuucccacguguaccauuuguuuucucuuugggcuuccaggccgcuccucagcucacugcaucacuuccucaguggacccuucccuggccuucuuuuuaauacuuaccauuaaauucggcuccaugaagucagagacuaccuguuuuguacccccaccccucacauuguguaaccuguagugcuaauacagugguaguagauagcaagugcuagaugaauauuugucagacauugaaggaaucuguaguguggagccuguaguguaguuggcuugugcacagaacuccuugccugauucacauauaugucuguaggugcccuugagagagaacucccucugggacuugauuauccauacagagaauacagagaaaaccagucccugccuucaggaagcuuguaauaaacggcaggcaguugccuuguuguaggaucacugcucugauagaagaaaccugggguacugugggagcacauauagguguggacaucaaagaaggcuucccagagagcaggaaagccaaagaagcauuuugacuuagccaggugaaggggagugggaguggugcgagcuggauccucucugcugcugggugaucacgaucugucuagucuugucucacgauucaauucaaaggccacauuuucuuuggaacuuuuccuguuuccuuccuuguguucuguguggaccucaauuuucacagccuccaguggcacauagcagcaccuacuuaccugcuucucauuccuauuggggugccacuccuugaggucucugucugcucauucuagcugcuuagcacaugcucuuugauggaaggaauuuauugagcucaugcacucuugauuuuggagggaacguuggagaccaucuaguuccauuuccuccauucauagguagagaaacugaggcucagugagggcaaguuacuugcugaaagccagccguuggguuuguggaaaugaggacaagcacuuacuuuccaggcaaaggcucuguuuuagccaugcuuuuaaaaagcuguucucuuucuaggcagaugcgguggcucacgccuguaaucccagcacuuugggaggccaagguggcuggaucacuugaggucacgaguucgagaccauccugggcaacauggugaaaccccaucucuaacuaaaaauacaaaaauuaguggucucugguggcacacgccuuaaucccagcuacuugggaggcugaggcaggagaaucgcugaaacccgggaggcagagguugcauugagccaagaucgugccacugacucuagccugggcaauagagugagacuccaucucaaaaaaaaaauauauguucucuuucuaagcuaccacacauuuucuucuuaauacagcuguccaacugucuauaaaggccuguguaucuuuuuuuuuucuuuucuuuucuuuuuuuuuuuuuuuugagacagagucucacucugucacccaggccagagugcaauggcacgauguugggucacugcaaccuccacuuccugggcucaagugguccucuugccucagccuuccaaguggcugggacuacaggugcgcaccacuacgccugacuaauuuuuguuuuuguagagacaggguuucaccacguugcccaugcuggucuugaacuccuggacugaagugauccacccaucuuggccuccaaaauuguugcuuacaggcgucagccaccaugucggacccuaaauuuuuuucuugaguggguggagggcaguaaaauucuugagaugagauuuccugccacccugucugguaggccuccuggcucaggggagcuggcccaacuuuuuuggccaguuugugacugguuggccuauuaaugggauguuuuccaguagccauaggucucacaaaggaaguacauccuacccacaucccaaacccaacaagagucaacuuucguuuuuuuugagacagauucucgcccugucacccaggcuggagugcaguggugcagucuuggcucacugcaaccucugccucccagguucaagcaauucuccugccucagccucccgaguagcugggacuacaggcacgugccaccaugcccagcuaauuuuuuguauuuuuauuagagauggggcuucaccguguuaguuaggauggugacuucguggaucugccuuccuaguuaggauccugacuucgugaucugccugcgugggccucccaaaaguguugggauuacaggcgugagccaccgugcccagccaggagucaauguucaaaguaauccugagaaugggcaaucuguuuuucugauuuacuuucucuguaaaucaagcgcgggagcugcaggcaggcagaauuuuugcucguuaaagggcccucacauguagguaauguucuaaauuugagcucagaucugucugccucacaccaaguguaguuugcugauugcugacagagcuccacuuuccuguguuugaggcuucuuuucuaacuccuuuuccaacugccaugcuguucucuuucugugccuccccaaucucccugcccacuuccugcagugggccugcuuugguacauuuccuuagaguugcuugugcacagagcuccuuggcugauucacauuugcaucuguauaggugcccuuuagagauaacucucucugggacuugauuauccaugugauaccaaccuuguccucuuaggccauccagucaguaauauguguuauuaaacacuucccuugugccaaggcaguguuccaggcacuaggaggacaguggugaauaagacagacaaaauucucaucuacuaguaggggacagauaauaauggaugaaaauaauggauaugaugucaguuaauuaugugaaaaacaauaaaacugugcuuggguguggagcaugagcaggaggggcacaguuuagaaaggguagaccggcugcugucucugagggggagaagauuguccugaguccugaauggguggugaugugaguuguguaagcaccagcaagaggccacaguggggcuggaagagugucugggccugguguggaauaagauacagggaaggggcauguaguaggacagagaccagauguggugccggcucguuugccuggcgcuuccuccaugggccuaauuaauugguaaacucaguuuaccagauguuuccauuggcauggugucuugccaucucauaugcaaacacagaugcugccaccucaucagaugacuucaggagaaguuauuucuuccucuggaguaagauuuuugauguauaaaugauauuuuuuucuuuccuauguuuugauuacacaggcuugcuuugcaucucuggugagucaggacuaugucaauggcaccgaucaggaagaaauucgaaccgguaagcauucccucuguguacacaauguucugggcuucagcaguauuuccuaguugcuaauuuuauacuucauguguuucaguccugcuuuuauccuaagacaacauuucagggacuaaaaugugugcacauaaucucuaugagcugcugauuuuugguucaguuuauuaauugacauaucacccauaacgaaucauuuauaaugaacuuuucguauucguacuagguaaagaagaagaccaauaguguguacugcuuuuuaaaaaaauuuuauuauuuuuggaauaggucuuacagagaaaagucucuugugcuucuuuuuauuccccaaguucugucccuaaagguaaccagagcuucugauuucuucguaccauauuuuacauguuuuuuuuuuuuuuugauggaguuucacucuugucgcccaggcuggagugcucacugcaaccaccaccucauggguucaggcaguucucuugucucagccucccgcguagauggaacuacaggcaugcacuaccauacucagcuaauuuuauauuuuuaguagagacgggguuucgccauguuggccaggcuggugucgaacuccugaucucuggugauccaucugucucagccucccaaaguaucgggauuacaggcgugagccaccgugcccggccuuauaugugccauuuuaacuguaaauuaugaugcugauugcuggaucucugcauugucucuuuuuuuuuuuuuuuuuuuuuggagacagaguucuugcucucucacccuuuuaagaaaggagugcaguggcaugaucucugcucacugcaaccucugccuccugggcugaagcaguccucccauuucagccccccaguagcugggaccacagugugagccaccacauuuggcuaauuuuuguuuuuuuauuuuuuuguggagaugggaucuugcuguauugcccaggcuggucuugaacuccuaggcucaagcagucuuacugccucagccucccaaagugcugggauuacaggcgugagccaccacgcuuggccucugccuuguguuuuuuuuuuuuuuugagacggagucucacucugucaccagucuggagugcaguggcgcgaucucggcucacugcaaccucucacucccugguucaagcgauccuucugccucagccucuugaguagcuggauuacaggcauguuccaccacgcccagcuaauuuuuguauuuuuaguagagaugggguuucaccauguuggccaggguggucucaaucuccuaaccucaugauucgcccaccucggccucccagagugcugagauuacaggcuugagccaccaugcccagcugcauugucuuuuuaaagaagaucucauggcuuuuaugcuauauuaauaucucucucuuuuuuuuuuuaaccugagaaaagcauaacuuaucugcuguuuaauguugguuaacacaugagaaguuggggguuaugauuacugcuguggccaagauuaaaaucccugaguugucuaugagagggcuuuguuuuuacauucugauuauucauuuaugagggagauaaaugagucuguuguuuuucuuauuuuaauaauuuuguuccuuuuuuuuuaagguguugaucaguguauccagaaguuucuggauauugcaagacagacagaauguuuuuucuuacaaaaaagauugcaguuaucuguccagaaaccagagcaaguuaucaaagagguaugaacucaguuuucuccucagcucuauaggaagaacuaaguggugccaggauuccuuuuaugcuuuaaaugagauguaaccguuuccugcgaguuucauucaggcuuuauaggucagugugaaauguggcuagucauccauguuugggacaaccugaacaagaaguaaagccaaggagugggguccgaaagcagagugucagacggaacagcucugaugugacuugugucauacauuggccuucaggaaagauuuuucuuaaaagauucugccaugugaaaaaaggacaaaaagccacuaacauauaggcuuguuuuggacaaaaacugagaucuguguccccacuugccuuacccagugccuugcacacaggaauccaaggaaucaaaaaguaguguucgacccagguuccuggaaacucaggauuucguugaucucaguuguucuaagcuagggcauuuggaaguguguugggguugccacgaugacuugggaagcuuuaauggcauugaauggguugggccaggaccugccccaugugauguggaagagugaagaaucauccugcccaaaaagccggcaaugcccucagugagaaacacugaauugagauuauugguugggggcaauuuuugaaguaacuagucccaauuaaucaaaaagucucuuuucauucaugauaccagcuguuggggauagcuauucuuacaguuuaucaugucagaucauuuccugaugugaauacuugaauaacagugcagguauguccaagacuggaugguuaguaaaggauguaaugcuguucuuaaaaagcucuugaaaauguaauuuuaacaguucauaaucugaagugauagaucagugguguggauuuucuuguaaacaguuguuaacaaauguuucagauuuucaguguuuuagguucucagcaguagccuuuggagagagguacuggauggcuggggaccaggaugggauagagucuguaauuagucuguuuucacccugcucauaaagacauaucugagacugggcaguucacaaaagaaaaagguuugauggacuuacaguuccauguggcuggggaggccucacaaucauggcagaaggugaaagacacaucucacaugguggcagacaagagaagagagcuugugcaaggaaacucccauuuuuaaaaccaucagaucucgugagauuuauucacuaccaggagaacagcaugggaaagacuugcccccgugauucaauuaccucucaccagguuccucccucgacacaugggaauuguaggaguuacaauucaagaugagauuggguggggacacagccaaaccauaucaaucugauuucuuuuuggcugcccuuuugaauuuuguaacuugcauauuacuuucuauaagaaaaauaaacguaggccgggugugguggcucacgccuguaauccuagcacuuugggaggcugaagcagguggauaacuugaggucaggaguucgagauuagccuagccaacauggcaaaaccgcaucucuacuaaaaauauaaaaauuagcugggugugguggcgugugccugugaucccagcuacucaggagguugaggcaggagaaucacuugaacccgggagguggaggcugcacugagccgagaccgcaccacugcacucuagccuaagugacagcaagacuucgucucaaaaaaaaaaaaaaaaagcccauaaaaacuuauguuagaaucugucaucuggguuaaucaaauaguggagccaagcagaguaaugggcuuaauaugguuuaauggauucucuuuguuuugaauuguuagccucuuaacuaaccagaaccguauguguuuuuccugcauuugcucugacuuaguccaugacuuucaucugcaggaugugucagaacuaaggaaugaauuacagcggaaagaugcacuaguccagaagcacuugacaaagcugaggcauuggcagcaggugcuggaggacaucaacgugcagcacaaaaagcccgccgacaucccucagggcuccuuggccuaccuggagcaggcaucugccaacaucccugcaccucugaagccaacgugagcaaagggcagaggcaguuggccuaugagugggcugaugcgugagguuggccacacauuccuuccuguggacuugacauuuuggaagaacucuuugccagauaaugaguucauuuuaguuuuaugcucccauugaaaaauuuuccacuauuuuuauaagcuguuaauuucuugaguacuuuauaacaugucuguagcuuggauaaaccaaguaaguauuuuuuuuuugucuuuagcaaaguuuagacugugaauaugaugacacagauucuuuuuuaugguggcuuugcuuguuuuaaauuuuugcaugacuuuucaucuuuuuauguguguuuccuguaguuugauccgaaggaaaagaguauaguagccugagaaucaggagaugggaguuuuagucguaggccuuaugauaauuaccccgcggugguguguagaaaaguauguaaauuugcucuguuuuaagacuuugaacuaccucaagaagaggaaucuaauacaauauuuguaauguuuccagagcucucagaaugaggauuuuuuuguaaauaggucagaagacgauggaacuguccuggguuaguauaguaaucuuacaguaggauccuuagguugaugcugacuucuguuugggguauguuuauauuuuaugugguguuuacuuuuuuuuuuugacauagaaggauauagugggagcagugauacgcuaacauucauuacauucugcaguaaugaaucug

SEQ ID NO: 191470 - RNA, 9888 nt, Homo sapiens
cagauucauuacugcagaauguaaugaauguuagcguaucacugcucccacuauauccuucuaugucaaaaaaaaaaaguaaacaccacauaaaauauaaacauaccccaaacagaagucagcaucaaccuaaggauccuacuguaagauuacuauacuaacccaggacaguuccaucgucuucugaccuauuuacaaaaaaauccucauucugagagcucuggaaacauuacaaauauuguauuagauuccucuucuugagguaguucaaagucuuaaaacagagcaaauuuacauacuuuucuacacaccaccgcgggguaauuaucauaaggccuacgacuaaaacucccaucuccugauucucaggcuacuauacucuuuuccuucggaucaaacuacaggaaacacacauaaaaagaugaaaagucaugcaaaaauuuaaaacaagcaaagccaccauaaaaaagaaucugugucaucauauucacagucuaaacuuugcuaaagacaaaaaaaaaauacuuacuugguuuauccaagcuacagacauguuauaaaguacucaagaaauuaacagcuuauaaaaauaguggaaaauuuuucaaugggagcauaaaacuaaaaugaacucauuaucuggcaaagaguucuuccaaaaugucaaguccacaggaaggaauguguggccaaccucacgcaucagcccacucauaggccaacugccucugcccuuugcucacguuggcuucagaggugcagggauguuggcagaugccugcuccagguaggccaaggagcccugagggaugucggcgggcuuuuugugcugcacguugauguccuccagcaccugcugccaaugccucagcuuugucaagugcuucuggacuagugcaucuuuccgcuguaauucauuccuuaguucugacacauccugcagaugaaagucauggacuaagucagagcaaaugcaggaaaaacacauacgguucugguuaguuaagaggcuaacaauucaaaacaaagagaauccauuaaaccauauuaagcccauuacucugcuuggcuccacuauuugauuaacccagaugacagauucuaacauaaguuuuuaugggcuuuuuuuuuuuuuuuuugagacgaagucuugcugucacuuaggcuagagugcaguggugcggucucggcucagugcagccuccaccucccggguucaagugauucuccugccucaaccuccugaguagcugggaucacaggcacacgccaccacacccagcuaauuuuuauauuuuuaguagagaugcgguuuugccauguuggcuaggcuaaucucgaacuccugaccucaaguuauccaccugcuucagccucccaaagugcuaggauuacaggcgugagccaccacacccggccuacguuuauuuuucuuauagaaaguaauaugcaaguuacaaaauucaaaagggcagccaaaaagaaaucagauugauaugguuuggcuguguccccacccaaucucaucuugaauuguaacuccuacaauucccaugugucgagggaggaaccuggugagagguaauugaaucacgggggcaagucuuucccaugcuguucuccugguagugaauaaaucucacgagaucugaugguuuuaaaaaugggaguuuccuugcacaagcucucuucucuugucugccaccaugugagaugugucuuucaccuucugccaugauugugaggccuccccagccacauggaacuguaaguccaucaaaccuuuuucuuuugugaacugcccagucucagauaugucuuuaugagcagggugaaaacagacuaauuacagacucuaucccauccugguccccagccauccaguaccucucuccaaaggcuacugcugagaaccuaaaacacugaaaaucugaaacauuuguuaacaacuguuuacaagaaaauccacaccacugaucuaucacuucagauuaugaacuguuaaaauuacauuuucaagagcuuuuuaagaacagcauuacauccuuuacuaaccauccagucuuggacauaccugcacuguuauucaaguauucacaucaggaaaugaucugacaugauaaacuguaagaauagcuauccccaacagcugguaucaugaaugaaaagagacuuuuugauuaauugggacuaguuacuucaaaaauugcccccaaccaauaaucucaauucaguguuucucacugagggcauugccggcuuuuugggcaggaugauucuucacucuuccacaucacauggggcagguccuggcccaacccauucaaugccauuaaagcuucccaagucaucguggcaaccccaacacacuuccaaaugcccuagcuuagaacaacugagaucaacgaaauccugaguuuccaggaaccugggucgaacacuacuuuuugauuccuuggauuccugugugcaaggcacuggguaaggcaaguggggacacagaucucaguuuuuguccaaaacaagccuauauguuaguggcuuuuuguccuuuuuucacauggcagaaucuuuuaagaaaaaucuuuccugaaggccaauguaugacacaagucacaucagagcuguuccgucugacacucugcuuucggaccccacuccuuggcuuuacuucuuguucagguugucccaaacauggaugacuagccacauuucacacugaccuauaaagccugaaugaaacucgcaggaaacgguuacaucucauuuaaagcauaaaaggaauccuggcaccacuuaguucuuccuauagagcugaggagaaaacugaguucauaccucuuugauaacuugcucugguuucuggacagauaacugcaaucuuuuuuguaagaaaaaacauucugucugucuugcaauauccagaaacuucuggauacacugaucaacaccuuaaaaaaaaaggaacaaaauuauuaaaauaagaaaaacaacagacucauuuaucucccucauaaaugaauaaucagaauguaaaaacaaagcccucucauagacaacucagggauuuuaaucuuggccacagcaguaaucauaacccccaacuucucauguguuaaccaacauuaaacagcagauaaguuaugcuuuucucagguuaaaaaaaaaaagagagagauauuaauauagcauaaaagccaugagaucuucuuuaaaaagacaaugcagcugggcaugguggcucaagccuguaaucucagcacucugggaggccgaggugggcgaaucaugagguuaggagauugagaccacccuggccaacauggugaaaccccaucucuacuaaaaauacaaaaauuagcugggcgugguggaacaugccuguaauccagcuacucaagaggcugaggcagaaggaucgcuugaaccagggagugagagguugcagugagccgagaucgcgccacugcacuccagacuggugacagagugagacuccgucucaaaaaaaaaaaaaaacacaaggcagaggccaagcgugguggcucacgccuguaaucccagcacuuugggaggcugaggcaguaagacugcuugagccuaggaguucaagaccagccugggcaauacagcaagaucccaucuccacaaaaaaauaaaaaaacaaaaauuagccaaaugugguggcucacacuguggucccagcuacuggggggcugaaaugggaggacugcuucagcccaggaggcagagguugcagugagcagagaucaugccacugcacuccuuucuuaaaagggugagagagcaagaacucugucuccaaaaaaaaaaaaaaaaaaaaagagacaaugcagagauccagcaaucagcaucauaauuuacaguuaaaauggcacauauaaggccgggcacgguggcucacgccuguaaucccgauacuuugggaggcugagacagauggaucaccagagaucaggaguucgacaccagccuggccaacauggcgaaaccccgucucuacuaaaaauauaaaauuagcugaguaugguagugcaugccuguaguuccaucuacgcgggaggcugagacaagagaacugccugaacccaugagguggugguugcagugagcacuccagccugggcgacaagagugaaacuccaucaaaaaaaaaaaaaaacauguaaaauaugguacgaagaaaucagaagcucugguuaccuuuagggacagaacuuggggaauaaaaagaagcacaagagacuuuucucuguaagaccuauuccaaaaauaauaaaauuuuuuuaaaaagcaguacacacuauuggucuucuucuuuaccuaguacgaauacgaaaaguucauuauaaaugauucguuaugggugauaugucaauuaauaaacugaaccaaaaaucagcagcucauagagauuaugugcacacauuuuagucccugaaauguugucuuaggauaaaagcaggacugaaacacaugaaguauaaaauuagcaacuaggaaauacugcugaagcccagaacauuguguacacagagggaaugcuuaccgguucgaauuucuuccugaucggugccauugacauaguccugacucaccagagaugcaaagcaagccuguguaaucaaaacauaggaaagaaaaaaauaucauuuauacaucaaaaaucuuacuccagaggaagaaauaacuucuccugaagucaucugaugagguggcagcaucuguguuugcauaugagauggcaagacaccaugccaauggaaacaucugguaaacugaguuuaccaauuaauuaggcccauggaggaagcgccaggcaaacgagccggcaccacaucuggucucuguccuacuacaugccccuucccuguaucuuauuccacaccaggcccagacacucuuccagccccacuguggccucuugcuggugcuuacacaacucacaucaccacccauucaggacucaggacaaucuucucccccucagagacagcagccggucuacccuuucuaaacugugccccuccugcucaugcuccacacccaagcacaguuuuauuguuuuucacauaauuaacugacaucauauccauuauuuucauccauuauuaucuguccccuacuaguagaugagaauuuugucugucuuauucaccacuguccuccuagugccuggaacacugccuuggcacaagggaaguguuuaauaacacauauuacugacuggauggccuaagaggacaagguugguaucacauggauaaucaagucccagagagaguuaucucuaaagggcaccuauacagaugcaaaugugaaucagccaaggagcucugugcacaagcaacucuaaggaaauguaccaaagcaggcccacugcaggaagugggcagggagauuggggaggcacagaaagagaacagcauggcaguuggaaaaggaguuagaaaagaagccucaaacacaggaaaguggagcucugucagcaaucagcaaacuacacuuggugugaggcagacagaucugagcucaaauuuagaacauuaccuacaugugagggcccuuuaacgagcaaaaauucugccugccugcagcucccgcgcuugauuuacagagaaaguaaaucagaaaaacagauugcccauucucaggauuacuuugaacauugacuccuggcugggcacgguggcucacgccuguaaucccaacacuuuugggaggcccacgcaggcagaucacgaagucaggauccuaacuaggaaggcagauccacgaagucaccauccuaacuaacacggugaagccccaucucuaauaaaaauacaaaaaauuagcugggcaugguggcacgugccuguagucccagcuacucgggaggcugaggcaggagaauugcuugaaccugggaggcagagguugcagugagccaagacugcaccacugcacuccagccugggugacagggcgagaaucugucucaaaaaaaacgaaaguugacucuuguuggguuugggauguggguaggauguacuuccuuugugagaccuauggcuacuggaaaacaucccauuaauaggccaaccagucacaaacuggccaaaaaaguugggccagcuccccugagccaggaggccuaccagacaggguggcaggaaaucucaucucaagaauuuuacugcccuccacccacucaagaaaaaaauuuaggguccgacaugguggcugacgccuguaagcaacaauuuuggaggccaagauggguggaucacuucaguccaggaguucaagaccagcaugggcaacguggugaaacccugucucuacaaaaacaaaaauuagucaggcguaguggugcgcaccuguagucccagccacuuggaaggcugaggcaagaggaccacuugagcccaggaaguggagguugcagugacccaacaucgugccauugcacucuggccugggugacagagugagacucugucucaaaaaaaaaaaaaaaagaaaagaaaagaaaaaaaaaagauacacaggccuuuauagacaguuggacagcuguauuaagaagaaaaugugugguagcuuagaaagagaacauauauuuuuuuuuugagauggagucucacucuauugcccaggcuagagucaguggcacgaucuuggcucaaugcaaccucugccucccggguuucagcgauucuccugccucagccucccaaguagcugggauuaaggcgugugccaccagagaccacuaauuuuuguauuuuuaguuagagaugggguuucaccauguugcccaggauggucucgaacucgugaccucaagugauccagccaccuuggccucccaaagugcugggauuacaggcgugagccaccgcaucugccuagaaagagaacagcuuuuuaaaagcauggcuaaaacagagccuuugccuggaaaguaagugcuuguccucauuuccacaaacccaacggcuggcuuucagcaaguaacuugcccucacugagccucaguuucucuaccuaugaauggaggaaauggaacuagauggucuccaacguucccuccaaaaucaagagugcaugagcucaauaaauuccuuccaucaaagagcaugugcuaagcagcuagaaugagcagacagagaccucaaggaguggcaccccaauaggaaugagaagcagguaaguaggugcugcuaugugccacuggaggcugugaaaauugagguccacacagaacacaaggaaggaaacaggaaaaguuccaaagaaaauguggccuuugaauugaaucgugagacaagacuagacagaucgugaucacccagcagcagagaggauccagcucgcaccacucccacuccccuucaccuggcuaagucaaaaugcuucuuuggcuuuccugcucucugggaagccuucuuugauguccacaccuauaugugcucccacaguaccccagguuucuucuaucagagcagugauccuacaacaaggcaacugccugccguuuauuacaagcuuccugaaggcagggacugguuuucucuguauucucuguauggauaaucaagucccagagggaguucucucucaagggcaccuacagacauauaugugaaucaggcaaggaguucugugcacaagccaacuacacuacaggcuccacacuacagauuccuucaaugucugacaaauauucaucuagcacuugcuaucuacuaccacuguauuagcacuacagguuacacaaugugagggguggggguacaaaacagguagucucugacuucauggagccgaauuuaaugguaaguauuaaaaagaaggccagggaaggguccacugaggaagugaugcagugagcugaggagcggccuggaagcccaaagagaaaacaaaugguacacgugggaaagucuuguguggcugcaguaaggaaacgagucugaaggagagaacgcaacaugcaaagccugggagaccacacuaaacaucuugaucuuaucucaagggcaacaagcagccacuguacguuuuuaagcagcagggugcugggagucaacuuuggcuaagacuuguacagggccagucuuucagcaagugcccaugacugagagccagcuccccucaagcacaaugcuagaugcugcucuaaaguucaccagccccuuccuuuaccacuuagcaccaccucaaaggugucuccuccuccuccuccuaaacggucuguccuuuaaaucauuuauuucuggcuaggcgcaguggcucacgccuguaaucccagcacuuugggaggccgaggcggguggaucacgaggucaggaguucgagaccagccuggccaagauagugaagcccugucucuacuaaaaaauaaaaaaaauagcaugguggcaggugccuguaaucccagcaacucgggaggcugaggcaggaaaaucgcuugaacccgggaggcggagguugcaguaagccgaaauugcgccacuguacuccagccugggcgagagagugagacuccaucucaaaucauuuauuucuaaaucuuuguacauccgugugguaaaagcauuuuguccaugcagucugaauaaucgcuugcaaauuauauucauuuaccacugugcuauuagauacaauacaaaagucacaaaguugggauuuuuauuuauuuauauuuuauuuuacuuuuuugagacggagucgagcucuugucacccacgcuggagugcaauggcgcggucuccgcucacugcaaccuccgcaucccagguucaagcgauucuccugccucagccucucgaguaccugggauuacaggcgcacgccaccacgccuggcuaauuuuuguauuuuuaguagagucaggguuucaccauguuggucaggcuggucucgaacuccugaccucaugauccgccagccucggccucccaaagugcugggauuacaggcgugagccaccgcgcccggcaaaacugggauuuaaaauguggaaaaguuaacuccaauuugaacguacauuacuuuauuacuacacaggaauagcucaucuuccacuuuaaagacuacuggaaaucaccagagcacuuauuuucaccucucuaucuucccucaauauacaguucaccuuucuugcuacaagguaaacuccuugggcaaaacugagagauugggucaccugugccucccucccucccuaaccuccagcauuccuccuuccucagcucuuaguaccaagcugcgccugguaacuuaagucaauuuccgcucuuaagagucccuuuaggaucguuuaaaggugaagcccagcggaaaggauacaggauacagcagugaaacucucagcuccgaaaaggcuugagccucuuacuaaacaugcagggaugcaagaaacggugcucggggaugagacuaaggaccggcugggaaucuggaaggguuccaaguuugggguuuaggcaaacuucggguucacguuuccacaaacgucgaguuuacgcgcccccgccagcagaccugaauugaauacgggccacggggaagccuaaagcaagugacuuacuuuaagccucaguuuccccauuugugaauuaguugcucggaucccuggaggagauacgcguacgcgcaguucacguuucagaaaaaagggaaggcuagggacaaagacgcccaugucuuauauuaccucgaaagaugacuccaacucguccaccaaaguacugcuggaaggucuaggagcgccuggagcugccugaagaagcgaagcuuggcccggaaggcccggcggggccugagggggaccggguggcugcccagaaaacauacccccuaguggagccgccauguuug

SEQ ID NO: 191471 - RNA, 149427 nt, Homo sapiens
uuggagacagggucucccucugucacccaggcugguuggaaugcaggaguucgaacuuggcucacugcaaccucugccuccuagguucaagugauccucccgccucagucccccaaguaccugggaccacaggcacacgccaccaugccuggcuaauuuuuguauauuuuguagagaugggguuucaccauauuggccaggcuggucucaaauuccuggacucaagcaguccaucugccucagccucccaaagugaugggauuacaggcgugagcugcugugccuggcagaacaguaugaaguguuaacgccaaaauuuguuuuagcuaucauauauaaaucauaagcauauuauuugguugguugguguuaguucauuccuucaaucggaugauuuaaaauaaauguuuuucaaguauccucugugauguaucccaaagguuagcuuagaaagaaaaguacuuggugaaccauuccuggugcggagagcccuguuucugcuggacuucuuuggcuugggccguuucaccaucugggguccuaaaagcaaaaaaagguuuuuuuauaugguuuugaaaacuaugcaagaagcagcuuaauacccaccaucuuuucagggaaagauaacugcuuguuuacucuucaaaaacacccaaaugggacuggccaacauuaguagugggaaacaaauuguaaaggauggggcuggggagggaguaccuaauccucauuuggaaaacagaagguucaccauuguuugguucuccauuguuccuuugagacuuagugguuguagcucuaauaaugcaggauuaaccaaaccuacagaucaagagacuuuguuuuuauuuuuugugacagagucucccucugucacccaggcuggagugcaguggcaugaucucggcucacugcaaccuccagccuccugcguucaagcgaucauugugccucagccucccggggagcuggaauuacaggcgcauaccaccacaccuggcuaauuuuuguauuuuuuguagagauggguuucaccauguugcccaggcuggucucgaacuccugaccuuaggugauccacccaccuccaucucccaaagugcugggauuacaggcgugagccaccaagcccggcccgauuaagagacuuuagaauuccaaggugauagaguaaaucuugaggaauaauguuaguaauaauacugaaacuauauugaagauuuuugugccaaguccugugcuaagcacauccuauggauuaauuccuuuagucucacgucagucugaugagauaggugcuguauuaucuuaauuuuaaaggcaagguauauggagaccuggagaggucaagugaccuguccaaggccacagagcuaagaaugaggaagacuguaauuugaauucagaccuccaggccagauggaguccaccuuuuguauaacccaugcugaaguuuucagguaagugauucagugucccuugucuaaucauccaugaaaaaaggccuucuggaauuugguaccaggugcuagaaagaauccuacuuccccucuuaucuacagggaaauagaauaagggccccuguccccaacaucccccaaaccuuguggcaguuuuugcaucuguagacugguuggguuuguagguccggccacagcuggggcuuggguccaagcugggugauguaguuauuggaggggcauuaauccuggaacucagaucgccacucagaaaguucuuugcauaggaggcgagguucggcacgcugaccacgcggcugggcacguccuccaccuucuuuuucuguuuguauuaauggacagguuagugcaaugcaaugcaaaaaacaaaauaaagcauuauuguaaaagcaaauaaugcucacccaaucaaaauuguaucggagaagaagcaacaauuucauuuauacacuuacaugcuauuuuuuaaagcacuuuucccuccaaucuucauuuuguauuauaaauaaauauguauguucacaaccucuuaaccaaaacuucuggagauggauguguuuugcaacucaauuuuguuuaagauuuuagaaggucauguaacacccccagcaggggaugggcccacccuagccucaaaugcauuuauuuaaauuucuggagugaaacuuguauuuugucacaaugagggauacauaaaaacuacacgagaugacauuaguuaagucacaaguguauuguccugugaacuauuuuuaaaaauacuauuuuuguuuuuaagauguagccuugcucugucacccaagcuggaguacgguggugcgaucucagcucacugcaaccuccgccuccuggguucaagugauucuccuaccucggccuccugaguagcugggauuacaggcaucugccaccaagcccagcuaauuuuuguauuuuuaauagaguuggaguuucaccacguuggccaggcuggucuugaaauccugaccucaagugauccacccaccucggccucccaaagugcugggauuacaggugugagccauugcacccagccaaaaauacuauuuuuuaagagccuuuaggauuuugugauaguagauaauugaaugugaauaugcucauugugaaaaauuccaaaaauauguacagaaauaguuaagaaguggaagauucuuacucuucucccucccaucaccuagauagagcuauucuuaauacugacacacauuuauucuagaaaauuuggaaaauacaaaaucccauaaaaaauaaaaaucacacauaauccgcccagccauagauauaaacaaguggguuuuuuuuuuccaaugaauauuuuucugagcguacaccagcccuuaaauaaccugugguuaccuuuaagaaaaacgaaaccaauggaauuguauaaugcauuaaaaccauuagaaccaauuuaccuucauggaaggggucaaauaucccgggugaggauugaaagagaaagaccgauuccggugggacauggcacuggggaaugcugcguagugaaaucuucucucuuccuagaaaaccaauacaacugagucuaaaugagccuaaccacacagcacuggguuugacuugaaggaagauggcugugagggcagaauagagaaggaaaguccaggggaggaaggggaagucagugggaauaaagcugccaggcacugaagcuuuugaggaagcaccuuugcuuuuuuuauguccccagccccucuuguaaagaaaagggcaagcugaugccuuaggaaauugaaaauucaacuguucuuagcaugugaagguaaccuaaugcagaaaguuaguaauuaaggcaaagaaagaaaacccccagguaugcaaaggauuuugccgccuuucuuccucugucuuguuugacauuuguguugccuaacauauacaaacauagggagaguaaugaaauccauccccacuuuaccuauaauaacuauauggccgaucuuguuuguguguaucauuuuccacuuuuuucucuccugcuguauuauuacuaaauuccaguuauuacauaauuuuucucuguaaaaacaucaguauguauuucuuagaaauaaggauuacuuuaaaaaaaaaaaaacccaugauaccuuuguucacacguagcaaaugagcaauaauuccauaucaaugucaccuaauuuucaaagcacagagagauacagaagugaggcaggugagcaggagcagaaaugaccagcaggccuugguuggauacugaaucagagggagcuggguucuuuccaaggggcuuagggaguggcuuugcuaaguagaaaacagguggucauuuuuacaaaaagaagaucaacaauaaaaacacuaauucuacuacaauucaaaccuaagccauuauagauuuucucaaauucuguaaguuaaaaaaccaauauuaacauggggcaaaugcuguuggacuugggaguaaagugauuuuuuuuugccuccuauuuuccuguauuaauuuuuuagugaguaugucuucuuuaauaauagaaaagaaaggaguuuuucuuugagacagucuugcucugucgcccagacuggagugcaguggcgcuaugcuggcucacugcaaccucugucucucggguucaagugauucuccugccucagccuuccuagaagcuggaauuacagaugcccacaaccacacccagcuaauuuuuguauuuuuaguagagacaggguuucaacauggcuaggcuggucccgaacuccugaccucaagugauccacccgccuccgccucccaaagugcugggauuacaggcuugagccaccgcgcacggcaagaaaggauucuuuguaagauauuagggcaccuagagaaaugcugggugcaagugaacgccccucccgggggagcccgcagugcccggccaggugcgugggugaggcgcccccugacagccucaccgugagcugcuugaugauguccucucucuccuucaggcgggucugcaggcggccaaugagcugaagguccucgggccuggacgcucccuucccuggcuucucuccggaaucuuucagucuguuccaagcaggcaugcagucaagucccccuuacagcaauuacucaacaaagagggagaacaagugcacacgaugggaaugccauccuguguucagcccggccagggaggcccagauagcagcagcggcuugcccagggcccccuggggagauggcuugccgaacccaggauuccagcucugucagguccccugaggcugcagggccaggaagcaaaggccccugugugcacauagaugcugcacucagcggggcuucaagagccagggaugcugcugggagaacagaccagggcaggaaaaugucccguagguucucuuaaugcucuggcgccaucugcuggcggacauagagcgcggccaguggccgguaccuauggccuuuuuuuucuuuuuuggagacggagucucccucugucgcccaggcugcagugcaauggcgcggucucggcucucugcaaccuccgccucccugguucaagcgauucuugugccucacagccuccugagcagcugguacuacaggcgcgcgccaccgugccagggaaauuuuuguauuuuuagaggagacgggguuucacuauguuggccaggcuggucuggaauuccugaccucgugauccgcccuccugggccucccaaagugcugggauuacaggcgugggccaccgcgcccggcccccacugcuuuuucagcgugaagccagagaagaguaacuggguggugaggagaggagggcugggggugcagauaaucuacugacuggaguugauaagagcccagggcuuugggugagaugacccggcucuaauacuggcucuucuuuuuucuagauaugugaccuugggcaucauuucaccugugugugggccccaguucccucuccuuuaaaaugggcaugaaacugggugguugugagaauucaaugugauaaugggagccuggcauauaguaagugcccguuagacuguaacugguaaaaccuuuccugcuggcuuuuggaugauuugcuuuguauuggagacuggagaaguuuuuaagagcucaggcuaaaggucagacaggugacauuuaaacugaauuaaugcugccugaccuugggcaaguggcuucaccuguuuggaccuggcuugcugccaucacauccuaaauggucuugcuagucacccccucccccuguuucuucucagcagucagaagugacccugugaaaaggcaagucaggccaugucacuccugcccagugccuugugaaggcuucccagggcacucugaacacauccaaacuccuucccaucagggcaggagucccuucacccagcuccucuccucccacucacccucccucucacugaugccucaggagugcccucaccuccuuguacuuaaacaucaccuccucacagaggccuuguuuugcccacccuugccacucccaauccugucuuccagcacuuucaccgccugguaugauguuaacuguuugcuuuuuuuuuuuuuuuuuuuuuuuuuuuuugagacagggucuauuuuuuuuguuuuguuuuguuuuguuuugagacagaguuucucucucuguagcccaggcuggagugcaggggugcaaucacagaucacugcaaccucaaccuccugagcucagacgauccucccgccucagccuuccaaguagcugggacuauaggcacacaccaccaugcccagcaauuuuuuuuuuguauuuuuuguagagacggaguuucacaauguugcccaggcuggucucgaacuccugggcucaagcaguccacccugggcucaagccucagccaugcaaagugcuaggauuacaggcaugagccaccaagcacagccuguuugcuuauuucuuauccgaauucucagcagaauuugugagccuaugagagcauugucuuuguuuuguucccugcuauaacuccagagccuaaagcagugcugggcauacaauggguccuuaacaauuauuuguugaaugaauaaaugcaauauguuugcaugagggaccagugggaauaacaauucuaauugagcagcccugauccuucugauuucuucgaagugugaggguuaaaccaaugcucauccucacaaauucccacugcccugcagaaaaggggaacauagccucauaaaaugaagggagacugaugagccccuggcuaguuccccccaccacaccccgccuccugcccugaacuugcucuguugcugaagcuggagugcaggguccugaucuccguucacugaaagcucugccuccugggcucaagugauccuccugccucagccuccagaguagcugggauuacaggcgugugccaccacaccuguaauuuuguauuuucaguagagaugggguuucgccauguuggccaggcuggucuccaucuccugagcucaagugauccaccugccucagccucccaaagugcuggauuccaggcaugagccaccgugccuggccagaacccaggacuuucaauuugaaaaccaggaaaucccagggucauuggggugaguuggccacccuacugaaugguacauuugcaagacccucccuggggcccgaggccucacuuacucggcuuccagggcagccagccgggccuggagcugggccugggcacuacugaaaucugccaccauggccugcaucuccuuccgguguuccuggcgcagugucuccaccucccuggcccgcugggcuugcugagucuccuccaggaaccugugguggaugaaagcacagccaggcuugcccagcuccagggauggcaccccuugggcucugggguuuauuucccucaucgcugcccaguuugggagaucuggguggggagaaauugugaucuaaggacaccugugggaagaagagcugaagucucuugaguuguggaguccaggacaaacccccacuaugggaccccuucucagcacccucccaucucagaaggagaaaccugagcauggggacagacuucagguggaagugauggagagcagcccugcaggggagccccagaaaacacacucuucacuugggacaggcggggaggcaagaggcugagauucucuaucaguauggccugaacgcugggacucugagaccugggagaccaggucuucccuaacaacuacacugcaguggaaagccucccugaacuuuuuuuuuuuuuugagacggagucuugcucuuguugcucaggguggagugcaauggcacgaucucggcucacugcaaccuucaccucccggguucaagcaguucuccugccucagccucccaaguggcugggauuacaggcgcccagcaccaggcccagccaauuuuuuguauuuuuaguaaagacgggggguuucaccauguuggccaggcuagucucgaacuccugaccucgggugauccaugcgcuucagccucccaaagugcugggauuacacgcgugagccaccacaccuggccacucccugaaucuuuaucccucaccuuuaucaaaagaagugguuaugaaaauuaaauugggcugggugcgguggcucacaucuguaaucccagcacuuugggaggccaaggcgggaggaucacgaggacaggaguucgagaccagccugaccaacauggugaaaccucgucucuacuaaaaauacaaaaaaaaaaaaaaaaaauuagcugggcauggugguguccgccuguaaucccagcuacucaggaggcugaggcagaagaaucacuugaaccugggagguggagguugcagugagccgagauggcaccacugcacuccagccugggcaaaagagcaagacugucucaaaaaaaaaaaaaagaaaauaaaugaacaagcacagucaaggcucaaagcaauuuugggccaacacaacaggguucaguguacacagcugacaaauauuaaaaaaaaggaauccuccagacauuaaaaugacaaaaaaaauuaugagcaauuuuaugauuggcauuaggacauucaaaaacuuggaugaaauagacgaauucuuugaaagauacaaacugcuaaagcucacuuaagaaauagauaauaugaaauauccugugucuuuaaagaaauugaauuuguauuaaaagcuuuccaacaagaggaagaaaggcucugaguucaggauugaugauagguuuuucacuucuacaauuaaccaagcguuucauucaugcuagggacaugccaagccuccugcacacauuccauugcacucuacaacagcccugacaggccagguuuuuuguuuuguuuguuuuguuuuuugagacagauuguggcucugccgcccaggcugaagugcaguggcccgaucucaacucagugcaaccuccaccucccaggcucaagcaauccccccucaccaaccucccgaguagccgggacugcaggcaugcaccaccacgcuuggccaauuuuucuauuuuuaguagagacgggguuucacuauguugcccaggcuggucuuggacuccugaccucaagugaugugccugccucagccucccaaaguacugguauuacaggcgugagcuaccacgccagccgaggcuggagucuuauccccauuuuacagaggacucagucugggagaggucagcuaacucacccaaccucacacagcuaauuaagagcgcacagcuaguuaagaagacaccgcauggucugaacuauuccacuacaccgucuccguaagguuggauuugaugacacuuuugguccaauucucagucucauaaaugcccugauuugcagggaaacaaacaggacucccucuuuuuuuuuuuuuuuuuuuuuuuuuuuuuuuuuuugagacggagucuugcauugucgcccaggcuggagugcaauggcgcgaucuuggcucacugcaaccugguccucccgaguucacgcgauuuuccugccucagccucccgaauaacugggauuacaggcacacaccaccacgcccggccuuuuuuuuuuuuuuuuuuuuuuuuuuuuguauuuuuaguggagacaggguuucaucauguuguccaggcuggucucgaauuccugaccucgugaugcgcccgccucugccaaccaaagugcugggauuacaggcgugagccaccgcgcccagccagacucccucuuuuauuucaaggcacuuccucugcgguuuugagauccagaauuucuggagcucugggacuuuucaugggucagaggaguaacaucugugaaaugcuggcgcauucagugucuagugucuuguggggcaggaugccgaggcagugacccauuucaggucucaggcucagccagccgcaguagggggaggggggguggcgggguagggggugaggguggcgcgguggcggggcgcgccgggucacccaccugcgcuggucucggagcuucugcgccuccugcugaugcugcuccaccuccgcgcgcagccgccgcaccgcguccuggagcugcgcguucuccucccagagcccgcaucccucgccggaacccugcccagcagcgcccgguggggagccggccuggcccgggccgccccgcuccugaggaaggcaaccaggagagguguuuucaggaggcgcaggggcagacaaggcagaaagggccagagaugugcugcggcgagauggagacccacuggcaccccgcccaggcuggagccuguggcaggcuccugaguucccugcagggacucccaucuagucucuuaaaaaauuuccuccuuugggaguuggccaaaucuggcccuuagaguuuaauaaaacugcugagcuaagaaugggucuugcauccaaaugaacaccaaccacacuccacacuccaccugccagggugcccuccaugccugccucagugaagucuucccuccgugaaguuaaguguucagugaagugauacugccucagugaagucuucccuaccucucagggggaacugauaagcuuucucuaauaccaccaaaucuugcuaacucuggcucuguaaggggugacacugaagagaauauguguccaugcugguuuccuuggcuagauugggagcuauuccucucuucaucuuuccaacccuguagcaccuagccugguguauucuauaggugccacgugaaugcuugcuaaacagaauugugcuagaaugucuguaguucagguagaaacacaaaaauugcuguccaacagcaaauggagucagauuuaaucugugauuagugaauguuccaguuuucaaauucacucaaacaugcccgaccacuugugcauguauuaguucacugcacacaguaauugcacagcugugcacggggagaaucuguggcccaggccccaugucucugccuuccugcucugggguuggcaugaugugggaugcccgugggcacccacuuggcacucucacaugcauagccuggaagagcaagagcagggggguuacugcucuguggggacaauccuugaccaauggaggacagaaacagauggaaaaaugcauuccccucuugggucucugggugggagagauaugagaauuagaucccaguaggacagacuccacuuagcucagcgguggccagcuugggccugcagccuggcauuguguccccuccccuuuccuuuuugacuccugcugccugggcuguuccucuuugccgacaccccugcaucuccucucugugugggguaucaccugagaccacacuuuccuucuagaggguucagggcuucccuccuauggggcaaaggugagggcuggugcauggguggccacguaucggcucauguacucagugcuccuuggcuucuauccagagcccucaggugaacacugacucccuccauggcccaguccccagcugucuccaucccacauuucccguccccucccauugguaccaguggcucccacccaucuaaacacuuaauggaacacguucugucuucccucugcuagaccuaaccacugggcuaaccugugauucaucauuuguuaauauuuuucacauaaacacagaaauugccuuccuaugcucagcaacagcuaaaucuggcacacaugauucccaugucccccgguccuucagcaggacuggccaccaaugaauccucaccacccacaggcacugguggagacccugcugagggcugggaguggggguggggaggcgaugaggcaggcagacagguuauccucaaaagacuccugauccagucuaggcaacaaggacaucuaugaaauggcauguccccaacaggaccgggcgguagauccuagagccagcugagcugucuugacaacaagugcuccaggaucucagagccagagggggccacugugugccagggaaggcccccagcaugagauaugcugggcagcaucucaggcaggaggaguggcacaggcgaaggccaaagggagggugcagaugccggguuuaugagccgcagggaauauggcaggacauacaggucauaaucagugguggaagcuuuucaaugccaaguugaagcauuuggagcuuucuccaaugggaaccaccaaaggcuuuaugaaaagugaugcuggucauccuaauaccaaagccuggcagagacacaacaaaaaaagagaacuuuagaccaauaucccugaugaacauugauguaaaaauccucaauaaaagacuggcaaaccaaauccagcagcacaucaaaaagcuuauccaccaugaucaagugggcuucaucccugggaugcaaggcugguucaauauacacaaaucaauaaacauaauccagcauauaaacagaaccaacgacaaaaaccacaugauuaucucaauagaugcagaaaaggccuuugacaaaauucaacagcccuucaugcuaaaaacucucaauaaauuagguauugaugagauguaucucaaaauaauaagagcuauuuaugacaaacccacagccaauaucauauacugaaugggcaaaaacuggaagcauucccuuugaaaacugggacaagauagggaugcccucucucaccacuccuauucaacauaguguuggaaguucuggccacgguaaucaggcaggagaaagaagggguauucaauuaggaaaagaggaagucaaauugucccuguuugcagacgacaugauuguauaucuagaaaaccccauugucucagcccaaaaccuccuuaagcugauaagcaacuucagcaaagucucaggauacaaaaucaaugugcaaaaaucacaagcauucuuauacaccaauaacagacaaacagagagccaaaucaugagugaacucccauucacaauugcuucaaagagaauaaaauaccuaggaauccaacuuacaagggauguuuaggaucucuucaagaacuacaaaccacugcucaacaaaauaaaagaggauacaaacaaauggaagaacauuccaugcucauggauaggaagaaucaauauugugaaaauggcuauacugcccaagguaauuuauagauucaaugccauccccaucgagcuaccaaugacuuucuucacagaauuggaaaaaacuaaaguucauauggauccaaaaaagagccugcgucgccaagucaauccuaagccaaaagaacaaagcuggaggcaucaugcuaccugacuucaaacuauacuacaaggccacaguaaccaaaacagcaugguacugguaccaaaacagagauauagaccaauggaacacaacagagcccucagaaauaauaccacauaucugcaacuaucugaucuuugacaaaccugacaaaaacaagaaauggggaaaggauccccuauuuaauaaauggugcugggaaaacuggcuagccauauguagaaagcugaaacuggaucccuuccuuacaccuuauacaaaaauuaauucaagauggauuaaagacuuaaauguuagaccuaaaaccauaaaaacccuagaagaaaaccuaggcauuaccauucaggacauaggcaugggcaaggacuucaugucuaaaacaccaaaagcaauggcaacaaaagccaaaauugacaagugggaucuaauuaaacuaaagagcuucugcacagcaaaagaaacuaccaucagagugaacaggcaaccuacagaaugggagaaaauuuuugcaaucuacucaucugacaaagggcuaauauccagaaucuacaaagaacucaaacaaauuuacaacaaaaaaacaaacaaccccaucaacaagugggugaaggauaugaacagacacuucucaaaagaagacauuuaugcagccaaaagacacaugaaaaaaaugcucaucaucacuggccaucagagaaaugcaaaucaaaaccacaaugagauaccaucucacaccaguuagaauggugaucauuaaaaagucaggaaacaacaggugcuggagaggauguggagaaauaggaacacuuugacacuguuggugggacuguaaacugguucaaccauuguggaagacaguguggugauuccucaaggaucuagaacuagaaauaccauuugacccagccaucccauuacuggguauauacccaaaggauuauaaaucaugcugcuauaaagacacaugcacacguauguuuacugcaacacuauucacaauagcaaagaccuggaaccaacccaaguguccaacaaugauagacuggauuaagaaaauguggcacauauacaccauggaauacuaugcagccauaaaaaaggaaugaguucauguccuuuguagggacauggaugaagcuggaaaccaucauucucagcaaaauaucagaaggacaaaaaaccaaacaccacauguucucacucauaggugggaauugaacaaugagaacacuuggacacaggaagggggacaucacacaccggggacuguugugggguggggguaguggggagggauagcauuaggagauauaccuaauguaaaugacgaguuaaugggugcagcacaccaacauggcacaugcacacauauguaacaaaccugcacauugugcacauguacccuagaacuuaaaauauaauaauaauaaaaaaagaaaagaaagugaugcugggcuuugggagaauagcugaagcuguacguuauggacuggagggagagagggcugggcuguuaggaggugacugccacccagcuagaccaggaaugauggaugugcagggaaggggcugaugggcaaagucugagcaggaagaggaaagagaguuggcacugagccugggugacaacaaagcugcuccacuuaggggaacagcaaggucuagauggagccugucugguaaaauguucugagaaauucaaaauguucugcagauccagaggaguagcccagaccagcugcaucgagggccuaucuagcaccaacacccugagauaccauugcgucugaauuauaaauaacaugcagcacuuaaaaccuuuuuuuuuuucuuuucgaagacaagacccugcaggcccaccaaguaucccacaggccuguggagaagggucuuccccacuucgggcaggggggaggggaaugaccaaguacccagagcccaucccuuuuuuuuuuuuuuuuuugagacagggucuugcuauguugcccaggcuagaguacuguggcacaaucauagcucaccacagccuggaacuccuggucaagugauccuccugccucagacucccgagccaguauuacaggcauaugccaccacgcccagcuaauuuucaauuuuuuuuuguagagauauagucuugcuauguugcccuggcuggucuugaaauccuggccucaagugguucucuggcuuuggccucccaaagugcuagauuccaagugugagccacugcacucagccucagagcccauccuuuauggggcuucuuacugcggcccugaugcugcucugggagggguauugcuggugcaagggcgggggcacugaccucuguggcgauuaugugauccuugcugucuccuggacacuggcugcuggcuugcugucugcccagagcccucagcucggccugcagugccuccaaguccuucuggugcccagaacaggcagcuugcugcuccgacagcuccugucugagcgacucuggaaaagggagagcagcagugaguuaggcguugggucuaggcugaagccugugucauggggacaacagucucuggggugggguuggaugacguggguggcugcugaaggcuugugguggguuagguuccccaaaccuuuuccaagguaacaguaacaacagggccaugugugaaaacuguucucauuuaagucccaccaccaacuuuucugguaugaauuaucccccacccccgcuucauuuuaggaugagggaccugagcaucagagagggugagcacaaugcccaaagccacacagcuauuaaaugguggaguugagaugcaaaauuucaagugguucuucacucugaaccccgugcuugcccucuacugguugguuaggauggguggcaggugugggcagcauggccugagcccagggcauucugugacaacgcuuggccucagcaucaaguuaggaggccaggcaaagaacaggaaauuaucaaaugaccgaaaaggccucuucugggggcgauggucucaaguuggaaauuuugaaauuuaugucaacucuuuuuuauuuuuuuuugagauggagucucgguuuguuucccaggcuggagugcagugacacgaucucggcucacugcagccuccaccucccagguucaagcaauucuccugccuuagccuccggaguagcugggaccaggcaagcaccaccacaccuggcuaauuuuuguauuuuuuuuuuuuuuaguagagaugggguuucaccauuuuggccaggcuggucucgaacuccugaccucaagugauccacccacauuagccucccaaagugcugggauuauagcgcgugagccacaguacccggccaauauccucuuaagacaaaauguucacagguucuucuuuccacugguguggggucuuggcuggaucauggagguaggagauggcaugucaucccagcaggauagggacuaaaauggaaucauccaggagagauguguacguucucuuaaacucaggggagaguaaggccagaaacucgagcuuccaacuccagcuuccccucugaggauggagacugauuucuaguacacuagacacuucccggcaugauugaaacaauuauuucaaaaugaauauuuucugauagagcagaugcuauuuagugagauauuccuuuuaaaaaagauacuuuuuaagugcuuguaaauuugauacuucacuuuucuguaaugagcuuuugagacucuguauuuuaguuauugaaaauaaccuuugaaacauuguucugaucauuccauaagcaccuagcacagguuuuaguacagagcaagugcucaacauauauuuguaaaauaaacaaaugaucuuuagagugaaaauggaugaggugauaaaaguguauucauuauaaaagcuuuccuauaagcuuacuaaccuucccucaaagguuaacuauauuaagcacauguaaaagcauaguguauuuggaugauauuaagaugaaaaauuggccaggcgugguggcucaugccugaaaucccagcacuuugggaggccgacguggguggaucacgaggucaggagaucgagaccauacuggcuaacauggugaaaccccgucucuacuaaaaauacaaaaaauuagccaggcgugguggcaggugccuguagucccagcuacucaggaggcugaggcaggagaauggugugaacccggguggugggacuugcagugagcugagaucacaccacugcacuccagcuugggugacaaagcaagacuccaucucaaaaaaaaaaaaaaaaauuuacuucguaaucuuuccagcagaauuuugauaaagugauuucuauagcuuauuuucuuaaaaaaaaauccaaacauaaccccauuuuuugaaaacuguuaucacaagauauaugcaauaaaacucuuuaccaaaucauaaauuauaggguauucauucuuuacccuccucucucauaccuucccaccauucaucuauccaucuaccuauccauccuucuauccaccuguccauccauccaccuguccauccauccauccacccacucauccauccauccacccaucuaucugucuacccaucuguccauccauucauccauccacugauccacccauugguugcccacccaaucauccacccauccguguguccacccauugguugcccacccaaucauccacccauccaucuguguguccacccauuugucugcccaaccaucugcccauccacacaucuccauuugucugucuguccauccauccauccauccuuccuccuguccauccauccacucauuuuucugucccuccaccuguccacccaacuacccauccacccacacccccauccacuuguccauccauccauccauccauccaucuagcaugucuaggucccaacccucuaguaaacacccacccucccugcccucucacagggaccuauaguauugcaggucaguugugucucacacagauauaagaagaagaauaaucagcaucaggaauaucucauaucaaccugccauuacuguaggugcuugcaccuucccuugaagccuaugauuuguugucaucacagaguccacaaagccccuucuucuugggacuggugcugagaagcccagccuuuccccagggucuuuccagggaucucuccugauucuuuucuuuggggaagaauggggcugcuguggagucagaaaagccagggaagggguggcagggacagcugcacuggcagcugcugcuggguguuggaaucaccaggauguccagccugaccuguacauggggagccuuggaccugagccauguggcacagccuggguucuaucuuuacaugcugcuaacuucagcauuucccauguaggcaccuccauuccaggguagcugcuaacugggaagucuacgaaacucuuuccuuccugcuccucacaccacuuccucagaaacaugcagucagugggacacgcuuucuaaugagaacucaaccaagcagcaagguagagccuaacucacuuauggagguaaagaaaaugcuguccuccagaauucucuuuuuacuuuuccuaauuuuuuuuuuuaaagagaugggggucuugcuauguuguccaggcuggucuugaacuacugaccucacgugauccucucucaccuuggccucccaaagugcugagacuacaggcaugagccaccacacucagcacccagaaaucucuuaaggagagcccugucuagguuuggaagaaauacuuaauaaagccaacaugaucuuuagugcucagcaugaaauggugagagguuauuugucuugcucuuaagaguaagaaagaugacaguaaaggagaaaaugagggacagggaugaucuacaaaaaugagagaggucuccagaaucaggcauacaacauugaaauauucagucauggccgggcgcaguggcucacgccuguaaucccagcacuuuaggaggcugaaguggguggaucacgaggucaggagaucgagaccauccuggcuaacacggugaaaccucgucucuacuaaaaauacagaaaaauuagccgggcgugguggcgggcgccuguagucccagcuacucgggaggcugaggcaggagaauggugugaacccaggaggcggagcuugcagugagcugagaucaugccacugcacuccagccugggcgacagagcaagacucugucucaaaaaaaaaaaaaaaaaaaaaaaaaagaagaaaagaaacauucagucauaauguaacagggaacacuuagauagacuuacugcauaccaggcucuauuugaagcacuucucaugcauuuacucaaguaauugucauuacagcccagugaagugaaugcuauuauuauccucauuuuagagaugggagacugagguacagagcaguuaagcaaauuccuacccaaaguuacacagcuagugaguguuagagcugggcuucacacccaggcaguuuggcucuagagaucuuuaccucuguuaacuucgaagaugcugugugugagugguuuuauugauguggcaacugaaaagggggagaguuuugugcuggggaugaugugggggcaggcagaggaagcagagccuggaggccuaagauccuccaauuugccgaaaucuucagaacagaaaugagagguugaggcaaugccaugaaacucauaugaaggcucagagaucuggguuacaugcaauaauaaugaugaugaugauaaugauaguaucuacauucacugggcuccuguuauaugcuagacacuuuauauuuaauaucuuuuuuuuuuuuuuuuuuugagucuugcacugucgcccaggcuggagugcaguggcgccaucucggcucaguacaagcucugccucccggguucacgccauucuccugccucagccucccgaauagcugggacuacagacaccugccaccacgcccggcuaauuuuuuguauuuuuaguagagacgggguuucacuguguuagccaggauggucucuaucuccugaccuugugauccacccgccucagccucccaaagugcugggauuacaggcgucagccaccacacccggccuuuauguuuaauaucucauuuaauccacacagugagccuaugagguagggacaacuguaauucaauuuuauacaaaaggaaaaugagacucacaguaagccaucccagguuucacagcuaguugguggcagagccaggauugucccugacaugugugccugagauuccuggagcccuggccugugagcccgagaccccuggagcccuggccugugugccugagagccuggagcccuggccugugaaucugagagcccuggagcccuggccugugagccugagauucccggagccguggccugugagcccgagaacccuggagcccuggcccucagcuugucucugguuucuacaugcagacccugcaguuggccaggcccuccucaguacacuauuggguguauaccuagcagcagggccugcugugccugcauccucucacgcuccuccugcagcucuugccuggccuuuuccuccaaggccuggagcuccagucggugugucugguguuggaucuggaggcuguggcuggauuccuucuucaagcguuccucuguggccugugggaaaaagugggaacaagaaggcaugaaagugggcaugagggugggagaccugacuccuuugccaagcucuucugagccaggaugcucugaacacucgcacucucccauggagggcuuaucaggcuacagagaaugcuguagcaauggccuggccacagcagccauuuugcaccaggugaaccaccuccuuccacagcugauugggccagaguggacaccuguucuaaccugggccaaucaaaguuccuuuaauguaaauuugacaugaagaggugggagauagagcaaaagagacugacagacagauacugacucuguggcuccaaauuuaccauacucaggagcacuaagguaacuaucugacaucugccccaggacuaguguggugauggcugcugucuguggaggaagcccagggcuggugugcacagcagagcagaaugacauagggaagggugaggggucccuacagcuuuucaguccaugcucuuguuugguccugagaacugucugugucucuguccuuggguucauauucauucauucuuuuuuucccuacuuuuuauuuuugguucauucacgcuuucacucaacaaacauuuauuuacugaagucccacugugugucaaacacccaaagcaaguucugugagcagcuggguaaacuuuaauaagugucucuucacugccugccuaacuucacucaagcugguuucugugagaggcacaaaaacaaccccuaagauguccaugucugaaaacugaguauguuaccuuacauggucaaagggacuuugcagaugugauuaaggaucuuagaugggagauuauccugaaauaucugggugggccucaaucacaaggguccuuauaagagggccguaggaggcucagugagaaaagaguugaugguggaagcagaggucagagagggagggggagggggauuugaagcugcuacacuuuuggcuuugauaaugcaggaagggaccagaagccacggaacucaggcggccucuagaagguggaaaaggcaaggacacagauucuccucuggagucuuuagaaggaaccagcccugccaauuccuugauuuuuggauuucugaccucuagaauugucagauaauaaaucuguguuguuuuaagccaccaggcuugugcuaauuuguuacagcagcaauaggaaacuaauauaguuucugcuuuuuuuuuuuuuuccaguuagcagaguuccaguuaauauauauccccagguuuuagaugaggaaaugagagaugggcauuggagagaugaauuugguuucccagggucacacagaaaaagauauggaaauuauuauccccucaucuuuuuaaacucuuuuuuauauauauauagagggagggucucacuauguuacccagcuggucucaaauuccgaagcucaagcaauccuccugccucagccucccgaaguguugagauugcaggcaugagccaccacgccccagcacccgccccugcugccauauuuuucaacagagcaggaaacuggggcuagaaaggcagggaaccugccugcagagaggugauggaagaggcaggauugugacccaugagugauggaguccagggcccaagcccuuuccacucacucaugcagugggcauuucaccaaauuuccucugggauuucaccaaaugcaugaggcuccugugagggaagaauucaaccaccuuugagcccaaguuggccucccaaacccagcgggucauguggaagcuuuccucagccugucucugccaccugucaccggggauagcaauagggaacuggucucacuccucccaggggaaacgcagucauucugugccaaaugucuuuuucuuuuucuuuuuuugagacgaggucucacucuguugcccagcuggagugcagcggcgcaaucauggcucaccucagccuugaccuccugggcccaagucauccucccaucucagcgucuugaguagcugagaccacagaugcucacuacuccaccuggcuaauuuuuuuuguagugcuuaguucucccuauguugcccaggcuaaccucaaacuccuggccucaagugauccucccgcauuggccucccaaaguucugggauuacaggcgugagccaccaugccugauugcgaguuuauuuaauaaaacagaaaaggcucauacuuuucaaauucucugauaccuuccuccucuuucccuugcugcaaggcucagagaacaccaauuggugacauguuuauccccagggaaauggggauggagagguugaagccuggcuuugcaagacggagccaaacucucucacucugacccagccucucuccaucccugggggcaaguaaagguucaggucagcacugcccacucacuugcucaggagcccuuggcagugaggaucacacagggugcagcacucagggcucagggcaaauuggagacucauuccuggugaauuucuccagcugcuaugggaggguuacccugcucuuguuguggccaguuuggggccuccugagggaccuaguuucacccugucucuccaaaaguccuauauuauguaaagucuccauucccagugcuuccaaauaccuuagacaacucccucauggcuuccacccacugaucccagcaaccuguuugaggggcugccuuuuccccuagagguaagcuacguaaggacacauaguguagugaucaucugguaucucugcagcucugcgugauggcagcucgugguagcuacucagugaaugccugcagaauagaugagugaacaauaaaagugaaccuuuuaaaaaccaagcuguuacucagccaugcacuguucuaaguacuuuacaugcagugucccuuuugaucuucauaaccaucucauaagauucauacuaccaucuaucauuuuauaaaugaggaaacugaggcacaaagaaccuaaugaccuauccgagcucccacacuuuguaaauggcagauccaggacuugaacccaggcagcccauuccuacucgccgacacaggaacuggggcuuauacccgaugggcagaguguccuuucacuuuccuuuggccgggacucagaccucauggguccaacccccuagagccccuggaacuccccgccucaggugagugaagccuccugccucucugccucaugugagaaauugggguccacagcaugaaggaauaaagcucagggauacacaaagguccaugucacccagcagugaauacaccugggaaucuccccaagcugagcucuugcagauuguaagccaaagugaaaaaagauuuagaaggauugaagaaauaaggaaacugacaucuuuuuugaauaccuaguaagugcccggcaguccaugugcauuauuuccuuucuucuuucuuuuuuugcuuuguuuugagacggagucuugccguguugcccaggcuggagagcaauggugugaucucagcucacagcaaccucugccucccagguucaagcaauucuccugccucagccuccugaguagcugggacuacaggcacgcaccaugacaccuggcuaauuuuuguauuuuuaguagcaaugggauuucaccauguuggccaggcuggucuugaacgccuggccucaaguggucuguucaucuuggccucccaaagugcuggcauuacaggcgugagccacaaugcucgacuuucuuuuuuuuaaagcuucucuuauauucuuaucaggggaauaugugcagauaguauaaagagccaaauaguauuaaaagaaaggaaaauaagcagccuccuaguccuuuccuccucccucucugucuccuguccucggaggcagccauugucaacuccuuguuucuuguuguauuuaccagcauuaaaaagacaauguuuccagucuacuguaucuugauuauuuuugagacuaugaauugucuuccuacuacaguagaucagcauuuuaggucucacucacucucuuccauuccuuuuacauaguauacaauauauauuuuuaauauauugaaguauacuucauauuuuccuuauugagaauauguaaauauuauucacuauugagcuaaaugaauuauuaugauugaacuucugccucaugcagcuuuuuguuuuuccuugcauuaguaaaugcugcauuuuuuauuuguuuaguuuccuuuggcuaucuggcaaagucuuccuacaacuucuaaaugcuuuguaaaacacacagugcaauuuuccacauggccaaaucugucagagaauccaucaguuuugcuuuccccuggagacagcucuuccagagcccucaguuccuugcugcagccuggacugagcuguuguccagcagcaaaaccagacuccucaaaccuuccuucuugcuccugaauugaaucccuggcaucguagcucucuuuuauucccucucccuugguuugcucccuuguuuuugugggacaccucuucaaggaacugcuuaagacggcaggaagggaacacccucugagaaagccguguuuaagccaggccacaagguagaaggcgcuggaugaaacaugccugaaccaccccaccagauuauccauaguuguuuaacacaguacaauuucccaaacccuuggaaaggucuuuguggcugagcuguucuuuuuuuuuuuuuuuuuuugagacagagucuugcucugucacccaggauggaaugcaauggcauagucuuggcucacugcaaccuccaccuuccagguucaagcaauuuuccugccucagccucccaaguagcugggauuacaggcaccugccaccacgccgaguuaauuuuuguauuuuuaguagagacaggguuucaccauguuggucaggcuggucucggacugcugaccucaggugauccacccaccuccaccucccaaagugcugggauuacaggcaugagccacugcacccggccugagcuguucuuucucaauucugugcugcucucuucguuuuuagcugcaggacugagccugacuuccuggcguguucauguacgccacugcucuagucaugaaagcaagucguucuuaugccaccaaggucgcaagcagguggggaaacguagcacaagaagcccagcagaccuagcccgcuuccuuugccauuuacuagcugugugacccugagcaaguugcaaaaucucucugagccucuuucuucaucuggaaaaagggaauacaauaauaacaaucuggaaagaugcucgggggauuggaugucauguagaaaagggacggcuuugugcauggcaguucucaccuagcaggugcccggcacagaguagacggcacagucauucccucaccuugaguuccugaugucuggccuucuccagcaugcgcagggcucucuggugggaagccucgagcugggcuuucauggcgugguucugcugaguggucuccuggagcucacgcugcagcuucucccucuccagguccgagagcugcuugagugccugcagguccucccuguaguugcuggugcacugcuccagagccugcugcaucugugagaccugcgcacaaggcauccugcccucagucuaagccccuugccuuuccugggauguuuucuucaaauaaaagcuuucuaaauguuaccuccaugcagcugagccuccucugucuguagagacucugaagggauggaagcugcaagcuuuaaggaccuggggguggccaguccuuccagcuagggccacaaaugccaggaaggaggaaaagagggguggggacaucaaccuuucaagagaaaucacuaggggacugaugccuuccagggacccacguggcagccccccuccucccucaggugcugcucgaaucuggcuuccucacuaaggauucuccugauagccccauguaguacuaccucccccaacuccacaucccccaucacaggacagccucccagaaaccucugcccugcucuaguuuucuuuuuccugagccaucauuaccuuagaaugaacuacgugauuuacugacuucuuaugucaaccauuuauugucuguucccaccuccauugcuaaaauauacauaucauuauauauaaaauaucuuuuuuuuuuuuuuugagacagggucuugcuuuguuacccaggcuggagugcaguggugugaucacgacucacggcagccucgaacucccaagcucaagcgacccucccgccucagccugccgcguagcugggaguacaggcacaugucaccaugcccgguaauuuuuuuuuauuuuuuguagagacagagucuugcuauguuggccugguuggucuugaacuccuaggcucaagcauuccuccugccucagccucccagagugcugggauuacaggugugaaccaccacaccuggccauaaaauguaagguauuuugucugguuugugcauugaugaaucaucaguggcucauagugagugcucauuagcacaacagguuuuuuauuuucuuuuugagacagagucuugcucugucacccaggcuggagugcagcggugcgaucucggcucacuauaaccucugccucccagguucaagcaauucuccugccucagccucccgaguagcugggauuacaggcgcccgccacauacccagcuaauuuuuguauuuuuaguagagaugggguuucaccauguuggccaggcuggucucgaacuccugaccucaagugaucugccccccucggccucccaaagugcugagauuacaggcgugagccaccgugccuggcugcaacagguuuggaaugaaugaauaaauaaaaccaagaaucccacuuugcccugguccuguaaugccuucccagcuuggaugugaaucaggcccugcaugcauuuccaaguuuguaaaaaggagggggcaggaucucaggaagggggcacauccccaccaggguuguccuaccugggcuugcaauuuggccuucuggcuuugccaguccuccucuagacgcuggauuuuggauguuuucuccuucaacaaagagcccaguggagguugugggucacuucccuccuugagaagcacuuugguccuuugaagauaaggaugccacaaucacaaaagauccuagggcuaggaaugacacugccacuccgauaacgugccagccacugugccugggaggagaaagcuccgauagcaguuaguggggauuagaaacaucuugcuuggcuuucaaaaagcaaccugccauauaaaguguauuauuguacuuaggauacaaucgggaaccaccugauaucuguuuagcaggaaccgccugauagcuguuuagcaggaaccaccugauaucuguuuuaguggguucuuaauaaaugaugaucaacugucagaaugacugagagcuuagaguuacugauaugaggucuuugggggcuccaaaaaagagaucucuauggucuuaauuuugcagcuuuuucugcaucuauaaaaacgacaacaacacuucacuuuaauacaguguuuugcacucgucaaagcauggucacacauuuuacugguguccccaaguacaaauagggggauuauaaauaggccuccacauaugcaacaugaacaaggaaaugcuaguuuaaagcugcaaaaguuucugcauucuagauaagaugcugacaaaugucuuuagaagagaccagagcucccuuccuuaauucggaacuuuugaaccagcugagaauuucaagugugaucgguuuagauugggaugugaaguauuuaucuuguuugacagcgugaaaggaugccacauggugggguucucuggagagauugccaggugaugagcagcaucuucuuccccugacaaggacaucaggccagagcuccagaggugggguuuagggucucgggcugugagaaaaggccaugagaaggggcacucugcuuggcagaggugagaaggcccaggcugggggguuaaggaagagacagacaauggggaccccgaaaggaagggucugauacuagaagcagcauaggaagguggccaagagaauggugcaaaagccagacuacccagcuccaaauuccagcucuacaacccacucaauacgggagagaguuuaaagaucucacugagaucuuggccugaucuuccuccucuauaacauaagguuaauaaugcugccuuuuccauaaggauuaguagagucaauaucuauacuuaaaacagcgucuggcacauaguaagaauuacuuaaagaacuaacuacgggcugggugcgguggcucaugccuguaaucccagcacuuugggaggcagaggcggguggaugaccugaggucaggaguucgagaccagccuggccaacauggugaaaccccgucucuacuaaaaauacaaaaaauuagcuuagugugguggcagccaccuguaaucccagcuacucuggaggcugaggcaggagaaccgcuuggacucaggaggcggagguugcagcgagccgagaucacaccuauugcacuccagccugggcaaugagagcgaaacuccaccucaaacaaacaaacaaauaaaacuguacauauuaaaagagagaaguuuucuuucucugcaucauuuugauuaucuuaguuuauccucaagucuuucaaaggugugcaaaacauagccaccuuuaaggagcaaugaagcagggauaccugggucugaacucuggguaugaaaccagcccaaggguuaggaggccagagaaacuggaggagcagccucggucaagagugagagguggcaccaccagguaagcacucccagugagucccaggagaggggagggggcugaacuuucucucaggauagggcucaguuauuauuauucuuuuuaauguuuuaguaaaauuuacauguagugaagugcacagaucuuaaguguacaauucagugaguuuugauaaauauauacaaccaugaaaccaacaucucaaucaaaauaaagaacauuuucauuacccaaaaacuucccuugcagccaaagcuuugauuuccaucaccauagaucacuuuugccugagcuuaagcaucauacaaacagaaucacgugggaugcauucucuuguuuccagguuauguugcuccucaucaugacuuuuggccucauccauguuguuguguaugucagcaauucauucuuuuuguugcuguguaguauuccauuacaugaauacauuguaguuuguuuauccacuuuucuacugauagacauuuggauuguuuacgcuucugggcuauuauaaacaaagcugcuagaaauaaacgugcccaaggauuuuuguggauauauauuuuuuucuuuuuuuuuuugaaauggagucuuguucugucacacaggcuggagugcaguggcacaaucucggcucgcugcaaccucugccucccagguucaagugauugucccgccucagccuccugaguggcugggacuacaggugugugccaccaugcccagcuaauuuuuguauuuuuaguagcgaugaaguuucaccauguuggccaggcuggucuugaacuccuguccucaggugauccaccggccucggccucccaaagugcugggauuacuggcgugagccacugugcccggcaauguuuuucguuucuuuuacuuaaauaccuaaaaguggaacugcugguagguaugugcuuaauguuucaagaaacaaucaaauaguuuucuaaagugauuuaccauuuuagacccuaccagcaauguaugagaguuucaguugcccuggauuguugcuaacauuuuguguugucagacuucuuaauuuuagccauuccagugggugggaaauggugucucacuguggugguaaguugcauuuccugaugacuaaugauguuaaccacauguccaugugcauaugagccacucacauauuuuuguuuuucuuuuuuugggacagggucuugcucuguuguccaggcuggaguacaguggugugaccacggcuugcugcugccucaaccuuccaggcucaagcaauccuccgaccucagccucuugaguagcugggacuacaggcaugugccaccacgcucagcuaauuuuuguauuuuuuuguagagacaggguuuugccauguugcccaagcuggucuugaacucuugggcucaagcaguccaccagccuuggccuucuaaagugcuaagauuacagacaugagccaccaugcccggccucacauauaucuuuuuuagggaagugcuuguuugaguauuuuguccauuuaaaaaauagguuugcagcacaugacaaagaugcccucucucacuccuguucaacauaguauuggaaguucuggccacgguaaucaggcaagagaaagaaauaaaggggauccaaauaggaagaaaggaagucaaacuaucccuauuugcagaugacaugauccuauaucuagaaaacccauaguuuucuaugcccaaaaucuccuuaugcugauaaacaacuucagcaaagucucaagauacaaaauugaugugcaaaaaucacuaacauuccuauacaccagcaacauucaagcugagagccaaaucaggaacacaaucccauucacaacacacacacacacacacacacacacacaaacuguaguuugugacagagcaauaacaccugacccucacccaggagucaagcucauguaaguccugcugauaugguuagguuuuuugcccccacccaaaucucaucuugaguuguaauccccauaauccccacguguugagggugggacuuugugggaggugauuggaucaugggggccguuucccccaugcuguucuugugauagugagugaguuuucaugaaaucugaugguuuuauaaguguuugucauuuccuucuacacacuuuucucucaccugccgccauguaagauaugccugcuuccccuucuggcaugauuguaaguuuccugagaccuccccagccaagcagaauugugagucaauuaaaccucuuuccuuuauaaauuacccagucuugggggauucuuuauagcgguguggaaacgaccuaauauacccgcagagccugauagagccaaucauaaggguagcucaucuaugagcuaaaucuuugauauuuggggguguuuguuagagcagcaauagcugacugacauaggugguauagguggggauuuccucaggaucacaaagcuuccuuauacccccuaauuaaagaacacuuggaaacauaggggcagagguuuuggaccagugcaaguuugaaucuuggaaagguuugcuaacuucuuugagcuccagguucuuaagcuaaaaaauggcuucucuggguuguuguaacaauuaaguaacacaguuuaugugaagcccauagcugugcugaagacauacaagauaugcuuguugccuccccaagcaugcugcaaggagcagugauaaauacuugaggauagaaugaaugaauggaugaauccuuccacaucugaguccucauucaauggagcacucagaagucugcauguccuccuguaccuuucuucuucaucacugcugguuccuucuucagcugcuaacuuaucuugauacuccucuccucucggcgaaguuucauccagcuucaagcauggauccuaaggccaaaaaagaaaaagaaaaaaaaaaaaaaggcaagaugagcuuaaguacagcuucaugauucaaccuguggcuuauucaaaucagagagcagagaagagggagcccccagcaacccacuaucggugcccugcuugcaggggaugccaaggcuugugaugaugacgugacuagaacagugccuggcuuacuaugauuaaugccagcccugagcccuguauccuguuuuucagucuaugaagcauuucacacugcugacaaaacuaaagcauaaagaggggaaguaaccuggcuagggugccaccaucagggaggaguggaaaugaaauaugcaaccggauaauaggacccuggggacugaacucuugaccacuuccugguaugguuccaugcauaacccucagagagagguccuuguuuccuuguuaagccugcugcacggggcuguugugaggaccugagaacaaugcuggcucauggcuaguggucaguaagugugagugaaugguguuacuauuauauccguuuaagaguuuguagucugcugugucccauuauguagaaucagaaaacauggaacuugcugaaugaccagaaaugggguaugggagaagaauaugggaacgauuaguuaacaaugaggcuucugaauauuuucugaguugaauuugcucauguuaucauucucuccuucccacagagauacacaggugaaaaagaccuuguuauuuugauuuuucuauuugucauaaccacacuguccaugaaaacaguauaagacaggguaggaacagauuugucucacgaaauagugauaauuguaaccugugcuuuucauuaacuaguuguauggccuugagccagcuucuucccuuuuuuggaccugaguuucaucaacugugaaacaaaggggcuggcuuauaucuguagugaaacuguguuccagggauccugggaggugucucagggguaggaaggggcagagcugaggcuggaggguagggccuugggcucccauccacccuugaucuggaacaaaacugcuuuuauugccuuuccacauacuguauuaucuauaaaaggccaucaaugucaagaccaaugaagaccuccacauugccaaauccaauggucgauucuugggucugcacuaacggggacucccagcagaacuggaaauauugaugauuccuuccuuugugcagccuucauuccugggcuuucuccuccccccgccccccaguugcugcuucuuagucuucucugcugaagccuccuccucuccugcuucucaaacuaccacaugugcagaaccaaacucuugguuuuacuccuccaaacaacaagcaugcaccuggcucagggcuuugcacuggcuguucccucuucccucugauauuugcauucuuugcucccucacuucacucacugcaaccagcagcucaucccuggcuuaaagcuuaggcucugcuaccagacgaccuguguuuaaaugccagaucuuuuacuuauuaacgaugugaccuugggaaaauuacuuagguuuucaugaggauuaaaugagcugauacaauguaaaguccuuagaacaguauuagguaccuaaggaacacucaacacucaaguuuauucccuggaauucuuuuuuuuuuuuuuuugagauggagucucacucugucacccaggcugaugugcaguggcgcaauuucagcucacugcaaccucugucucccaaguucaagcaauucuccugucucaguuucccaaguaguugagacugcaggugcaugccacugugccugguucuuuuuuuuuuuuuuuuuuuuuuuuugguauuuuuaguagagacgggguuucaccauguugcccaagcuggucuugaacuccugaacucaggugaucugcccaccuccgccucccaaagugcugggauuacagacgcaagucaccaugccuggacucccugggauuuuuguucccuggacaccuucucuaaaaucucaccccccucacucucuuuuccucaccuugcucuauguuuuucucacaauacauaucacggccuaacguugacuuguccacuuuuuaauuaucuguuuaccuuacuggaagguaagcuccaugagggcaggggcuuugcucaccuguuucccugaugccuagaacaguguguggcacaugcgagucauuacuaaaugaauaaacacaaauaugucacgggccacuccagauagcagggggaccacucucucccauacuugcccuacacccacuuuuuuuuuuguuuuuuuguuuuuuuguuuuuuguuuuguuuuauaagauuucacuccgucacccaggguagaguacaguugcaaaaucauggcucacuggagccucgacuuccgaggcucaagugauccucccaccucagccuccugaguagcugggacuacagguauacacccaccaugccuggguacuuuuuacauucccuguaggcacagggucuugcuauguugccuaggcuggucucaaacuccugggcucaagugauccuccugccucagccuccuaaaguucucauauuacagguguaagccacagcacccacucuucccccacuuuacaucccauggagagaagggccugggauugcugcauugucaugaaaauccccugggcauguggcuggaggguggcguguggagacagccaucacccaaacuuugaguguuuuccuguucugcuuuagaagcccuuugugccuuuaugauucauaaguucacguucuguuuaaaucauuugcauugccucuaaauguagcagaauaccaugugaugcccacuuccagagaaucaucauggagauggcacuugggaauccacugcccacugugcccaggaggaccuguccuggggcacuccaaagugauggccugagagagaguaaacaucugcucugccucccgcagcuuuucucccuaagcccuuaucuucccccugggguggauauguucugaguuaacucugcuaagccagaacuacacuucccaggacuuucuucccuacauacucuggaccaugugacuuugcauaaaauauagaagauggaagugaagcagcagucauuuccuuguuaugcuugcaugcuuggaugcuugaaugcagggcaccuggugcuguugcagcucucacaugucauuauugaucuacucgcucaccuuauuggccagggcaggugcugggcucucagcuccuuuagcucuugcugguuucucuuuuaguucucucuauccugggccuguguguacagcuccuggggcagcagccaggccugaagcuccucccacaccugccagauccuccucaggguucucccuauccccaggcaggugcaugucuagcuccgugaugaaggaugccugauucuccuacaggucaccugcauuagcaaagguggagccuuguuggcuuuagauacugacacaguucaagcccagccuugugggcugcaguucguucuugaucuuccucaguucacuucuguccuucuuuccuuccagcggcccgcccugcugaauuuaggcccagcaccagauaaagaagcaacaguugaacguaaaguguuuagcugucuccuucaauuaugcuaggucaguuccuaaauuuaaucucauauccuauaucauucuuaguagcuuguuucugugaucaaauccuaauugaugcacccuuuaaucuccagauccuacuuauucuucaaggcccuauucaacuguuacuuccucaugaagccuucacaaucuuuuuuguugcaauuauaccuucuccucuugaaguucccauagcaauuuuuuugcuaccacaauuuucuuuuuguuauuguuguuuuuuguuuuguuuuugagacggagucuugcucugucauccaggcuggagugcaguggugugaucuaggcucacugcaacuuccaccuccuguguucaagugagucuccugccucagccucccaaguagcugggacuacaggcgugugacaacacgcccggcuaauuuuuuuauuuuuuugaguagagaugggguuuuacuguguuggccaggcuggucuugaacuccugaccucaagugauccaccugccuuggccucccaaagugcugggauuacaggcaugagccaccgcaccuggccuugcuaccacaauuuucuuacaaauacuuauugaucacuuacuaugugccaggcauuguucuaggaacacaagaauaaacaaaacaacaaaaguuuuucugccuuguacuguuauaggagcauuuucuuucucccuuccaaaacauaagugaauguaaaaguaaucccagauauaguuuuuaaaauguuauaaacccuacagccagggacugagaacacgcugcacagcuauuuuucauagccugaguccucccucuuuacucuauguaacuagaaacuaaaguugagcuguuugacaugaacuggucacagggcccagugagguugguucauuguuguguauuuucaaacauguugugacuaagcagauuauaaccuacaugugaaccagaggcuaaaagguccuccugugccuccuaguuucagguauuuugggcauaaaaaaaaucucagagaucuuuaauucccacaaagcccagcagcaaauaacauagucuagaagcaaaauagcuuugugaguuaccugccauaaauucagguucuguauaaaccuggggaaauugcauggugaacauggaagaaaaauagauaaucagaugagcauauguacuauuacaauauaaauacauaaaugauguaugauuaauuagguccaggucucaaaaggaaaauucaagguuacaaagaaauuuuguucaauagaaagcacaaaauauguuggcaaaacaauucuaauaagaccaguagcuaggacaaacgugaacuggcuaaguucuacauggagagcucuucugauaaaaggaauuguucacugaaaugcuauaauaaugaagcuauagcccucuaacgauagagccugaaaacauaaggcaaaaugugcauaucuguagugagaaaugggaaaauauauaaugggagauuuuaauauacaucucccagaaacugauggauuaagcagacaaaaugagcuaggaugaggaagauucgaacaagaucagcaagcuaaaccuaauagcuaaaaaaauaaaccaauaccuacuaacauuuaugugaggucauauagugaauauaucccagagccaggauucaaacauacauguuuuacuaccacaucaagaauauaugcuuuuuuuccuaucuauaggaacuauuuaaaauugacccugaauugguuuacaaagcaaaucucaacccagugcucacauuuuacagacugugcuaucugaugacauugcaagaacauuagaaagcaauaagaagguagguuuaaaagaaucagauaaacuuuaaaacucugggacacagauaagacauacacuuagacggaaauuuauagcuuuaaauguauucauuuguauuuaaauguauucauuagaaaacauucaagaauuuagaaaaugaacaaaagaauaaauccaaaguaaguagaagaaaagagaaauaaaagacaaaacaaaugaaauagaaaaaacacaucugaccaacacaucuaaaagcuggcuuuugaaaagauacaucaaacuucuggcaagccugaucagggaaaaggggagaaaaaacuuaaagcaacaugaauaauggacaaggaucucaugacaguuauuagagauuaaaaagaauuccaaauguacucugagacaacacagagccugugaaagggaaucugcaggauguaauuucugggccacuuuauugaccauggcuauauuuaaaggaguccugggcaggaguccagaaaggggagaggacugaaaacacuaaaagggcugaugcacccagauaacaacacuggcucccagcuacacugcauuugucuauuucuauacauuaucucauggaugcauauggcucuaugaaguagccaggaaaggcacugccaucuuugauuuacagauggggaauuaaauuggagaaguccagccauuugccucaggucucauggccacuggaggguggcacaaaaucuagaacccuguauuuucugacucccauccacguaauuccauaucacugcacugacacucagcugugcuguguuaaccugauugucaccuaccagcaucaaggccuaacuggaugugaguucaaaccauguugugcaaauaccaaguaucugaaaaacugcaacucaaaaaucaaacugagaggaguaaugucagcaacaugguagaaggaaguccugaucccuuuuuuccccaauaagcauaucaauucagcaauaguucauguacauauucccuuuguaaaaaaucagaaacuaaucaaaaggcuccugcaccccaggagaaugcaaaaccagacucacuaaagcugguagggagauucagaacacacucuugccaaagaugcugccccuggugaaguaccauaugaucaugaagagacccccuacaccagcuucaaccagaggaggaaaggaguuaauuggcaugucuagcaccccaaguuuucuaagggggaugucccuagagggcuagcuuuugucuugcugcuguuggagcucuauaggguccaucacagucuagccacuuggaagagaauggagguggaaacuugggcugguagauaccauagcuccuccuuggcucagugcagagugagcaaaugaaaaccacagcuuccugcuucuuacugggaggaaaugaguugguagagacccccauuaccuggccaggcucauuaaugggggauucucuuguacaagaucagccugggaagacugggagaggugauugcuuugucuaaugcauggacaccaacacagagagucaaagagaauaaaaaucaggcaaagauguuccaaacaaaagaacaagauaaaucuccauaaauugacccuaaugaaauaguuauaugauuuaccugacggagaauaaaaauaacucugauagaguugcuuaccaagauaaagagaauaaugaaugaacaaagugagaauuucaacagagaggauauauuuuuaaaguaccagaagaaaucauggaccugaaaacacaauaacacaauaacugaaaugaaaauucacuagaggaauuuaauagaaaacuauaucaagcagaagaaaggauuagugaacucaaagacaggucacuggaaauaauucagucaaagaugcaaaaagaaaaaagaagagagaaaggacaagaaggcuuauuuaaagauaaugacuaagaaguucccaaaucuggaaaaggaaauaagcaugcagauccaagaagcccuaaauacaucagauaagaugaacccaaagaaccauacugagacagauaaucaaauugucaaaggucaaagacacaaaauuuugaaagcagcaagagaaaagcuauuugucacauauaagagaacccccucauaagacaaugaacauuuuccagcagaaaacuugcaggccagaagggaaugggaugauacauucaaagugcuaaaaaaaaugccaacuaagaauacuauaccugggaaaacccuccuucaaaaauaaaagaaaguuugacuuccucuugacugauuuggaugcccuuuauuucuuucucuuaucugauugcucugguuaggacuucuaguacuacguugaugaagagugaugauagugggcuuucuugucuuguucuaguucucagagggaauacuuucaacuuuuucccauucuacugaauuuuuuccauucaguagaauguggguuugucauagauggcuuuuaucgcauugagguauguccuuuguauaccaauuuugcugagaguuuuaaucauaaagggaugcuggauuuuaucaaauguuuuuucuguaucuauugagaugaucaugugauuuuugguuuuaauucuguuuaugugguguaucacauuuauuuacuugcauagguuaaaccaucccugcaccccugguaugaaacccacuugaucauggcgaaucaucuuuuugauauguuguuggauuugguuaacuaguauuuuguuaaggauuuuuagcaucuauguucaacaaagauauuggucuuuaguuuucuuuuuuuguuauguccuuuccugguuuuggcauuagggugauacugccuucauagaaugauuuagggagggcucccucuuccucuaucuugcagcauagugucaauaggguugguaccaauaaggaacagucagcagaguaaacagacaacccacagaaugggagaaaaucuucacaaucuauacaucugacaaaggacuaauauucagaaucuauaaugaacucgaacaaauuagcaagaaaaaaacaaacaaucccaccaaaaagugggcuaaggacaugaauagacaauucucaaaagaagauauacaaguggccaacaaaccuaugaaaaaaagcucaaaaucacuaauuaucagggaaaugcuaaucaaaaccacaacgugauaccaccuuauuccugcaagaauggccauuaaaaaaauagauauugguauagaugcaaugaacagggaacacuucuacccugcuggugggaauguaaacuaguacaaccauuauggaaaacaguguggagauuccuuaaggaacuaaaacuaggaacuaccguuugauccagcaaucccacuacuggguaucuacccugaggaaaagaagucauuauaugaaaaggguacuugcacaggcauguuuauagcagcacaguucgcaaucacaaaaauguggaaccaacccaaaugcucaucaaucaacgagcagauaaagaaacugugguauauauauacaauggaauauuacucagccauagaaaggaugaauuaauggcauucacagugaccuggaugagauuggagauauuauucuaagugaaauaacucaggaauuggaaaaccaaacaucauauguucucauucauaagugggagcuaaguuaugaugaugcaaaggcauaagaaggacacaauggacuuuggagauucaggaggaaagguugggaaggggguaagggauaaaagacuacaaacugagugcaguguauauugcucaggugaucgguguaccaaaucucauaaaucacugcuaaagaacuuacucauguaaccaaacaccaccuguucaccaauaaccuauggaaauaaaaaaaaauuuaaaacaacaacaacaaacaaaaauaaaugaaagauuuucccagacaaacaaaaguggagggaguucuucaucacuagaccugccuuacaagaaaugcuaaaggaauuucuucaaguugaaaugaaaggaugcuaaacagcaacaggguagccuaaaaguaugaaacucauuagaaaagguaaauauauaggcaaauauagaacuaaauuacuguaauaguagugugcaaaucacuuuuaauucuagcauaaaaguuaaaagacaaaaguauuaauaauuacaagcauaccucagagauauuguagguucaguuccagacuaccacaauaaagcaaauauugugauaaagcaaagacacacaacuuuuuuuguuucccuauacacauaaaaguuauguuuacacuauacuauaguuuauuaagugugcaauaaucuuaugucuaaaaauacauaccuaaauuuaaaaauacuauuuuucuaaaaaauguuaacaaucaccugagccuucaguguauuguaaucuuuuugcugugaaaggucuugcucaauguugauggcugcugacugaucagaauggucauugcugaaggcuggggcagcuguggcaauuucucaaaauaagauaacaaugaaguuugccacaucgcuugacucugucuuucacaagagauuucucuguagcauacgauacuguuugauaccauuuugcucacaguagaacgucuuuaaaaauuggaggcaauccucucaaacugucacugaucuauuaacuaaguucauguaauauucuaaauccuuucuuguuauuuuaacaaugcucacagaagucucaucaggaguaaauuucaacugaagagaccacuuucuuugaucauuucuaagaagcaacuccucauccauugaaguucuaucaugagauugcagcaauucagucacaucaucaggcuuuacauuucauucuaguucucugucucuacauaguuacuuccucaucugaaaucuugaaccccuccaagucauccaugaggguuggaaucaauuucuuucaaacucuuauuguuguuuuuuaucuccucccauaaaucaugaaucaugaauauucuuaaugguuucuagaauggugaaugcuuuccagaagguuuucaaugggcuuugcccagauccaucaggagaaccacuaucuauggcagcuauaaccuuaugaaaugaaauguauuucuuuucuuuucacccuuauugugccaagaaaucuacuuccuaaauaauaagacuucaaaggagaaauuauuccuugaucuaugagcuacagaaugaguauugugucagcaggcaugaaaacaacauuacucuccuuguaccucuucaucagugcucuugggugaccagguggucaguaagcaauaauauuuuaaaaggaaucucuuuuuucugagcaguaagucucaacacugggcuugaaaaaacagaugugcuaucauacaggcuuuauugcucuacuuauaaagcacaaguagaguagacuucacacaauucuuaaggccucuagaaauuuugaaaugauaaauggucauuggcuuuaacuuaaagucacuagcuuuauuaucuccuaacgagagagucagccuguccuuugaagcguuggagccaggcauugacuuuuacucucuagcugugaaaguccuagauggcaucuucuaauauaaggcuguuuugucuacauugaaaaucuguuguuuaaguuagccguuuucaucaaugaucuuagcuagaucuucuggauaacuugcugcagcuucuccaucagcgcuugcugcuuguuauguuauagagauggcuuguuuccuuaaaccucaugaaacaaccucugcuagcuuccaacuuuucuucugcagcuuccuugacucucucuggcuucauagaauugaagagaauuagggccuggcucuggauuaggcuuuagguuaagggaauguuguggcugguuugaucuucuaucuagacaacuaaaacuuucuccauaucagcaguagguuuguuuugcuuucuuauuacucaugugucacuggaguagcacuauucauuucuuucaauaacuuuuccuuugcauucacaacuuggcuaacuguucagcacaagaugccuagcuuaggccugucucaaaguuuuugacaugccuuccuugcuacgcuuaaucauuucuaguuuuugauuuaacaugagauaugcaacucuucuuuucacaugaacacuuagaggccauucuaguauuguuaauuggccuaacugcaauauuguuguguuucagcgaauagggagguccaaggauagagagggaaagacgggaacagcugguucuggaacacaaccagaacacauacaacauuuauuaaguucaccaucuucuacgggcaugguuuguggugccccaaaacaauuacaauagcaacaugaaagaucacugaucacagaucaccuuaucagauauaauaagaauaacaaauuuugaaauauugugagaauuaccaaaaugugacacagagacacgaaguguauuuuuuaauuaagguacacauauuuuuauagauaaugcuauuacacacuuaauagacuguaguauaguguaaacauaacuuuuacauguauugggaaaccaauaaauuugugugacuugcuuuauucaauauuuacuuuauugugguggucuagaacugaauuugcaguaucuccgagguaugccuucauaauggagcugaaaaauuccuauugccuaaugaugacauagccauuguaaagauguaguguuaaacauuaucuuuucuauguuuagcuacuuuaggauacauaaauauuuacccuuguguuacaacugcccauauauuuuguacaguacaguaauaugcuguacaggcuuguagccuaacagcaaaaagcuauagcauauagccaagguguauagugggcuacacaaucuagguuuguguaaguacacucuauaauguucucacaaugacaaaaucaccuaacaacccauuucucagaauguaucaucgucauuaagugacacacaacuguauaucacaauugaacuugaccguggggaucaauaaauaguuggcugaaugaguacuuuuuuuuuagauaaggucuguggcucuguugcccaggcuggaguacaguggcacaaucucagcuaacugcaaccucugccuccugggcucaagcuaucuucccaccucagccucccaaguagcugggacuacagguacacaccaccacgcccuucuaauuuuuguauuuuuuguagagaugggguuuugccguguugcccaggcuagucucaaacuccugaccucaagugaucugcccacauugaccucccaaaguguuaggauuacaggcguaagccacugcacccagccugaaugagcucuuucaagcccagcaauacuuguuucaauugcuauuaugaacaccuuuacaugcauaaacuagaaaaccuagaggagaaggauaaauuccuggaaauauacaacucuucuagauuaaaccaggaagaaauagaaacucugaacaggccaauaacaagcagcaagacugaaaugguaaaaaaauugccaaaaaaagucaaggacagauggauucacagcugaauucuaucagacauucaaagaagaaucauauuaauccuauugacacuaaucuacaagauagagaaagagggaacccuccauaaaucauucuaugaagccaauaucacccuaauaccaaaaucaggaaaggacauaacaaaaaaaggaaacuacaaaccaauaucccuaaugaacauagaugcaaaaauccuuaacaaaauacuagcuaacgaaauccaacagcauaucaaaaaaauaauccaccaugaucaaguggguuucauaccagggaugcggggaugguuuaacauaugcaagucaauaaaugugauauaccacauaaacaauuaaaacaaaaaaaucacaugaucaucucaauagaugcagaaaaagcaucugacaaaauccagcaucccuuuaugguuaaaacccucagcaaaaucgguauagaaggaacauaacuuaauguaauaaaagccaucuauggcaaacuugcagcccacauucuacugaacggggaaaaguggaaagcauucccccuaagaacuggaacaaaacaagguugcccacucucaccacuucuauucaacauaguauuggaaguccuagccagagcaaucagacaagagaaagaaauaaagggcauccaaaucaguaaagaggaagucaaacuaucacuguuugcugaugauaugaucguauaccuagaaaacccuaaagacuccuccaaaaagcuccuagaacugauacaugaauucagcaaaguuucaggauacaaaauuaauguauacaaaucaguagcucuucuauacaccaacaucgaccaagcugggaaucaaaucaagaacucaaccccuuuuacaauagcugcaaaacaaccaaacaaaaaaaaccuuaggaauauaccuaaccaaggaggugaaagaccacuacaaggaaaacuauaaaacacugcugaaaaaaaucauaggcaacacaaacaaauggaaacacaucccauagucaggaauggguagaaucaauauugugaaaaugaucauacugccaaaagcaaucugcaaauucaaugcaauucccaucaaaauauugccaucauucuucccagaacuaggaaaaaacaaaccuaaaauucauaugguaaaaaaaggaacccacacagccaaagcaaggcuaagcaaaaagaacaaaucuggaggcaucacauuaccugacuucaaacuauacuauaaggccauagucacuaaaacagcaugguacugguauaaaaacagacacauaggccaauggaacacaauagaaaauccagaauuaaagccaaauacagccaacugaucuuugacaaagcaaaaaacaaaaaacauaaaguggggaaaggacacccuauucaacaaauggugcugggauaauuggcaagccacacguagaagaaugaaacuggauccuaaucucucaccuuauacaaaaaucaacucaagaugguucaaagacuuaaaucuaagacccaaaaccauaaaaauucuagaagauaacauugggaaaacucuucuagacauuggcuuaggcaaagaguucaugaccaagaaaacaaaagcaaaugcaacaaaaacaaagauaaauagauuggacuucauuaaacuaaaaagcucugcacagcaaaagaaacaaucagcagaguaaacagacaaccuacagagugggauaaaauauuugcaaucuauauaucugagaaaggacuaauauccagaaucuauaaauaacucacaucagcaagauaaaacaaucccaucaaaaagugggcuaaggacaugaauagacaauucucaaaagaagauauacaaaugguaaacaaacauaugaaaaaaugcucaacaucacuaaugaucacggaaaugcaaaucaaaaccacccugugauaccaccuuacucugcaggaauggccauagucacaaaauaaaaaagaacacauguugacauggaugucgugaaaagagaacauuuuuacagugcuggugaaaauguaaacuaguauaaccacuaugaaaaacaguauguaaaguucuuuaaggaaucuccauauuguuuucuauauagaacuacccccaaucccacuacuggguaucuacccugaggaaaauaagucauuauacaaaaaagauacuugcacacgcauguuuauagcaacaaaauuugcaacugcaaaaauauggaaccagcccacaugcccaucagucaaugagugguuaaaaaaaaauugugauauauacauaccauggaauacuacucagccauaaaaaggaagaaaauaauggcauuugcagcaacuuggauggaauuggagaccauuauucuaagugaaguaacucaggaauggaaaaccaaacaugguauguucccacuuauaagugggggcuaagcuaugaggaugcaaaagcauaagaaugauacaguggacuuuggggacuuggggcaaagggugagaagggggugagggguaaaagacugcacacuggguacaguguacacugcacaggugaugggugcaccaacaucucagaaaucagcacuaaagaacuuauucaagcauauaagguaacacauauguuaauuagcuauauugagccauuccacaauguauagauauuucaaaauaugucacacaugauaaauuauaguuuuugaugucauuaaaaauuauauuuaaguuuuguuauuuugaaagcuuuuucacagaucuuuuucaguuuuguuuguuuuugagccugucuuguaccugguugcacuaaauauauaauaguucucucuugugaaaaccuuaaaagccuagauuugaacacauguucaaugauaaugaugauauaacagaaaaaagaacuuauuucauguaaccagacaccaccuguuccccaaaacccuacugaaauaaacaaaacaaaacaaaaacauuguccaugucucugaacucuaaauaaaacagacucagaacauggcuucugagaauaucccugagccacuccugguguauccugaguuguucaacccaauuccuacucuuggguuuuucccaucaggcguuuuucucagauucaguccagugcucucucagugcuaaaguggccuggguaugaauagugugcacggaaaaauaaauagaucugcuucuccuuuccaaaccaucuacugcaaaugcuuccucccacuuccucccaggcaaauggcugguuauuuuaaaucuguguucacauuuagguccucaucuuucaucuuccaguuauuuaaccuuuucuggauuauuucuauuuuaaagaaacacccacgcccaggaaaucuccuagaagggaauauucaaagucauucucaaguucauuugacaaucuuucaaaaguagcauuauguacaucuuaaaauagaacaccgaacguaauggaguuuugcugaaaugauuacaggggacuguaauagauacuauaaagucaacuuacauugacagaaucuuuaacaguucugaaaagugacuucauaugcuuucuccuguucauuaccacaagucucuggggguaugaagugcagggauuauugccacuguuuuacuaacaagaaguagugcagcauugcagcuuacagcacaggcccugguaccacccuuugggccuugguuucucuguaagagucucauagggugguuuguggacugugugaaguccuauggguuugccauuaugaguaaugaagaaacugaucucagggaugguuucugaccugucugaggcuccuaaggaggucuugggcagagcuggguggaacccauguccuaagccuuaggcagguggcccugcccuacacugucuucccaggcucuacugcaucucagccaaugcccagaaccucuccauggagugaagggcagccugccuuguuccaugucagguggaaccagacccuucaauucacaccaaccaagggugcuggcucccaauuggccugagggacacucaggaugucacaguuguuuaagagccuagugguuaucugccugccaacggccaggacaggugaugccucaaauuccuaugguccuccaaaauauggcacggggugacucuugcccagcaaaccacucagggccuccaaggaguaggggacacuuucaggccuggagagcuuuggagugucccuggauccuucccaaaugccucaggagcuugccuugggcugcuuccccauggcaucccauuuccuggugaagucauguucagauuucagugucaagcagauguccgcagaugucauucuucuggaauaguuuccuggacuucccuggacagaaagcuuccucucccauaugggcuugccauuaauauaucuucuugccaucaucauagcagucauuguaacagguuaguauuuaaggaaauaguuauuucucccauuugaaaugugagcccuccaaggaucaagauugggccucauucuccuggacaugcagcccuauggcuuguauagugaugguacucagacauauuuauagagacgagaugacuuaaauggcaguuaccacaaaugacucccuuuuccuucuggagagggcgugggcagguguauauaugaaaacuuccacccuucuccaccgcccguucaguguggcccaggcaccaaaggaaucuuccggaaaaaaauuuucccucagaaugauuaugacuaaaauggcuuucuggaaaccaauuaguaaaacuuugaaucuacgagaaucaaggagacuggcagggagagaccaggauuaaagucuuggugaggucccagcuaaguuuaguggggacagagucacacccacguuuggcagccuucucccugcauguucugggaguggaguggaaagccugaucucaguugacauuauuauuuuuaucucucucucucucuuuuagauuucuuuuuauuguuuguuuauuuauuuauuuauuuuugagacagucucacucuguuccccaggcuggaguacaguggcacagucuuggcucacugcaaccucuaccucccagguccuagcgguucucgugccucagucucccaugcagcugggacuacaggcgugugccaccaugcccagcuaauuuuuguauuuucaguagagacgagguuuugccauguugcucaggcuggucuugaacuccuggccucaagugauccaccugccuccgucucucgaaaugcugggauuauaagcaugagccacugcgccuggacuguuuuuauuucucuugacucacugaagugcuuugcagaacagcuacuggccuaaacugaaaccccugagucuugaacaaacuuaaauuuuauagccccaauccagcaggaacaucacuggggaaguugucauuuaauauccuguucugaugccccuauugccaccagcagaucugccaccagauuguucaagccccugccuaggccucccuggcuuuaccucugccccuuguaccauucugugugguugcagguauggcaguacugaaguaugcugcucacaccucaucuagaccuaggcagagcuucggcucaccaggcuggcacagagcuggcuugccaaaacuguuugaacuacauuacauuuuuuuucuaauuggcaaaguucagaaaguuuuguaacuugcuguguuagcaaagcacacguguugcuggugggggcacagagcagaacaaccucagugaguggcaagugaugguaucuauugaaguuaaacacgcacacaccacugcacccggcaaauuccacgggagcaagaguuagcaccuagagagcauuugcacacacuaggugcuguuuccaacaccauacagauaggaauucauuuagaccucacaaagacccucuggaguagauacuaucauuauccuugguguauaaaugagaauggugaagcaaagagacauuaaauuauuuguccaagauuauccagccaguaagaacccaggugucugguucaggggugagcuugcuuaacuacuauacuauauuauaucccucuauggugcuauccauugaaguauuaucuauaauagagaaauauuaaaacaaucuaaaugucaaucauaagggaaugguuaaauauaauaugguuuuucuguacaagggagaacuaggugguugguuuguuuuuaaaaaaaugacgcuaaaagggaaguauacugauauauuacaaucucuaagcuauaaaauuuaaguuaagaaaagcagaacuggccagacgcagugguucaugucuguaaucccagcacuuugggagguggagguggguggaugguuugagcccaggaguuugagaccagccuggacagcaugaugaaggcucgucucuacaaaaaauucaaaaauuagcugggcauggucgugggcaccuguagucccagccacucaggagucuaggcaggaggauugcuugagcccaggaaaucgaggauugcagugagccaggacugcacuccacccuggguagcagaacaagacccagucucaagaauaauaauaauaauaguaauuacuauuauauuauaguauaaaauaauuauauauaaaauaauuauauauaaaauaauuauauaauaaaauauaauauaaaauaaaauaauuauauauaaaauaguuauauaaaaaauaauaauauaauuacuauuauuauuauuauuauucaugagaguauccuaucauuuauagaaaaaacuccauaauuaugccuguauauacacuauaccucugaaaggauacauaagaagagagaaaauaaaacacaacaaguaguuuuuccugggauagggaacucagcaggaagaaggaagaugcuuuccaauguauaccuuuauauaccauuugaguucuguaccauauauguggauugcuuauuugaaaagaggcccgcauuugaaagaacaaacaauaucugcaaaaugccuaauagaaaacagcaccagauauuuaagcuguuacuaaauguccacauuguuuuccagcuauuuguuuaugcacacuucucccucuagcauccagcucagaggcuggcacaugccagguauugcacacaugacugcagaaugaaugaauaacgugcauauugaguugaaucaaaugaaacugauauuugucgagguucuugcugcaacucuauagaggaggcaucugcacuucccucuagaaaccgaacucauucacuauucacaacagcaaagacaugaaaucaacccaaaugcccaucaaugauagacugaauaaagaaaaugugguacauauacaccaccauggaauacuaugcagccauaaaaaggaaugagauauguccuuugcagggacauggaugaagcuggaagccauuauccucagcaaacuaacacacgaacagaaaaccaaacaccauauguucucacuuauaagugggagcugagcaaugagaacacauggaugcagggagggggaaaaacacucacuggggccuguugagggaggguguuggguugaggagagcauuagggaaaagaucuaauacaugcugggcuuaagaccuaagugauggguugauagguacagcaaaccaccauggcacauguuuaccuuuguaacaaaccuauucauccugcacauguacccuggaacuuaaaaaaaaaaaaaaaaaaaagaaaccgaacucauugaaagacaacauucuagauuaagaaggcugaggagggcugggcagguuggcucacaccuguaaucccagcacuuugggaggccgaggcaggcggaucaugaggucaggaguucgagacuagccugaccaauauggugaaaccucaucucuacuaaaaauacaaaaauuagucgggcgugguggugugcgccuauagucccagcuacuugggaggcugaggcagaagaaucgcuugaacccgggagguggaguuugcagugagccgagaucaugccauugcacuccagccugggugacacugggugacaaagugagacucugucucaaaaaaaaaaaaaaaaaaaaagacugaggaguuuccuggugaaccaacccaugguucccaacaggcacuuguauucuggacuucuucaggacuugcuuuuuuagcuacagaggugguucucaacuggggauaauuuuguccccuggagacauuuuugguuggaaagguacuacuggcaucucguggguaaaggccaaggaugcugcuauacauccugcagcacacagcauagcuccacacaccccgccaaaacaaagaauuauccaaccccagagucaagugcugaaguugagcuguggugauagcaccggcucauggacaucgugaccaugacugguagacucaggucaucagcccuggaacauaccuagaauuucuauguguuuauuucccuaaaacacagccugcucuacaaucuuccugaacugcauuuuuuuauucagucuccagcuuaccaccuuauuucagauuuaaucucaucaagaaggauaccagccaacuccgguccaucucccugccacagucacuuugaggagcuaagaaauacuugaguaucucaggacaaccuuucugggaaaccccacagggcgcuggugaaaggugcagcugucucuggggccaaaaguucucuggaaugcuagcucaugagacugauucuugagaaacugagggagaaugaaaaugucugcacaucccucaggcagaaaucuucugaaaggagagggacagccucagaucaggaaggggcaagcccuguggaugagggugccucugcuccuuuaggcuuguccuccaggcuuacaugggggcaacagggcugcucaaggauucucccuuaaucugggugucagaggaggaaggaggaaauccagggaguccuggcugcuccccuuaacccaaugacagcuggagucuguuuuaucuggaaggcauccugggcaugugcugcucuuauggagagaggaggggaucagagccaguaguuccauccuguuuuggcuauuuaccugccugugacugugggcaggucaccugcccucaccuucaguuuucucuucuauaacaugggugccuuacaggguuguuggaaaauuccaaugaagcugagcaugcuggcucaugccuguaaucccagcccuuugggaggccaagaaaggaggaucaccugaggucaggaguucgagacuagccuggcuaacauggugaaacacuguuucuacaaaaaauagaaaaauuagcugggccugguggcaugcacaugaggucccagcuacucgggaggcugaggugggaggaucacuuaaggccaggagguugaggcugcgugagcugugacugcaccacugcacugcagccugggcaacagagaaagacccugucucaaaaacaaaaaaacuccagugaagucaaagaugagaacagugcucuaugacugaccaguucacauacaaauguuaauuauuauuuaaauccacagucacuagauuuuggcucauuuuugcccuggugaauaugugguugaguggggguuaucucagaggaguaugccaugggggcuguuggcaggaccggggccugagcccuggaagaugggggucaugggagagaaacugcaguuccugaggacacucguguacacagaaauggguaaacaagagacuggugagacugaugugguaagauucagacugacccauguaguguuuucccuccuggaguuugaaauggccugaaaauuguaggcaacaaucaaauaagugaaauugaaggccgugaguuuuuuauggcucucuugcugcugaaacaggaauuaagaggguuauucaagccaggguacucaagcgcccacuucagggagauuauuuauauugcugacaugguacaacaaauguucacugagugccuaucuuguggguuaggcugugucccuaagaagauaugcugaagucuuaagccccuguaccuaugaaugugaucuuauuuggaaauaggaucucugcagaugcaauuaguuacgaugaggucaugcuguaguagagugggcccuaaagccagugacuggugucuuuauaagaaggcugugugaaggcacaaagacucagagacaaggggaaagaggccgugugaugacagaggcagagaucggagugacguguuugcaaggaagacuuggccaaggaacaaaaggacugcccagcaaccaccagaggcgaggggagccgcacagaccagguucucacucgcagccuccaaaauaagccaacaccuugauuucagaccucuggccuccagaaccgugagagaguacauuuccauggcugaagccaccaaguacauggucauucguuauggugauccuagagaacaauccaacccaccgugagccagacagagacaaacaggaaccaguuucuacccucaagcggcgucccugaaacggcagguucacggacaagggcuguugugagaguaaaugagaucauggcuguggaggcagacagccggggcaagagaggggcuuuuaugacuacuacugggguucgugcugggcagaaucaaaggcccugcucgaguugagugcgcccuuuauccuccaggcaggcugcucucagagagagagcggagacucaucugacaggccuuauucucuuucaaaccaugcagauaauuagucagacuucuauuuccuucgugguuucugugaauggauuuuguggugauuuuuuuuuuuuccgggcauuuuggcagugucgaggagagauguaaaagagcccauuaacaucagcauguguuacuggggacacugaaaggcugagaccgagaaaagaaauaucuuuaauuaaaucugacaaagcuggagguuaccugggucuccagaaugcugcagugcuggcggccuaauuccuggggacuuuccucagcuccuguggggcgugucuuauuuuguuggauaaauucuuccagccuuaaaaccuaaaacaggagauaagaaacaccacacaaugaaaccagguucuaccuccucgauacagucauucauccgggaaucaauucuccugggucagucuguucuggggagagugccccauuagacaaauucuacacacacuucuagaaaugccuuuuuuuuuuuuuuuuuuuuuuuuuuucugauccagggucuugcucugucacccaggcuggagugcaguggcacaaucuuggcuuacugcaaccuccaccucccggguucaagugauucuccugccucagccuccugaguagcugggacuacagguaugcaccaccacgcccagcuaauuuuuuguauuuuuaguagaaacgggguuucaccauguugcccagccuggucucaaacuccugaccuuaagcgauccgccugccucggccuccaaaagggcugggauuauaggcguaagccacugugcccggccuagaaaugccauuucuaaugagcuaguugcuuggucuuuccagaagaaaaugugcccaguagguuuauaguauuccacacuuuccuuaaauuauuuacauagauauuucuauacucgaucuguaggguggcuuuaauaccauuccuggaaggccacucaauuucuuuugaaaacaaaacaaaaaaguuaauugguaaagaaaaugaacaacauuuaagaauuauauagguaaaaugagaaaagagugguugggggugcucuaaaaguguaaggccuuaauuaugaugaugauuaaccaacuaauuguaauauuugaauuaaacagacagauuuccccuagacuuugaggagaaugaggccaaaaaacauaaaggaaacuuugacuuuccucaaaauuuucuagaaaccuuaauacuaguuaggcaccaugcuagguacaaggagggauggggaagggacagagugagagcaagauaguaaaaucauaaagcuuggucccugccuuuaaggagcugucauuuuaugagggagauagauaaauguuuauaaccccaaugacacucaguagagauauguacaaaauaauaagagcaccuccuuaaugguccauuugcucugugccacccaggaaucuaagccuuuuuuaaaaaaauuauuuucuuuuuuaaaaaauugagaugggaucuugcuauguugcccaggcuggucucaaacuccuaggcucaagagauccucccaccucagccucccaaagugcugagauuauagggaugaaccacuacacccagccaggaaccucuacaguauuaacucuuuuaauccucacaacagccuuuauaagguaggcacuacugcacagaauuuacagcaauagggccgggugugguggcuuaugccuguaaucccagaacuuugggaggccgagguggacagaucaccugaggucaggaguuugagaccugucuggccaacauggcgaaaccccaucucuacuaaaaauacacaauuagcugggccuguuggugcgugccuguaaucccagcuacuugggaggcugaggcagaagaauugcuugaaccugagaggcggagguuacagugaaccaagauugcaccauugcacuccagccugggugacagaacgagacuccgucucaaaaaaaaaaaaaaaagaauuuacaacaauaaacucugcccaggggcauucaagcagcuuaagggcacugaaggaugaacaggagucugccauuggugaaggugggauagugcauuccagacagcagaaacagcagguguagugguagagggcgggugggguagaugugaggacugaagaaagaguccauguuggaggggccagagugaaggacgggacagaggcagcagagccuuggaggauagugguagcaagugagguucggcccaaauugugaagaagauggggauucaagauuuuaggaagggaggaguggggcuuugagcagauuuggauuuuagaacaugaguucugggaguagcuggccuagagagaacguggaggcagaaagauccauggcaacgcucuugcaagacucuagcaacauugcaggggaacagcaaggcuaucggaaaguccuuccagacuuuccauaaggaauauuagagaaagagauauuucaagauuauaaaacuaugcuuaaacugcgucuugcuaagguuuaugaaauauucagaggagcuggugcaauuguuuauguaacaucuacaaguggggaaagagucuaggcaagucauuccaaggaucuuguucaaggcauagguguggagacaagggaggggacagaaaggcuuaaggcguaggacccacaggacuugacaaggaucgggugugaugauagggcaggauugugacuaggggugaggaugggagagcugggagaagagacuaugaucaaggaugacacuuucauuucuagcuuugguaagguggggacagauuguagcaucauuuaggggguaggaggagucaagaauggagagcaagacugaggcccuuugucaauggucaaccucuuggucaugacuugcaacugaauguaaacauucagguucugagugacccuuagucaucaaagaggcaacauaccauacuagaggcaguauuagcuuagcgguuaaggguggggucauuagagccacauuaccuggguuugaaucccagaccugcuacuuguuagcuaugcaauguugggaaagugauuuaccuucucugugccucaguugugucauuuguauauagagaugauaauagcaccuacaugguaaaguuguuaugaggauuaaaauaguaaauguaaacuucuuagauaguaucuugacuagagcaagugcuccacaaagcuagccauuauuguuuuuaaaaaaagagcucugggcugggcacgguggcucacgccuguaaucccagcacuucgggaggcagagauggguggaucaccugagcucaggaguucgcgaccagccugggcaacacggugaaaccccgucuuuacuaaaaugcaaaaaauuagccuggugugguggcaugcgccuguaauuccagcuaguugggaggcugaggcaggagaauugcuugaacccaggagguggagguugcagugagcugagaucacgccaaugcacuccagccugggcgauagagugagauuccaucucaaaaaaaaaaaaaaaaagaaaggaaaaaaaagagcucuaaggcacauucacagaaauaggucagggcccaggcuucccugaccuguguuauucaaaagaaugacugggccuguaaucccagcacuuugggaggccaaggcaggcagaucacgaggucaagagacugagaccauccuggccaacauggugaaaccccaucuccaccaaaaauacaaaaauuagccaggcgugguggcaggcaccuguaaucccagcuacucaggaggcugagacaggagaaucgcuugaacccgggaggcggagguugcagugagcugagauugcgccacugcacuccagucgggcaacagagcgagacuccgucucaaaaaaaaaaaaaaaagaauaacugggcuggucucauacauguacaggccaccuuaagcucugcagugaggagugguccauguacaacaugaagacuggcaguguaucuucaacagggcgagaggaagagauggagggagggagaagugaaggaggagggagugagggaaaggcagaaggaagggaggacagcagggaagaaaggaggaaggauagagaaaggcuucuuugcugugcagccccaccuuggucugggccagaacagaagccucuaucccagaacuuuucaccaagacccaccucuagacccugaaauaucaacucuaaggaaagacauacucaucauuuuuuaaaauaaugauuuuagaaauagaaggaguuagagaaacaucacaccuguguacuuaucacucagcuaaagaaauaacaugucacaaauacagcugcagcuccuuacagucucucccuucuagagauaaccacugguccucaugccuuguuuagauugaccucuuggauauuccuaaacaaucgauacuguuuugcgcauggccuuuguguucuuaaaaauucccuagagguugugauguacagccagggcugaggaacugguuucauggguuccugaagcaggugggagacacaggucucauguggaagguuugagggaggacaggggaaggaaggaaacuuguugacauuuuuuugguuuaagcaggcucagaaauggcucuuaggauucuguuucuagccuuuuccacuaguucuuugauacuuuuaggggcccacgaaaauguguuaauuucuuuuaaaaucagaaaaaaguauagucuggaugauauucaucuuucuaccaaugcagucauaaaauauaaauuuuuaauauuuuuuaauaaaggaagggccuagaaaggcaaaauugcuaagagcccacaaaggggcgaauguaacccuggggaaggaaaggcaggggaacugcaggcuacccacuugugccuucaugaagccacagaaccaacaccagcggccuccuguguccuucucuuauuugagacauuaaaagccucuuuguuuaagcaucucuaaucuggcucucuguuacuugcagcuaaaugcacgccccccgagacagccugccugucuggcugaguguccuuuucugucuuccaaaauucuuggcuucucaguuagguagaagcucccagggaccagaaacagcaccccaaggcuugcauuuggucagggcucaccucaagcagagaauucugaagcuucacauugagggcugcuuucucuucuuccagcugcuuuaucuccuuuucugauuucuuccucacuuccuccaacugugcuucuacuuccuaaaugaugauuggaagaguuaaccauacaaggcacgaaaacaggacacuuaauguuuucacacccugccuuauucccagagaucaaagaagcuuaugagugucauacaacacugcaaauaaacauaaauuagacauacacgagaaggucaaaagaaaacacguguuaacgucacaacacaaagccugauauauauagggguggggcggggcaaauuguugucuuuaaguuuucuagugucaaauaaaaaaaugcucauuacuaacaaaauucucagugucacauucauuacuaacaaacuugucagugucacauaaguaaaaaagccaacuacauuuucggaugcagggaaauaggaaaagcaguacaaaauuucuucucaacagcauccauacaugagucaaaauggugugguuagccggguaugguggcucacgccuguaaucccagcacuuuaggaggcugaggcaaguggauugcuugaguccggggguucgagaccagcccgagcaacauagugagauggugucucuauuuuaaaaacaaauacauaaauaaaauaaaauaaaugaugggauucccagggccuauugcuccauggucccucaccacagcccaugagccucagugcaaagcagauccaggugaaggaacauucuggggaccacaugagcggugcaguuacguuccagcugugucaucucgagcacauuuccuacauuuccuaaccucucagugacucacugugcuacucacuugcucccugccacuccagguacauaguaaaggauugguagaugacaagcacuaauauaauucucauagaggggccaggcgcgguggcugacgccuguaaucccagcacuuugggaggccgagguggguggaucacgaggucagcagaucgagaccauccuggcuaacacagugaaaccccgucuccacuaaaaauacaaaaaacuagccaggugugguggugggugccuguagucccagcuacucgggaggcugaggcaggagaauggugugaacccaggagggggagcuuguagugagccgagauggugccacugcacuccagccugggugacagagcaagacuccaucucaaaaaaaaaaaaaaauugucauagagaccuaggcuuucuguucuagcuuaauuucuguggaaauugugcaaguaucuagaggagugaaugagauagucuguuccucuuagcugaacuuuagguagacauuguguuacucauucauucaacaaauauuucuugagaucuacuaugugccaggcacuguccucagagcuggggagauaaaagggagaauuccuacacaccaggagcugacauuugagugaaaaagacaggcagcaaucaaaguccaugagcuaacaagacggcaaacacuagguuggauggagaaauaauaaagcugggagggggcucugcaguguuggggaagggcugaaauguuagacaacuuggccagagaagugcuccagaaagugacuuuagaguaaaauccuguaauaagugagggaguucaccaaggagauaucugugugugagguuuccaggaccugcaaaggcccuggaauguucuaaggacagagaggagcugccauggcuagacuagaugagguuugaggagcaccaucugaggccucaagcaucaagguaagacuaaccagugaggagugacgugguugcaauuauauuuggauaagcuggcuacuguuuuucuuuguuguuuuuuuuuuuucugagacagggucucgcucugucacccagacuggauggaguacaauagcacaaucauggcucacugcacccuugaccacccgggcucaagcaauccuccuaccucagccucugaaguagcugagacuacaggugcaugccaccaugcccagcuaauuuaaaaaaaaauuuuuuuagagauggggucuugcuauguagcccaggcuggucuugaacuccuaaacuccagcgauccucccacuuucaccucucaaagugcuaggauuacaugcaugagccaccaugcccagcuucacuacggcuuccuucuugaguacagacugauguggguggaggcauugggugagagcaguggcaggcaggccugggaggaggcuguggugguaacugagguaagagugaugguggcugggccugugguggcagugcagcugggaggagggguagaacuugggauauauguggaauguugagugacaggacucacugaaaggagaggucaggaugacacuaggagagaauggugccgccaugaacugagguggggaagacaggaguggauucagggaccaucugaggagcuugucugcaugugucaagcuugauacaucuguuagaugucuaauuagauagauagagggucuggaauucaggggaggguucuggguuggaguaugcauuugagaaccaucaacauacagaauguauagaggcaugcauuugaaugagaaaagcuagggagagaacaugaaggaaaauauaagacauuaaagaaccaagcccucggacacuccaaaauuuccugugaauuagagguuacaauauccagcagguauuuguagagcagcucuccuaggcugucaguugauuauagaccuguagaucuaauggacaugauaacaguagcugacauuugcugaguacaugccauuugcuggcacuuuacacagaucaucucucuggucuuugugaaagcaguaugacuuagguacuaccacuaagccuuauuguaaagauaaagaaaugaaacuuaaagagguuaaacgccuugcccagggucaagauuugaacucaggaaagccugauugguugacugugcuucuucccugccuucuuaaggaaaauuuaguuccuaguacagaaaaaugcuugacugugugaguacagagguugucauguaucggacaacagcaucacuaggcugagcagagaagacuuguaggaaaacccauguuuaagcuagacuggaaggaucauuaagaaccggacgggaccaggcagguaaauguggaagcagggagaaaguacucuucaucaagauaaagaacauggaaugaaagaugaacuaaaaggcuggaaccaucgagugugcucacgccuauaaucccaacacuuugggagaaugaggcaggagaauuguuugaagccaggaguuugagacuagccuuggcaacacagcgagacgcuaucucuacgaaauuuuuaaaaaauuagcugggcuuguuggcauguaccuguagucuuagcuacucagggggccgaggcaggaggaucacuuuagcccaggaguucgaggcugcagugagccaugaucgcaucacuguauuccagccugcaugucaaagcaagaccuugucucuaaaugaaugaaugaaugaauaaauaaauaaauaaauaaauaaauaguaaaaggguggagggcagaguuggacaggggagaggugugggaugagguagaagagagcaaucaggagugugccucuguagggucuuaagaaccauguuaaggaauuggaacuauuuaauacauuauaacgaugauagggagugauuggagaguuugaaaccaagguugaauuuccagaaguuuccacugcaaugaagauuagauuacaugaaguggggagacuggaggcagggaaaucaucgcacaguccaucaugaaauggagguugacuggaucagcaugguaccacugaggagagagggaaguggaggaauuccacagucauugaagaagcagaauuaauacauuugauggaugacugaaugugaggggugagaaagggaucauguuugacuccugaguuuccaaguugaacaucugaaaagauacugcugcugaucaccugcaugauaccuuuauacuuccuauggggccaagcccagccuaggccagugacucuggggaggcccuuagcauuuuuccuggggucagucacuuaaaagagaagaaaaaaaaacccuggauauuuagcauguguauagucucuguucaguaaaucuaugauccccuuuugcagggcuuguuguuucugagagcucauuuucuaaacacaguauguaaauucuccuuugguuucaaacaaguucagguaacuuaagcaaucaucagcagcaaggccaucccuucaacaaaaauucauuaucuuuacuucauuaauuagcuucucauccauagaagcuuuuauugaacagaaguuuuguuuaacaugcuuuaauaaagaagacacucacuaacauugccaagauguguucacuguaacagcacagugacaaucaccugugauaauaauuuuuagcauaaaggaauggcuauuucuaauuuuacguagcuuaacuucgcagucuacaagugauuaaucauagcuucagcuguaaccuugacaaaugaaccuaaugugaaaaaaaauucucccucagauggaaauaaucaauuucagcaguaauuuuuggcauuacuaagcuucauguugggugcaaaauaaugugguuugcuuucagaaaacaaacaguucugggucacuggagaacacagauuugaaagaagcaugcccaguccagcucagcccaaagugaccuugaagauuucaacaggaaaauucccuuaacucagguaaagagaaaaaaaaaaacaaacaaaaaaacaauaacaaagacaaggauauugagaaaaaaggagacuaaugcucucagauauuuaaacugcuucagcccaaaccuggaagacuguuucaugggccauuaauuuauagaauucacagagcauuuucauaaacucuauucucacugaacuuucagauacccaggaaaacagguuuuauggcacccauuuuacacagaggaaaucccacugcugauaagacguagauacaggacucacacucauuuucuguuucuuuguccagauugucuacaauuacagguaauuaaggaaaagagauguaaaagugccacuguaagggaacaacugagcaaucaccgaaaauuaccauguagagauuucaguuggcguauuacgagaaaacuuguuaacuuuuuucaaaaagaaaaguuaauuauuugguauauauuuaaaguucaugaugcagcugaaagagucaaccaguacaaggccuuaaauaaucacucagaaccagucauuagcaauaauaccaacacugauacuaaucaauacaugggagaccccaugaagugucccaacucaguaguagggcuuaacuagaguuagagaaaauucugcucuagacucauccuaaccaagcuuaaaaauaaaucuggaaaauugaaaauguuauguuauguauaauuuaucauaauaaaaaugucucacacaaugaagcugguucacaaguaauuuaacugccugucaaaacaaaauucagcaaagaggacaacaaaaacuagauguucaacaacuuaacauucucaauguccagcauucaauaaaaaauuacuaaauaggcaaagaagcagaaaaaugugucucauaaagagcagaauaaaaaagacccaaaagugacagagaugacaauguuaaaggaacauuuauaaauguauucaauaauuuaaaggaaaacaugaaaauaaugaggagggagaaggaaacuguaaagaagaacagaauggaauuucuaaggcuaaaaauuauaauaucuaaagugaaaaauguacugaauggguuuuuaaaaagauuagaugguacagaaagaaagaugaguaaacuugaagauacagcaagagaaauuauccaaacugaaacagagagacaaggaaucugaaaacgaagagaaccucaaugacuugugggacaauauuagaagagaagcaagagcaggaaaagaaauggaagaaauggccauaaaauuuccaaauuucaugaaaacuguaaacucauagauucaaugagccuauaacaaaaacacaaagaaaaucacaucauggcauaucauaaccaaauuguugaaaacuagugauaaagagaaaaucuugaaagcagccgauaagaagaaauauacuaugcacaaggaaaagaagauaaauguggcuguuaacuuuucauuagaauaaaaugcaaaccaaaagauacugaaugacaucuuuaaaguguugaaagaaaaaacaacugucaaccuagaauucuauauccaguaaaaauauccaacaaaaaugaaggaaaaauagagaaagaaaauauguugugaguaggaguugacacacgcuacaagaaauguuacaggaaguucuuuaggcuaaagaaaaauaauacuauacaggcacuugaagccaccaaaggaaugaagacugcagaaauggcaaacaaaugggaaaaugacccuuuuuucucauuaacuuuuuuuucucuaaaauaugguuguccguuuaagcaaauauaaaagcaauguacugugggauuuacagcacguguaaaauaaaauacaauauauaacaacuauuguacaaagaacacaaagggugaaaugaaaauguauuaucaugagguuuguaugugugaaguaauguauuucaagacagaccaauaaauuuaaaggugcauauuccaaauccuacaguaaccacuagcucuccacuuugccaaaagagagcauaccuaguaagucaaagguggagcuagaaaauggaauacccccaaaauacucaauguauccaaauuaaacgggaaaaggggguggggaacagaugugacaaguaggaaaaacaagaugguacacuuaaugauaauuacauuaaaugugaauggucugaauguccccuaaaaggcggagauugucaaucuguauaaaaaaggauccaaguauaccacaaaagcacuuuuaauagaaagacacagguuaaaguaaaaggacagauuaaaauagaccaagauacacuaaccguaaacaugcuggaauauacauauauuaucagacaaagcagacuucaggacaaaaaauauuucauaaauaauaagagucaauucaucaagaagacacaagaauccuaaauguauaugcacaaauaaaaagguuucaauuuacaugaaacaaaaacugagaaccaaaaggagaaauagacaaaucuacaauuuuaauuugagauuucaaucuuccucucucagugaucaacagaacgagcagagaaaaaucaguaaggacauaauagacuugaacaauacuaucaacaaacuugaccuaauuagcuuuuauagaacacuccacccaacagcagcagauucagauucuuuucaaguacacaugaaccauucaucuagacagaccacguuugggccaaaaacaagcugaaaaaauuucaaaggaaugaaaugacugaaucuauuaucuaaccacaggggaaccaaauuagaaaucaauaauaaaaugauaucuagaaaugucccaaauaguuggacauugaacaauauacuucuaaauaaccaggguuauuuuggaaauugauagaaauaugaaaaaaaaaucugagauuuuggugguaguagcaaauaaagaaaaaaauuugagaaaauaucauuaauauuuguuauuuaaaauuagaaaacagaggccauaaugacauaugucgaggugacauauuuaagauuugacagugagacugcucuccccaggcacagugcuuauuacacacugacuugacucugguuguuugacuagaucuuguccucccuaccagauuguuuguucccugaagacauggcugauuccuguguuccugcauugcucgaaacauaaauaugcauucagucaaugguaaauaaacaguagaugaauaacggcagagcgaggacccgaauguuauaaucuacggcccagggcaauguauauucuuuuauacacauagacugguagagagcaagaauuacuggcuauggagucagacaagccugauucauauccaacuuuaguuguguucuacucaaguuacuuaauuucccaaguuccuugucuaugaaguggaaaaacaacaacagagcugaggucaggaucugaaugcugaguggagaguugucauucauuuuggcugccaaagaucuagccucccuuccauuuggauguuugagaacccuccaucugauggaucagagcccuccucuuauuauagaccuggaaaacaccagacugccugcagcuugagcaugggcacaugacugaagcuucccagucaggcgcaccuauccuggauugcaaaucacaggccaugauguggacagugggaagcacacagaacuuggcaccugcaguauccaggggcagcagggccagcuguucuagagcuguacugaccaaccgaacuuucugugaugauggaauguuccacagugugacguagcuaaugugcagaaaucacauuucugugugauuucucagacacuaugcucagaccugugcuggccaguaggguagccacuggccauauaugacuagggagcacuugaaauguggcuagugccacugaggaacugaaauuuaaauuuuauuugauuguaauuaauucaaauuuaaguaaccacacaugucuaguggcuuccguauuagauagcucagucaguucuccaggcaaugcgcagggcccagugugggugguguuggcuguguaagcugcagguccagguucagagguggcagcauagguguucuaauuuguuuugcaauagauuugggacauuauuccuggcuggguagcugccaagcccaguuccuuggucuuccauuacgcuuguuaaauuccuuuucugccuaaacgcccaguuugguuugugauucuugucaccaagaauccuaagugauacaaaugagaauugcagaagugauuagcacagcucaggaggugcugaauacaucaucugcaccccuucccuaggagucaguguaugcaaaugcuaauuauaggauguguacugugcuguccaucaagauucggugacaguaucaucuaaucuggggucaaggaaggcaucaaggccuacaggucagcuccagcccaccuccuauaguguuuucuuuaggguaggguagcacuuaggauacacaguauaccugcagacaagggcucaaagaaauagugcacuccuaacucuacaggggaaaaugauaucuauuuuuaguccauaaacccuagauuggaggccucuuuaagguuucaccuuucccaaucugcauggccuaauuuaaauucucaguucuuggaaacgaacaaaauguaaaaccaaaaaaacaaguaagugcaacuuauugugacaugauucauaucccagguggacucaugcccccuauuaaggcugaagugagauuuacacauucagggucagguguggcugacagguuaccagggcaaccuguaguucugcgagagcaugcugcggucccuccugcugcuuguggccggggauggaaagaguguccaucuguuugucugaggauuagauuugugcaaccaguugcagcucauguggagaaaaaaugcuuucaauacagcugccuacccagugugaagguggggaagccacgggcucuggagucaggauaucagauuugaauugcagcuccaccacuuagcuguguguguugauauauaacaucuuugagcuucagcuuccucaacucuaaauggggauaugaacauuuuguaauauuguuggaaagacuaaauguguucuaaaguaugagguacuuuauaaaguauaguggucaugaaauaauauuaucacacauuauguuacccaaugcacauggaaauuaacaaugagaccugggcaugguggcgcaugccuauaaucccagcauuuugggaggcuaaggugggaggaucccuugaguccaggaguucgagaccagcugggcaacauggugagauccccaucucuacagaaaaauuuaaaaauuagccaggcaugguagcaugcaccugcagccccaguuacucaggagacugagguggaaggaucccuugagcccaggagguugaggcugcagugagccaugaucacaccaaugcacuccagccugggcaagagagagagacccugucucaaaaaaaaacaaaaaaagaaauuaacaauaccuaccauaucuugaacuuucauuacauguuugcacuaaggguuuauauauacuauaauaccauauuuaauuuacauaauaagcccuugaaguauuuagcccuauuuuagaaaucaggcuuuaggccaggcaugguggcucacgccuguaaucccagcacuuugggaggccaaggagggcggaucacgaggucaagagaucuagaccaaccuggccaacauggugaaacccugucucuacuaaaaauacaaaaauuagcugggugugguggcacaugccuguggucccagcuacuugggaggcugaggcaggagaauugcuugaacccggcagguggagguugcagugagccgagauugcgucacugcacuccagccuggugacagaccaagacuccguuucaaaaaaaaaaaaagcaaaaagcaaaaaaagaaaucaggcugccgagagguuauaugaccugucuacagucacacagcuugugucaggguuaagacuuagauccaagacuagucuugaucuuucaccaguucauuuaacacauaaucuugaguauuuacuacucguaacccccacacaacagugcaugccccagugauacaggauuaucuuucaguggacacucaaagcugguacugcagaaucuugggcuauaaagaggccuccuuguaauuaaacaaagcauuccaccuacauucacaaugauauugcuucauacuuccuucuuuucugaaaucuucacauauguuacuuacuuauuccagcaaacacaagagacgaggcuuugcaugccuugccagcagaaagccacccuguuuggagggagaguggaacagcacacagagacagaaauuucccucacuuuggcaugcugcugauuaaucaccuguaucgaccugcugcccacguguccuaggcacuaggauacgccuugugucuucacgugguuccucauuaaauccuugcagcuacucuacaaggugcuauuauugucauccuccauuuuacaaauuaggauccugaggcauguggaauugcccucugugggggcccagguuaaaucacuugaaguguggugauagaguggggaauuggauccaggaacuccuccaggcaugaauuuuugguuaaugguauuucucuguguguuuuugcagaguaaguagaguugaauuucccuaaguucaccacucgugacacaauuccaccccaugucaaugacuccaggccuauaggggugucccccaucuccuccaaaagacccugaacucccuuuggagaaggcauaaggagcugugcuaucuaucauaacuguauguuucaucuguguguauucagagaauaagcuuacauuuguacagagcaggagcucaguaaauguuugaggaagaaaagaaggaacaaaaaaggaaagaaaggaggugggagaaagaaaaaagaaccagaacagucucuauggaaguaggucucacccucugcaguuucuuucuuucagccuccacggacgagcgaacggauuugauuuccacggugugcuucuuuaccaagucuucuagucgcuucacuagcuggucuuugagauguuucuucuccucuucugucugauguuugauuuuacgaaggucuucuucauauuguugcuucauauauucugucucagcacuugccucuuucuuggucuauaaaaagaaaaaggaccuuguaaaaccacuggggaggggugaggagcaaggaaucaccauuucccuuucauacaacuuuuacaacguuuauacacuguuuuuacagcauguagcacaaggugcaaucaauuuuacaagacuauauauuugauguuaguaaaagucuccaccacuggaaaagggcuuuuugcaauggugugucuauuaucaugagaucagauacuucagcccauacuaugguagauuuuaaauaaugcuuugcuuguuuugacugggaacaugcaaugagauccuaagccaguuuccaguuucccagaagccgaugauauagcguugggaggauucugcuacagucucagucuccugguuuccaguagcauggaguaggcaguaaguuggcuggaauucuacuccaggaacuacagggucuucugauuccaaguggauccacuaugcuuggggacuggccucuaccugacgcuuauaauagauagcaaagcucucugugccuucuccauccccagggcugggucagacacuaccugcauaucugugccuccuuucaugcaagggcacuccuugagacagcuuugauccugcugaggaugaagauugccggcuuccaagucauucucuucccgcaggacuuuguucucugaaacuaacucagucuucauggcaucugcaagcauacauuucagcauuauuuggaaugcucuuggccauggccucuuguucaaggcuuucugcugucaggcccccguuccgcuuuacaaccacuuuguccaacauccccuguguaauuccugcccuguggucugcugaccccgaagcauggucaagguagcaauucucaucucuucucaagaagccucgugagcuuaaauaacugcccugcucuaccuuccuaaauaaccuccaaaucuuuuugacugcaguuucuauagguuaaaaaaguugagcauguuucaaauauguucuuuuaauaggaauuuaaaggaugaaacaaaaaccaauauuuaauauaagcagaaugacuaaguuuuccucccauauucucugaaguacucaugucccacuuuugagaccucugcucgaaacccacaacaccuuucugguuccugcagaaccaguaccuccccuucucugcaccuuucugcuccaugguggcaucuuucccaugcacguuauucgucugcugccugggccaugucuagauaccaaagcaugcugugggccguaagguacaggcccaugagcucccugaaggcagcucccagguuuugugccuuuguuauaucucccagugucaagagcuuucuguugagggcccuaggggaaggcacuuagaaucauguauuuuuggauacaagcaagagcucugucaccaaccaguuggcugaccuugagccagccacuuaucuuuucuuggucucauuucuucaucuguaacaugaaagauuggcaauacuuuuugggcugggcgugguggcuaacgccuauaaucccagcacuuugggaggccaaggugaggggaucacuugagccccaaauuucaagacaauacuuuguauuuaauuuaauuuuuuuuuugagagggaguuuuguugcuauugcccaggcuggagugcaauggcccagucuuggcucacugcaaccucugccuccagggcucaagugaguccccuuccucagccucccaaguagcuaggauuacaggcaccccucacugugcuuggcuaauuuucuuguauuuuuaguagagacagguuuauaccauguuugccaggcuggucucgaacuccugaucucagguuauccaccugccuuggccucccaaagugcugggauuauaagcaugagccaccaugccuggccuguauuuaauuuuuuaauuuuuauuuuuucauagagauggagucucacuauguugcccaggcuggucucaaaguccugggcugaaguagcccucccuccucagccuccuaaaguguugggauuacaggcaugagccaccaucaaucugcccaaccagauugacaauacuuaucacacaaaauuauuggaaagacucaauagcauaauuguguuaaaugauguuaaaagcauaaagcauuguguaagugguggggggugaagugagucagugcuaagaauuucaggcacuguggugagccugguggggaaauaucugggggcaagggguccuuucacaucacaccuuuuagauguccaaucugagccagcuccaggugaggcagcuguaguugucagcucaccuguacccugcagggauuggucucacccaccaggcaggucagaucaagcagcccugccccuccucucugcucccuuagcaggcuuaggcugccaguagcaccagaccaaccuggcagcuaaccuugggucuuuuaaggaaaucauuccagggcaucucaccugucugcugugucccacgacacuccugcagcaucauucugucuuuggcaacagccagcuucuccccaaguuuuuuugcagugccuuucaacucugaauucuccugucgagccuccuuaagcugcacauccagguccuaaacagacaggaagggucccauuucucugguuauagcucuguauagagacauccuguguacacagaauagccaucagaccugaaaggcggguauaugcacagcagaagcccugagucaguggaauucaguggcccagggcucaucaaaucucuccucauccucuggccuuccuuuagugaggauuaaaugagauaaagugguaaaaaaaaaaugcucagggaguguuagaaauacuaacugcugcuacuuguagagauggggcucugugcuuuuguggggcucacauaacugaaucauccaugauccugcucucuauaaacacaaaguccuggggauuuuagguugcuaugaaacuaacaggggcuuuagaaucaggcugaccugaguucaaacacuuauuagccaugugccaauguaggcuaguccuuacgccucucaauuucagucuuagcuucucaucuguagacuguagguuuccaaguucuccaacguuagggaccaagucuaacucaccacgugucccuugcccauagcccugggccuggcagauagucaguguucaauaaauaucuguggguggggcgcaguggcucgagucuguaaucccagcauuuugggaggcugaagcaggcggaucaccugaggucaggaguuggagaccagccuggccaacauggcgagauccugucuguacuaaaaauacaaaaauuagcuggguaugguggugggcacuuguauucccagcuacuagggagacugaggcaggagaauugcuugaaccugggagguggagauugcagugagcugagaucgcaccacugcacuccugccugggugacagagugaggcuccgucucaaaaauaaggaaacaaaacuauauauauauauauauauauauauauauauauauauauauauauagugucuguguguguguguguguguguguguguguaaugaauguaggugaauucaauggagauaauagggcucaccuccguagaaggcaagugcuuagcacagugccugaucuauagcagguucacaauaagcagcccugcugauuuaucccuuugggguuguaagaagagaugcugcuuuaccugaauccucuccuucagcuucugggcguacuucuucaggucacuuaucuugcggccucugugcuccaggucuccuuccagcuuccggaccugagccugcagggcugacuccuggaccuggaaguucuugcggagguccgacuccuucuccugccacugccacagggccuggcucaccgacugcugcauggccugccggauggccucguuuucccucucguagguggccugcagcuccucggccuugcgggcguaguccuugcucagcugcugguucuccacucgcagccgcugcaccucuagcaggaccuccugcaucuccgggcccuggccuggcuccgacuugguuucagggcucuccuggggcagccggcccugcgggguagccucguggcucgucaggugcuggagccuccucucguagucagccuugagcuccagcauuucccuggagagcgugaggacucgcucggcgugcucugccuccacccucagcucucucuccuucgucuccagccugcacgaggccgacucagccagcgccuccuccgucagccucuuuugcagcuccagggcgcucuccagggccuggaugcgcuguagaagggcuuccuccucugcgcagcccuguuccugcaggagccuggccuuggucucugccaccgcauucuggagcuccuccuggugcgcuucccgcagcgccuccaugcuggccucagccucauccuggcggguguucagggcauaaaucaccugcaggaaaaucaacagagcccaguuagggugagggggcuggggugugggagggcugaggggacagagcaauauucuccugcauggcgguugaucugcacaaguggcaccugagaagaggauuugcgugcaggggauuuauuagaaacuguucccagaagaagccagugagagagcugcaaagugcgacagggaaggacuuggauugggagcaaaggggugacauugcacaaaggccccagagagggcagcuuuggccgaauuccgaaggggaccucuguaguacagugggaauccacggaagaguuuuaaagcagagaagugaugucaucucauuuguucagaaggaacacuuuggaaugcaaaucccggaacaaaacauuuagaaaacuggacccaggccaggugcgguggcucacggcuguaaucccagcacuuugagaggcagaggcaggcggaucaccugaggucaggaguucgagaccagccuagccaacauggcgaucuggucucuauugaaaguacaaaaauuagcuaagugugguggcacgccccuguaaucccagcuacucgggaggcugaggcaggagaaucacuugaacccaggaggcggagguugcagcgagcugagaucacaccauugcacuccagccugggcaaaaaagagugaaacuccaucacaaaaacaaacaaacaaacaaagaaacaaaaacuggacagagcaauauauaaaaaggccaguauaacuugaaaaucagcuaauguaauaccccacaucaacagaguaaaggacaaaaacuacaagauugucucaauagacacagaaaaaaauauuugacaaaauuaaacaucuuugcaugauaaaaaacacucaacaagcaaggcacagaagggacucuucucagccucauaaggcacaucuaggaaaaguccccaguuaacaccauacucagugauguaagacuaaaugcuucccucguaggaucaggaacaagacaaagaugucuguucucccacuuuuaacacaaaagaaaaaaaaaugcuuucuuugcugugugaagaacugaaugaaggaagacaggagcacaaugagaagcccgggaaugaagaaugacucuuaggauguuggccugagccacaggucgguguuuccugaaaugggaaaaacuguagguagaacagguaagcagaagaaaaucgggaagucuaauuuggacauaguaaguuugaugugccccuggacauacuaguggagauggcaccaaggcauaaacagagauaaauguccagcgcucagaggaggcagccugagcuacagaggaggggggugaagucaggagaguuuuguugcuguuugcuugaugagagauuccagaacauauuuguaggaugaugggaaugaccccauggagaauccagaaguugaagccaggcacaguggcucaugccuguaaucccagcacuuugggaggcugagguaggaggauuacuugagcauaagauuuugagaccagccugggcaguguagggagacucugucucuaccaaaaaaaaaagccagaugugguggcucacaccuguaaucccagcacuuuggaggcugaggugggcggaucacauggucaggaguucgagaccaggcuggccaauauggugaaaccccgccucuacuaaaauuacaaaaauuagccgggcguggggugggugccuguacuuccagcuacuggggaggccgagggaggagaaucgcuugaaccugggagguggagguuguggugagcagagauugcgccacugcacuccagcuuggccaauacagcaagacucagucucaaaaaaaauaaaacaaaaacaaaaacaaaaaaugaaaaagcugggcaugguggcacauuccuguggucucaguuacuugggaggcugaggugggaggaucacuugggccagggagauugaggcuacagugagccgugauccugccacugcacuccagccugggugacagagugagacccuguuucaaaaacaaaacaaacagaaguugaagccccaggaauaacaauagauaauaaagggccaaaaucccugagaaggguaccacagagauugguuucaagagccgugagaacacguccucauggggauaggauggaaggaagagguggagacagguguguggcacuugggacaggagaaugagggagcucucaccuuguagacaugagaagguggcuucuacauucucaguggaaugagacaaggucacuaacagugagcugaguuggaggacaggaagaaagcauaaaagugugaggugugagaaguugugaacucauuuuuaggaagagggaagccaguggucuacuuuacaguguguggcaucagaggcuguguugaguuacaguucucucugcuuugcuaugagauuuuccucagucagguucaucugaauuaguucagagaagaacaggaaggauggauggguuaucuggaguuggaguuuuauuuggugggugugacagaaagagaagacaagguauuuucaaggugcagcaagauggaaagauggagcagaaguaguuuuuuggugaugacaaggccaaguggcaaagggagcaugugacugaggccaaguagaggaaaugaucacuggagauaagggggucaaagacugagaaauccagggcagagugaaccccacaugagacguccucacugagaacaaugcaagagaagcugggcugguguagacgccguggagucagaugccaaacacgacacuggcugccuggggcauuuacaaucagaaaaguuuuccugaagacuccccaucacacccuuucacacggacuuuuagccuuuguggguugcugguuuuuccuuauccaugaggcugucuauugaacuacacucuaacuucauugccaaguuccuauuacugauucacccaugguuuucaaacugcacuccuuguagucuugaguucucugauagaggucagggcaacaucagggauccugggggaggcugagcaaguggggagcccccuaucaaccauggaagagcuuucacacucagccuucccuagcauagaguuuagaaaacaaaaaaaaagcuuuguauggcuuuaaaaaaaagucaaaaacuagaggcuuagauaauuaugaaauagaaaauaggccaaucgggaauaguguaugagaggaaguuuuggguaucacugugugccugugugucugugcaugugugcauucauuacaaaaucaucaucgacggccagauggcaccacuagaggugacauguguaauagauuuaauaacgguuuaccuggaggcugcagauguugaagaaagagugaacguauaaccacgacacagccuaagaucuuacuuuucauugucucugucugauauagccaucaguuuuuugucugucuuccucaccagaauguaaacuccaggagagagaagcuuggucuuccuuguucauuacucuccauccccagugccuggcucaaguggacacucuaaaaauuauuaugcgaaugagugaauaaaggagucagaacuccaucuuaaagaauguaacucaaggugcgauaugaaugugacaucuugugaagcccugggagaauaagcacuaccuugaggaccaugaauccaacacucugucauggacaggagaaggaaguccccuuguccuuccaggaagauccugcaaugaaaugaagugcugucuccaaaacuccucccucucaucacuuggugcacaggauuuggccacuucuguuaauuuccgugaccuucuaaugacuuccauccaagaauauaucuggaagcugaaauugguuucccacuggcuauaauuuauguuaauaacagauaccauuuuaaucaaauuuacuaugugccuagcacagggauaggugcuauauacacauucacaaucucagaggauccucauggcaacccugcaauuugguauuuuucugagcaaaugggguucagagaaguucaguagcuuuugugaagucucauauaagaagguuugaguaaugcugaagcacacguucuacacauggugccacacugcaucucaccgucucacucagucauuuauucauucgcggauucacugcacaucucggauguggcaggcucugugcugggcacugggguuaccugcuggccaauaagacaacugaauuugcaaccucagaaauauuuuaauccaguaggagagucagacaagaaaauggaaaguuucaaugcacugcgaugaguacuacgagaggauuugucaccaguuacuauggaaacacagaggaagcggucugggaggaaagaagacuucccagaaaaagugggccuugccuccucauccuugggguggccaauccccuuuuccaugucaagcugcacauggacaagaaccauaucacuucuuugggcugcucgacagcacuugguauacaguugaguauacaguagguucacaguaaguaucugcuauggggcugcugcaguucaucaaggauucacgcuuuccuuccacagcgaagagcugcugcagaacagccauugagcagaggccccauuuccuagcuccuuucauuuaggugagguccuaugacuggugauugccaauggaauuuggguagauggggugaugugugucauccuggggccaauguggggacauuaagaagggcuuauguccuuuccacaguuucuuuuuucaucugcaaacuuaaugcagaggagucagaggccuuagaggaaggcagaguucaagauggaaggcauccgagcccugaaggaccagggagaaggccaccuacucccucaggaacacugucugucauugaucuuuauggcaauaacuaccguguugagccucugacaucuuggcauuuaucuguaacagcaucuauuaguaccuguuuggggucccugagacuaacuccagguuuaaccauucauuagaggauucaguauauagccaugcucggggcuaugauuuaugacagugaaagguacaaaguaaaaucagcuaaaaggaaacgugcaugggaugaaaucuggaggaaauuuaggggcaagcuuccaaggugcccacccaaaauuaacacaaaaucagauucagggugaggguagcagagaggguaccacauggugggcucacaaugucuaagggcacuuuggcauguucacauggagccacagugucuggcaaccaaaguccccaaauccaacaaaaugugguaucccuuggggacaccaaggaucugccugaacuguucugucaggcugaaaucugguaaaugguuccuccccuccccuuccccucaccucccugcacagaagguuacuuauauauccuuucagggauaguguguacauaaacaagaauguuauguuacauacuccauaucacauauuuucaccgucuuuuauacacauacacauucaucugcaccuugauuuuuuuaaacuucauaauagauuuuggagaccaugcuauuucuguacauaaagaaauuaauguuggggccaggcucaguggcuaacaccuguaaucccagcacuuugggacgccaaagugggcagauuguuugaggucaggaguucgagaccagccuggccaacauggugaaaccccaucuccauuaaaaauuaaaaaauuagcugugugugguggugugcaccuguaaucccagcuacuugggaggcugaggcaggagaaucacuugaacgcgggagguggagguugcagugagccgagacugcgccacugucacucuagccugggugauagagugacacucuaucucaaaaaacaaaaacaaaaacaaacaaaaaaaaugaaauuaauggggucaaaagacacaaaauuucaauuaaaggaauaaauucaagagaucuuucauauagcacagugacuguaguuaauaacaauauacuguauauuugaaaauugcuaagagagcagauuuuaaguguucucaccacaaaaaaugauaagcaugugggguaaugcauauguuaaauagccugauuuagcuacuccaucacauuugcauacaucaaaacaucaugcuggaaaccauaaauguauacaauuuuuacuugucaguuuaaaaaaaaagagauuucuuauuuuaauuuuuggcugcuucaugugccauuguguaaguuauaauuuauuucucugccuccuucugagagccguuaagucauuucugugggagauuaucgacauguuucuuauuucacuguuauuaaguaaaauuuucuuuacucuuuuuuccauuucugccaguaagccugaagucugcuuuuugcuuauaaaugcaacuaauaaaauuccaaugccuggccuuaaaaaacucaucuucauaauuaauacaggagccucagaaagagaugcaagaggaaggaggacaacauaccugccaucuugugucauaaaacuagcucaaagaauguugagaaugcuugcaagcauccagugugucuuccugugcaauguggagaugugugcaaguguucaccacugaccaugcaagggcacuccugggacugcuccccaggacauguacuuacucuuaccacauccucucuuuucuccacccucuccacucccuuccccucauucuauacuuguucucugagcuugacccuuuuuccucucccagguuuuuuuguuuguuuguuuuuugagagacagggucucuaugucccaggcuggagugcagugguguuauuauggcucacugcaaccuugaccuccugggcucaagugauccucccaccucagccuccugaguaccugggauuacaggugcauaccaccaugccuggaugauuauuucauuuuacuuuuuacagacagggucucauuauguugcccagguuggucucgaacuccugggcucaagucaucugcucgccucagccuccaagagugcugggauuauaggugugugucacugugcccagcccucuccuaguuuaacagucucuuuucaucuuaacaucuguccuuuuacagccugucccucauggucaaucauuucaauuacauucuuguugacaucuccaauccccugcucagcucaucuuuagccuugcauucuuggcauucucaauaccagagcuuacccuuuauuuuauuuuauuuuauucuauucuauugucucccucugucuuccaggcugaagugcaguggugugaucuuggcucacugcaaccucugccuccugaguccaagcgagucuccugccucagucugaguagcugggacuaaaggcacaugccaccauaccuggcuaguuuuuuguauuuuuaguaaagaugggguuucaccauguuggccaggcuggucuagaucuucugacuucaggugauacaccugccucagccucccaaagugcuaggaucaucagugagaaacacugcacccugcccagaacuuaucuuuuaaaaugugcucaaguuauuucaucucucugaagcucaguuuucuugccuguaaaauagagagaauccaggcccaguuuuugugaggaucaaauaggguaauauaucuuaggugucuggcacguaguaaauacuuauuaaacguuucuuccuucccuccucucucacccaaucuccuccaaaggaaaggucccauguuuuagagacacaaucuccuccaacuuguucugaauaucugaaaucauugagcagauuuugagcaguccgcucuucuccugggcuucaugccucacaggucgcuuggcaacucuucugccaucugcuugcuugcuuucacucaccaccuucuagacuggaacaucagacugcuccaggccucauuuauaaacccaccuccuaugggggaggcugacuucagaauccaucaaggcacauaaauaauucagcagccaagagaaauucugagcaagucaaaacgacuuccuaagaguuuuagaaauccacugcugauggguugacgucagaggagauuucagcagaggccuguuagggucguagagauugaguguuguagguuuaacaaggcucuaauuaauggcuuuuaagcaucagauccugaugacaguuuucaucaaguuuggcagcaggaaucagaauugaaaugaaaaagaaaaaaaaaaggacauaauaucuguugagggcccagaguaugacauucacugggccagauaauuuacaugugucuuuucaauuaaucuauuuagguuggugcaaauguaaucgugguaaucgcaacaaguaauggggaaagccgugauuacuuuuaaaccaaccuaauaacaauucuacaaagugaauguuuuuaugcuuagccuuauuuuacagauggggcuaacuucauauguagggguaauauaauagaacuccaccuuuuucuagaugugugaacuucaguacguugcugaaccugagucucaguuaccuuauccaagacaugcggagaguuuuguuuggagaucaaaugacauuaugaaccaaaaacccuucacagcacucuuaagcacuuaacccuucuuaagcucuuaaaaaauucauuaguuaugauuuuuacuauuaucgguauuacugccagaagucauugagcuaaaaagugagagugcugggauucaaauccaaauccuucuggguccaaaguuaaaagaguagaaucauaccuuguuuagaaaaaaaaagcugguaauaugcuuuuacucaauguuuuugcagcauuuccuauaugccuggcaugauacuaggcaugggaaaaacagaacaaauaagaccauucuguugaggggcuuauaggcuaguagaguguggcagacuacauuauuuguccguauaauaaucuucgcccuuucuuuccccuuccuugccauggucuguggauggcauuuauuugucuuccccauugauguugaacuuggcugugugacuugcuuuggccaagggaaugugaguggacuuguugcaagcaaaggcuuuugauauguuuaugugcuuuggcuugcccucuugugcuucuaccacuugcuacaagaaaagccugugcuggguacccacgggucccagaaugagagacacagagcaggcuggaccccaccccagaguguggaaugcaacuggcucagccaaacccagcugaaaucagcugaacagcagugaaacugagcaggaaauaacucacugcuguagccauugagauuuagaguuguuuguuacacagaauuauugcaggaacaucugccuaauacacaaagugagauagaaaagaaagccaauuaguauguacaguaguugucccuuaucugagggggauaccuuccaagaugcccacuggaugucugaaagcuuggcugguacaaccccuauagacacuauguuuuuuccuauacguauguacauaucugugauaaggcuuaauuuauaaacuaggcacaauaagagguuaacaacaaucacuaguaauaaaauagaacacuuauaacaauguacuagcaucacugcucuugagcuuuggggccauuaugagguaagaauaaggcuuauguacuugaaaacaagcacugugacaguugaucugauaaucgagacagcuacuagugacuaaugggcagguagggacuacagcgccgauacucuggacaaggguaugauucacaucccaggaggaaaagaggaggacggcacaagauuucaucaugcuacucacaacgacaaauaauuuaaaacuuaugaauuguuuauuucuggaauuuuccauuucauauuuucaagacuucuuugguccaccuuggguaacuaaaaccuuggaaagcaagaccacagaaaaaaagggacuacugucuagggauauuucaaguacuuugcuagaagucuguagaggugcagagaaaggcacaggggaggaaaggaucacauugcuccaguaauccccccuuuucuccuucauuaccauuaguggaucacuccuaucaauacauaacugugcuguaauuuuuaucaugaacaaaaaucuuuauuuuaaccccacauucuccauuuuucuacaccccuuuauagcaaacuccucaaauacucuauaaccauuguuacuaauuucucaacuucccuauuccucuugaauuaucaccaaucaggcuuuuacaccaacuaauccacucaaacagcucaucagagucacuagugauguccauguuacuaaaacaauacccaguucucagucuucaucuguucaacuuuucagcagcauuagagcuaaugaaucacucccucuucuugaaauauugucuucucuuggcuuccgcaauagaacauacuccuacugaccgcugaccacuccuucucaucucuuuggcuaguuacauccuccucaacucccauccuucacauaggaaugccccagaguguuagccucagucuguuucuauucuuuugcaaaaauuuccuuggggucucacucaauuccauuauuuaaugcauucucuauuugcuaaugacucccaaauuuauaugaccaggcuggaccugccaccugaacgucauacucauguauucuguugcuuaccaauaucucuacuuggauauugaaccugcagcucaaauuuaauucuggauuuuuccuuuuaauaccugcucuucccacaauauuccucaucucauuucacaggaacuccuuucuuucaauugcuaacgucaaaaauuuuagaaucaacaaauaagcacaugaaaggaugcucaacaucuuuaaucauuagggaaaugcaacucaaaaccacaaugagauagcacuucaugcucauuagaauggcuaucaucacaaaaagagaaauguuggugaggauguggaaaaauuggagccccuguacauugcuggugggaauguaaaaugguguagccacuguggaaaacaguaugcugguuucucaaaaaauuaaacauagggcgaggcgcgguggcucaugucuguaaucccagcacuuugggaggcugaggggggcagaucaugaggucaggaguucaagaccauccuggccaacauggugaaaccccgucucuacuaaaaaugcaaaaauuagcugggugugguggugcaccccuguguucccagcugcucgagaggcugaggcggaagaaucgcuugaaccagggaguuggagguugcagugagcugagaucaagccaaugcacucuagccuggugacagagaaagacuucaucuaaaaaaaaaaaaaaaaaaagaaagaaaaaagaagaaaagaaaaagaaauuaaacauagaauuucauaugauccaguaauuccauuugcuuaucuuucucucuaaaauauaaauuacaugcaggugaaaaaguucgucugcagaguucacuaccagauccccaaagaguggcuggcucauggaaaggacccuaauauuuguugaaugaauaaaaaaucucggcugggcgcgguggcuuacgccuguaaucccagcacuuucggaggccgagaaggcggaucaugaggucaggagaucgagaccauccuggcuaacacagugaaaccccaucucuacuaaaaauacaaaaaaauuagccaggcguaguggcggacgccuguagucccagcuacucaggaggcugaggcaggagaauggcgugaacccgggaggcagagcuugcagugagccaaaauugcaccacugcacuccagccugggcgacagagaaagauucugucucaaaaaaaaaaaaaaaaaaaaaaaucucuuugcccuagcagaaagggcauccgagugcagaggauacccaaguuggguuuggaaaggugagcaaaugucacccagguggacaggaaggggaagaaaauacugauaagggaaguaccaugagcaggaaguagcgcaaaggcauggcauagaggcaagacaugcaaggggcguccuccggggcagagccgaggugaagggcauuggcagggaagaggagcgcaccaugacaugacgcuggacaggugggcaggggucagacccucacaaguccagcauccauguuagcgagugcugacuuuguccuguuugcuagcacauggugaucaugcagacucccaggcccugccccagacagccugauguggagagucugggggaggucccgagauaugcauuuuuaacauucccucgcaaugggccuaagaucugaaagccagauggaugcauacuuuggagacuugugguauguguuccacgcaggaaguuucucucacaagauucggccucuugggaguuagggggaauaacacugcaucucauaacugcaucucuggaaucguugcagagagcagucugguugagaugcaggcaggaagaagaguuaaggaaggggccagggaagggaguuugggcuagagagcuguccaggaggaggaguggcagggccagugacucacuggguguggagagggggagacggaagaguccagaagauucugcagcuugugugacugaggguauggcuaucccauuucuacugggaagcagagcuuccugggaucacaggacaccaaaaggccacagucacugcucuugacucacaucccugcacacagagcggagcuucaguguucugggcaccaagucagaaaagaggacuaacuaaaccgccagaaggaagcccuggauucgggugcugagaggccuggggagagcagagguugugugguuacugucccuuccuuuaagaaaacaggcucaaacagguccccaacaaagcugggcuccuuccagcaaaugagcuuggaauggauuucuagauagauccaaaacgcuaauuaaaaucucaucauugcucaucagagagcuguugcuaggcaccuagcugcacauggcauugaacugugagacaucagcuucugaguaauugaaacccaacuguucuccaaaccaauuuaggcugagacuuagcugaaagacgagggugggcucccaggaagguucuuaaugagagccccaccgucuacaggcccaguccaacccucacacagaacacaggccuggacucuuucccagggagucuccccacugcauaagaugggggucuggaaagggaucaucuuguuuauuucaaaucucgaaugacuugcuuagaguuuuuggaaagcaccuuugguuggccaaccugguuaauaaacauguguaugcgugaaugauuuuuuuuaugaauaaaaacaauacaaagaaaucuuaacacuuuucauaggaaauauuaugagagagaauuaauccaagcgggagcaucaaacccuauaaccaugcauacaaauggaauugcgaaaauucaaacgcagacagagcagcucuuccaguucaccucuuuauaugccaauuuuacauauuuaaauccugaaagcagcuuuugugugcagaucuaaauagacaugcauauccauuuuuccauaugaaugguauaacaaugugugcuaccauuauuuuugcauagcacuuuccaguucaccaagcaacuuuacaagguaaaccccgcagcaugauaaauauaaacauauugaaugcucguucuaacugaauuuuuacuuuugccacuauucgcagcagagaaaaaucucuuuaacuauuuucuaguucauuuauuguagcuucugcaaaauccucaaauaaacaguaugcuucaaguuauauauuauuguccaaacaacaccaucacaaaacccaaacauccauuuaugauacuuaggucaccuuugccaguugucuucccagcaauggcugaauuucugugcccugacugcacguggccucgaguguagcagcagguaguuuugcuaaugauucuguugaauucucaguuuauggguuaugggucagaugcugcucacuuaaccugcacaucagaaauggaagggccacacugggucaaguccacggccagcccaucucuugucucugacuuaugcucucaguagcgucuguauacaguccaugacagucugccaggccagggagaaaagggacauacaauagaggaguccuaggaaggguggucuggagaaaaugauuccagaaaugucuaggcaggacacggagcaagcucacccuccacuuuacacagccaaaucuucuuacuguugcugugauguucauucccagcauucccagaagaacuucaugcaaggucgaauucaagagcucauuucugaaagcguagcgugccugccaccacaugaccucuuuuguucgugcccugugguucccugucugcuggauggaagcuuccaguagcacgucaucacauccggggcagcaagacucucuuaaacaagguacaaucuuguuccagguuuguuucagaaucacacaugccaccacuauacaauguauccauguaaucaaaaaccacuuguaccccugaagcuaaugaaaucuuuuaaaaagagggaggcaaaaaaacaaaaucucacacacacacacacacacacacucacacacacacucuuacauacacaugcauauguaucgacaaaggaaagggucaagaauacaccaaaacaugaccgugguuaucuuuagaugguaagauuaugggugaucaauuuuucuucuucuuuuuguuuuuaugcauucucuaauuuuucuaugaugcacauggcacuucauuuaucaucaaguuguauuuuuuaaggcuaaagguauaccaucaaaauacucuccaucaguuaauccacaaguacagaagccugggacacagcccugggagaagaaacagauccugacaaggaagggccaaguccugaggccucccuugagggauuuggcucuggcugugccauguccaccuggcuggugagaaaccaaaauuggucuguuuuagucugagcagcccaauuacaguaaauguguugucucuuccaccaagaaacuugguuccauggaggaaaagaguuuaagagagucuugcugcugaugauguaacgaggugcuaccauccagcaggcagggaaccacaccgcacaaacaacagaggccaugugguugcaggcacucugcgcuugcagaaaugagcuccugaauucaaccucgcauaaagcucuucugagaaugaaugucacaacaacgguaagaagauuuggcuuuguaaaguggagggcaagcuugcucucuguccugccuaaauauuucuggaaucauuuccuccagaccacccuucguaggacuccuauauucuacgucaauucucucccuggccuggcuagaguguucuuucuaaauugaagggcugacuacaagacagucuugcuuaauacuccauggaugcucuucauccaccccagaaguggcucucaaucucuaucugcccccgcauaccugaggguagggccuggucucugggggacucaccgcugcagagccugcuggcuuugugaggcagggucaugacuucgucaccuuugugucccaauggcaaacauagggucaggcaaugugcaggcauacggcagguccucagggacaggaacuaguagggacuguuuguuacucaguauuguauccucacuaccaagcagaaccaugguccaggauuuaacagaugguaagugaaugagugaauaaauggugaaaaaaugaaugaagaauucuguaugacagagaggggacaccauuuagauguguuaugugcaaguggauuuacgcagugcugccugggaaaaagaggcauguaauuauuauccccacuuagccuauuuaagaaaugcuauuuuucucaucccagauaccaaugucaaaaaguaauagaaacuacucuuucacagacacaucuaguagcaccaaauaugugucagguccugaauccagggcugcuuucauucaguucaaaucugguagcugucuuuagggucacgcacacuccuauuagcacauuugaaggugagggucugggaaguugccaguguggguuggauaauaggguuaaguguaaaggcaucuccauuuucacuaauggugacagucucccuuuuucuuggcuggguucccugagccagucauauagcgucugucaguacugggaggcagaaaguggcauuuaguacauauuccuaaaagucuuuccuugccuuuuuaaaaagaaaggcccagggguuguggcauaaugcccucucaggauggcuuggucagauccuucuuguccagugaaaaucugugagauuccuuuuaaaaucauuaugauucagcaaccaaaucccauauauguacggauuuacuaaucaaaacucuucuuuuuuuuuuuugugacagagucuugcucugucacccaggcuggagugcaguggcgccaucucugcucacuguaagcuccgccucccagguucacgccauucuccugugucagccuccugaguagcugggacuacaggcacccgccaccacgcccagcuaauuuuuucguauuuucaguagagacgggguuucacuguguuagccaggauggucuugaucuccugaccuugugauccgccugccucagcgucccaaagugcugggauuacaggugugagccaccgugcccggcccacuaaucaaaacucuucuauauacaaaaccagauucccaaauccauuagcuuggguuaaaggaaauuuauuggcucauauaccugaaaagcccgaagccagggcuagcuccaggugugggcucuuaaaugaugucuuuuuguuuucuuuuguuuuguuuuuauugggacagaguuuugcccuuguugaccaggcuggagugccauggcgugaucucagcucacugcaaccucugcuucccagguucaagugacucuugugccucagccuccugaguagcugggauuacagguaugugccaccaugcuuggcuaauuuuuguauuuuuaguagagacgggguuucaccauguuggucaggcuggucucaaacuccugaccucaggugagccacccaucucggccucccaaaauguugggauuacaggcaugagccacugcgccuggccaaaugaugucauuuugacucuacuuuuccccaucccauaguuuugcuuuccucugaguuggcuuuauuccuugguaggcucuugacaaaguagccacaggcagcuucaggauuuuauuuucccagcucagccugccccaggaaagagaacuccucuuugucaacagucccaacaaaagcuccaaagcuaacucuaucgaucuggcuagugucauggaccuaaugcugauggaucacuguggccaaugggauagaauauucugauuggcuaauuucagguugcaugggauccaggagaaugggguugaccugccucaaucacauggaaugaagacugagucaggguaccugcucaguaucucaaaggaaauuagaaaccuggugccaggacacacauagauucugugucaguaagaacagauacaugcuacagccagcauuccugacccuucuaaguaaacucaguaugacucacugaacaccaacuucagaacuggaggagacagaacaaaagauuaagacucugucccuacucucacauagcacaugagaaggacguguacacacacagggucaugugaaaccuccaggcagaaagauggcacaggaugaaggcuccgcaggacaccagaggaggcaccaggacagcugacaagagaccugagucccaagacccagcucugucccucucaagcagugugaacuuaggcauguccuacagucucucugagaaaacuaaguuuccuuuccuaauguauuagucuguucucacacugcuauaaagauacuagcugagacuggguaauuuauaaacaaaagagguuuaauugacucacaguuccacauggcuggggaggccucaggaaacuuacaaucauggcggaaggugaagggaaagcaggcaacuucuucacaagguggcaggggagagagugaguucaggggaaauugccacuuuuaaaucaucagaucuugugagaacuccuucauuuucagaucaacagaacucaugagaacucacaaucaugagaacagcaugggaaagaccacccccaagaucgaaccacuucccaccaaguccuucccuugacauauggggauuacaauucaagauaagauuucaguggggacacagagccgaaccauaucaccuaauaaaugaaauggucaaacuaaccugauauuucccaaagggaaugaaagugacaaagggucaaauaagcuuggggaguguuugguuagcucuguuauaaagacauuugcuuaacugucuuuaccccagcaguuggccauugaguucuuauuuaaaaaaaaaauuacaaugaguccaggcaugauggcucauacuuguaaucccagcacuuucaaaggcugaggugggaggaucacuuaaaucuaggagucugagaccagccugaguaauaaagugagaccuugucucuacaaaauuaaaaaaaaauuauccaggaauuauggucauaaugacgaugacaaucacgacgaagguagugaugaugaggaugaagaugaggauaguguugcugauggaagaggaucagggccaacauugcauauccauccacaagcauaccuguagucccagcuacucaggaggcugagaugggaggauugcuagagccuaggagguugaggcugcagugagcuaugaucaugccagugcacuccagcccaggugacagagcgagacccugucucuuaaaaaaaaauuacaaugaaaauuaacaugccucagaacauauuuuggauagugcuggaccaggagaucuuuacauuuugacugcugugaguuaaaguaugaacagcacacaagaacaaauccuaggagagcuuagggcuugcagacuccgucucucggggcagucaguguagguccugcagugaaagcagguguccugaaggguggagaagauggcaacuaaggggcaguaggaaggaagagugcugcggaaauugagcccagguguggagcagaggcaaaugcuggugucagacucagaggugguauuucagcauguuaguaguaaccuccgggugaugggauuacaguagauuuaaauuuuuuaaaaaaaauuucugagagccaagauggccgaauaggaacagcucuggucuacagcucccagcgugagcgacacagaagacaggugauuucugcauuuccaucugagguaccggguucaucucacuagggagugccacacagugggugcaggacaguggguacagugcaccaugcgcgagcugaagcagggcgaggcauugccucacucgggaagcgcaaggggucagggaguuccuuuuccuagucaaagaaaggggugacagacggcaccuggaaaaucgggucacucccacccuaguacugugcuuuuccaacaggcuuaaaaaacggcacaccaggagauuauaucccgcacauggcuuggaggguccugcgcccacggagucuugcugauugcuagcacagcagucugagaucaaacugcaagguggcagcaaugcugggggaggggcgccugccauugcccaggcuugauuagguaaacaaagcagcugggaagcucaaacuggguggagcccaccacagcucaaggaggccugccugccucuguaggcuccaccucugggggcggggcacagacaaacaaaaagacagcaguaaccucugcagacuuaaaugucccugucugacagcuuugaagagaguagugguucucccagcaugcagcuggagaucugagaacgggcagacugccuccucaagcggguccuugacccccgagcagccuaacugggaggcaccccccaguaggggcagaaugacaccucacacggccagguacuccucugagacaaaacuucuagaggaacgaucaggcagcagcauuugcgguucaccaagaucugcuguucuacagccaccgcuguucugcagccacugcugcugauacccaggcaaacagggucuggaguggaccucuagcaaacuccaacagaccugcagcugacgguccugucuguuagaaggaaaacuaacaaacagaaaggacauccacaccaaaaacccuucuguacgucaccaucaucagagaccaaaaguagauaaaaccacaaagauggggaaaaaacagagcagaaaaacuggaaacuguaaaaagcagagugccucuccuccuccaaaggaaugcagcuccucaccagcaauggaacaaagcuggauggggaaugacuuugacgagcugagagaagaaggcuucagacaaucaaacuacuccgagcuacaggaggaaauucaaacaaauggcaaagaaguuaaaaacuuugaaaaaaaauuagaugauuggauaacuagaauaaccaacacagagaaguccuuaaaggagcuaauggagcugaaagccaaggcucgagaauuacuugaagaaugcagaagccccaggagccaaugugaucaacuggaagaaaggguaucaguaauggaagacgaaaugaaugaaaugaagcgagaagggaaguuuagagaaaaaagaauaaaaagaaaugaacaaauccuccaagaaauaugggacuaugugaaaaggccaaaucuacaucugauugguguaccugaaagugacggggagaauggaaccaaguuggaaaacacucugcaggauauuaugcaggagaacuuccccaaucuagcaaggcaggccaacauucagauucaggaaauacagagaacgccacaaagauacuccuugagaagagcaacuccaagacacauaauugucagauucaccaaaguugaaaugaaggaaaaaauguuaagggcagccagagagaaaggucagguuacccacaaagggaagcccaucagacuaacagcagaucucuucgcagaaacucuacaagccagaagagagugggggccaauauucaacauucuuaaagaaaagauggggaaaaaacagagcagaaaaacuggaaacuguaaaaagcagagcgccucuccuccuccaaaggaaugcagcuccucaccagcaauggaacaaagcuggauguggaaugacuuugacgagcugagagaagaaggcuucagacgaucaaacuacucugagcuacaggaggaaauucaaacaaauggcaaagaaguuaaaaacuuugaaaaaaaauuagaugauuggauaacuagaauaaccaacgcagagaaguccuuaaaggagcuaauggagcugaaagccaaggcucgagaauuacgugaagaaugcagaagccccaggagccaaugugaucaacuggaagaaaggguaucaguaauggaagacgaaaugaaugaaaugaagcgcgaagggaaguuuagagaaaaaagaauaaaacccagaauuucauauccagccgaacuaagcuucauaagugaaggagaaauaaaauacuuuacagacaaccaaaugcugagagauuuugucaccaccaggucugcccuaaaagagcuccugaaggaagcacuaaacauggaaaggaacaaccgguaccagccacugcaaaaacaugccaaaauguaaagaccaucaagacaaggaagaaaacugcaucaacuaacgagcaaaauaaccagcuaacaucauaaugacaggacuaaauaaacacauaacaauauuaacuuuaaauguaaaugggcuaaaugcuccaauuaaaaggcacagacuggcaaauuggauaaagagucaagauacaucagugugcuguauucaggaaacccaucucacgugcagagacacacauaggcucaaaauaaagggauggaggaagaucuaccaagcaaauggaaaacaaaaaaaggcagggauugcaauccuagucucugauaaaaaagacuuuaaaccaacaaagaucaaaagagacaaagaaggccauuacauaaugguaaagggaucaauucaacaagaagagcuaacuauccuaaauauaaaugcacccaauacaggagcacucagauucacaaagcaaguccuuagugaccuacaaagagacuuagacucccacacaauaauaaugggagacuuuaacaccccacugucaacauuagacagaucaacgagacagaaaguuaaaaguuaaaaaggauacccaggaauugaacucagcucugcagcaaguggaccuaauagacaucuacagaacucuccaccccaaaucaacagaauauacauuuuuuucagcaccacaccacaccuauuccaaaacugaccacauaguuggaaguaaagcacuccucagcaaauguaaaagaacagaaauuauaacaaacugucucucagaccacagugcaaucaaacuagaacucaggacuaagaaacucacucaaaacugcucaacuacauggaaacugaacaaccugcuccugagugacuacuggguacauaacgaaaugaaggcagaaauaaagauguucuuugaaaccaacaagaacaaagacacaacauaccagaaucucugggacacauuuaaagcaguguguagaaggaaauuuauagcacuaaaugcccacaagagaaagcaggaaagauccaaaaucgacacccuaacgucacaauuaaaagaacaagaaaagcaagagcaaacacauugaaaagcuagcagaaggcaagaaauaacuaaaaucagagcagaacugaaggaaauagagacacaaaaaacccuucaaaaacaucaaugaauccaggagcugguuuuuugaaaagaucaacaaaaucgauagaccgcuagcaagacuaauaaagaagaaaagagagaagaaucaaauagaugcaauaaaaaaugauaaaggggauaucaccuccgaucccacagaaauacaaacuaccauuagagaauacuauaaacaccucuacacagauaaacuagaaaaucuggaagaaauggauaaauuccuggacacauacacccucccaagacuaaacaaggaagaagugaaucucugaauagaccaauaacagucucugaaauuguggcaauaaucaauagcuuaccaaccaaaaaaaguccaggaccagauggauucacagccaaauucuaccagagguacaaggaggagcugguacgauuccuucugaaacuauuccaaucaauagaaaaagagggaauccucccuaacucauuuuaugaggccagcaucauccugauaccaaagccuggcagagacacaaccaaaaaagagaauuuuagaccaauauccuugaugaacauugaugcaagaauccucaauaaaauacuggcaaaccgaauccagcagcacaucaaaaagcuuauccaccaugaucaagugggcuucauuccugggaugcaaggcugguucaacauaugcaaaucaauaaauguaauccagcauauaaacagaaccaaagacaaaaaccacaugauuaucucaauagaugcagaaaaggccuuugacaaaauucaacaacccuucaugcuaaaaacucucaauaaauuagguauugaugggacguaucucaaaauaauaagagcuaucuaugacaaacccacagccaauaucauacugaauggguaaaaacuggaagcauucccuuugaaaacuggcacaagacagggaugcccucucucaccacuacuauucaacauaguguuggaaguucuggccacgguaaucaggcaggagacagaaaggguauucaauuaggaaaagaggaagucaaauugucccuguuugcagaugacaugauuguauaucuagaaauccccaucgucucagcccaaaaucuccuuaagcugauaagcaacuucagcaaagucucaggguacaaaaucaauguacaaaaaucacaagcauucuuauacaccaguaacagacagagagccaaaucaugagugaacucccauucacaauugcuucaaagagaauaaaauaccuaggaacccaauuuacaagggaugugaaggaccucuucaaggagaacuacaaaccacugcucaaugaaauaaaagaggauacaaacaaauggaagaacauuccaugcucauggguaggaagaaucaauaucgugaaaauggccauauucccaagguaauuuauauauucaaugccaucccuaucaagcuaccaaugacuuucuucacagaauuggagaaaacuacuuuaaaguucauauggauccaaaaaagagcccgcauugccaagucaauccuaagccaaaagaacaaagcuggaggcaucacgcuaccugacuuaccaaacuauacuacaaggcuacaguaaccaaaacagcaugguacugguaccaaaacagagauauagaucaauggaacagaacagagcccucagaaauaaugccacauaucuacaaccaucugaucuuugacaaaacugacaaaaacaagcaauggggaaaggauucccuauuuaauaaauggugcugggaaaacuggcuggccacauguagaaagcugaaacuggaucccuuccuuacaccuuauacaaaaauuaauucaagauggauuaaagacuuacauguuagaccuaaaaccauaaaaacccuagaagaaaaccuaggcaauaccauucaugacauaggcaugggcaaggacuucaugucuaaaacaccaaaagcaauggcaacaaaagccaaaauugacaagugggaucuaauuaaacuaaagagcuucugcacagcaaaagaaacuaccaucagagugaacaggcaaccuacaaaaugggagaaaauuuuugcaaccuacucaucugacaaaggccuaauauccagaaucuacaaugaacucaaacaaauuuacaagaaaaaacaaacaaccccaucaaaaagugggcaaaggauaugaacagacacuucucaaaagaagacauuuaugcagccaaaaaacacaugcaaaaaugcucaccaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucagugcggcgauuccucagggaucuagaacuagaaauaccauuugacccagccaucccauuacuagguauauacccaaaggacuauaaaucaugcugcuauaaagacacaugcacacguauguuuacugcagcacuauucacaauagcaaagacuuggaaccaacucaaauguccagcaaugauagacuggauuaagaaaauauggcacauauacaccauggaauacuaugcagccauaaaaaauaaagaguucauguccuuuguagggacauggaugaaauuggaaaucaucauucucagcaaacuaucgcaaggagaaaaaaccaaacaccacauguucucacucauaggugggaauuaaacaaugaaaacacauggacacaggaaggggaacaucacacuccggguccuguugugggguggggggaugggggagggauagcauuaggagauauaccuaaugcuaaaugacgaguuaauggaugcagcacaccaacauggcacauguauacauauguaacaaaccugcacauugugcacauguacccuaaaacuuaaaguauaauaauaaugaaauaaaauuaaauuaaaaaaagaaaguucgauuauaaaaaaaauuuucauuuuuuaaaauuuucuuauuuccuauaaugaauuacuacugguucaauuaaaaugaucaaaggaaauuuuaaaaauauuuuuuaaacccugacaugauaugaaccuacauguagcuuuuucuauguccaauauuguauuuuauuaaaagggaaagauuuucauguuaaugguaacuuucaaggcuucuuccuuagaccccugucauuggcauuuuuuuucauagucaaaaagcaaaucuaaggaugacaaauaugaaaaagaaacccuucucuauccaaccguucauuuuuccucauugcucccuaucucauuucagguguuccggcuccugagaggaugcugaaugugcaagaccacaagugcaaggaacgccaugcucaaucacucugcaaaugacauuacaaccggaauaaaugcaaaggcagcaggucucuuuaggacauacaccuacacacagugccaaacucauccuguggccaacagauguacagagaaucccagagugcuuuauuaaggaugggugacuguucauaguuggcauaguugguuuccuaaaccugggaagcucagcaaaccaguuuuacaaaaacaucaauagaugaugaugguggugaugaucuugauaacaguguuaaugauuauaucagaaacuaguacuucugaggguuuacaagguggcaggcacugaggcaacaucuuccuauaccuucucucaugugauucuuccaagcaucccaucagguaagucucauuauugccccaguuuuacagauagacaaaccaagguguggugaagcuggguaauaugccugagguuacggggcuggaaaacaacagaacuaggauucuguuccgucugacuccacagccuguguucuuaaccacuguguaagccauuuaaagaaaauaggaguaccacuuaaguaaaagugaauccuaauucugugauugguagggacuuaauuaaauaaugaaucuuaaucguuacucaaucuuaaguaaaaaugaauuugaauuaugugauucguaagguucagguuaagcuguguuuaaaaaaacucuccaaaaguacagaggguuaaauaagguggaaaugucugcuucucuugggacaacagucucaaggccagugguggucagaaauggauggaaggcucuacucugugaccauucagccuucaucaguucucaaccuacaacuucuguuaucugggcccaagucagcuguccugguugucaccauucucaugugguaagaaggggaaauacaggagauacaggguaaguaccuugugcuuagguuggggaugaacuagagggugcauucauccccucaucucaccucccucuugccugcacuuacucccauagccacaccuggccacacggaggcugggaaaugaagucucuagcugggcugccaugugcccagaaaacucauggaugguucaauuauugaaaggaaaaaggggaggccuagugcaguggcucacgccuuuaaucccagcauuuugggaggccgaggugggcagauuggcugaggucaggaguucgagaccagccuggccaacauggugaaacgccaucucuacuaaaaauacaaaaauuagcugaguaugguggcaggcaccuguaaucccagcuacucgggaagcugaggcaggagacucacuuaaacccaggggcggagguuacagugagcugagaucgugccauugcacuccagccugggcaacaagagugagacuucgucucaaaaaaaaaaaaaagaaaggauaaaggggagauggcuguuuccuccaugccaguaccucaggacauuaaaauuagagcuugccuuuuaccaaauuuauaccagcuguguuauguacaaacaaggaagauaaagcucagagaguuuaagagaucuggucaauguccuucaucucauuaggcagaacugaaucuagagccuguuccaugauuuucagaacaguguucuuuuuuuuuuuucuaaauugagucuucauauuaaauuggaaaggaaagcaugaaauuucuaaguugugccagauaaacacaaugaccuuuaaaaaaugauaccugauuuuaacauugcucagauguuaaaaagagguugaaaaggagccaauaaaugucaaaaagaaagauaaacauauucauagaauuuuaagaucguaagcaagauaucaccaggaucaccuuccucauucuguaauaaggcagcuuuggcuccagaaguugaguugacugauuuaucuuucgauuuucaguguuccucccccgaaccucaaagucccucaugagaaggacaaaguaucucccaacacccuaacauuggagcccauaagacucccaggaaaccccacucuaucuucuugagcauuaucucaaaucuguuacucucugaucuggcucacauucagaaaacagugaguuucaaccaaccaacuuccauuuauagagguaccauacuagcugcugaggaacgcaaagauacaagggccaugguuccugccucugggagcuuacaauuuagcaacaaacagacaaaaacaaccaugaaaugauacaaaauggcauaacagcuggauauagacugucagcuauuuuauuuguuuucccagagagcauaauauuccacauaucaucuguaauagacccugacccuuggucacagggaugagcagguaucuaagacugggcugaugauagaacuccaucccucugaccaaagugauuggcauaggaugggcaugugacucaagccaagccaagcaguccuucuugggaauuuauucauugggaugggagagaauuucucucuugcuuguuaggucugaggguuggaaggguaugaauucagagugaccaguggcccugcucuccaucacauggaaaaagcuuccuguuaguaggaaagggugacccugccaagcagaucaaugcagagauaugaguuggagagagaguuaaagauaucugccuaacagcaacaaauauccagauuauguaucaucaucauuaucaucagaauaaacauuuugaauguuuaugccaggaauggugccuacauacaauguaggcacuuaauagcaucucauugaaggaugauaaaaacaguaauauucauaaguauaaugucauuauccuccuuuuuucuuuggagaacaaggaggaccaauaauuugccacacagcuaaugagagaacugggccaugaacccaaaucugucugacuguaaaaaaaaaucuuaguucuuucuacugcaacagauaguccugugcuauaguuuggaugcuuguccccuccaaaucucauguugaaauuugaccccaguguuggagguggggccuaauggggguguuugggucaugggaguggcucacuuaugaauggauuaauaccccagguggcgggcacagugaguuuucacucuauuauuauaguuucugugauggguccuuguuaaaaagcaucagccccucccuucucacucguuuccucucucgccaugugaucucugcacacgccagcuccccucagccuccaccaugaguagaagcagccugaggcuuuuaccagaugcccagucuuccauccagcagaaucaugagccaaauaaaccuuuuuucuuuauaaauuaccuagucucagauauuccuuuauagaaguaaaaaaugaauuaacacacccugugccugcaaggcaccauccucugaaugaagauagcagcuugacuuuccugcauagaauuaggauucauguauucaccucacuugacccacaagguggauuugauucuggacagcuucuucucuguguugauuccuggcaggcuccuuccccagucugaccuccccuccucagccaccauggcggauccccuuccaggcagaggaaucucaagucuuguccccaguacaacugucccacaguggacaucagaaucugccucugcuguucccgccucuguccagaguagaaaacuuccgcuugugacaccuacacaacaucuccacagguguucauuauucgagguuccugggagaggcgacguuagccaggcagaaucugggugaagaguucuaagccagggcagcauggcagagcagaagaauaacaagagccuggcuggcucccuacaccauaugucauaccaacuguuuuuuuuuuuuuuuugagaugggguuucacugugucucccaggcuggagugcaguggcgccaucuuggcucaccggcaaccucugccucccagguucaagugauucuccugccucagcguccugacuagcugggacuacaggcacccgccaugauguucaacuaauuuuuguauuuuuaguagagauggggguuccaccauguuggccaggcuggucucgaacuccugaccucaagugacccaccugccucagccuugcaaggugcugggauuacaggcucaagccacugcacccacccugucauaccaacuuuuaacugucuacaucuggacuucuuuuaucuaagaggcgaaugcacuucuaauuuguucaaauugcuauuauuuuggauuuucuguuaaacguuaaaccuaacccuaaguaauaaaaagucccuccuuguucacuuuugcaucuuccgcaccuugcauagugucuggcacaaaacaggcacucauaaaaaaaugucuggcagcugggcgucaugguucacgccuauaauucuagcacuuugggaggcugaggugggcggaucgcaggaggccaggaguuggagaccagccuggccaauauagcaaagccgcgucucuacuaaaaauacaaaaauuagcugggugugguagcgggcgccuguaauuccagcuacuugggagacugaggcacaagaauugcuugaacuggggaggcagagguugcagugagcugagaucacgcuacugcacuccagccugggcgacagaguaagacccugucucaaaaaaaaaaaaaaaaaaaaaagucuguggagucauaagcaaauggguguauguuaaaugguucacaccacaacaacaauguaaaauaaauauuuugcauacauauagcaaacauauguagauauucguaauucaggaaguacuuuggggaaagcuagggauguuucacuauagcuuuuaagaccuaguugagccacuguuuauacucuucauuucuugaaauaaaauacauaaucuugcccuuggaagagagcugcugucaggugggccucaccguucaggucacaacagacagaaaaggaagaguggcaguugcccaguuggaagcuggcugggagagaugauugauugguuuugggauuauacuuaucuaauauuuauaaaagcuaaccaucaucagaagccaaccuccaggcccccaagugcuuuguaucauaaagccucaugggagacuuauguuuuauguggugucuuucuuuuuccaucacaacagguuucacugucggcucugcuugcaaagcaagcugcauaaccuugccgucucuuuguccuggacuguuguagccaaggggaaugaauagccaacucauuacuuuucuuaaaaaaaauacccacccccaguuucuuaguaaggagaaagcaguuacccuuaggaaauggaauauauuucugcuuaugcgcacaucucucuuuuguucaaucauuuagcaaauauuuauugagugccugccacgugccaggcacuguucuugguauuaggaauacgaugugcuuuaaacacaccuggguucuugugggcaucaagcuaacauucuagugggaggaucugacaaacauauuaaaugaguagaauaaacaauuuguuagugauaugugcucaaagaaagaauaaagcaaggaagggauauugggggauggaguuacaauuuuagacaagguggucaagaaaggcuucacugagaaagugacaugcgagugaagauuugacaaaaaugaaagaguaagcaauaagguaucacaggaaagcgcaguccugcccaggguucaagagcaaaguccuggccgggcgugguggcucacgccuguaaucucagcacuuugggaggccgaggcagguggaucaccugaggucaggaguuugagaccagccuggccaacaugaugaaaccccaucucuacuaaaaauacaaaaaguagcugggcgugguggcgcaugccuguaaucccagcuacucgggaggcugagacacaagaaucgauuaacccaggaggcggaaguugcagugagccgagauugcaccacugcacuccagccugggcaacagagcaagacuccaucucaaaaacaaaacaaaacaagaaaacguaaaguccuaggcaauauggacugacauggacauaaacccggaggacacucuccuggguuaaauagcccacucacagaaagacaaagaccacauuaugucacuucuaugaaguaucuaaaauaguguguuuauauaauuaaagaguggaauggugguuaccagugguuggggcaagugggagauggggaguuucuaaucaauagguuuacuaucaauagaaguuacuaacaguuacaauaagaguugcuaaucaauagaaguuucagccaacaaacauaauuaacugcuagagaucugcuguaccacauuguaccuacagucagcaauaauauauuggacacuuaaaaauuuaccaagaggguagcucucauguuaaguguucucacuacaauaaaauauacauauacauauacauaugaauauauauauauauauauauauauauauauauuuuuuuuuuuuaaagaggcuggccaaggugguucaugucuguaaucgcagcacuuugggaggccaagacaagaggaucgcuugaagucaggaguuugagaccagccugggcaacacagcaagacccccaucucuacaaaaaauuuaaaaaaucagccaggaggcugaggugagaggauugcuugagcucaggagguugaggcugcagggauccaugaucacaccacugcacuccaaccugagugacagagcaaugauaacagaagggcuggggucccagcuaaaccccacccuuaagccuggaaccacaggccugagugaaaacggcugaccccauuuuucugcgcaaauguugccuuuuuggccugccucgcccugccccuauccugugccuauaaaagauuucagcugauagagcaacacaggcagcugagcauugagguuacaagcagcugagccgcgagcagagaagcaacugagcaucaaagacuguggauagaugcagcuaacuucagacagugcggcuucagggaaagaucaccuucccaucccguuggcagccucccuuucugcugagggcuacacaucacucaauaaagucuuccacaugcaucaccuuucaaacaguucaugugaccugauucuuccuggacaccagacaagaacccaggugccaagagggcaagaaccugggugccaagaggacaggggcugccacucugacccuccacugagcugguuggcacuugaccaucccuggacagcagagcugaaaaagcauugguuauacaugcuuggagcugcuguggagccccacagagcuugcuccugccagagaggaguggccggccauuccagcauccauuuacuccaguucccgcacuuacugucuugcaugcuuccuccugugaggaguggccagcagcuggcugagugaaacgggccacuccaguuccugcccacaaaggaggucaagagaacuauccugucucaucgagacccuguccacccucaccaaaaaaauagcaaaguaugagagguguaaguaucuauguggguugauggauccaccaggccagaguggcugggauggggguggggagagagcucguggaaagagggauggcaccagugguggaggcaucugucagccaccgaagaauuuagauucacuccucaugaaaugagaagaccuggagaguuuugaacagggugccaaagcugauucaccuguuauaaaguucacucuggcugcugcguugagagcagguggaagcagggagacuagucagggagaccagugaggagacauuuauuuuccagguccccaggcaccaucucucaccagccauuuuccucucucccucuucacuccugcggugaucuuccuccccagccacuucagaaacaagaaucgucuugugcucccucuguccucauccaaaugugcuuuuaaauucuuucaucacacuauucaacaacagauacuccuguaagcagauucauacccaagaaaagccaagugaagaacagcaguuucuagagucugcguagggcaguagaagaggacuauuuucuccucacugguuuagucaacacuucuucaggucuuacccaaguguauuaguuuucuauuguugauaaacaaccacuaacuugaccacuuaaaacacgugcuguaugucagcagucuagguauggcaggguuggggucuucacucagggucucaaggaccaaaggaaaucgugguguuggcccagcugaguucucaucugaaggcucuggggaaaaguccguuuccaagcuaauucaggcugugggccuaauucaguucccugugguuauuagacugcugucaggggacugcucucagcuccagaggccaccggcuuugacuccuucacuaacauuuggucacauuucacaucuuucugauuuuucuaugccugaucucuagacucaguuugaaggccuuguguaauuaagccagaucugcuuggcucaucucccuaucuuaaagucaauuuauuuggggucuuaauuacaacugcaaagucccuucacagcaauaccaagauuagugcuugacugaauaacugggagaaggugcaauagaccaggggcugcgaauuaugagccauccuagaaaucugccuacuacaccaagaaaaagggagcacauugacccaucuggggaagugccuggaguagaagagcugaaggcgcgaggcaggccuugggggcugggacuaggauucaaugugccaugagucacucauucucucucucucucacacacacacacacacacacacacacaccacacacacacacacacacacacaccuuucuccauucaccucucaucucugcuggucuucauuccgcagaguugcuccucccauguaacaagaaagccaugugccuguaaucccagcuauucaggaggcugaggcaggagaauagcuugaauccgggaggcagaaguugcagugagccaagauggugccauugcacuccagccugggggacagagcgagacuccaucucaaaaaaaaaaaaagaaaaaagaaaaaagccaccaacugcccuaguuccugcuaucacaguuuugcuuuuccaguaaaaagauaaugucuuucuccuaaugcuugaauaucaaccuagagaaagagucugauagagccagcuugggucugggaugggaaguagagugcugagauugagaggcagcuggaagaggugaagaguugucuaaaggaggcaguaggacgcaugucagguaagcagaugcacagagccacugggaccucuucagccggagcugcugcuuuuccucaaagaccuuacagcccuucugcaucgcucuccuuccucuucugaccugcuuagugguccugccuucucuaaccuucagggggcugacaucuagcucuaacauccacaagauuaaguccaaaccuauaaacuuggggccaugggauggggccaggcauuggagagagaaugccuugcagaauaaucuagaaagaauucuggacuagauuuuaguccuugcucugcuacuaaccgugaucaugaacauguugcgguggccauggagguuggccgcucagaccucccuuagagagaaccugauguggggaguauaguugggugacagcuuauaccuuucacaccuuuggauuugccgugauauucacaacaaagcuugauuucccccugccgcuuaccaagcuacuucuagccaacuacuaaguccgcggccuuagguaccgcggccgggcuauuucugcccaacacaaaacuccuugaauguucgaucuuugcucagggauacuuuacuggccuggccaagacccuuucauggcuguaucgcagucugaggguucuccuauccacccacuuccuuccgucuccuuucacauaugcagaccugcaccuccaucaauaggugcacccugccuacuccuguucucucccucauuaccuuucacagauauuucucccaauaaaucucuuguacaucuaaauucuucuugguuucugauuuucagaggacccaaacugacacacaggugaauccuccuucucucaucuguagcaucaaugucacucgacuggauuucuggggucccuucuggcucaaagguccuaccugcuuuugugauuuuagagaguuaucccuguuugaugaaagaagaaaaagaugauugcauauuuagaucucugauccacaacuauuugggccuaugaucuuugguuauauuuaauuuuugucacuacaaagaacuuuuuuuaaauuuugaaacagagucucacucugucgcccagacuggagugcacugguacaaucucagcucauugcaaucucugccuucaggguucaagugauucucuugccucagccucccgaguagcugggauuacaggaggccgccaccacaccuggcuaauuuuuguauuuuuaguagagauaggguuucaucauguuggccagacuggucucgaacuccugaccccaggugauccgcccaccucggccucccaaagugcugggauuacaggcaugagccacugcaccugacugcuacaaaaaacuuuccuguuggugauaucuuaucaggcaagguaaaggauucugggcaagauuucgugaaggacuggcugaaaacucuacacauuaugugaaugaaccaucacuguuuuagccaaugguucuucuacuucagcauacagaagagucccuugggaauggcuuaaaaaaguagauuccuuuggcagggcgcgguggcucaugccugugaucccagcacuuugggaggcugagguggguggaucaccuggggucaggaggucgagaccauccuggcuaacacggugaaacuccaucucuacuaaaaauacaaaaaauuagccagccgugguggcgggugccugaagucucagcuacucaggaggcugaggcaggagaaugguguggacucgggagguggagcuugcagugagcugagaucgugccacugcacugcagccuaggcgacagagcgagacacggucucaaaaaaaaaaaaaaguagauuccuggcugggcacgauggcucacaccuguaaucucagcacuuugggaggcugaggcgggcggaucaccugaggucaggaguucgagaccagccugaccaacauggagaaaccccaucucuacuaaaaauacaaaaauuagcugguuaugguggugcacaccuguaaucccagcuacucaggaagcugaggcaggagaaucgcuugagcccuggagguggaguuugcagugagcugagaucacgccacugcacuccauacuccagccugagugacagaaugagacuccaucucaaaaaaaaaaaaaaaaaaaguagauuccuggauuugacccauugagagcuucuuaaguucuacacaaauuauuuccuggguacguauaaugugcuguggggcaccauaggaagucacugaugcugcaugguggggggcggugugagccaaggugaucucuuuagguggugacauuucagcagguaauaaagaaugagaaggaauuugucccccagguggcaaugugguaaagccauucccaguauguugagacaacucaacugcuaggcaguugagggggugugggguuggccagcgagggaagagaagaacaugggaaacgguguggaccuuugguuuagcuccguuucuggcacggacguuauuuuagagaucugugauauggguagagguugguacuuccgaagucuggagaagagcucucuuaucuaaacaaaauacaaaguaaacaaaaagauaagaaagagucagcaucaguggcuuacaccuguaauccuagcacuuugggaggccgaggugggugaaucacuugaggucaggaguuugaggccagcugggccaucguggugaaaucccgccucuauuaaaaauucaaggccgggagcgguggcucacgccuguaaucccagcacuuugggaggccgaggcgggcggaucaugaggucaggagaucgagaccauccuggcuaacacgaugaaaccccgucucuacuaaaaauacaaaaaauuagccgggcgagguggcgggcgccuguagucccagcuacucgggaggcugaggcaggagaauggcgugaacccgggaggcggagcuugcagugagccgagauugcgccacugcacuccagccugggcgacagagcgagacucugucucaaaaaaaaaaaaaaaaaaaaaaaaaaaauucaaaaauuagccaggcaugguggcgcaugccuguaaucccagcuccuccaggcugaggcaggagaaucgcuuaaacccgggaggcagagguugcaguuagcagagaucgcgccacuccacuccagccuggaugacagagaaagacuccgucugaaaaaaaaaaaaaaaaaaaagaaaagaaagagucagaaguagcaaaugccauuuguuuuuuucuucaauguccaauacuuagaaugcugcuccaccggaaccucucugugacacggugggguguccacucuugcucucugaggugcguguuauauuccaguacauuucccagucccaggagugagcaucuaacugacuuuuggcaaccccccaccugccucgaaaagcuaaacugccccaaagauccaggaaucaguuuggggcauccucaguugauagaguugucccugucagaagugggaaucaagacucuuugguccauugauauaccucagaguuggucaaugguuguccuuggauuugacacaugacuuugucccuuacuuuaauccucuuguguaauuuuuuuuuuuuuuuuuuuuuuuuuuuagacaaugucucgcucugccacccaggcuggagugcaguguaguggugaucucggcccacuguagccuugaccucuggggcucaagugauccuccagccucagccucccaaguagcuggguucacagauucguaccaccacacccagauaauucuuuaauuucuuguagacacgaggucuuauuauauugcccaggcuugucuugaauucccuggcccaagugauccuucugccuuggccucccaaagugcugggauuacagacaugagccacugugccuggccuuccuguauaauuuuuuguuuuaugucuuagagaugggguuucacucaucacccagacaugaguguauugggugcaaucauagcucacugcagccaaacuccugggcucaagugauuuucccaguuuagccucuggaguagcugagacuacaggugcuugccagcacacccagcuaauuuuuuuuuuuuuuuuuuuuuuaagagacaggggcucgcuauguuguccuggcuggucucaaacuccuggcuucaagcgauucuccuacuucaaccuccugaguagcugggauuacaggcagagccacuaugcucagcuuaaaauauccuuauuucuuuuuuaaagaguauauauguuucacaauuuuaaggcauuaaagauccucugaagcgcaucuauaagccucuuaaugucuauggacucuaguucaggaacccauggaauuauaaaaaaggaggccagaaaagaucagaaacgaaagaaccagacgggcacaguggcucacaccuauaaucccagcacuuugggaggcuagggcaggagaaucgcuugaggccaggaguucaaaaccagccagggcagccuagugagaucucaucucuauuaaaaaaaagaugcuucaggaaaggauucuaggaaaaaauaaaagaaaacacuaucaauggaaacagaucuaaaaauugaauuauuaaaaacuaucaauggaaacagaucuaaaaauuggauuauuaaaaacuaucaauggaaacagauauaaaaauuaaauuauuagugccaucuauauggccugcauuuguugccauguuacaucauaauauggugguugcauuacauuaaaaaacaagguuguauuaccuuaaaaauaaacauggcuguaucaucuuaaaaaaaucaaagcuagaagaauaaaauucaccucaauccccuucaguacaaaggaauagucauacuaacacucugguguuucuugccagguuacuuucgugcauauauauuuuaagguauuuauuuucauaguuaaguauuuauuucauaguuaagaucgugguaaguauucuauuuuauuucgucacuuuuaguauuuaccguuauaauguaagugucuuuuuccuucauacaaaucaugcuuaacaccaauauaaaauuccaucauguaccucaaucauauuuuauugcuguuuacaccuauguugaaguuuauuuucaauguugucuuauaaauaaugguguuuagaauaaagaucugcauuaaagcuuuuuuccuauuuuggauuuuucccuuaggacagauucucagaagugaaauuugaggaugaaagggcaugaacauuuuuaagagucaucauacauauuguaaaacugcuuuugaaaauagucaugcgauuuccuaucaccaccagcuuaaaauagugucugcuucacuauacucucaccauuauuguguauuguuauucuuuaaucuuuacuguuggcaaaaaucauugacuuaauucccaugauucaguuuuaauccuaugaacuuuaauucucagagaugccaguaagauauuacaaaccaguaucacagauacgcaaaaaaugaacuaaaacauuuuacaaacauucauaaaagcaguuucagucuuuucauucauccugcuucauauuguuguauuuuaaugcaggguuucacucucagugacgcuggcauuuugggcuggauaauucuuugucaugaggggcuguccugggcauucuuguauuucacagcauucuugguguugacccaguggaugucagaagcuccccuagguugugacaaucaaaaaugucuccagacauugccaaauguccccagggggaaaauagcuccugucuaagaauuaccguucuaaugaaaaccauauagcucuauuaguucacauuucauuccaauguuaaaauuuuauucuuuaguaucuuggaccugauagagccuaccaagcacccuuuccuuccuucuuccuugccaacaaagccccaguuuuguucagcuguucccccugccuagacccagggaaugaauucugucucauuaugccugaucuaagcuggcuugguagccuuauucuccuuaucagugacuggcuuugguuaggacauggaacucagucccgacccauaggacccaaggagacaucugcugaaggacuucugagaaagauucacuuacugauaaaaagcagcacauagggccgggugcggugguucacaccuguaaucccagcacuuugagaggcugaggaggguggaucaccugaggucaggaguucaaaaccagccuggucaacaugaugaaacccuggcuuuacuaaaaauacaaaauuuagccggguguggugguggacaccuguaaucccagcuacucaggaggcugaggccggagaaucacuugaacccgggagguggagguugcaguaagaggagaucccaccacugccuccagccugggugacagagcaagacucugucucaaaaaaaaaaaaaaaaaaaaaagcagcacauaggaaaaaguacccuucuucuuuaguagaugcugucaauguuuccauguguugccuggaagugcuguggggaaaaaccacugacaugcugaggaguaggaauacagaaggcauguggcuguggugacaucccugagacacugaaguaccucucuccauggagaggcucuaccuccagacuccuugcuaugggagguaacacauuuccaaacuuucaaacaaccuuuuguuguuacuguugugucuuccacgauuagcauccuaacaggcuuucugggagccccuaaauagugccagggagaggugguugagccugguucuaucugagccuguuucaacauccacguuuaagcaauaggcaggcccacagucauaaggaccaacuucugagaaggaauauugcuccagggaaguccagcuaguugaagaaggagcucaaccaaggggcuggaggucaagagggcugauucuggcccuaaaaacaaggcacacacacacacacacacacacacacacacacacacacacacaaaagaaccaggcacgcaaguucagacagguagagguguggcgggaugcaaacucuaguucaggaacccacggaauaagaaaaaaggagaacaggaaagaucaggaaaaaaaaaaaaaagaacuggcugggcugcugagugggcuucccuacugaguggccagaaucccagggaagcagaugaauuccaagcccaccauggacaguaacaggagcucuugguauacaaugacuggcucuguuuucacuaggcuguaccaagcuuggaagucuucaguacuaguacuuugggggagcuaaaacagguaggaacugagggacuuagugccaacauaccuugaggaaaguacuuucauacaagagaaugaaugaggguuuuggaauuggaguuucaagagagauuuugaucccgugucugacauggguagaugggugaguaaaugaauagggaaauggguggauggguaggacgggagauagggggaggugaggcugggcagaaggcuggaugggaggagcaggcaaugaaaagaaugaaugguugggugggucaaugagugggugggauagcuuacuagaggaacaaugaguaacuauauagaugaacaaauaaauaacagcaacucuuuuaguuuugcuuugaucacagagagccauguucuuaaggugggaaggaaccuccggagaucucagcaggccacauucccuucuugcugcauuucauggaccgugagggcagaagugcaucccaaaaucagaccacaggaggaugcccaggacaucacaagagucuacugcacaaaauuuguauaugucauauaucuuuuaaaaagacacaaagauacuuccuucaagucagauauguaaaugagaacugcaaaugaacuaucaaaccgauacauaugacagcacucagaaaucuaauaucaucgcugaaaaagcuuugaccuguaccgaauccaggauagcugcauuuguuaaaauuagcagaacaccagagauuaaagcaacagaugucuuuuccaauuggaaagcaguuugauugacacccaaguuucucucuuaaccuccacuauuugcccuugaagguagcagcuacuucuaacuuguuugcaguguuucaauuugcuuguacuuucuucaguuagcaauguugcaaggucuuuucaauuugguagcugggcuuuugauuccucuuugccuaaguuuccucucacaucuauuugaccccugcccugacauuucgucauccuccaucugcuccauugggguucccuccuuugugcuccacuguaccccaaauggaccuccauuaccucacacccaucagaaucuauauguaauuguuuguuuauuuacauauuuguccucuaauuuaucguaagucuccucagggcagggaucaugucuuauucuugacccaguaccuaauacaugaaggaucucaaaaauguuuuagguauaaaggaauaagcuugaacuuauaagaccaaauuuuauuaaaacaaggcuuuagaaacuucucuguauguauauuuuauugaacaaaauguuuuaaauguguuuaaauagaacccagcauuauuuuaaagauaaccauaagacaauuuucccacacacuuaaaucaguucuccuacugucaauaauuuucacaaucaaguaaucuagggaaaacacuuauuaaguacuagauuagggugcugugagauuguugguggucacuuuccagagggcuuuaaaaauggacuaggguaaaaguaugugguucaguagcuuucccaauguuugcugagagggcuguauaugcaaacacagaaggagccaagaaaccaaagaacaaagcaggugaaugcaguuuguccauagagggugauuuauuggggaacuuagggacagaagcacagucuuaggugaccauaagagagggcgaucucugcauugugauguuccaggccugggguuuauauaccacagggaaaggguaugcgagcuuuggaagaaauauguaggacaauugaaguugaccucuuaggaaaggcaagaggacuaguguauuauagccuaaggguagaauuuaugguaaguacaguuuacauaacaucaagguugucuuggccuaagggcaggauuuacaguaaguauggcuccuacacaagauauaaaaaaauaaaguagaauucuuagagguguuacuggaacugggggugaaccagaagucaacacagcagauuaucgucuaaaaugguuacuuuagcuccauacccaauuauaaaaaauaaccagcugaaaacauguuaaggaaguauauauucuauuuacaauagcagcaaacacacacucaugcacacaugcauauacacccgugcacacauuuaggaaaaaacuuaagaagaagagaauuuaggcugggcacagugacccgcgccuguaaucccagcacuuugggaggccgaggcagguagaucaccugaguucggcaguuugagacuagccugaccaacguggagaaaccccgucucuacuaaaaauacaaaauuagccaggcaugguagcgcaugccuauaaucccagcuacucaggaagcugaggcaggagaaucgcuugaacccgggaggcggagguugaagugaggcaaggucaugccauugcacuccagccugggcaacaagagugaaacucugucucagaaaaaaaaaaaaaaaaagguaaaagaaagaaaaagaaacuuuagaucuacagcauaaaauuuuacugacacauccuggguggaauagaaccuaaaggucaaagaacugcacacaugcacacacccacaaacacauaagccccuagauacaugugaaaccauuuucaauaaucacaucauuguugguaguguuauuauugucauucugagacuuucccacauauauuaugaaauaaacaaguaaucagggccuuagaaacaaaaauguuuaaagugggaaaaaggagauacagauaggaaaucaauaaaauaaaauuaaauuaaaacuuuuuuuuuuuugagauagggucuggcucugucacccaggccgcagugcaguggcaugaucauagcucacugcagccucaaccuccuggguuagcuucagccucccugguagcaaggacuacaggugugaaccaccacaccuggcuaauuuuuaauuuuuuuguaagaauggggucuugcuguguuucccaggcugaguucacucuuggccucaagcaauccuccugccucagccuuucaaaguauuggaauuacaaguguaagcuaccuugcccagucuaaaauucuuuuauaccucaauuugaauaaaaguaucaauaugaacucaugauguaauuuaucuuuaaaaaacagcuauuuucuaggucuucauaaaaaagccuagaaacaaaagaagacauucauacagccagcaaacauugaaaaaaaagcucaucaucacugaucauuagagaaauguaaaucaaaaccacagugagacaccaucucaagccagucagaauggugauuauuaaaaagucagaaacaacagaugcuggugagguuguggagaaaaaggaaugcuuuuacacuguuggugggacuguaaauuaguucaaccauuguggaagacagcguggugauuccuuaaagaucuagaagcagaaauaccauuugacccagcaaucccauuaauggguauauaccuaaaggaauauaagucauuuuauuauaaagauauguacaugcauauguucauugcagcacuaugcacaauagcaaagacauggaaucaacccaaaugcccaucaaugauagauuggauaaagaaaaugugguacauauacaccacaaaauacuaugcagccauaaaagggaaugagaucaaguccuuugcagggacauggauggagcuggaagccguuauccucagcaaacuaacgcaggaacagaaaaccaaacaccacauguucucacuuauaaaugggaaccgaaugaugaaaacacauggacacaugggguaaacaacacacacuggggccuguugaggggaguggagaagagggagaacaucaggaagaauagcuaacgaaugcugggcuuaauaccuaggugauggguugaucugugcagcaaaucaccauggcacauguuuaccuguguaacaaaccugcaaauccugcacauguagccuggaacuuaaaagcugaaaaaaagccuggagacaaugaaugaccuagcagcaaugaacaccuucaguguauaaauugggggucucuaaauaccauuuccuacuaaaaagaaacagaguuucuuggggcaauggcugaauccagaucuagagcaggaaacacacaagaugauccucaaauaucuugugagagcaaggaaauaaaaagcaagaaaccuguuaaagauuacugcaaccacgucaaaaggacucaggagccaacacugaaggguuucucuaaccaaaaauuagucaauuugaacaucaaaaagaauaauaacugcaauggauugaaacauaugaaauauuaugucauuuauauauaaauaauuaucuaaauuuacaaugauauccuccucuaauaaaaaaccucauuggucaucuuuggaggauguaaggaaaauaaaccguaauuuuuaaggcagguaaucaacaaaacacaaucaagcauuuguuuugcuuuuccaauaugaaccguaccaccagcuaaccaaauaguugaugagcagaaguuucucuugauagaaguguuuuagcuauuaaaugaagaugggguuggagacaguggcucacaccugucaucccagcacuuuggaaggcugaggagggcagaucaccugaggucaggaguuugagaucagccuggacaacauggcaaaaaccugucucuacuaaaaauacaaaaauuagccaggcacgguggugcacacuuguaaucucagcuauuugggaggcuaaacaggagaaucacuugaaccugggagguggagguugcagugagccaagaucacgucacugcacucagccugggugauagagcgagacuccaucucaaaaaagaaaaauaaaaagauggaauggaauuaggaagucauuauuuugcaaccucuagugaaaugauggucagcagucuuuccagugacugauaacaucacaaaaagagaaaaucagacaguaucuuccuucugauagaaauucauggcacuugcuaugaaguguucuugccaaaaacauugaaccugaaucgaaucaaucuucuagacauaacuacaaauucauaggaaauauaagugacagaagaacagguuacagagcaucauaaguaauaucagcaaaacccaaacuguuggaaacccuauagaucaaauaacucaguuucuuaaauaagcaaagaaaaaacaauguguguguguauguguguguaugaaaccacagauuuaaaaaaucuaaaagacauaucaacguauugcaacauauaaauccuuauuugaauccugauuuuuaaaaacuguaaaacuuuuaugagacagaacuacaaaacaauguaaguacuagaagaaaauuuggguuaaauaugaacacugaccagauauuuugugauauuaguaggauuuagcauuaauuuuuuuucagugugauaauggcauugugggaauguuauaaaaaagaaugcuuaucuuucagagacauacacugaaauauuuauggaugaaauacuucugagaucgauauaaaaugauucagguguagggaauagauauggauagaaauaaagcaagauucacauguguugguaauuuuugaggcugagcaacagagguacauuauaccguauacuuucuaauguuacacauauuugaaauuuucauagcaaaauguuauauaaacaauaacaaaugccuucuuucagaguacagaauuuguauaacuggaaucacaucaagaaauuuagcugccaagaguucugagaaauauaguuucaagcuuuccagucucugcagcaguuuagaaucaggcuugaaauauaugugagugagauaaucaauagugucugcucccaaauuuauaacucaaacccugaccucucucuugaaggaccauuacaaauauccaacugccuccuugaaaucuugacuuggaugucucccaggguccccaaacucaaagugccaaaagcaaaacuaauacuauauucucaccaaaccugcucagcuacuaacuagcuguguguccucagagaagccucuaagguucucuagucuccaguuugcgaacugagggaaugacuaaauuaucucuagcauauuccuagcucaaggaauauaaaggacucaaauuuaccccuuuugucaguacuaauuucauuauauauuguuuuuuacagcaagccuccuuaaagagaauuagcccauaaucuuuuuagaagcagcaaugcuucaugauaaaucuuaguauccguuuagccaucagugaucauuuauucaauauuggcagaaaguucaaauagccuauaauugcuuucaguauggacucaugcauccuagaaccaaccagccaaguaacuaacugacugccuaccuguagcagcagcugucugcuguugugaagacaauuuagauggcuggcuuuuucagacacuggcuuuuguaucuguuuuagaaaugugacaggugugauuuuuuuccaaggcaagaggaagagaagguuugaccucuagugcccauugaaacaucuacagagggguaacuugucauuuuuauugcacaagugagggugcuccuacggugaagaaaaagaggugauaaauaacauucuuggaggccauuaaauggcacuuagcaggcgagagccugaaugacagcugcacacugcucagggaucacaacaacaauauguucccccuucccacagcacucugcaguugcaaagcacuggcacaucgaucgugguguuggacugcauuuucucucucugcucagauagcuuaccgaauuuaggggguaaaaaaaaaaaaccaaguaagcuuaacacaaaugggaauaaaagaugauugggaaaggugaggaaaggugggccagccucuuuuggccaguucagaacuuaacccagguauaaagauaaugucuguuaaauccaguuuaucuuuucucagagagacaguuuacgucugauguuggcuuggcgauccuguccuuugagauucuaaagaaguggaacuugaacuuccauuaaguguagaguuagaagcccagugccauacaucuugccgguucucagggggcuggcuucuguuucucccagucuccuugauaugguuuggauuuguguccccacugaaauugcaugucgaauuguaauccccaauguuggaagauugguuguucucaugauagugagugaguucucaugagaucuggauguuuaaaaguguguagccccucccacuuuguucucuuuuccugcucuggcuaugaaagacacacugacuuccccuuugccuucugccacgauugaaaguuuccugaggccuugccagccaugcuuccaguacagccugcagaaucagaacugugagccaauuaaaucucuuuucuuuguacauuacccaguuucagguaugucuuuuuuucuuuuuucuuuuuucuuuuuuugagacagaguuuugcucugucacccaggcuggagugcaguggcucacugcaaccucuugccucccagguucaagugauucuccugucucagccucccgaguagcugagauuacagacauccaccaccacauccagcuaacuuuuuuuguauuuuuaguagaaaggguguuucaccauguuggccaggcuggucucgaacuccucaucucaggugauccacccaccucagccucccaaaguacuggguuuacaggugugagccaccacacccggccuaagcaccuaaguucuuaaagcucauucaaaaaagucuuagccaucuucuguaguguuuuauacauucauuugcuaugucauuuacuucccauaucuacaggccaagguggguaccgguuucaauagucaucagaugaggaaucucuuagguaacuuucaggggcugcaagcagacuguggcagccgcugaugugauucaugcuuggcugaccgcacaccugggcucuuuucccugcaucaugcuguguccccuaaacaucucagcauuucaugacauacaaauuaucaccugagccuacccaacagccccauggaggacaugggagacuaauauaaucauuacuaaguuaauaaauucaucaaucuuguagauuaagaacugaaauccgcugggcaugguggcucacgccuguaaucucagcacuuugggaggccgaggugggcagaucacaaggucaggaguucaagaccagccuggccaacauggugaaaacccaucucuacuaaaaauacaaaaauuagcuggcauugguggcgugugccuguagucccagguacucagguugcugaggcaggagaauugcuugaacugagaccugggaggcggagguugcagugagccaagaucgcaccacuguaccccagccugggcuacagagcaagacuccaucucaaaaaaaaaaaaacaaaaacaaacaaacaaacaaaaaacaaaaaacccugaaauucuacagaagugaaggcucaugaucaaccugauacugaauggcccuauucucucucucaccaaagaaauaaauaaacaagcaaaaaggacacaucucuaggacacagccuauccauaagacauucuuagguaucacuagcuuugugugaauuguccuuuuaauuuucagagcacuuagaauccuaaaagaucucggggaaaaugggagucugaucccuaaauccuccuuggaaacucuggcuuaccaguaaaagccccaggggguugcauaauugcauaaaagccuguugcguuucucggaagaaaugcccuuucuccaaggcacuucgggauuuucaguugagucgugcuguagagaacugaagccucuucaaagucaaugucaaagguugcuuccaccuugaauggacaaggaccucacccuaagucaguaguucccaacaguugauuugcacaguccccuccccacuagccagggagaauuuggcaaugucggagacauuuuuaguugaggccagggauacugcugaacaacuuaacaaugcacaggacagcucaugcagcaaagaauuauuuggcccaaaacgucaguaguguccagggugagaagccugcccuaagccuaagauagagccuaggcucuguucugcuccucagcucacugucagcacaaagggaguccccucacauguccuuauuagaagaggaagagacagcaggucucucucucucucucucucccugugugcacacaggaaaggccauaugaggacaaggccauaagccuacaagucaggaagagagaagaacccuuaccagaaaucagcccugccaguaccuugagcuuggacuuucaggcuccagaacugugagaaauaaauaucuguuguuuaagcuauccacucuguggcauucuguuaucauagcccaagcagaucuauacagauacuaacaccuggcucucuucaccaggcucuccaaccuggcccaucagccuuggaauacccaggccaccaauggccaacuauaaugacauaauguugcccagccuagagugcaguggcacgaucuuggcuuacugcaaccuuugccucccagguucaaguaauucuccugccucagccucccaagcagcugggauuacaggccaccaugcccagcuaauuuuuguauuuuuauuagagaagggguuuugccauguugaucaggcuggucucgaacuccugaccucaugugauccaccugccucaaccucccaaagugcugggauuacaggcaugagucaccgcagcugacuuuuuguuuuguuuuguuuuucaggccucaacccaccuuaccucucuguacuaucuaccacuagucaauacucucccucucuuaaaaggcucuccuccuuugcuuucuaaaauaccaccuucuccugcauuuccuguuaccucucugagggaucucaggcgcucucucuuuuaugggcuagcaauccccagggcucuucauuuuguuuuguuuuguuuuguuuugauauguccuucucuucucccucugcaaauucucucugagaaagcugccaagagaccucuuuccauaagaaucuuggacaguguccuccauaccgaugaauggaaguauccagcacagaauaagcuuguacuaaauauuuacugagugaaugaguaaaugaacaaauuaacaaaggauccccuaugagaugauaauuccuaaaccagaaucucugaucuagacaucuuuuuugaguuucagacucagaaaagaugcucacaagaaugccacguaacaaacuaccccuuaaauucaaugacuuacaauaagacacacauauucuccuuuagguuaacaguggucgagcugaucuaggcugggcauggcuaaggggaucugcccuagcuucagauugugugggcucggcuucaggcugugagcuggauucagauccggcuucauuagggccaggcuacagagcaguggccaccaacacacgauauugucauggcaaucacuaaaccacacaaguacacuuaaggccucugccuguguuugcaucacauucgaucgaccaaagcaaguugcaaaaagaagcccauuaucaauaggaugaggaaguaaucucugcucauggaguuggauagagcgacaggagugagugacuauuuggugaacaauaaugcaagcauccaaacuagcacaacuauacaucaaaaugccuauaagacaccucuuuuuugaaugucucacaagcugucuaaacccuccaaguuguuugcuaagagcuugguacucugccaacuccuuucuguagagcugggucuucucauccauauccuaccagcaggggaugcugcugaauuuggacagaacaccuacuuccaacugccaacugcccugacuuuugaaucacugcaccuuccggaucuccucauugcccuggccuacacagcugaacagcucugcuacuacacacauguuccugacucacuccuguguuuucuaugguuuuuggacacugcaucccuggcugcugucaaugggauguucauuucuuagugcccauuuuguucagugcuaguucuuucuuugccugucaaccccagccagcaagguccgaucaugccuugugcuucagcuugccuaagucacaaugaggagacuggauacuggacaguccuuuugagcacuggccuccaacacugaaaaugagauucucuaaauugggucuucccugggacaacaccucauaggcucagcagugagccaccucccauagaauugacauuagaauccaccaaaggggagagagaucagcaaaugagcuacugauuaggucugcuuuccuggccuagcuuucagagggcacacacacacaaacacacacacacacaggcacaugcaccuguacucaguucuaaucuucucccucauauuuauuuaggcuguuaccagauaauuugauaggcuuccuugggacaaauaggccccgcuccaggggucuaggacaggaauaguaagacuggacggacacacuuuggcagcgugaagaggcuuugcaagaugaaugucaccacuguugcuggcucuugucugcuguauuaauuucucccuuaaaagaaagcugacccauuuuuuccagcccacagcccuaauggacucuuauucagaggccauccuucucccacauaaagagcuguauuguauuuaaugauaagccuuuuaauggaauuugcuauuucuaggucucugggaaaaugucauuaaugagcuagcaagugcaaggaacagcagauguuugaggggcaugcuuuuucaagggcagaccacccuggcaggaaagugaacgaaaacaaggcacaccuacuuuuuuuuuguuacuuuuuuggaucuagcuuggccuuacuaaaaauaccaucuagacaaacguugucuucaaaaugugaagauaucacuuuucaugcucuccacccgcccccaacaccuaccuacauguuuuuuacucugucaucacccacaaauauuucugucauccuaauuauaacaaaaucagcagcauucaaaacuagaccaagacccauggguaaacuaaacaggcuaacaucugucacucguuuucaaaucuguauugggucaaugccaagagacugaacacaccaaggaaaacggaagaggggagagauuaaucuuccuuuuacugccuggaacaauucagcucuggccccaaaccugcauauuugcucauuaaaacagaagguuguguuuaaccaaaggugcucuccuucacaaagcaguuuaucgaucaccucuuugcacuccacaagaccccuccaaauugcaccucuaaucuggaagggcucaucgaagcacaugcauacaucccuuaaggggguucucauauguuuugcaucucuugguauuuccacuggcacccagagaggccucaguaugccuuauugguaggaguuuugcuggcacacccacccuuuaaucugucucuuacuagcacccacuguuuccuggcauuaauggagguucuaaagauguaaaaaacauaagacaaaguucuuguccucaaaaguuuaacagcgaaaaguccaacucauuuuauugaauauuguugagagcagggcaguaugcuagaagcuguugggaguucaaagaugagaaaagcaaaguaaagauccuugaucauccuaaagauuuguuguagucugcagcaucaccugggagcuugcauuaaaaugcaaauucucggccaggcgcgguggcucacgccuguaaucucagcgcuuugggaggccaaggcaggaggaucacuugaguccaggagaucgagaccaggcuggacaacauagcaagagcuugucucuacaaaaaauaaacaaaauuagcugggugugguugcacacaucuguaaucccagcuacucaggaggcuaaggugggaggaucacuugagcccaggaggucaagccugcagugagcuauaaucauaccacugcacuccugggcaacagagcaagacccugucucaaaaaaagaaaaaaagaaaguaauucugccauuguccuugaaacuacgaguguugcucccauggaguucuaguauuuggauggugggaggagaaaguguaauaaauggcuuuuaaaauggcaagcuuuguaguuaccgagucaggaccucagcacaucuugucuaucagauugucuuuuuaaucacuacauauuucuuuuucuaggcuggucucuucaaaucuuccuaauauucuuucaugggcauuaccuguaacaaaggugaauuccgcucacaggaaucuaccucaaggaaacgucuagcaaauagaaucaaacgaggggccacuacaauauugauuauaauauugauuauauuaauauugauuauaauauauaaugacaaacugggaucaacaaagguggcucacaaugagggauuaucucaaccuaacuuucacgaucccucguauugacaauauuucacaguucuuagcagcauaucaaaauuauaauccaguuuuuguauaaaaaacaguagaagcucuuuggccagucugccuucaaccaacauguggauaaacuuuucacccucucucugcugacacugccaccuguuuauucugguuguauuuguucuugaaauuauguaauuuaacacugugguaaugcguccggaaaugguggguucuuggucucacugacuugaagaauaaagccacggacccuccugaugaguguuacaguacuuaaaggugguguguccagaguuuguuccuucugauauucagauguguucugaguuucuuccuucuggagaguucggggucucccugguuucagaagugaagcugcagaccuucgcgguggugaguguuacagcucuuaaagcagcacaucuagaauuacuccuuccuucuguccgggguuauucauuccccccggcagguucaugaucuaacuggcuucaacagugaagcugcagaccuuccccgugaguguuacagcucauaaaggaagugcaggcccaaagaguaagccacaggaagauuuauuacaaagagcaagauugggaagguaaccuaaccagguugccauugcugggucaggcagccugcuuuuauucccuuaucuggccacacccacauccugcugauugguccauuuuacagagagcugauuggucuguuucacagagagcugauugguccguuuugacagggugcugauuggugcguuuacaaucccugagcuagacacaaaaguuguucaaguccucacuggauuagcuacacacagagcacugauuggugcauuuacaaaccuugagcuagaccacagggugcugauugguguauuuauaaucccuuagcuagacauaaagguucuccaaguccccacuagauaagcuagauacagagugcugauuggugcauuuacaaaccuugagcuagacgcagaaugcugauugguguauuuacaaaccuugagcuagacacagagugcugauugguguauuuacaaucccuuagcuagacauaaagguucuccaaguccccaccagauuagcuagauacagagugcugauugguguguuuacaaaccuugagcuagacacagagugcugauuaguguauuuacaaucccuucgcuagacauaaagauucuccaagucccuacuagacucaggagcccagcugguuucaccuagaggaucccgcaccggggcagcaggcggaggugccugccagucccgcgcagagcacccgcacuccucagccccugggcggucaaugggaccaggcgccacagagcagggggcagcgcucauuggggaggcuccggccgcacaggagccuauggugcaggggaggcucaggcauggugggcagcaggucccgagcccugccccgcggggaggcaccugaggcccagcgagaauuccagcgcagcgccagcgggccagcacugcugggggaucuggugcacccucugcagcugcuggcccggguguuaagccccucacugccuggggccagcagcgccagccggccccuccgagugcggggccgccgagccaacgcccacccggaacucgcgcuggcccgcgagggcugcaggcagcccagguucccgcccgugccucucccugcacaccucguggcaagcagagggagccggcuccagccugggccagcccagagaggggcuccugcagugcagcggugggcugaagggcuccucaagcguggccagagugggcuccgaggcugacaaagccccgagccagcuagggcugccagggcugccagcaugcugucaccucucaguaagucaauuauaaauggacaugaaaagaaaguuuugguuccuaugaaaacaggaaaaacucaauaaaggcaaauugcuaaaggaagaaaaccugguaucaaauuacaugugacagagaagugaaaaagacugggaaacaaguuuuaaagguuuaggagaauucugaacuaaauuguuuuacguguguuuuagauuuucauucuucacuuaagccaaaaugggagaaaguacaaaugcauuaugggcauggugacguuacacuuggaucaggcuggaacagucuuuguuuacaucugcuguuucagcgcucugucuggauuagugcccccuccccgccccccaccccccgccagcccccuuugggucucagaagagucccagucuggaugagaaauuaaaagaucacccuaaauauggauguacuuuaaacaagacuaauaagguagggugccaaucaacaagccauucccaaagaacugaaacugagucuucaauuaaaagauuagugauccaguguuuauuugcaugcuuuaauuuagggguuucaaacuuuuucuguaaagguaguaguucuaggcuucauucaaucucugucauaacuauucagauuugcuauuuuaacacaaaggcuacucuagaaaaccuauaaaugaaugggcauggcuguguuccaauaaaacuuuauucauggauacuaaauuagaauuacauauaauuuuccaacugucacagaaguucuuuugauuuuguucaaguauuuacaguuucuuuuucuuuuuuucuguuuucaaauuauuucuucaaagacaucaagcaauuaaaaauguaaagaucaucuuugacuuggaacucauauaaaaaugggcaguggaccagauuuggccugugggccauaguuuucugaaccccacccccccuuuuauuugagacgaagucucuugucgcccagacuggggugcaguguugcgauuucagcucacugcaaccucugccucccaaguucaagcaauucuccugcuucagccuccagaguagcugggacuacaggcacaccccgccacgcccagcuaauuuuuguauuuuuaguagagacggggugucaccauauuggucaggcgcuggucuugaacucuuaaccucagguuuuacccgccucggccucccaaagugcugggauuacaggcaugagccaccaugccagccuucugaccccuuuauaaguuuuaaaauaauauuguguauguguuaguuuuuuucuuuuaugguuuucaguuuucaauuauccaaaauguccaaaugacgucgaauaagaggaucucuauuauuauauuuguucacauuuuuccuacuuuucuugccuaugagguccacaagauaagggauuuuaucugauacauaacaggugcucaguaaaucaguaaauguuuauuucuuuuuucuuuuuuuuuuuugagauggaguuuugcucuuguugcccaggcuagagugcaauggcauuaucucagcucacugcaaccuccguucccggguucaagcgauucuccugccucagccucccgaauagcugagauuacaggcaugcgccaccacgucuggcuaauuuucuguuuuuaguagagacgggguuucuccauguuggucaggcuggucuugaacucccaaccucaggugauccacccgccuuggccucccaaagugcugagauuacaggcaugagccaccaugccuggccaguaaauguuucuuaaaugaaugaaguuaaauuaugcaaucuccauacaacagaauacuaacacaaccauuaaaaauuauguugaagaguucaagauuuauugugaagggggaaaacaaaacagguuacacaauaguuacauauaauauaacuauuuuuaaaaauaugugucucccuuugcaggggaaaucaucuaguaggguuugcauaaauguuaauaauuauaucacuauacuuauagauuuagguuucuuuaaaaacuuuuucuuuuugcuuaucuguauuuuugaguuuuuucaaaaauggguguguuuucugucugugauugauucucauuauuguuuuuauuuuacaacucugguucccugaaggaauuuggaucugaucaaauggaggcaccacgucugaauagaucccgucauuguggucaggggcugggagugacuaaguaagauauuagcuugggagggaguggguaaagacuacuugucagcgcuggccaguuuccuagugcacuuaaaacacuugaaaugagaugcuagaccuuuugaguucaaggccagaaccuugaaugaggccuccccacuccccgauaagaugaccguaguuccuggugaaauuugauauauuacuuuaagagcaaugggaggucuaagaagaauuugguucacuuagucuaucaacaaauacuugaugggugcccaccacuugccaggcacuguucuaggcacuggggauauaggagaggacagaaauagacagaaaucccuacccuuaggcaauaaaccaauaaaggaaaaaaggcagauggagcugagauagccucagaguggggcagggcagccgcauuagucugaagagacaucugagccaaguuggcugagucuggaucaggcagaggaaaccaagaggacaaaggcccgcaguggcacaagcuuggcacaggagaagaucugagagaagggugguguggcagaggaaaugagacugagaggcggacaggagcuaccucaagugaccacaauaaaaaaauuuauuauaaggugaauacauuuucuucuaagugaaauuggaauugaaauuucaucccaagggaagccagugguagguuuuaaacagacgaaugacauguucugguuuauauuuaaaagauaauucuugccuuugugugagugggcaagagugggccacaaggccagugcgggcgucauagcagggguugguggccagaggugaagguggcuccgacuaugguggagguggaaauggagaauggagguggacuuacucauuuuguuuaugagguaaagucaccaggacuugccucagaacuaguuguuguuguuguuguuguuguuguuguuguuguuguuuuuucugagauggagucccacucugccacgcaggcuggagugcaguggcgaaauauuggcucacugcaaccuccgccucccggguucaagugauucuccugccucagucucccgaguagcugagauuacaggugcauaccaccaaacccagcuaauuuuuuuguacuuuuacuagagacgggguuucaccauguuguccaggcuggucuugaacuccugaccucaggugaucugccugccucggccucccaaagugcugggauuacaggcgugagccaccgcgcccggccagaacuagauuuuaacaggagacagaucugauucaaguuuuguuuguuuucauuuuagcagcuuuauugagauauaauucucauaccaggagauccacccaaaaaguguacaauucaauggcuuucaguaucuucagaguugcggaaccaucaccacaaccaacuuuagaacauucucauuacuccauaaagaaaccuugcaucugugagucacacuccucuuugucuaaggaaugaaagguuucuuuuugugcuuaucuguuccuccguugauggacauuuaguugguuuccacuuuuuggcuauugugaauaauguuucuaugaacauucuugcgucauuucucuuggguauauaccugggaguggaaagauaagcguguccaagcauuugaggaacugacagaccauuuuccacagcagcugcaucauuuuauauucccacuggcaguguaugggaaugcugauucaguuuuaagaucacucuggcugcuguguggagaaaggauaggaggaaggcuggggcgaggcaggggaguuuugggggcacuguggaaaguggagagaccagaaugguuaugcagaaguucagggaucugagcaagguucaaggacauucaacuuaaggugcacucccuaccguuuacaguauggugcaaagauucgugagcuccuuacacaaugaaucacaucgcuaaauuaaaagauuccaacagagagggcuuguuaaaacagaucugccguuuucaagucuagaguccuaaagcaaacuggcauggaacugcuuaaacaucuguccccaaacaagcuccugcaagcaagaggauauuuucagaaaagcgagaggagccagugggugccauaagauuuccacaccuuuaagccaugaaaacacagggcucaagugacagccuguugcugaggacucucauggcaacaggcaucacuccuccugcccuacagcacugcccuggccucucagcccagggaagagcuggcuuguuuccaaguucgacaacugggcagcaguccuugacucucugaaguuccuccaguucagaaagggaugggaaaugaacaucugucaggcuucagauaugccccguguuggguuauaagugacuuuucacauacaucccuuauauugguaaagccucacaacauaucaccaagguggaaaauuuucccccaacuaaagaugaggaccguuggccccuuugcauggggaggucagaaaaggccacuuugaagagguggugauuuagcugauaccagcuacacagggauccagagcaagaacauuccaaguuuaaccccaaaauuauucauuugcucucuagaugucuucauuuuuauucuuauuuaauucuaauuuauauucauuaguauaaagaagggugaaaaguugcccucuagaaacaaaucaaauuuaaauucauuucacguauaacuuugaauagaaaugauaauuauuuuuccuuauuauuucugauuuuaaacucagagacuauucuccacuacaucucccaauccuauacccaucaccucccaucccccacccccaaaacagagacaauacuauugucucuauuaaugugucuuaauagauggguaagguucugggacauguggagacacaguccucauggucuggcugugccacugugcaggaagcggugacuuuugaccucuugaacuucccauggaagauguaucuacagauaaauaccacacugccacucaaaaguuucccacucucagguuaauaugcuuucccaaauaaaggaauuaguuuucacuguaacucuguaccaaauuccucaaagcuagacucauccuaagaucugucuguuggaucuuuaggauggcccaauaaauaacauuccucuuccccacugaucuaacugaaaugcaagaccaaggugugagucuguuuugagaccaaacuaucaccguuuuaucaacuaaaguuaauacuggagacuguggcauauauccacuggcaagcugaauuccugaugcuuauccauccggucacaaugcuaggccagggcaguucugccugccaggugcaccuaccccuguaaaauugauguguagaagacaaugugugcuucuauaggcagaucacuccaggagcaagaagggaggaagaggcaagagcucuauaggcccagucccugcuccaaaccucacuaauuaacuauauauuccccuuugcaguggaaaaaauaguaaaaguaauugagagaggcuauggaaacaucaggaugaacagggaagagacuuccccaccucccucucuucaacacacacacauccagugcuggauucugcauguccuagcucugucaauauauauuaauacgauguuggacaagaauacugacacccucccgggucucagauuccccccuucucaauuagagaugguucuucccucccagccaugcagaauugcugugcacacaaaggaugaguaaguaugucaaaggcuuugcaaaguaugcaaaacuaaagaaucguaagguguuccuaacauggagaaacugcaaccacuugacucagcauuugcucuugcagggucuccugacaaacuggcagagauccaaaacaagaaugagugagaaggccccaugagguuauucgacuccuuauacuugagcuuggcagcuucuggcacuaagacgccugcgcauuucuuccuggguacauuuccucuaguugguccagaugagagguagugcccugguaucugcuucuccuguguguggucuggguucucgagagucagucuucaguauauuuucuuuuuuucuuuuuucuguuugagacggaguuucacuuuuguugcccaggcuggagugcagcggcacaaucuugggucacugcaaccuccgccucccggguucaaacaauucuccugccucagccuccugaguagcugggauuacaggcaugcgccaccacacuuggcuaauuuuguauuuuuaguagagaugggguuucuccauguuggucaggcuggucuugaacucccgaccucaggugauccgccugccuuggccucccgaagugcugggauuacaggugugagccaccgcgcccagccaagccuucaguuugagagaugguucuugcagaggaauacaugcuaucccacucauuuucuuguuuuaauacaaaagaaucuucauuaacacuuguguuugggguaagacauucuauuauucuuugaaaaugggaauuggagaaucccuggguaggagggauuccaacccugcuggggaugagguuguggagagagcugcaagaugaaaaaccagguaaggccgagaguggcggcucacgccugcaacccuagcacucuggaaggcugaggugggaggauuucuugagcccaaggguacgaggccagccugagcaacauagugagaccucgucucuaccaaaaaaagccggacguggcagugcacgccuguagucccagcuacuggggaggcugaggugggaagaugguuugagcccaggaggcagagguugcagugagcccagauuguaccacugcacugcauccugggcaacagagccagacccugucucaaagacaaacaaacaaacaaacaaacaaacaaaauccagcuggagagugcugggaggguacaaaaacucagagagguggacacgggcccagaggcagggcagggcuggggaaaccugccugaugcuuucaagaacaaaagcuucccaaaggguuuauuuacuggggaauggaucuagaaccucuucuuccaaauaccuccucugggugcauuuuacuguuccauccuucaauugcugcaagccagugguucucaacccugucagcacauuggaugcucuugaagggauuugaaaaaaauacuaauaccugucaccauucucucuucuccuuauaagaugggccugggcccuguaugcuguuugguuugcuuguuuuaaacuuugacuauaaucucaaacuuagggaauaaccgacagaaaaagaacaguacaaagaacauccacauacucuuuuacucagaaucgccuauuuuaccccauuuugucucauguaucuuuuauucuauuuccauauucuguuuucuauaugaugaaaugaaaugcuuugagaguaaggcaucauacuuccuuaaacguaagaucagcuucgaugugcauuuccuaagaauaagauauuuuccuuuucuuuuuuuuuuuuuuuuuuuuuuugagauggagucuugcucugucaccaggcuggagugcagugguaugaucucagcucacugcaaccuccgccucccggguucaagugauucuccugccucagccuccuggguagcugggacuacaggugugcaccaccaugcccagcuaauuuuuguauuuuaauuuuaauuuaauuuaauuuuauuuuugaaauggagucuugcucuguugcccaggcuggaguguaguggugcugucuuggcucacugcaacuucugccucuuggguucaaucgauucuccugccucagccucccgaguagcugggacuaccggugcgugccaccacacccagcuaauuuuuuguauuuuuaguagagucaggguuucaccauguuagccaggauggucuccgucuccugaccucgugaucugcccgccucggccucccaaacugcugggauuacaggcaugagccacugagcccagcuagaauaggaaauuuucuugcauagccauaguacagucaacuccaguaaacuuaacaucaauagaaacacuuuuaucuucuuuacccaacauuuguauuccaguuuugucaacugacccaaucaucucuuguagcaauuuuucuggucgguauagaauccaaucuaggacaggcacugcauuuaguugucaagucuucaacugguguguuuuuaaaagcucucugaguggaggcuauuaucuuaaguuaaauaacucaggaagagaaagucaaauaucacauguucucacuugcaagugggaacuaaauaauguguacacaggaacacagaauguggaauaauagacacuggagacuccaagggugggaggcugcagggcggaugagggaucauaaauagcuccuggguacaauguauccuauucgugugaugguugcacuaaaaguccagacuucacuaccacguauuguauccauguaaaaagcacauuuguacccccuaaaucuauauaaauuaaaaauaaauacguauuuuagaaucuuuuggauacauugauauaguaaacaaauaaauaagggcucuguaggugauuuuaaugggcaccuugggccuugggucauuguguaaauaaauauuuacuacacuaccacauagugagugccuaccagguguaaaguauuaugaauaaaauuaaggagcuuauuacuuuaaggacauacuauccacaagucaacuauaauaucauagggauaaguaucaugaaagaaauauuaacaaaccuauaggaggaaacuauaauuaaauugaacaaguuuacugaggaucuacuaugugucagacuuuguacaaacugcuggagaaauggauggauaaguaaauguaauuaauacacaguuaaaaauuaauuaacaauuuuuuuuuggaauggaguuucacucuuguugcccaggcuggagugcaauggcacgaucucagccaacugcaaccuccgccucucggguucaagcgauucuccugccucagccugccgaguagcugggauuacagguaugcaccaccaugcccagcuaauucuuuucguauuuuuaguagagaugggguuucuccauguuggucaggcuggucucaaacucccgaccucaggugauccaccugacucggccucccaaagugcugggauuacaggcgugagccacugugcccggccaguuaacacagucuuaaucagaaaaguaagguuuuuaaaagguuuuuuuuuuagaggaggugggacucaaaagauaagcagauuuuacuuuuagagaggaagacauuucaggugaggaaacuucaagaggaaagcuaggugagugcacaguggaguaaggaaagaaucguacuucccugugaccugagaauugggugcguagggauguacuaggagauugugcugaaguaggcuggauaauguauggugguacagucacuucgcaaaacaauuuggcaauuucuuaaagaaguaaaaguuaucauacaacuuaagaauucugcuccuagguaucuacccaagaacacauaaagacuugcacgugaauguaaucuucauagcagcauuauucauaaaagccaaaaaguagaaacucaaauguccaucagcuggugaauggauaaauaaaacacagcauacccauagaacaggauaaauaaguaauaaaaaggaacgaauuaaugauauguguuacaauguggaugaaucuuaaagaauuagauggaaagaauaauuuauuauaugguuucauuuagagauaauuuaaagagauaggaaguagaugaaugguugccuggggcuguuggugggaacagaaacugacuacaaauggccacaagggaagauuucuuuggggugaugaaaaugucccuaaaacuggauuaugguuauggcuuaaugacuaaaacaauguugaacugaacaauuaaaacaggugaauuuuaugguauguaaauuauaccucaauaaagcuguaaauauuaaaaaaacuguuaaucaaaauuaggcagaaagaaaauaggaagcacaaucuuagaaauaaaaaauauaauuauugaaauucaaaaaacuuaauagaugggaaaaacucuggauuggacaaauuauuuagaagacuggcaaauuggaaggcaaggaauucaccaggaugcaacacaaagacaaaaucuuuuuuuaaaaaaauaacaucucaggauauagauagugaggcuuccucacuuaccuaaugguagugccagaaaagauaauggagguaauggcuaggaagcaauauugcaagagaaaaucaguaauaauuuuccagaauuaaagaaagcauaugcaccccuguaaucccagcacuuugggaagccaaggcgggaggauugcuugagcucaggagucugagaucagccugggcaacauagugagacccugucucuacaaaaaauuuuuuaaaaauuagcugggcaugguggcucaugcuuguaguccagcuugaguaugggaggucaagguuguagugagcuuugaucacaccacugcacuccaaccugggugacguagugagacacugucucaaagaaaaaaaaaaaaaguaccuccuccuuuugcagaggauaaagauaaacuaacaccaagacaguucuagaaaaccugcuggacaguaaaaauaaacaaaacaaaucugaaauguuaucaaagagaaaaggcagcuuauuuauaagggaaugaaaauuagauuggcaguagaauuuuuaaccagcaacacuuaguaccagaagacaguggaguacuaucaucaguguggugugggaaaauaacuguucacuagaauuuuauauccaaauaaaucaucauacaacagugagggcaaaauuaagacauuuccaacaaugaauucccucccauaccaaggcaccuacagaaagaacuauuaaaggauggacuucagccagaagaaaagugaacccaaagggaacacuguagauucaagaaaaagaaauagcagaaaaauugauaaaaugucauaaauuuaauuaacuuuuaacuauaaaaacuauuuuuaaauuuaagaaguaaaaacagauugaaugcgguggcacaugccugagcuuuggaagguugaggcgggaggauugcuugaagccaggaguucgagaccagcuugggcaacauggugagacucuauuucuacaaaaaauuuuugaaaaagaaaauauuagcuggggguggugguguggaccuguuccuagcuacuugggagucugaggugggaggauugcuugaggccaggagcuugaggcuccagucagccaugacugugccacuacacuccagccuggguaacagagcaagacccugucucuuaaacaaacgaacaaaaaaguaaaaauaaaacucuaggcagcaauaaaaagaugggaaggaaggggcuguuaaaugaguaaaauauacaaaguucuuucaugggaagaaacaauuacauacuaacuuuguuagcaaaaaaaucagaguuaaguauguauguugaaaaaauaaaagacgauucugagaagaauagaaauaaaaccuaaagcucucaaaccagcaguggaauauguaucacuuuacuaaucugauagaaggcaagaauggaagaaaaagaagcaaggagaaagaaugguaaaugaaaaacacaagaucugauggaagaagagcccaaauauauuaguaaucgcaauaaaucccuguggauuaaauucaucugucagagacacaaccaaaauaaaacucauagaaagauuaaauaugaaggacaauauuucacauacaaauaguagccaaaagaaugguggccuauuaauaacaaaaacuucuaauuuaagcaauuagcauaaaaaugguaaacagacgcacuacauaaggaucaauugcgauuucuaaugcagaauauacuuuaagaaacacugccuacugugugccaagaaucauguaugccuucuauacugcuguguuuucagugcuuggcacauaauaggugugccauaaauauuaaugaguggaaugauugcuauuuuauauugaaaugaucuguuuauguguuugucauaccacaagggcaagaccauaucuuacuaauuguuaugccaucaacauucagcauagcagcuggcacauaguaggaauuccauaaguccacacugaauucaaggaucaucucuuccauaaaaucuccccucacuguuccucccauacugauuuguccuuuguuucuacuucuauagcacucguaauuggaaacacccaauuuagcacccaagacauaguauagucuucuagcuuucacucaauauuucaaaucuuguuucuuuaaaacuauuuuagauucuuugaagauagagaagaugccuugcacugugccaagugccuuuucagguacuugaauaaauacauguuuugguugaugucacuauuuacaugaauguagguuagaucaauaguaccagcuauacaugucaagaacgcuaagggcuaucuccagucucuuuuuucauuccuugaccaaagagagcccuguuuggagacaggcucacgugcaaagaaugugaaguuaaugagacaggugggagaaggcggcuaguguucaauuccaagccccugugcucuauuccuccuggcaaaauagugagguuggcgggacagggggaggggaaugucugugaucccacaaaaaaaugugugggaagugagagggagauggugaggaaagagagcauguuccagacgcuacaggacagaccuggaccugaccucucccuggcgggcauggcaccaggaguuuauuaugagaccgaaaggaaaccccaaggcaaacagcuaaauucauccacuugaaaccuuguauaggagacagugagggauguuguuuuccaucuagacaaggcacagaggggagucugugacaaggagcuucuaauuggggagcugcagaggguuaacaaagagcacugguggcaucuuuuugcuggucuucuugaaaaagacauagucugggaagguucaaucagagcccccugcacgagguaaggaggugggcuggcugacuucccuagguccuuccuaaucccauaguuauuuggugaaucgugcucuuccccauuuaugcuccuacacacgucugcacccaguuugauaguaaguccccuaggcugcauuccagguuuaguacggugccacgcaagcugcuggcacucaacaaaugacgcaaauauuuguugaaugaaggaauaaauggaucaaguguuuaaauagagcccacaugaccuccccagcuguaaaguauggcaguugaaugaaaucacaacauucuaggcacuugagcaaagcuggcggggacacacacacacacacgauucacauucccaccuuggaaaagcacagaccaccugcccagccagcaggcugugggaguuuccuuggcaaggauccucuuucucugcugcuuuaggauggugccucuagaaggucaagucacccagauuuaggaccgcuucccuucccgguuggccuccgagacaaaguuucugucuggauuuggcccgggccucccgggaggcgcauccgcacugacucccggcucgggcgccccgggcgugcagcucgcuggcccgcugcgccccaccuuaccuuggugagcugggcgaucuucuugcacauuuucacgugcaucuggggaucacaguccauucuccagccggcgccaccgucggcuuuggagcccuggcaagugccgggcggguuaauuuugcuguugagagcagaagccaucgcuaaaacgcgcccagcacucagacucucucguuuucucccugcccaccgugugcacgugcgugcgcgcgcgggcgugcgagcguguggguuucucgggagagguggcacugcagucccgucgccugcaccgccgcguggccccagcuucccgaaggucuccgccucccgggcccacccgcgcgcccacccuuuuuccucuccugcugguuc

SEQ ID NO: 191472 - RNA, 78933 nt, Homo sapiens
gucaucaccgcgcgccacugucuucgccuucuugcacuucgcgggagaaguuguuggcgcgaauggauccugagccucgauaacagauuccucaaccggcccacccgccagccagccagcgccuucauccuggggcugcgauggugagccgcugggggaggccgugcggcucggggucugggggggcuuugcaggccugguguggaccgggcacuccugguaugcagggugggggaggauggcggugggugguuccggaggcuagcaaaggcagagaaggggccgcacaccgggcacuggacgcaaaacuuucauugcaucgcgggcucuggcucugggcggcagccagcgcgcagggauuuuguugcuacguguacuugcacuuuccccccgccccccacucuugggggaagggagaaaggaagagaggaaggauggugguuuugggacgcauugguaaaguuauuuucuuguucggcguugcccgaaccucaguuugaguacugccuaaagcguggauuucaagcuuugggucacgagggagaagaauguaacaaacuuuucuuucuuagggaauauguuguguagggccuuaaacuuuuaucauuaacagcucagcucgucucaucuccgcucgucauuaacgaucaccugagcgguguugagaccgagggcauggagaggauauuuuauuuuguuuagaugaguucauaggagucaaaaggauaacauggcuuacuaggaaaaagaaguacagcgaauagaaacagaugcaagacauuugacagcugucauccucuuaccaccugauguuuaaaaucugaaaaaaacccaagccucacugcauaauucuggauaaaauguucaaacaaauugaaagugaaaugauuaugcagccagcaaagcagacauuccugaugguauggcaauggauauggcucuguguuugaaauauuuuuaaaggaccauuuaaaauguucauuaagcuagaagauacuuaacaauccgauauaauuuuuuucaaucauuggucaacgugucacagugacaacauucugggggggggcggugaaaauuuuaugccacacugggaaacguugcaggccuuuguguuucuucucaaaaaagggcaacaguaaugauaguagcuaccuuguaccaagcaucuucuuuaggucaauaugugaacuguugguuuuccaugguuuuuuuuuuuuuuuuuuuuuuucauuucaacccacaucgaugcaguuuuacagauggugcaagcaccuuuuuggaauuuaaacaguguaucauauaacuaguaggugguugaacuagaauuagaaucuugguguuucugaccaccauguuauacuacuucccuauaaugaucaucauuacauuuuggaggccaaagcacugugguauuuuggaagcuugagacuuggagucuugaagaugaagaacgugguaauauuuuaguuuaaugguuuauauauuaauuuauaguuauauuacuauguuaguauagucuaguuuaauaguuacguggucuugggcaaguaaauagcuuaaguuuaaucucuuuaagccucuguuuccuuaucuguaaaagaggggaaaauaauagcugccauagugauuguuuuggggauuaagcaagauguauagguaaagcuuccguucugguucuggugccuggcauguuaggcaacuacacagcuaccagugaucuauuuucucagaaaggacucuauggaaaguuacauagauuuuaagaggcaugguagauuccucugucauuuauggugaacauagcuuguguggucaacuuuugaucauucaggugcuuuuacuuuugguucuuuucuuucuuuaguacuccuguucauggugcagauaaaaaauagaccucuucucagaaaagaaauaggucaaauuggucaguuuuguuguuaguggguaaacauccuaugagguagauaagaauuuuguauuauacugauauuuaauuuagcccuccagucucuagugcaacaauuagcaaaacccuagacuaaaauugauucaacaaauguuuauugaacacuugugcaaaguuauaagacaguaguucuuuuuuuuuuuuuucccucagacugugucguuggguaugaaggacaguaguucucaaucuuuguuucaguuacaguuuccuuugauaaauacagugaaugauaugcaaauuuucugcccagagaaaugcauaugggcauauacacaccauuuuaagggauugaccuaucuucuucuucuuuuuuuuuuuuuuuuuuuuuuaaaggcaaggucuugcucuguugcccaggcuggagugcaguggugugaugauagcucacugccaucucuaauuccgggguacaagcgauccuuccacccuggccucccaaagcauugagauuacaggcaugagccacugugccuggccuguucacuuaucaucuucuucuucuucuucuuuuuuuuuuuuuuuugagagucuugcuguuuugcccaggcuggagugcagugugcagucuuggcucacugcaaccucugccuaccagguuuaagcgauucuugugccucagccugccugguagcugggaauacaggugugugccaccauguccagcuauuuuauuuuuuuauuuuuaguagagaugaaguuucaccauguuggccaggcuggucuugaacuccuggccucaaguugauccaccugccucagccucuuaaagugccgggauuacaggcaugaaccacugugccuggccuauucacuuaucuucugaagcccauccauagacagcucuugcccugggagcugcauugaaaacaaaaauuccaauuaaaaguuaucaauaaagaaauaaaguacguguauucacacaauggaauacugugcaaccuuuauaaaaaugagaaaacuuuauacucugauaugaaacaauugccaaaauauaaaauuucucuggaaagauacagaaggaaccaacugauaacauuuguugccuccagagaugggaaauaugugucugagaggcaggauaagagggggacuuuuuacccuuucgaaauuugaaccacguaaauaaauagaaagaaaauuaaaaauaaaagaaauaaagaagccauguagacaauuugaauuucacugagauuuaauuguuugcacaaaacgugaauaaaaccugagagaugccauuuuuaagaagucagcauauauaauuaauugguugguauaauuauugaaaauaugcauaagauugaauuaaacacacaugagacuuaaggaacagcuguuugaagagccgugaggucaguuuaaauaaauuguggucugaacuguuucauugcuccacuccuacaggcaggcaacuuucacaucaugguuuacuauguggaaugcucucccuggagcagugcucgacuuuauuauaauauagcuuuugccaaauaauaugcuuuugccaugcauauguaccugaacuuggccucuaaggccccuaccuaccucucugauuuucucucucugucuuuugaguguguuagguugguucuguuucucuccgggcuuuuguugcuauuuucuuucuuugaaauagucuuccuccacauccuugcaugucugucuuuuuuucaucauuuaaguuucucuugcuaauccaaggucaugaagauuuaugcuuaagagcuuuguaguuuuagcucuuacauuuaggacuuuuauccauuucugaguuaauuuuuauauagggugugaaguauagagguccaauuuuauucuuuuauauguggacaucuaguugucccagaaccauuuuuugaaaagacucuucuuucuccauugaauuaucuuggcacccuugucaaaaaucaguugacuguaaaugcgagaguugauuucuaaacucccaguucuguuccauugaucuauauaucuaucuaaaugccagcaacacacuguguuaccguggcuuugucauaauuuuugaagucaggaaguauguccuccaccuuuguucuuuuucaagauugucuuggcuauuccauuuccuugaauuucuauaugaauuuuagaaucagcaaagaugccacauggaauuuugauagggaauuuauugaaucuguaggucaauuuagggaauauugccaucuuaacaauauuacaucuuccgauccaugaaugugggaugccuucauuuguuuaggucuucaguuuguuuaaauaguauuuuguaguuuuucacagugugaguuuuacacuucauuuguuaaauauauucguaaguauuuuauucuuuuuggugauuuuuuuaauggaacugauuucuuuuuuuuugagacagucucgcucuguugcccaugcuggggugcaguggcaccaucuuggcucacugcaagcuccgccucccggguucaccccauucuccggccucagccucccgaguagcugggacuacaggcgcccgccacugcacccaucuaauuuuuuuuuguauuuuuaguagagaugggguuuuaccauggucucgaucuccugaccucgugaucagcccgccucggccucccaaagugcugggauuacaggcgugagccaccgcgcccagcuggaacugcuuuccuaauuucauuuuuggauuguuuauugcaaaaguauacagaaauacaauugauuuuuguauauugaucuuguauccuugcugaacucauuauucuaaauuuuuuaguggauuucuuauguuuuucuguaagauuguuucaucuguaaacacauggguuuacuucuuguucaauguagaugucuuuuauuucauuuuauugccuaauucuuuugcuagaaacucgacaacauugaguacaaguggcaagagcagacauacuuuuuccugauuuuagagggaaagcccuccaacugcuuacuuuuugcuuccaagguauaaggccuuaguauaauuuuaaauauuuuauugauugauugauugauugauugaaacgcagucgcgcuguuacccaggcuggagugugguggcgugaucucagcucacugcaaccuccgccucccaaguucaagugauacuccugccucagccucccaaguagcugggauuacaggcaugugccaccacaccugacuaauuuuucuguuuuuagcagagacgggguuuuguccuguuggccaggcuggucucgagcuccuggccucagguaaucugcccgucucagccucccaaagugcugggauuacaggcgugagccaucgugccuggcuuaaauacuucacaauuauuucaugauuuuuuuucuguguucccaccaguuaaaucauuauauauuuuauucagauauaugauuuugcauuuuaaugauuuucaggauaaaagauuuuuguacuuggauagacuuuugugaaguauguugaugauaauccauuucugcucauggauuuggugggcuguuuuaaaauauuaaccagaaauacuuauauuucuuuauuacuuucaaaauagagaaguaaaaccaaaauacaauauuuugucaaccgcucugcagcauacugcgguacuuauuuugcauaaaacuguguacucuucaaagauaaaaugaacacagugacauaauuugcuuucuccuuuuuuuuucugagacagagucucgcucuguugcucaggcuggagugcagugguacaaucucagcucacugcaaccuccgcuucccagguucaagcaauucuccugccucagccucccaaguagcugggacugcaggugcucgccaccaugccaggcugauuuuuguauuuuauuuuauuuuauuguauuuauuuuauuuuauuuuauuuuauuuuauuuuauuuuaauuuuauuuuguauagagauggagucucgcccugucacccaggcuggagugcaguggcgcgaccuuggcucacugccaaccgcugcugccuggguucaagcgauuugcuugccucagccucccaaauagcugggacuacagacguaugccaccacgucuggcuaauuuuuuuguauuuuuaguagagaugggguuuccccauauuggccaggcuguucucaaacuccugaccucuaguaaucugcccgccuuggccucccaaagugcugggauuacaggggugagccaccgcaccuggccgauuuuuguauuuuuaguagugaugggguuucaccacguuggccaggcuggucucaaacuccugaccugaaacgauccacucaccuuggccucccaaagugcugcaguuaaggugucagccacugcacccggccaaaaaaagaaaacauuuuuguguugccuucauuuuuauuuauuuauuauuauuuuuaaauuuuuuauuuccauggguuuuuggggaacaggugguauuugguuacaugaguaaguucuuuaguggcgauuugugagauuuuggugcacccaucacccaaguaguagguaugaauccaguuuguagucuuuuaucccucacuuccuucccaccguuucccugacuccccagaguccacuguauuauucuuuuuuuuuuuuuuuugagacagagucucgcucugucacccaggcuggagugcaguggcgcaaucuuggcucacugcaagguccgccucccggguucaugccauucuccugccucagccuccugaguagcugggacuacaggcgcccgccaccaugccuggcuaauuuuuuguauuuuuaguagagaugggguuucaccguguuagccaugauggucucgaucuccugaccucaugauccacccgccucggccuccuaaagugcugggauuacaggcuugagcgaccacguauuguauuauucuuaugccuuugcauccucauagcuuagcucccacuuaugggugagugagaauauacaauguuugguuuuccauuccugaguuacuucacuuagaauaauaguuuccagucccaucuggguugcugcgaaugccauuaauucauuccuuuuuaugauugaguaguauuccauuguauauauauaucucccacaguuucuuuaucuacuuguugauugaugggcugaaugacuuuauauuuuaaaagugcucaaaucauugcauggcacagagugaggccucuagaaaguuguguuaaguaaacaaaagaaguccugaaucaaggcaguggcagugggaauagaggggagaagacagcaguauuugggagaucguuuagguuggaugauuagguggagggccagagggaggaggaaaagcaguggccauguuucuguuuugggugaaugguggugcuaugcauggagauggggaauaaagggagagaagcaggucccagcugaagauaaauuuaguugaggacauuauuaguuagaggcaccuuugggagauuugcaaugggauggauuuggcugcauguuggcugcauaaauauggaauucagagcuggucuggagaaacagacacaagauuuaggaaguaucgguauguacauaagugguacugggguuaaguaggugugaguuaguucgcacagugugagugugugguuccggaguuuugacuugggguucccaauaggcuuuaggggaaaaccccuaacauuggauacaaaguuuugugcauauguuuguuuuuucguauuuccguggaaaauauguguagcuuucauccacaaaagcauaaaaacaauuggcaugauuagugggagagcaccugcuuuguuuccuuggcacacauuuuggcuuauuuuaauaaaugagcaacuuguugcagguguugacaacuuccuucacuagcauauaagcucuguaagggcaggggucacaaggagagggaacugccauauagcgcguggcucacggugcguuuuccacaaauauuagaggaaugaauaauuacaagugaacuuuauauuuccacuaaaaauacaaauaaacuagaagguaaaacuuccugguauaaaaacaucucucgcacuguugcaugacuuuauaucuaagcuauuaaaacacuuagcgacaaauaauauugccuagagaaauacaguuauuuuauuauguuguaggucuauuuucaguuuggacuuaauuucuuuuuuuuugaaacggaauuuugcucuuggccaggcuggagugcaauggugcgaucucagcucacugcaaccucugccucccagguugaagugauucuccugucucagccucccuaguagcugggauuacaggugugcaccaccaugccuggcuauuuuuguauuuuuaaguagagacaggguuucuccauguuggucaggcuggucucgaacucccaaccucaggugauccacccgccuuggccucccaaagugcugggauuacaggugugagccacugcgcuuggcccaguuggacuuuauuucuguguucauuuaaguaguuuaaauuugauuuuuuuggcucagaagucaguuguaaaaagcuagcuucugggccgggcgcuguggcucaugccuguaauccuggcacuuugggagguggaucaugaggucaggaguuugagaccagccuggccaacauagugaaacccugucccuacuaaaaauacagaaaaauuagcuggguauggugaugggcaccuguaaucccagcuacuugggaggcugaggcaggacaacugcaugaaccugggaguuggagguugcagugagcugaaaucgccccacugcacuccagccugggcgacagugcaagacucugucucaagggaaaaaaaaaaaaaaguuagcuccuggaugaauaaaaaccauaaucggaguacauuagcccuggugaaaaugucaaaauucugaaauaaaccauuagaucaggcauaaacagucucaaaugcuuuaguuaucccaguuaugcagguaugaaaagaugcuuuuuaaacuuaaauuagauaauuauuuccauuugcuauuuuaauaugccuguguugauuuguauuuuuggaucagguaccuggaaacuucugugauagaguauuucauugaaugcguagucuaaagcucaaugauaguaaauauuaugacuucagaaucuuauucuucccucuugccacaacagcaguagaaaugggucuuuuugcugucaugggaguggccucucagguagacuuaacagauacuggggugaguaggggaaguaguuucuauucucuauuucuguucccucagugugcuuuauuucuucuguucuuucuuuucugugcucugcuuuguuuucuaaagauggauuaaagaaagauuaggaacagaaaguagaaugaaagcuucacaagaacagagaccuagccuguuuuguuuaucccaagcaucaaaaauaguucuugguccauaaaaggcucugaguaaauauuucuugaauggauaaaugaaugauugaaugaaaaaaguugaugcgggcucuuaaaauucuuccuagcuagaacuuguuacuguucaaaaguuuuucagaccacacuuauauuucacucaccaguguuuuccucagagaaguuuuugagacccaugcuagacuguuaaauuaguaacaucaauuauaaaucuagagauauuucugauuucuuuaaaaaaguuauuaguuugacuuaaaauaaauuuuaaagaagaggaaauguccuacuaaaagugaaaguauauuuuuguuuuuuguagccacaauguuuuaauaugagaguaacagaaaaucaauuauagaaacucaguuuuauuaacuuagcucagaaauaauauauaaucagcauuaauuuaauaccuucuuaaaauuucuuagguaaagucauagcacaaaguuaaucccaauuaaaagauucuuuuaauacauaaucuuuaaaaacaaaucuaccauuuauuuugguuuacauaaucaagaaccucucuuucugagugcaguugugaaggucaguggccugaggaauaaccguucauguguucaaugaauuuuuuuguuuuuaagacggaguuuugcacuuuuuccccaggcuggagugcaguggcgugaucuugguccacugcacccuccacuucccgggcucaagccguucuccugccucagccuccugaguagcugggauuacaggcacguaccaccaagcucggcuaauuuuuguauuuuuaguagagaugggguuuugccauguuggccaggccagucuggaacuccugaccucguaauccacccgccucggccucccaaagugcugggauuacaggugugagccaucacgcccugccuaccauuucuuuuagaaaugaaauuacugggcaaaggguauguaccuuuaaaauuuugguaaguguggcuagauugccuuccauaaagguuauaccaguguuuuuuuuuuuuuuuuuugaggugaagucucgcucugucaccaggcuggagugcaguggcaugaucucggcucacugcagccuccaccucccggguucaagcgguuuuccugccucagcuucccaaguagcugggacuacaggugugugccaccaugcccagcuaauuuuuguauuuuuaguagagaugggguuucaccaugucggccaggauggucucgaucucuugaccucgugauccacucaccucggccucccaaagugcugguauuacagggguuagccauugcgcccagccaagguuauaccaguuuucacuuuuaucagcaguauagugcgugagcaucuguuuccccacauccuugacagauaugggcauuaucagucuucuaaaacuuaggggaaaaugaucaaguuuuaacuuaucugcuuauuugugacaucuagcauuuuuuauguguguuggcuauuugcauuucuuuuauacuuugccuauuaggagcuuuuauuuauuuuuucuauugguuagguuaucuuuuauugauuuguaggaacccuuuuacaaguuuuguguguguguguguuuuaagauagguuauugcucuguugcccaggcuggaguacaguggugugauggucauggcucacugcagccucaaacucuuggcgcgcaagugccaccccagccuccugaguagcugggacuacaggcaugcaggcaugugucacuacacuaggcugauuuuuuuuuuuuuauuuguagagaugggggucucccuguguugcccuggcugguauuaaacucuugggcucaaaugauccucccgccuuggccucucaaaguguugggauuacaggugugagccaccacaccuggccuguuguguguguguguguguguguguguguguguguguguguauuuuuuuuuuuuuuuuugagaugagugucgcucugucgcccagacuggagugcaaaggggcauucuuggcuuacugcaacaucugccucccagguucaagcgauucuugugccucagcccccugaguagcuaggauuacaggugugcaccaccacacauggccaauuuuuguauuuuuaguggagaugggguuuugcuguauuggccaggcuggucucaaacugcuggucucaagcaguccaacugccucggccuccaaagugccgggauuacaggcgugagccacuguguccagccuguuguagauguuuuuaaguuaguugcuuuuuuuuuuuuuuuuuuuuuuuugagauaguuucacuauguuguccaggcugaacuugaacuccuggguucaagcaauccucuugucucagccugucugguaccugggacuguaggugugcaccacagugcccagcucuguugcuugcauuuuaacuuuguuuauggcacuuuuuguguaguaaaaucugccuuucuuuagggaugguuucuggccuugauguucugcuuugagggacuucuacuugccaagauugaaaaauaaauuuaaauauuuguuccuuucuccacucauaugcucaacaagaauuauucugugcaggcaagagaaguguuuagauucauuauuugggaguuagacuuguuuuucugcauuucaugaagucuuugaaggucuagaacacuggacagcaaauguuaauuggaacagucaggugaagucacgugcuauaaauuaaggacaaauugcugaccuuugccucuuagauguuuauaccucagauggcugcucacacuggagauaguucuaaaaaaguaugaguagaauggcuuccauucugaugaaaauuauuuucuaaaagcuuugauuuuuaguguauacugaguuagguuacgaugcugcaauuucuuuaacucuuacguugccaucagagugugggggaguuuaggggaguaggguaaaguaaugcaaagggaaagaaaggaggaugugaguggaaauaauuacguagggaggaaaugguguaacagugcuaaggaguggcagugcagauuuuuguacagacaaaaaccagacagaucaguguuaacaguggcucuguuuccugaauuacauuuuguuuucuuucucuucucaguuuuaagcauuuuugguccgaaaacagguugaaaaccaccacuugcuuuaaccagauuauuaauuuacaguuugguuauuuccauggcacacaugcacuaucacucugucuuuguguguauguguuuaaacaaucacuacuuuuuauuuuuaaaauguuuccaucuaugagcucacuuagaacagucaugauuguuugagugaagaaucacuguguaauuucaaaagugaaacugauacgaaacucauuugcuccagaagcaauaaaguaguugucagccucagacuugauucucuguaauuauaggaaagacugugguuuucuuuauuguucuucuccucuuuagcaucugauacagaugucucaguuucauagcugagacacccagucuguaagcaguaucuuuuaaacuuagacuuaauuaggauggauuuguaacuaggagauuuacaaaagaggauauaaagccagagaagucuuuaaucuuuuuuuuuaauuuuuuuuuuuuuuuuuuuuuuugagacagucucguucugucgcccaggcuggagugcagugguacaaucucgccacacugcaacuucugccucccagguucaagcgauucucgugcuccagucuucagagcagguggauuauaggcaugcaccaccgugccuggcuaauuuucauauuuuuaguagaaaugggauuucaccauguugaccaggcuggucuugaacuccuggccucaagugauccuuuugcauuggccuccuaaaguacugggauuauaggcaugagcuaccuuacuuggccuuaaaaaaauuauuuaacaugcuauguacuucaauuaucugcuuuguuuauuggcuuagccacaguuauuugugugugugugugugugugucacacuuauuugggauuuuugacauuguaagaguaugacaauuauugucaggaucuaggaaauaauugcuaacuuuucuuaacacuuuacaaaguacuuuuauaggcauuucucucaggcaauaaagagagguagguuguagggauaaaaagugauaaaaacuggugauuacaaccaucaaggauaggaagagggaaaaugauacaggugguucuuaaauccaguucuuuggaauucagauccuacauucucauuauuuuuucuucuuauacccuucucuauaagcagagauaaugauaaacagaguguuucaguaauaugaagggaugauaguucagaaaugaggugaggguaagauuuuuacugggccagaauugugguagaugcauaauuaauccacauaaagggucaguauuagucccacuuuacugaggagaaaacagauaaaguagcuugcccaagaucacacaguuaaaaagcacuagagcacagauuugaauuaaggcuucugauucuaaggucuguucccuuuccucuauaccacaguuucuuaaacuaaauuuuagagagguggggaagacuaugcaaagguuaggaaaagugagugauuuuaauuguaaauuacauuguaaauguuucagugugauuaauuugaauucugugguuuaacacggguaauuaaagagcauauuguaauaagcaucaaagguuuuuuuucuucaggauguugaaaaaucauauaaaggaaaacaauuugaagcuuuuuaguugccaggaaugauuaggguugugagaguuauucuuucauacuggaguauauguuccacagacaaggaucauauucuccaacuuugucuucuccccagcuaugccugggaugaugggauguguauguguaugugcauguaugaucaauaauaaguaacugccacuugccucuuuaauaacucugaugucauuagcaaaaauaucacuugcuuauuuuggccuguuuuuggccugauucugagaauuuauauuacucuuuauuagacaaauuauucuuuuuuuuuuuuuuuuuugagacggagucuugcuuugucauccaggcaggcuggagugcagugguguuaccugggcuuacugcaaccucugccuccuggguucaagcaauucuccugccucagacucccaaguagcuggaauuacaggcaccugccaccaugcccagcuaauuuuuuguauuuuuaguagaaacgggguuucaccauguuggccaggcuggucucgaacuccugaccucaagugauccacccaccucggccucccaaaguggagggauuacaggcgugagccaccgcgccuggccgacaaauuauucuuaacucagguaaaguuaucaguuaacuuuugcacaugaaaagaaagcuacuauauucguggaacuaucuugguauggaaaaauuacucaggguaacccaguguguacauaaagcugucccaucuuacaauugaaguuauaauuuuaugcgguuaauguuuauucgugaaucuccuguuuuuugcuuuuaggacauucggaaauucuuuggaguaauaccaaguggaaagaaacuuguaagugaaacaguaaagaagaaugagaaaacaaagucugaugaagaaacuuuaaaagcaaagaaaggaauaaaggaaaucaagguuaguuuucuggguauaauuuugcauugaaugaaauguaaaauaaacucaguucuuauaaguuuuuuuuuuuuuuuuuuuuuuuuuuuuuuuuccugagacagagucuugcucugucgcccaggcuguagugcaguggugcaaucucggcagacugcaagcuccgccuccuggguucaugccauucuccugccucagucucccgaguagcugggacuacaggcgcccgccaccacacccagcuaauuuuuucuauuuuuuaguagagacgggguuucaccguguuagccaggauggucucgaucuccugaccucgugaucugcccgccuuggccucccaaagugcugagauuacaggcgugagccaccgugccagccauucacuccauucuuuaugcccuaguugucauauauauuacaccuacauauguuaauacugcacaauucaauguaauuuuacuuuaaauagauguguauuuuuuaaaaaaauuaaggcaaaaauugcuguuuuuauuuuaugcacguauuugcuauuucugaugcuuuucauuucucacugaagaucugaguuuucgucuaauaucauuuucuuucaacuugaagaauuuuguuuagcauuuuuuguaguguaggucuguuggugauaaaccucuauaaguuuuuguuaaucugaaaaugucuuuauuuugccuucauucuugaagguuauuuuugcuggauauggaauuuuggguugacuguuuuuuaaaaaacuuaagccuuuuaaagauguuccacuguuuuuuggcuucuaguuuaucugaugagaugccuccagucauugauguuguuuucucauguguguuguuuuucucaugguucauuaaagaauuuuuuaauuuuugguuuucagcaguuugacuauggcuuaccugagugugguuuucuuuuguuuaucccauuuuugguuucugagcuucuuuaaucuguaaauuuauaucuuuuaucaaaauugggaacauuuugcuauaauuucuucaaauauuuuuucugccucauucucucucuucucuucuugaauuacaauuacauaaacguuggaguuuugauauugucucacggaucauugagccuuguucauuuuuaucagucuuuuuuucagauugaguacuuucucuuucugucuuuaaguucauugauucuucuuuuaucaccaauuuacuguuaaggcuaucuagugaauuuuuauuuuacauauuguauuuuuuaauucuagaauuuucauuuguuucuuuuuuguagcuuuaauuucugucuuuuauguccuugaguguaauuauaguagcugcuuuaguuuuuauuuugagauggaguuuugcucucauugcccagguuggagugcaauggcacgaucucggcucaccgcaaccucugccuccuggguucaagcaauucuccugccucagccucccaaguagcugggauuuuaggcaugagcccccaugcccggcuaauuuuguauuuuuaguagaguugggguuucuccauauuggccaggcuggucucaaacucccgaucucaggugaucuaccugccucggccuccugaagugcugggauuacaggugugagccaccgugcccggccuaguagcugcuuuaaaauucuuaucugcuaauucugacaucuguguuguaucaaaauuggucuucauuaaaugccuuuuguccugauucuuugggucauguguuaguucaggccaccaugacaaaauacuacaaaauagaugguacuggcugauuaggugucuggugagggccuuuuuccugcuuuguacauggcugccuucucguguuguccucacauagccucuucuuagugcauauggguggagagagagauugagcacugguggagaaagagagauagagauugaaugagcacucuggugucuguucuuauagaaugcuaauccugucagaucagagccccacccuuacgaccuuauuuauccuuaauuacuuguuuagagguuccaacuccaaauauagccacccugaggguuagggcuucaacgugugaauuuuggggacacagacauucaggauauaacauuccauccauggccacccagaauuuauguccuucuugcaugcaaaauacauucauuccaucauaacagcccccaaagucuuaacucauuucagcaucaagucugaaguccacagucucaugucaauaucauccaaaucagauaugggugauacuugagguaugaaucauccugagggaaaauuuucuuuugcugugaaccugugaaaccagauaaggaaugugcuucuaaaauaugauaguagaacagacauauaggauagacauuaccauuccaaagaggagaaaucagaagggagggaggggugauggaucccaaacaaguccaaaaccuagcaaggcaaauucaaucagaacauaagccuugaaaauaaacucuuuggcuugaugcccugcccucuagacccacuggguuaguggcccuacccccacagucacaggcagcuguccugcuucugcagcucugcugggccauccugcccacaaggcuuugggugguggcugucucaucuguugaaaccaagcuccaucuuuugaagagggaguucugaugguugaucucugaauugcuuuuggggccauucuucccuuuucuugaagaauagcuguguuguccugucacuggaaucucagaagucugacagccuucuuucauuuuguccuuucuccauccucuucaauucaaacugacaguguuuuugccuguauaaucccauaaucucuuuaucaagugauacuccagcuacaccguugcuauucucuuuagaacaugcuuuuucuuuucuuuucuuuucuuuucuuuucuuuucuuuucuuuucuuuucuuuucuuuuuugaaacagagucuugcucuguugcccagacuggagugcaguggcgcaaucucggcucacugcaaccucugccucccagguucaagugaaucuccugccucagccuccugaguagcugggacuauagucgcgugccaccauguccagcuaauuuuuuguauuuuuccuagagaugggguuuuaccauauuggccaagcuggucucaaacuccugaccugaagugauuggccugucucccacaaugcugggauuacaggcgugagccaccacaccuggccuagaacuugcuuuuucauuuucugaaauacggacaggcugagaauuuuacaaaucuucaaguucuggucccuuuuggcugaccgguuucuucauuaguucaucucuuccguuuugcauuugacuacaagcagucaggaggacucaggccgcaucuucaagauuuugcuuugaaaucuccucagcuaaauaucugauuucaucauucacagguuccaucuuucacaaagcacuaggacacaacuuggccaaguucugugccacuuuauaauaagaauugucuuucuuccaauuuccaauaaucucuuucucauuuccauguaaaaccuuaccagguuggccuuuaacauucauauuuauaccaacauucuguucaugaugauauauguauucucugagaugaaagaggcuucuucucuagcucuucucuucucuucaucagcucucauuguuauuacauuuaacguucauauuucuaccagcaguuccuucauggcagucuaggcuuuuucuacaugcuagaaaauaucuagccucuccccaguuccaaagucacuucuguauuuuagguuuuguuuuguuuuuguuuguuuguuuguuuuauaguaguaucccauuucuugguaccaaaaucuguauuauacagucagaguucuguagagaaacagaaccaauaggauguauguguguauacauagagagauuuauuaccaagaauugguagagcugauguuuuaguuggaguccaacggcaggaagaaagugucccagagauaucccagcucuaaggcagucgggcaggaggaauucccucucauucagcagaggguuggccuuuguucuuuccaggcuuucagcugauuagaugaggcuuaaugccauuagggagggcagucugcuuuacuuagucaauugauuuaaauauuaagcucauucaaaaacacccuuguagaaacaccuaauaugauguuugaccaaauaucuggacaucuugugguucagucagguucacauaugaaauuagccuccacaggucacauuuccucuuugcauguucuaguuauuuuggauuuaucuuggacauugugaacgauacaguguaggaacuuuggauccuguuauuccuucaaagaguguucuuuugguuuaucaggcauugaucuuggcuguacucaagcuccaaacucuugucuccccuguaaugggcagcagcugaaaucuuuauucaauucuuuuaaccuuagcuaagcuauaggaguuguuccacauauguauaauucaggagauagccagagauuuggguaaaguuuacaggcagaauuugggauuucuuucuguggcuuucuccuuuacuugauaccuucuucucuuacuuuugaggugugguugauucugacucuguccuugauccagugguauauauaaauuauaauugcucauuuguuccauuuucuugcaagcuaguugauuguucuuauguuuuugaaguuuuauuauaauggauagaaauaguuucuauuucuaccuuauaauugauuacaaucaguuuuuucacugccuucuugaugcuuucugagaaaauuugaauauguuagaaaugugauguuuaacuacaaaauauauaauaauaccuuuugcauugguuuuauuuaguacuuuuuuuuuuuuuuugagacggaauuuugcucuuguugcccaggcuggcaugcaauggcgcgaucuuggcuuacugcaaccucugccccccagguucaagcgauucuccugccucagccucccaaguagcugggauuacaggcauguaccaccacgccuggcuaauuuuguauuuuuaguagagacggaguuucuucauguuggucaggcuggucuugaacuccugacuucaggugaucugcccgccucggccucccaaaguguugggauuacaggcgugagccacugagccuggcugguucuauuuaguuuccuaacaggcauuggcuagugguaggccacuagcuuagcauuuauuccuguuucugucguuucauuuucaggaagcacuugccuuguaauaucugauauccuuuuauucuuuguuguauacauagguuaguguugaaaauggagcugaauaauaauauagcguuuucuguaauuauuuuuuucccauugugguacaguuacugucuggccuauuuuuagccaauaaggguauauuacugacaguuuagucuggagaauucuuuguuguggaggacuguccugugcauuguaggauguuuaguagcaucccugaucuaccuguuacaugacaguaaaccucccuacccccauuugugauaaguaaaaauguuucuagacauugacaaaugccuucuggggggcggggaugcaaaauucccccugguuaaaacgacugagcccaaaucuaacgagaaaaaaggauagccccgucucuacuaaaaauacaaaaaauuagccaggcauuguggcggguuucuguggucccagcuacucagaaggcugaggcaggagaauggcgugaaccugggaggcggagcuugcagugagccgagaucgugccacugcgcuccagccuggaugacagagugagacuccgucucaaaaaaaaaaaagauaguuauauaggcuucuuuauguucuaauuauauugugauguuuauagguaaauagcucccguaaagaggaugacuucaaacaaaagcaaccaagcaagaaaaagaggaucaucuaugauucagguaauaauuucuucugaggagcuuuaaaauuuuaaaguuauuguauaucccuuagaacagugcuuuaaacuauguucuaaggaugggugcgguggcucaugccuguaaucgcaaucgcagcacuuugggaggcaaaggcaggcagaugacuugaggucaggaguucgagaccagccuggccaacauggugaaaccccuucucuguuaaaaauacaaaaauuagcugggcgugguggcacgcgccugcaaucccagcuacucaggaggcugagauaugagaauugcuugaaucccagaggcagagguugcagugagccaagaucgccacugcacuccaaucuggguagugagacuuugucucaagaaaaaacaaaaaaauuauaaauaaauaaaucaacuauguucugagauacguagcucucugagauguuaauaaguccugugagaagagggcuguaugcucaaguaaaauuucaaacaauuuuauuauagaacuuaucagaaccaaaauauguuuguauuaaagauuccuucagaaagugauauaguaugcagcauuugucaaacuuauuuugaaugugauauauguguuuuuauuuaauuuaauuaauuuauuuagagacagucuugcccuguugcccagguuggagugcaguggugcgaucugggcucacugcaaccucuaccucccagguucaagcgauucuugcgcuuuggccaccuguagcuggaaccacaggcgugcagcaccacaucuagcuaauuuuuauaauuuuaguagagaugaaauuuuauaauuuuaguagagaugggguuucaccacguagacaaggcuggucucaaacuccuggccucaaacaauucgccuuccucggccucucaaagucuugggauuacaggcaugagccucuggcccuauuauuuuuuaaaauacuuguauuaauuucuuuuccaguugagguuguuggaaguuaaauuugaaaaauagugccuuagaauacuguuuuuaaagcaaagaucuaaaauuuaauuuuugugcuuuauugaaagaucuggcuuuuuuggguugcauuuaaaaaggaauaaacacaauuuaaaggcuuuucuuugaacauaauuuuaaaauagggaacaugaauuuuuuugcaugccuuuuaugaugcacaaaaugaugguaaaaugguagaauucagaaaguuucaguuuuugcuuuuguggacaagaucugcuguauuaauucucucuuucuguuuuauuuuuaucuggugugaauuuuuuuuuuuuuuugagacggaauuuugcucugucacccaggcuggagugcaauggcaugaucuugggucaguguaaccucugucuccuggguucaagcgauucuccugccucagccucccagguagcugggauuacaggugcccaccaccaugcccagcuaauuuuuguagcuuuuaguagaaaagggguuucaccauguuggccaggcuggucucgaacuccugaccucaggugauuuugccugccucggccucccaaagugucgggauuacaggcaugagccaccacacccggccuucuggugugaauucuuaaaauaaaaaaugugccuaaagaaggauugucaaaauuuucacaguacuaucaaagguucugaauucugaaaguacuuaaguguuuacucugugccuuuuauugcucuauauuguaaagaauuugaaagaaguacgcguuccucuuccucaggaguuuuguuuguugggaaacuggacauuuguuugauacaguuuacuacagugugacaggauuuauaaaugcauggugcaggggaagaggaaggacacuaaaguuuaugaaacaucuauuuuguaccaggcacugugccagguacucacacuuuguucugauuuauauuuaagugcccugggagauuaggcugugguagacagaauaaugcccccaaaagauauccacagccuaauuccuagaaccugugacuauauuagguuauauggcaaagggaaguaaaaguuacagaugguguuaagauggcuaaucagaugaccuuaaaaauagggagauuaggccaggcgugguggcucuugccuguaaucccagcacuuuuggaggcugaggugggcggaucacuugaggucaggauuuccagaccagccuggccaacauaguaaaacccugucucuacuaaaaauacaaaaauuaucugggcgugguggcacgcgccuguagucccagcuacucaggagucugaggcaggagaaucgcuugaaccuggaaggcagagguugcagugagcugagaucacgccacugcacuccacaacagagcgagacuccgucucaaaaaagaaaaaaaaauagggagauuauccuggauuauuuggaugggcucaguguagucacaaggaauagggagguagaaaaaggguuuagagagugagauuaacuguggaggaagauuagaggauccgggagauggcaacgugagggcuuucgcuugauguugcuggcuuugaagaugcaggaagggucuuugagccaagaaugcuggcauccacuggagacuggaaaaggcaaauaaaauucuuucuuagaguauucagaaaggaacauagcccugcugguaccuugacuggcccagugagacccauauuugccaucuaucuaaccuccagaacuggaagauaauaaauuuaguggcuuaguuguuuuaagccacuaaguuuguggucauuuauuauagcuggaauaggaaacuaauacauaggcuuagcacugaguaaaaguaaccugugagaauucacagaagacaugugccuugaaaaagaccuugaggaauugguucaccgugacuacuuuaaacaugcacuauauuauaauaguucuuuucaaaguuuuguuuuauuuuucucucacauacagauucagagucagaggagacguugcagguaaaaaaugccaaaaagccaccagaaaaacugccaguaucuucuaaaccugguaaaauuucacggcaggauccuguuacauacauuucagaaacagguaagguugcauugugguauaugagaugccguguguguuauguucuugaguuuuuuguuggugucuaaauguaccuccuucacuuugaauggaauuucuacugccuuuuugcuuuguugaguuauauuugucagggaaggcugggaucaucuuuugcauuuccaguagauuaaggaccaauuacagggaaauugcucuuggaauuuuuuuuaagugcuuguauugaaucauauaaguugaagcuuaaucuugaaucacauauuaaaauaguauuggguuguuuuagaacuacuuuuuuaaugcaagcuuuuuaucuggcaggccaaagucaauaaucuaaguguagagugauuacucauauuugugauuuauaauuuagcacggauguugaauuccuuguauucucuggugacacuacaaauuuaaguauuggguuuuuuaaagaagauuguuuuguacuuaaauuuaguucuguuacaucuguuuuaagaguaaugaaagugcaaaggacauuuauaaauaauuaugugcuaaucucaaauauuuuguuguguaaguaauuguuucauggauauuguucuuuuauguaaggaucccagaguuauauugucauccuaggagaaaaacucagauaaguuaguggugaagucauuuugauuguaauguuguuaacccuuagaggagacaauaaccggaauaauacgggaugcuguacgugaaagggccagacccagugccugacacauugaguagcaguccaaaggaaaaaauaaaaagaaaaacaaaguccauaggugaacuuuguagguuacgugaaacauuuguugaugaaacuguucaaaauaucaaagacaaaaaguaagugaugugaacauauuuuuuggaaaauuuuuaccaaacagacguuucuuuguuaugggcagguggcugauugacucuuaaccuuuuugugcuguugcuaaauaucugcccaggcacacuguguaaacgaacucuuaaauuaagaggcucuccucuuagcucuggcuaccuuugugaaguuuugaauacgugggaggggagaguaagaacaguauagugauagguuuauuauguaacugaagguggugugauagggcuuuccagugacacccugaaaaacgucaaaguuagugugcagccagccauggccuucaacuguggaucagggcuguuguuaucuugugauuuuaaguaaacaaaaaggucagacaauuuaagcucugaucacagauuuucuuucacaugggacuaguuauuucagacaagcaauuuuuuucuuucuguauccagucauccauuaagaugagcaguuuuugaauguuguuuugugaagagauguccagcuuuuuaucuggacuuuuuaugaacguuaggcaguauuugugucauuugcugguagcauauacaugugaaaguaaacauuguccucauguuuuagcuaaaaaucuugggguaugauguaccugucucagaugguguucaguauuaugcauuauucuauuuuuuucuuagaauugagauguagggaagaagcuugcuuuauuauugccuguuuuaucuuuucauacuuuauuguuugaaaugauaggugaaugggaggaagauaagcccuuuccuucauacaagagaaugagacuauuaaaaaaagcccacaauaagauuggcauaauaaaaucacaaauguaagaguuucaaaaaagaaaagugcagcuuuuucaaauuaauauaguacuggaaaauccuugacguuaaaguaaugcuuucauuacucuuuacguuaggcuaaaaccauacuuuucaauauugggucauaaauauuuuuguuuuauauuaccaguauaagguuaaauaaaauguguguguguguauaauagaauugggcaauaccucauuccauaaaacagaauaaguguucccaauauuuguguaauaguuuaaaaauucuaaucuaaaacuguauugauugucuggagauuggagcuucuugugaaaaagugucauaugacaugauucaguuuuaaaaaaccuguuaauuccaaaagauagaauuuuuucuucauuauugcauacuuuaucuuuuccuaucuucuguauucugacuuuaaaaacaaccuuugguucuauuggcauuuuucuugcggcauagcauguauacuguuuaaaagcauggccuuguuuacuuaacuuuccuuguguuuuaguuuacuuauauguaaaauggagacaucgcuaguaccugcaucagcagccuuugugauaaucaaaugagauaaugcuugaaaagcauuuaaaauagggucugacuuagggucuaaaauaguaaaugcucaauaaauauuaacuguuauucuuauauuuugacuuucuuauaagccuacaucugccuuuaaagacauuuuguauuuguuuaguuacuuagggcuuucuguugauuuuguaauugagcuuuagaaauuuggaaaugauauuuggcccacuuauguuauggauuuguguggucucguaugggaacuacuaguuauuuguggcuauggagcgcuugaaaugugcuuuuagccugaauugagaaugcuguaaaugugaaauacacacagauuugacacagcaaaggaaacagucaacaaaaugaaaugacaaccuacagauugggaaaaaauuugcaaaucauauauuugauaaggggaugauaucuacaauguaugaauaauucauacaauucaauagaaaaacaaacaaucaaauuuaaaaaugggugaaggaccugaauagacauuucuccagagaaugcauaaaaguggccaacagguauaugaaaaagugcuuaauaucauuaauccuuagggaaaugcaaaccgaaaccagugugcgauaacaccucacucguuaggauggcuauuaucaaagaguaaagggauaacaaacguuauucagggugugcagaaaagggaaccuauacaccauuggugggaauguagauuggugcagccauuuuggaaaacagcauggaggagcccaaugaaauuaaaaauaaaaccaccauaugacccagcagucucucuucugggcauauaccuaaaggaaaugaaaucaccaccucagaaaguuaugugcaaucccauauucauugcagcauuaugcacaauagccaagauauggaaacaacuuaagugucacaugguggauggaugaaggaauugcgguauauguaauaauggaauauuauuuggcuuuaaaaaaaaaaggagauucugucauuugccacagcaugugugaacccggcggacauuauguuaagugaaaugucaggcacagaaagaagaauauugcaugaucucacuuauaaugcggacucuuaaaaaagaagucaauagagaaugcaacagugguugcaggggcauuggggaggacauggggagauauugauuagagguuacaaaguagcagauacaugggaugaacaaguccagagaucuaauguauaacaugaggacuauaguuaauaaaguuguacuguauuugggauuccugcuaaauuaguacauuuuaguugcucuugccacaaaaauaaaaugaguaacuaugugagaugauggauauguuaauuugcuucacuauaguaauuauuuuacuaucuguguauccccugacaucauguuguauacuuuagauauauacaauaaaauuuauuuuaacaacaccgauuucaaagacuuccuacacaaaaaagguaaacuaccuuguuaauuuuuuauuauugaucccauuuugaaaugcuaauaauuuggaucuauuggguuagauaaaauauacaguuaaaauuaauuucacuuguuucuuucuacuuuuaaaaauguggcugugagaaaauuugaaauuuuauauguggcuugcauuuuacuucuauugcauagugcuuuauaaacaaugaaaaacagauuuaggaaaaauguagguuucaaguauuuuugcuuauauuauuauacagcuagcuuuuuagauuauuguuauacagauuuuuaggcuuuccguuucacuccaugagaaauauuuuucaucaucacuuugauuagaucugucuucuacuaggauuuauugauuuuuaaaaacuaauuuaaccacauuaauuucccaaguuacaggaaaaggaaagaacugcuuauaaauaucuuuauagccaacuauugacucuaguaaaauguucuucaagguugguaaaaacccaaauacuuguuguacuggguaaauauauuuacuuuuagcuguuuaaugaagugagagaccuugagucuuguuuggcgaagauugaccuuuuauuacgguuucaucagggccuguuguuugaucgaaaaugguggggguuuuuccugucuugaauuguuugacugguaauuuuaauugugcauauaauucuggaggcaguuaguacuccugaaguuaaaauuauuugaggaguguuuaaaugggaaaaaaauuggcgauguuguguucucuaggugacagguuaccauguaauaagagugacuugugacuuuggaaaauaguagcagaaaauauucuuggggauguguguaacauucucuuugcuaacuuuuagagacauauagucuuguguaucagacaaauagguauauauucuguauaugauagagagcuucucuuagauguuugcagggaaaccuagagugauaaagguagaaaauuuccuucaagugaguauuguauuuuuuugauuauacuuguuaaaaaaucaauaauuuguacacuaaaauucuguauaaaagaaacuaaauuuagaauuuuugaagaugagagauuuaaauuaauaauuuuaaauuaccuaaguaaauguuacacacacacacacacacacacacacacacacacacacuuauuugaguagcaucuuauuguaaaauuucuacagcuugcuuuuucuuuuuuuuuuuuuugagacggaguuucgcucuuguugccuaggcuggagugcaauggugcgaucuugggucaccgcaaccuccgccucccagguucaagcgagucuccugccucagccuucugaguagcugagauuacaggcgugcaccgccaugccuggcuaauuuuguauuuuuaguagagacaggcuuucuccauguuggucaggcuggucucgaacucccgaccucaggugauccgccugccucggccucccaaagugcugggauuauaggcgugagccacugcaccuggccuacagcuugcuuuuucauaacuuaauggcuuaacccucccuucuuccuucccgcccaguagaagaaucuagaucuuuggaugucucucauacacuuauuuuuucaugucaucuaguuuuauaucuucuauaaauuugauagauuuaucuuuguguuccuuccugaaucauuauuaaaauuguuuagcauuaagggacaaauaaaguuuuuuucaaaauuugcuuugaaucaucaucagcacccuggauauagcuguuuaguuucuuaugaauaacugucuaauuacuuaugaaucuuaguaaugacuauuguuuuguauuucucuaucuugccauaaaucaguguuucucaaccaagggugauauugccuucugaggggccuuuggcaauaucuggagacauuuuugguugucacaacuaggggaugcuacggcauguaaguggcagaggccaggcaugccacuaagcaucccgcaaugcacaggacagagaguuacucggcuucaaaugucaguaacguggagguuagaaacccugccucuuaucagaagagaauuugguggauacuuuaaguccagauaucauuuuuaguauucauuucaccuacuagucugauaacucacagaauaaaugaaggcuuaggccuugguuuaugcuuagugagcccuugucuacuucaguugagugccauaugcugcuccugaccaguucaugauguuacuguauagcauugucacuaaaccugucuucuguaguucugugguguggaucugccuuucucuuuuuuugacaauuaggacuucauuucuuuaaucuucaggggcuucuauuuuauaugaugauucaaaggucacugauagugcuuuagcaauuuuaucugcaaaugcacauauuuaugagagcuagaugcuuucuuauaaucuuuuuugguaauuuguucuucaauucucuuuuauuaguguguauuaugggaccugaaaaaaauuaaguggcauauggagaggaaggagauuugaaaagggcacaguaaauaaugagacacuaagauacugagguuccgaagcaucuuugaaaaugaacagacuguucuggugacagguacuuuacugucaggcacuugugaaacugugagagacauaggacuguauuccugaaugccaaggaaguaggauuaugugaugaaaauaucauuaaguacuaauacaauacaauauauaauaauaaaauaauauacaaaaugacuuauacuuggcuuucguacugagaccagcacuguucucuccucuuguguggggaagauguaugugaauggcaguggggaaauugcaucgauugcagaaucacucccuuaacucuguggucaggcagauuuccuuauauugcccguuuuaugccuuagaauuguaagaagcuuuggguaauguaccuguggccaacugcccaggccuuucccccacuuuuucuuauuuaggcauuccaguggacucgguaccugugugguggauaacaucacauuucaagccaguacuuuuuucucuuauuuaucauuacucagcuaccucacuagaccccacgaauuauaaaauaagguuuauuuuaaaaauauaacugacucuguuugauucuaagaggauucauuuguagugaaucaugagaucucugguuucuugauugaagaugagcagucuuagggguuuuauuuuaugcugauauguauagaaugucugauuuaccacauaaaugggcaaaagugcuauguuuaguuucucuuccauccacuuaauuuaaccaguauuuauugaaggcuuggcacauacaugaaccuuuuucugucucugaaaccaaaaugaugguuuagauuuuugacucaaggaaauauugaaaagaaacuuuauagaaaaaggcuuuaaacaccuugauuccuuuuuuaguuuuuguugcuaaauaaauuauuuuaauccccguaacuggaucucuucauuaauuugcuuuuuguguauucuagaccaaagaaaauaaaaucacagaauuagaauucagagaucuguuuggaaaggccagauucucagcaguaugaauuccagaauuagacuuuuuuccuuuuugccuuuuaaauagauuuuuauauggacccccacauuuuuuauuucucuuuuguuauucuucuaaauaaaugaauguaucuaacacagaguguuaaagcaaucuucucucccaggcaauuccucugcuguguguaggauaaugugauaaugcuaguuugcuugguuguucguaccacauuugagguuauguugccuauaaauaaaaauaaaugguguuuuuacaagaagacagauauccuagagggaaaaucuaaguguucaauuguucaugauuuucaaccaguucuccucaauuugacuuagaucuguuuaucauuauuuuauuguaaguuucuggggagaagagaacauaguuugccuuuggcuuccuaugaggcggaauccaauuuaagcuuauuagaaaacaagaacaaauguuaaaaaagaacaacuacaacuuuauuuggaauguuucaucucuacacacuguguaggauuguaaaauauuuauuuuacaugaggauccucacagcaacaccuguuaagucacugucuguuggaagcagcuaguugucuucuuggccuguuuugucuucuuuccauaauauauugguauagccuuuaaaauguuaagggcaaaggaacuuuaagacaacuaguucagaagucauaguagagaaacaguaggacugcucguucuucaaguuuucugguuucaucaaggcaagaugacaguguuuucagauaugccuguggcuuauaggguaccauauuuauuuauaaaauaaauaugaaaucccuuauauuugugagaaauaucucaaugcuuaggaucaugaauuugcuuuuuuuaauguuauucucauaacuguaaggaguauggggaaauuggcaaaucagggggcacuaaauagguauuaaagcaagagagccaguccuugagaauuacccucccuuuuucuuuucauaacuguguuuuacuagaguuacucguaccuuccuaggggccuagagagcuguuuauuuuguaguuaacagagaaaaggagccuuauuugcacuuuuuguuuaacacaaugaaaacauacuugaaguaucuuauagaacacucccauauuuuuucuuuggagagccauguguaauuaaauuuuucucagaaauuauaaaaauguuuauaaaauuaugccuguguuuagcuauaguacauuuuuuaaaucuauagcuugaagacauuguucaauuuaaauucauguauucagagaagggcucuguuacccuccacuauuguaaagagaucucugguagaggaggcucauaacaagaaccuccccuuuuaggggugauguuuauaccuauaacauuagggugcacauaaaagaacagagugauguauuuuguuuuuuugacagccguuuugcuauuuucaugagguuuuuuuuuuucagccucgaaauuugggcuuaauuuuugauggcuucaugaguccauuguauaguuagaccauaauuuauauaaaaauuuccccgauuucagcauuucaguugcuuauacuuuucauguuccuaauagugugaugacuagacuaaauuuauaugcaaauauuugucaucaccucugauuaucuccaagaguuacuaugcuaaaggauaugaacuucuuuaagguucugguguguucuaccaaauuacuuucuagaaaagucacacuaauuuacacuuuuauaauuaguguuuuuauuaguacaaacucaucacauuuuuaccaauauuguguauaauauuaaaaaaaucuauauggcuacccauagggucauaaaauuguaaaggggaaaaucuuaagaguucguuugguccaacauuuuacagaagaucgcagugaaacccagaugguuaauuaaaaauaguaagucaaacuuagguuagaauuuuaguuuucuagacuucugguucagcacuguuuuucccagagaauacuacuuuuauuuauugaauggcuguaacauggcuaggugcuacacugggcacuuagccucuaaaauuuugucuuauuguauuuguagagauggggucuugcucuuuugcccaggcuggucuugaacuccugggcucaagugauccuuccgucuuggccucccaaagugcugggauuauaggcgugggccaccauguccggcccuucaagaaaaauuuaaucuucccaguaaccuaaauguugauuggcuugaaacuguuuuacuauuuauagagaaggggacguaaggaagaaauaagggcagacuucagaggcugaauguggaaaaaguagauaaacuuuuucucccuguucagcggauagauuaaggaaaguagguggaauucacagggaaguauuuugacuuaauauaaggaaaaacuuuccuaaggaguauaguauuuugcuauuugcuaaagaaagaaggugaauuaacauugcucgauuuugaaaguauuuaagucuagucuauuuuuuuguuagaaauguagaaaauggggucuauguauugaauaaggagguaggacuaguugacuaaagauaauuuauuauaaaguucuuggcauguaguuuaaugcucaauaaaaacuuauuaauaguaaauaaaaagauaccaugaagucugugaagccagcaacagaauagcagaggugcugauaaauaaugaacagaaguaagcaaagaagaguggagaggagguagaaacuaaagcacugacucugaaagcuaaggggucagagaguucuaggauguauucaauuuguuguaaaacauuagacggagaaaaggguguauuaguccgauuucaugcugcuaauaaagacauacccaaaacugggcaauuuauaaaagaaagagguuuauuggacuuacaguuccacauggcuggggaccucacaaucaugguggaaggugaaaggcacgucucaagugucggcagacaagagaagagagcuugugcagggaaacugcccuuuauagaaccaucagaucucaugagaguuauucacuaucacgagaacagcgcaggaaagaccuguccccaugauucauucaccuuucucuggaucccucccauaaugugggaauucaggaugagauuuggguuaagggcacagccaagccauaucaaaaggugugaaaaaaacauaaaaauuacccauauuucccuaaucagagauaaaaauuguuaauguuuuauugauucuuuucagauuuuagaaugugaauuuaaaaguuauguauauagcuauagauaaacagugucauuaaacauacuguuaugucaucugcuuuugccaccuaguaaacauaugaauauauuucuaugagcaaauauagauauuuuuuauaauuuuuauugcuguagagauuuuguuacaugguugaguauacauauuaauagauauuuagguuauuuuuuuucccauauuauacacaauacucacaucucucuguuuguacugccauuguuaugguuguugaggccaucuuugccuacguggucauuuacuuuuugucuuccccuuuucuugcccuguuacaaucugcucuccauaguaguugaucucacccacucagcuaugggguuuucugucauacugcuuauaagcacggcuaaguguaguggaaauggaauguuaguauuuuaggcauuuuuaaggugguaggaaacuaguagagcaccaucauuucagagacaauuuaaguuuguucuuucuccauuaagggacucccucuugcccagaaguacaauuguugaacuuaaagcaaauaaacauuauaaaauuuaauaagauaagaaauuuaacauauacuggguauagcuggucagcugucaaguauuaaaaaaauuugaguuucuauaauaccaugaucauuguguaauuauuuuagagaaaaggaaaggacuuugagauuauauucucaaugguuaguuacuaggacuauuaugggugauccacguggcuguuauaaauggaauggugauguuaccuagccuuuugcaaagccuuuuucccgucuggcaaagaggcagagaagaaccaguaguuagguagggagaauauauauauauguguguguguguguguauauauauauaugaaugacugaaccuagucuguugacucuuuguaacgugguugaacugaaaucuguuaauuguaucaggccuuggaugugcuuuagaaagaguuauggauaaauuuuuaauuaaagcuugacgguagauugacuauaguugaagagaagugaaacaaguauguuuuaauuuaacucuuucgguugcaaacacuuuaguguaagcaaaauggggaaauuuauuaggagccugcuaacuuaucucauugaauguagaaauaaaccuuuugcaccuugguuuguacauacugguugagcaaaucaaggauaaaguuggccccaccuugcugaagugcucacuccuggucuagcugauuguggucaagaguguggagccaucuaauggauauaucugugguuuuuggaggcccuuggagggaggggugagcuguaaauuauuagagaaaaugugcuuguagugaagggcacuggcauccucagagauuucuacuacaugcuugcuuuaaauaguggguuacuuuuuacauuuaguaaucagaaaccuguaagagugaaguguugcaaaauuuauaguuucauuuuaauauaaauauaauaauuagaagguaaggcugaauccuuuugauuuuuacauaucauuagauacuuucauguuugaaauggcagccaccuaaggauaacacagugccugggacguaaggccuuuagcaaauguucauaguugaaugagggagcaguugagaggacauaggagccacucauauguggcuuugcauaccaaauugauacagugaaccgucccccauccccaccaagaccuagucuucaugguugucuuuuauuuaaaaaaaaauuuuuuuuuugagagggagucucacucugucgcccaggcuggagugcaguggugcaaucucagcucacugugaccuccgccucccaguucaagugauucuccugccucagcugcccaaauagcugggauuacaggcauacuccaccacgcccagcuaauuuuuauguuuuuaguagagacgggcucucaccauguuguccaagcuggucuugaacuccugaccucaaaugauccgcccaucucggccucccggagugcugggauugcaggugugagccacugcaccuggccuauuuucaauuguauuaaaaaaguuuuuuuuagagacagguuggagugcagugguacaaucgaggcuuacugcagccuccauuucuugggcucaagcgauccuccuacugccuuagccuccugaguagcuggggcuacaggccugcaccaccaugcccagcuuaauuuuucuuuuucuuuuuuuuuuuugagacagagucuugcucugucucccaggcuggaguacagaggcacaauuucagcucacugcacccucugccucugccuccggaguagcugggacuacaggcgcgcaccgcuacgcccggcuaaguuuuguaauuuuaguagagaugggguuucaccauguugaccaggcuggucuugaacuccugaccugaagugaucugccugccuccccagcuaauuuuuuuugguagagauggagucucauuauguugcccaggcugaucuugaauucccaggcucaagcaauccuccgccucagccucccaaaguacugggaugacaggugugugcuaccgugcccggccucauguuugucucuuagauuuucauuuuuauuggauuucuuuuguuuauaggccaaaucgaaaagcuuuuuuuuuuuuuuuuuuuuuuuuuugugagucacugaagcaaacaaauuuauugaggcccuuuugagguacauuuuuggagcuccuaauuaucuaaacguugucaugaaugcuuaaaaagacauuuaaagccagauguuuuguggaaacuuuuuagaaaaauaaaauguaacaaagaauuuauggucuuaaaugaaugguuagauaucaguagaugguucaccugcaauauauagcuagaaccugacaacuuacuaccucugcaaauaccaccacaguccaagccuuccguaucucaucugaaacugcaguagcuuucuaaguggucucccugcauucacuuuccccgcucugcaguguguuuuccaaaugacaggccuuaaguugggucacaaacuauucucagaauucuccaguggauucccguucuauaauaaagacuaaaauuauuccuauugccuagaaaguccuccaggauuuggccccuaccucuuucacccgaacucuucuggcacgccuccgcauugugcugcagccacauugaacuccaggcacacuuccgucucggcuuuuccauuuguaguuuuaauugcccagauauucuugccugagguaucuucauuucaggccuccguuaaaauguuguuuaucaaagaggcauucccucacuaccuuaucucaaagaguacccuucaucacucuuuaauucuuucacccuguuuuacuuuuuauucauagaacauuuaacuugacaguguauauuuguuuauuuguauaucuguuuccucuucuagacuuuaaguuccaugagggcagggauuuugucuuuuuuauucacugcuguaucuuaaguuccugguacauaaugagugcucaguaaauauuuguguacucuugguaguaacugggggauauagcguauuacaggccuggcacugguaaauguggggaugaugguugaauuuuggagauagggggaaaaaguuauuagcaucucuaaguucuuggauguuuauuuuguuuuugagacagggucuuuguuguucagacuggagugcaguggugcaaucacagcuaacugcagccucaaccuccuggguuuauauccucuugccucagccucccuaguagcugggacuacagguguguaccaccaugccuggcuaauuuuuuguuaauuuuuuugaagagaaggaguuucaugauguugcccagacuggucucgaacuccugagcgcaaaugauucuccuaucuuggucuccaaaagugcugggauuacaagcaugagccaccaugucuagccucuuguauacuuuuuauaaaguugguagaaguguuuucuuuguauaaccgaauugauguuuuauaaaaaauauuugguuacauuucauuuaagaugaagaagaugacuuuauguguaagaaggcggccucuaaaucaaaagagaauggaagaucuacaaauagucaucuuggaacaucaaacaugaaaaagaaugaagaaaacacuaagaccaagaauaagccuuuaucaccaauaaaacuuacacccacaucaguacuugauuauuuuggaacuggaaguguccaaagaucuaauaagaagaugguggcaagcaaaagaaaagagguaaguguucuacauauaagcaaguaugcucaggauuuauacccauucacuaauauuaacaggagaaacuaggauguaguaaauaggcaacauguuuuaauaauuaaaauaauuuuccuaugauuauggauaaaauguauugcccucauuuuaaaggaugaggaaguuggaauguuacauauuuaauuuuuuaauucuugaaagcgggaaaagaucauuuaagccauaagaaaaaaugauaauuauucgaauuuaaauugaguucucagaauggaaacucauuuuacuauugaccucaaccagucaauauuagcgauaaauuuguuuccaaaugagauaauaaauagauuccuuauaaauagagcauaccuaugcuacacuugugaccuucucuacuuuggcagauauuggauucaucuguuucuggccauuuaggaaacagacauaccagauaaauuauggugaaaguaguccccugaguuaaagaaagccugccccauaguguguguuuguugauucuaucacuuccuccauagaacaauguaaucauucucacauauugguuugccaauguucugggcuacuugucaagccaagacauuaaucuacaggauuggguuuuuuuauuuuuauuuuugguacuucucuugaacauaucaauagaacuaagugagacaggucugucuauaggauauuuauuagggauuggauauggucagggaguagccauaaauuugacuuucuggcugguguacauugcagcuguuacugauagauacacuuaucucucacugguguauuuaaucagcaacagucaagaaaaagugccuuauuuuuaacuuaagguuuaugcugauuuugcuugauuuucuuugaaauauagcuuucacaaaauacagaugagucuggauuaaaugaugaagccaucgccaagcaauuacagcuugaugaagaugcggagguauuggcauuuugcuuagaaucauuaguaacuugauauucugacuagcuauuuaguccagccagguuuugaauugaaccucauuggaaguuacauguaaaauaaguuaaaaucuaauaaaugaaaaucuaaauuucuauacaagauaaaugaugagaccaggggagaauuauuuacugaaagauuuauuuuuagagaagauugaucaagugcugugagaugauuuugaagaaauggcuagcagcaaauccuguaggucaugauaggucuuugauaccuacaaaaaggauguuaauuauaaggacuuuggaauuuaguuucuuccaaaugggaaaccauuggaguuuuuauuuuuuauuuuuugagacagagucucgcuuuguugcccaggcuggagugcaguggcauaaucuggcuaauugcaaccuccaccuccugggaaucaagugauucuccugccucaccugccccaguaacugagacuacaggcgcccaccacuacgccuggcuaauuuauguauuuuuaguagagacggaguuucaccauguuggccaggcuggucuugaccuuggccucccaaauuguugggauuacaggugugagccaccacacccagccccauuggaguuuugaauagaaaagugacaugacuugguggaucuuaaaagaaaauuacuuuggcuucgaugauguuaauaguucauggugggggcaagaucaaaagcagaucaguuugcagacugaaugguaggugagagaugucagcuuguaauaggaaaaggcagugagaagugggcauaaucugaaugugccuugaaacaugcaaguucuuuuugacagauuggauguaaggugugagggaagaagauucacagaugaggcugggugugguggcucaugccuguaaucccagcacuuugggaggccgaggugagaggaucacuugugccugggaguuugagaccagucuggguaacauagggaaaucccaucucuaccaaaaauacaaaaaucaacugggcaugguggugcacaccuguggucccagauacuugggaggcagaggugggaggauugcuugagccugggagguucaggcugcaaugagcugugauugugccacugcacuccagccugggugacagagcaauaccuugucucucggaaaauaauauucaguuauggccuuaacaacugggugaauggugauacgauuuacuaaggcuggaacacaggaagcagaacagguuugguacagagagaucuuuuggacaaguuaaguuugagaugucuaauagacuuccaaauggaaaggcagaguaggugguuggguagaagagucaggaacucaggggagaagucuaaacugaagauggacauuuggaaaucauuaccaguugaguaauauuuaaaccuguguaacuggaugagaucauggggagauaaugcaaauagaaaagaaagaaaggucucaggauugagcccugggccacuguuagaggucaggaaaaggaggaugauccagcaaaggagaggagagaguggcuagugaaguaggaacaucaggagagguugauaucuuacagaagccaaagaaaguauuucagggaggagcgcucaucucugucagagguuccaggcuuagcugccggcuguuagaacucccuuccucuugcuuagcuuaagugucacuuucccagacuaccucaacuauauuagaaaccccuccgauauacucugucacacucugucauagcuacuauuaucauuuauuauacuugcuauuuaauuagaauggcaaguauaggcucuaagguccccucaccaggacucucacucaaccauuugucucaaccauuuaugucucacucaaccauuguuacaucagugcuuaucuuagugucuggcauacaaugggcucuugauaaguauuauugugagagaacaauauugugauuguucacauuuuauuacuuuggcaguuuaguuuguguuuucaaaauguuuuucuaucuuauuugaucacacugaauuacauaaacuacaagcgaguauccacaugacucaagguagcacaaguagccuaggucaaacuaggaaguaauuuuuaggaaccugacuucuccugauccaaauacuagaggguuaccuaauccuuuccaaaccaggugugguacuuuguaucacaauccucuauuuuuccauuuuuaucacauucuuucagaaucuuguuuggguaauuuauuaaucugauuaaggacuucuaggugucaguaacugaagaugucuuuacuaauuaucccuguaagaguuuuuccucccuuuuuuuucacuucacuuuuaaaagauugaguggauuuugaaguccuuuucuuuguuugaauaauguaggguguuuuuuauugaauaucacguaaggccauuuuaccagggagcauacagccauuugguuuauaaugagaaagauacuccacugcuauauauucucuuuuggaagagcuccauuuugcugaaugugaaaguauuuugaaauaacugagauaacuagaaugucucuguguuacauuagcauguuaguagaacuccugacaugaugacuuaaauuuucaaaagugagaacagaugcauuugaauuaguaauugaaaauaggaguuugauaguaaaagugauuuuacauuuguauauagcuuacuauaugugccaaaaaaauacuguauaauuuuuuuaaauucuuagauucacuauuuuuguacuccccagaugauuguguuuuccuauuagguugagauuccuuucagaggucuuuuuagauaauaaauagaaauaagaaagcuguguugcauaagaaccauuaagagaaaaguacagaccucauguuuuauaaguaagaaauaugacuuuaaaaauaugcucacuuuaucugucaucccugcaaaaccagaacuguauguuccaaaaucugauucagcuuagugaaacaaaccugugauacuucacuauuaauguugagugggaaaaugucauaauuauuuucuggaaaauguuuuucuaguuucuucuaaauauaugaaucagacauuuaaaaauucuauuuacgaaaagaaaaagagcaacucaacucacuuugcugacacauuuuacagcuggagaggcaguugcaugaagaugaagaguuugccagaacauuagccauguuggaugaagaacccaagaccaaaaagguggcauaauguugggcuauuugcguucugaauauacaguacagaucaguguucauacuugcguguucuaggcucuagccaaaacaugaauaacuuuuccagaaagaaauuaaauuauuuuauaaaaauguuuuuggggaagcucauugagaaacuuauucuucuuaaaagaagggugacggcaucaaaacaaaccagaaccuuuuaucacaaaacaaagaauuauaucuuuuccuuauucuuuuuauauuuuauuuuauuuguuuuagagacagggucucucaugaagugcaguggccugaucugggcucagugcaaccuuugccuccugagcucaagugauccuccugccucagccucccgaguagcugagacuacaggugugugccaccacacccaucuaauuuuuguauauuuuuguagagaggggguuuuguuauguuggccaggcuggucuugaacuccagaguucaagugauucuccugccucagccucucaaagugcuaggauuauagaugugagcuaccaugccuggccuuuuaguucuuuuuuuuuuuuuugagacaaggucucacucuguugcccaggcuggauuacacuggcacguucauagcacacugaagccucgaacucaugggcucaagcuauccucccaccucagccucccaaaguguugggauuagaagcaugagcuucugugcccaguuuaccuuuuccuuacuccuuuaucauaggaguucuuauguacuuguucagaaaauaaugcucauaaaaauucuuuuggaacacaaguuuaauaacuucaguauuaaucacugucuuuucaggaagcacaguuuugucaguucuaauuaguuaacucuaagaucuauauuaugacagucucauauaauaaugaguauauuuugaggaaucuuuuucuuucuuuuuuuuugcgaggucucacuuugucacccacgcuggagugcaguggugcuaucucagcucacugcaaccuugacuucuugggcuugauugauccccucaccgcagccccccaaguagcugggacuacaggcauguguuaccacacccagcuaauaauuuuguguuuuuuguagagaugggguuuugccauguugcccaagcugguuuugaacuccugagcucaagugaucugccugccucagccuuauuuuggggaaucuuuaaaacaucaagacuuuaauuuuuuuaauuuuuuuauuuuuauuuuuuauuuaucuccaggagauuagcuuuauuucugaugaaucacauucuguuaauauaauugucaaugucaauaugugauuacuucaaaagauuuuacuucuuuaaagcagagaguuguaaaccuagauacaucaggagcuaagacuaaacaggcagguauuaagacaguagggagugguagagacuuugccauuugaaaagucuuauuucaucuaaagacacucaaauuauaauuacuuuaaaagacuguaucacacaccucaauuugugaacuuuuuauaaaauggaguuuugaaggagcaguggaaagaauggauauauuuuuuuccccuuugagaaagugcucucauuuucuuucgagcuuuuguuuauuuuuauuuuagucuuuuaaauuuagauuuuaguuuuuaacuacuuaauacuaacaauuugagaguugagaugaaggagaaauaaggcuucuacuuccagauuuacagguugggaugaagagagauaauuuuuauagauguauuuuuauacccuuucaucuguuuccucauuuguaacaugaaguaauaaaauaugccucauuugccuuggaaauuuuguggaugaaugaaugacaguuuauuguaguguccugcuaguugaaaggugacccuuaaaauuuugauggauuuuaacaacagauuuuaugguaauaguuuuucuauuauuugucacauuugacacuuuuaaaauuuguuuaggcucgaaaggacacagaagcgggagaaacguuuucaucuguccaagccaauuuaaguaaagcagaaaaacauaaauauccucauaaagguaauacuagcagaaaaaaguaagauggagcacuugucuucauggaaguaaauucaugauaaucuuguuuaaguauccuauucaguaauuauguauuguuagguagacauuauuucacaggacuauuagagcauauugaacuuagaaacuuugaaagcucuuuggaugcuagcugguacagaaugcccaucugcucuaugauuacugugagaauuguguuaaaacuccuggcuucuuguuaauuuccaaguauagugcaauauguggauuucaauauauaaagaugaagaaccuagauguuuugagcuuuucaugucagagguagucucagaguugacucauaguuggccaggucaucuucagcucucuugcuuauugccuguagguuuuauucuucagugguucugauagcaaaucaucugcuagucuagaugaucuuaguccuauaaguaaauguauuuauagauuuacuauaaacagauggucuugacacuuuaggacuuugggccuucaggguauauucugugcuaagauuacucaguugaaaaaugaaagaaaaguugauauagauuaucauuuuccaaaaacaacaaccauaaucuuuucuuucuuccuaguaaaaacagcacaaguuucagaugaaagaaagagcuacaguccuaggaagcaaaguaaauaugaaaguucaaaagaaucucagcaacauuccaagucaucagcugacaaaauaggagaagucucuucucccaaggccaguucuaagcuggcaauuaugaaaagaaaagaagagagcucuuauaaagaaauagagccuguggccucaaaaagaaaagaaaaugccauuaaauugaaaggagagacaaaaacuccuaagaaaaccaaaaguucuccagcuaaaaaagagguaagaacuuuguuuuuuuuuuuuuuuuuuuuugagauggaguuuugcucuuguugcugagguuggagugcaguggcacaaucucggcucacugcaaccucugccucccagguucaagcaacucaccugccucagccucccaaguagcugggauuacaggcaugugccaccaugccuggcuaauuuuguauuuuuaguagagacgggguuucuccauguuggucaggcuggucuugaacucccgaccucaggugaucugcccaccuuggccucccaaagugcugggauuacaggugugagccaccgcgcccggccuugguaggaacuuucuagggaguacaguauucccccuuauccaugguuuugccuucugaaguuucaguuacuugugguuaaucauguucugaaaguauuaaauggaaaauuccaggaaugaacaauuaauaagguuuaaauuggguacucuucugaguaacaugaugaaaucucucuggccaaccugcuuuaucucacccaggaugugaaucaucucuuuguccagcauaaccaugcuggauacacuacccacccguuagucacuugguagccggcuugguuauuagauagaaaaaacaguacauguaaguauauauauaguuugguacugucugugguuucaggcaccuacugggguggucuuggaacauacccuccucggauaaagggggacugcuguauauauuuuggugcuauguguuagucuggguuuguuuucaaguuuuauuucuaacgaucauaagucauuauaauauuuuuaagauaucuuauuuagaagcuguuguaggauauggaguauuaauauagcuaaguaagcccauauuuauuguuauugugugucagauacugugcgaauacuuuacaugugguagcucauauaauuuucacaacaacccugugagauauuuauuuuuauuauucaacuuuuaaagacgaggaaacaggcugaaagaguuuaacuauucuaagaucauccaccugguaaguggcagggccagccuugaacucagguccucugaagcaguauaacauaguggcuccacacacaggcucuggagccaguuucaggcucugggacucugagcagguuuggucacuuccccugucugugcuuuggugcuguuuguaaaauaggaauaauaauaauaguaccuaaugacuucauauguaaaagcacuuagagcagugccugggaccuaauaagugccaucuuaacuauuauuauuaaaaugauuguuauuuggcuuaguccuaaauuuacucuuuuuuauucuuguacaacaguguugcgauacugaaauuauuuuuaaaggaaaaaaugaugagauaaugaauaucuuugaaaaauuuugcuaggaaauauauuugagaagcgaacggucucugaaucuccaauuuggaacuacuuuagauucauaaugagaaaccacuauucauucaugccucuuaggcacuuaggauuaaaagcagaauaucaccuauuuuaacuggucaucaccauuauauuuuagugcagaacagugaaauggugaugauuucagaaugcuuuuguuuguggacaaugcuuauaaauacgcuuaaaggagcaauuaacuuuuugaucucagauuuuuucugcacuaaaugcuuaucugguaaaugaaugguuuucuucaggcacacuaaaacauguuccauuuacagaggcagucuguuuuuaugaagaaagaggaaaucuuuaaaugauacucuucacuguacuuuuuaaaguuagaauagaaauaacucaaaacuuuuacuuaagcaguuuugguuggaaacgucaaauaaagucuauuuaauacauuuaguuggucuuggucaaauaauucugacuucauaaaguggguguccuucaaaguuauuguauacgcuguuuaccauucagaauucuuuucauagaaugagugucguaaauuaaucguuuuuccauguugguaugcacuggacucucuugugaaacuuguuaaaaaaauggaguuucccagggaauguggugugggcagcuguauuuuaauaagcuccucauaugauaugaacacacaccaacauuugagaaccauuguuagaaaguaggguuagauucuaggaccagccuguuaauggcuuaucgaccucuuagccaaaccagcugaacuauuuuauugguuaagccauuccuuuuuuuuuuuugagacggagucucgcucugucacccaggcuggagugcaguggcgcgaucucagcucacugcaagcuccgccuccuggguucacgccauucuccugccucagccucccgagcagcugggacugcaggcgcccgccaccaagccuggcuaguuuuuguauuuuuuuaguagagacggcguuucacuguguuagccaggauggucucgaucuccugaccucgugauccacccaccucggccucccaaagugcugggaccacaggcgugagcuacugcagccggccgccauuucuuuguauagaaguuacuauuuugucuacucucaaaaggauuugggauugcuuacaaguuaaaaauaauguuaaaauaggaaguggaaaaauaacaaacaccugauagugguucuuaaaugagagcuaucuaagauauuuuucccccacauaaacacauucuagccauaccccauaucuccgaaagagaaacuuggagguggaucuagggaugcauaguuugaaaaguuuccccaggauuuucugagauauaccuaugguaaauuccccgagagaaguagaaugggaggagaugaaauagcauagagaacgugucuucucuuuggaguaaagcuuguaccuucuuugagcugacuguuuagauucuccuacuggaaugcuuauguccuuagggaugcaggcuggugcuuuaggggcauggaaggucauaggauuaacacagaauaucuucucgggcgaucagguuuacuuggggaaaaaauguauuuucccguuaaacauggauauauggauauaucaugaaauauaauuuaaaauucaggugaauuccuaaaguaaaacacuuuuugcauuucuuugcuuggagcuggcaacuuggcuuauucccauaaucugcccugagguguguggcuuuagagaguggaaaguuuugagaagcgcugaugcagggauguucguaagucaguugucuguaaguuaggaaguacuuguguagcuaaaacuguuaauuucacagccagacacagaagugacacaauaaaaauaauguuuauuucuagauauguauuuuaaauuuugcaugaauucuguaugacuuuguucauuuuccuuucccuguucccaaagucuguaaguccugaagauucugaaaagaaacgcacuaauuaucaagcuuaucgaagcuacuuaaaucgagaaggucccaaggcucugggcuccaaagaaauaccaaagguaagaguacugagagggcaugccauucugugagggccucugccguauggguccauguauguauucacgaugauuauagcagcagaggauuaauaauuaaaaaugagcaacagaaaagcuucaguuacugucuucaagaauuagggauguuuauucauguuaugaaucacugcuugauacuuagaaaaauuucccuuuaaauaacaaguagcccuagaaaggcugagcuuugagacuauaccagugacaaaacuaauguuuuugcuugcauggcacuuauagccuaaagaaagagacauuaaauaaauaauuuaauuauaauugggauaugugcuaugagggaaaaaucuaagaugcccuuagguaguauaacagaggaaccugguccuugguggggcauguagaaugugacauuuaaauggagacuugaagaaugaaagggauucaacaggugugaagggguugugauggcgugguggucugggcagaggggccagaauguaugauguuccugcagggggaagguucuugcaugguauguuugaggaacugaaagaaaaauuaugguuggagcauagugaccaagggaugagaauggccaaagagguuaauaggaucacaucuugcagggccuaauguuuaagacuuuugucuaagagaaggaauuuuuauuuuguguuuuugaaauggaguuuucgcuccuguugcccaggcuggagugcaguggcgcaaucucagcucacggcaaccuccaccucuuggguucaagcgauucuccugccucagccucuggaguugcugggauuacaggcgugcgccaccaugccuggcuaauuuuguauuuuuaguagagaugggguuucuccauguuggucaggcuggccucgaacucucgaccucaggugaucugccugccuuggccuuccaaagugcugggauuacaggcgugagccacugggcccggccgagaaggaauuuuaaaguggagggauaacaugaccagauuugaauuucugaaagaucgcucuggcugcugauguaccaagugcuguggauggggcagaaauagcuacacagagaucaucaggagagauggugagaagugauagggacuggucugggggagcagugaaaaugucgaaaaguggagagguuucacuagaagaggcaaaaucuaugggacuuggugauaauugaaguggaaagugagaagaaagaguauuggggaugaucuuguuauuggcaugagcagcuugguggaucaugcgauugguggcagggcuaguuuggggagaugauaaugaguucguuguuggccacacugugcuuuaggguuaugugagauguccacauggagaugcugaguagacaagcagauaugugggacuggagcuuagaacagaagucagaacuagauggacaaacuugggcauucuuggcaugaagggauuaauagcaucugguaaacuaguacagaacaagaagagaagagggccuuggccccugcuucuuugugaaguagaagaggguggaaaccaaaaggaaacugagaaguagcagcuacaaauaugggagagaaguuugauaagcgugggaucacagaagcaaagggaagagagaguauuucaaaaaugauugaguaguuaagucugucaugcuguuaagauuccagguaagggaagaccggaaauuguuccauuuaguaacaugaauuaaugauccuuaguggccuuagcaagagcuaaggacaguggaggcagagccugauggaagcggguggaagagugagugugaggagacaaaauggagacagcaaaaguagauauuuuugauaaguuuggcugugaaggagaaagaagugggaggacuucuagcuagaaggacuagaaggggaagugacuucuagcuagaauggaaaguggaauuuagggggagauuuaaguauuuuuaugguaggagauauuuaaagcaugcguuuugcuaaugggauagauccuaccagaaagggagagauggaaguuauaccagcaggagaaggagaaucaauuguagcaugagauuucuaagaaggcaggaggggaggggauaaguauacaauauauguauaaauuuaauuuucaguuugcuugguauauauaaguacauauagagauuaauagcuccccuaauaaagagagggagagaugguguagcugggaccggaguggggagcgagaaggucggccuuaaggggcuuauggguuuuaugggagccugcaggaagaugccagucuugccuccuguacauggguaugagagaccaaacaaguucugcuugagaggacuucagucaaaguggugcccugaggggacagacagguuucagugaaggcaaggcuauggagggaauguuggagaagagguugaggauacuagggguggcuggcugcuccuggaguaagagcuuagccaaauucuagaauagaagaguuugauagggaggcuagaagugcuaagauuggauaaguaaaaagauaaucagagccauagugggugauaauuugggagauaauagauguuugggauaugggauauaggggcuugcaugugcaauuuuuccaggguuguuuugaguuuguucagaaguaguuaaguuccuguaguguuacaguagaucauuucaauccaagaacccauaaaggcuucaagggacccugagauauuguuagucaaaccuuuucuuuccaagcaccuucauagcuguuucuuuuugucuuccgagaaagauucuucaucugaauggugaaggauugaacuuacauggaggcagucuuugaauuuugguuggcugcugcuuuucaagcccauuuuaaguuuauuaaucucaauucucuauuaaaagaguaauaaguaacuuggaaugucauguauaauuuucauuuuguuugguuguauaauuuuauugaaccauugcaaaaauauauaacucaacauaguuccaauuaagauuuaaugucuuuuccauccagcucucuuuggcaaguaucucuuauauuauacauuaugagaguuaucuuuccaauccagagauaauacgaucuugccuuuaaguuacuagaagauugcuagauuuacuauccuagaguaaugagcagagaggaaggcacgagcucacacuugcuuagcuuuuuagaaucaaaacuuucccuuuuuaacaauagcaagaguugccuuuuuucccuuuuuucccauaaaacaguaaaaauuuuuuauuaagcauuauaaguugcauucaguagccuucagauaugccacaccacaauccauuggcagaccauccaacccagcagcaguuuguucuuguacaauccaugaguucgggcaaaacucccuucaacuuacaguuaagauccuacuuagcucuugcgggcagggauuggggaauuagaccucauuucugaucacuaauguggugaaaagcaucagaaguauuugaaaaugauaagaagugauucugauuuuaaaguacauuguuucgaaacauuaacagaaacaucaaaaugauaggaguauaccugcuucuauuaaauucuuguugggaaaguucuuaagaacaagcaguuuccugaauagcaagaguuucuacagauggauugcauuugguuguuuauuuauaguuaugcaaguuaacuaguaguuuagauaugaagagggcauaauggaaaauaguaugaauggguaauuuuaauagcuuugcuaacaguguuggauguauguuuuucacugcuuguuuuguaaguuuauuaaacguuagccauaucaaaauuucuuaggaucuaauuucagguggugcuuauuugcuguaaauuuccagcaaacuuuccaugccaagguuauuuaugaugugaaaugagaaaaaucaacuuccugcaguuuugaugccaaauguuucuuuggaaagcuaccauguaauuuccucucugcuugaacauuuugguuuuuagggagcugaaaauugcuuggaaggccuuauauuuguaaucacaggcgugcuggagucuauugaacgagaugaggccaagucucuaauugaacguuaugggggaaaaguaacaggaaaugucagcaagaaaacaaauuaucuugucaugggucgugauaguggacaguccaagagugauaagguggguacugcuuuguucucaacaccaugacaccuccugccugccuuggcacacucuugaugugauuugcccuuuacucagaguuaaaugaaggaaagaaauagaaaaguaauuucuugccuacauuauuucuucuccacagaaguguuauuggcucugacaccaggauuuugguuuuccaauggaaggcauaguuccuguuuacuugacuuuuuuuuaguguauuuaaguuuaagucuuuuuuuauuuuugaagauagaaacaaaugcaguuuucuuuuucuuccaguccgaaguauuccuauauaugccacuguauacaccaucuuagguuuuuuuaaauugguguuuuuagaaaaagaaucagcggccuguuggguaggauuguguuuagcuccaaacagcagaauaucugauuaaccguggauuaaacagcugcuaauuuuucucacaagaauucuggagguauugcugggauaguucggcaucucaacgaugugguuccuccaucuguccuuauuguguuaacuuuuguccucaugcauguugccuugugguugcaagguaguugcagcucuaggcauuuaaauucuuauucaaggcaggaaaagggaacaguggcaaguaugucauaagagcugugacuggccugacgagaguuuucccagaaacaugucuuauagaauuucacauaaggcucauuggccagagcugucaccuggccacucagagcuguaugggagguugggaagaaccaagacguuucugguugccuuggaccagucaucauucaucacuugaagaaggacacauuggaguuccaucagcagggaagaaggugggggaaaugucugccauaugcauuaaauaugggagaagguaugaagagcuggucuuaggcccuaguggccauugccccuuucuaggggaggaaagguaaagcaguccacaaaaguagaaauggaccacuucccaugccaaccugcuacucuuagggaauguaucuguuauuuucuuucuuuucaauguuacuuuuucaaugaaugugcuauuuuuuguuuuucuuuuuuaauuccaguguuaucuuaauuuacgaaugugguuuuucaccuacuaauaggcccuagaauuuuuuuuuuuguaagagaagggaaugguaggaugcaggaugcaguuuugaugguuuacauuuuuaaucaacaggccgcagccuuggggacaaaaauuauugaugaagauggccuguugaaucugauucggacuaugccaggcaagaaauccaaguaugaaauagcaguugaaacugagguucguauaaaaugaaugugauuuaaguugguguauauuaacuuuuuaauuucauagacauaugucuuggguggauacaggcuuguuggcugaaagauuaacaucccugucuaccacaaauggaccaccuuaguuccuuuugagcuggaagacucugcuucaagaugucuacuuuguuguuuuuccuuaucuuugucagggaauaugaguagagaaaggacaguauauugcauauaacauaucuacuuaucaaacuuuccuuauuuuccauauuacuauuauuacuacuauuuuuuaauuuuuugagacagagucuagcucugucccucaggucggagugcaguggugugaucucggaucacugcaacuucugccuccuggguucaagcgauucuccugccucagccuccugaguagcuggaacuacagauaccugacaccacgccugcuaauuuuuauauuuuuaauagagacggaguuucaccauguuggccaggcuggccuugaacuccugaccucaagugauucacccacuucagcgucccaaagugcugggauuauaggugugagccacuguucccggccauauucucacguugacuuuaugcaaagguuauuguuuaagaguuccuuaaaggauauuuuaauagguauuagcaugauaaauuuguuuucaauuagaacuguauuaggacuuuuuaaauugugcagacaccuagccuguauuagcuuuugcaaaaggaaaaauguuggcucacauaacuaaacuaugggcagggagggucuggucuaggaacuauuggauccacagacuacaaagcugugaggaccccuucaguuucugucucucuguuucuacuaguuagccucauucauucccacuguagaccaucuuuuuuuacacacaggacacaggauugccagcauuccaagauuuuaauguccccagcucugucacccaaauggcaagaugguccauccagguuauuccgguuagagaaaucuagggaaugauuucgauuacauaaccauagcauaguuauaaaaaccaggaaauuaacauugaugccguauuguuaacuaaccuguacauauuuuucgaaccuuacauuuuucccuguaguucuucuguuccagggucccacacugcauuuaguugugucuucuuagucuucucccgucgaugacauuucuucagucuuuccuugucuucuuacaaccuugacacuuuuaaugaguacuggucaguuuuguggaaugucucucaguuuggaucugugauguuuucucaugauuagguugagguuaugccuuuuuucuaagaacaccauggaugugaucuuguguccucagugcauccuaucauagauacaggaugucaauaacgucuuauuauuagugaggauaaucuugauuauuugguuaagaugauucagcaucccacugaaacuagugcuggguuccuucacuaguaaagugacuauuuuuuccuuuguaaucgauaacugucuuggcaggagaaggagguacuuaugcuuauauccuguuuguccuuaaacauucauccacuaauuuuagcauccacugcuaaagaggcacuaauuuuuuuaaaaacugagauauuacauacuauaaaauccacccuuauaaaguauacaaaucagugguuuuuaguauauuaacaagaguauacaaccauuagcacuguguaauuccagaacauuuuccucacccugaaaagaaacccuguaccuaucagcagccacucauucuauccaccccguggcacucacugcucugcucugucucuauggauuuuccuaugcuggacguuucacguguguauggagacauuagaauauauggccuuuugugucuggcuucuuccacuuagcauagugguuucaagguugaccuggguuguagcauguaucagugcuucaguccuuguuagggguaaauaauauuucauuguguggacacauccuauuuuguuucuuuuucaguugauggacauuuggauuguuuccaucuuuuagcuauaaugugguuaugaacauuuguguacaaguuuuugucgaggcauuaacuuuuaauuaggaaacuuugaaacaaaaaucucaacacuguaccuuguuuuuuucaaacuaaaauuggaguacuuauuacuuuuaaaaaucaacguguugucacuuuuagaaauugcauuuggugguuucugguguguuuguuaauuuuuauaguuuagaagguggugauuuccacaaacaggaaagucuguugugaaaagaccagcccagguugaguagcccacuuggauaucucugauugcucucuguaguacguuuagcaggauagaaauucuguauguuucaucagguuucuuuuuuccucauuuuuccacuucuuaagaugaagaaagaguccaaacuggagagaacaccccaaaaaaauguccaaggaaaaagaaaaauuaguccaucuaaaaaggaaucagaaucuaaaaagagcaggccgacuuccaaaagggacaguuuggcaaagacaauaaaaaaggaaacagauguguuuuggaaaagccuggauuucaaggagcagguggcugaggagacaaguggugacagcaaggcuaggaauuuggcugaugacagcagugaaaacaaaguggaaaauuugcucuggguggauaaauauaagccaaccucgcucaagaccauaauuggacagcaaggugaccagagcugugccaacaaacuccuacgcuggcuccgaaacuggcaaaagaguucuuccgaagauaaaaaacacggugauuuuacaaccucacucauuuuuguguguguguauaucaacaugugauugcucaguggcacauauaugagaaaaucuaacgauucauucaucugucagcaagcauuuauuaagagcuugaucugaacccaggugcaguacuagacccugcuggugguguugugaacaaaacagucccucucaggagcucacaggcagugggggaggcauaucugaaccagccauuaaaauauauuugccaaguacugcuagagggguaaguccagggugcugugaggaugaagauguguggucagggccagggugugugugcucccaucccagaggaagggauggcuaagcuaagacuuggaaacaaaguaggagcuagcuaggugaagggagggagagaugaguguuggguaggaaagaguaugugucccaaggucugaagccaugugacagcaagaccccugaguggcaagggcacuaggaggaaagcugugaauaaauaacagaggcaugcgugcagggcagucagccuaaacucccaguagcaagcacgauuugcuguggcaggcccgauaggccugugcuucuguaguuucuguccuuguuuaugauguauuauuugucguggagagugaaaagcuccaauauguauuuaauguccaaaguauuuucuuaacugagcuuugagaucacaaauguuuuaguaguguuuucaacauagaccagugaugacuagauugccaaucaucauugccaaugaugccuguuuauuuauaaaaauaauauauuguaaugauacaggacuaaauuuaaguuaaaucacuuuuuucauucugaaacuucauaaaaucucccuuaaaagaggagacaggcauuucaugugccuggagaagacuguuuuuuuuuuguuuuguuuuguuuuguuuugagacagagucuugcucuguugcccaggcuggagugcaguggugcgaucuuggcucacugcaaccucugcuuccuggguucaggugauucuucugucucagccuccugagcagcugagacuacaggugcacaccaccaugccuggcuaauuuuuuguaguuuuaguagagaugggauuucaccaugcuggccaggcuggucuugaacuccugaccuugugcucuacccgccuuggccuccccaggugcugagauuacaggcgugagccaccgcacccagccaagaagacuguuuuaaagcuucgggugaacucuagucccugucuucaugcccgcuggcaguagguugaaaaccauugucucugucaguuauugaguaugaguugagcaugauguaugugccaggugcucacguggugaggggaggaagagugcuguaguguugaggggcacaagguaguugcagacgcagcaucuucaagucauuuuuucuucuugugaccauguagcuacuaugcuuguuaacauuuagugaagcuugcauggcucugugcucagccauuccguccucacaacauccuuagcagcaacuuuacuguuguucuccucaucuaacaaaggaggaggcaggcacagaggggcuaagucacuucuaaaguacccacggcuggugagagguggcaugaggauggauggaguugggaucgagccccggcagcgugcuccauggccugugcguucacaggaaaggaaacucauacaauuauuauuucaaaucaagaguuuuaagugaguuaguuuuaguuuuuuauuuugggugggggugagguaggaaguagaauuucacugaaugcucuggaaacuuguuuaugcuuuguagaaaauagucugcaaauuuagaacuaaacuggaggacagcugucuaugugaaguuuaggcauaacuauuucugccaugcuugaauuucuguuaggugauauagguugacacucuggaacuucuuuuuuccuagcagcaaaguuugguaaauuuuccggcaaagaugauggcucuaguuuuaaagcagcguugcugucaggcccuccugguguuggcaaaaccaccacagcuucccuggugugucaggugggugcguugucacaguguggucggacagauaaccucgaguggucauggcuaggagauaaaaguguguacccacaucugugcgugugcauguguguguguggugucuauauauaaacuguguuuauuuuucuaagauaaaaccuuuagaaccuguuuugguucuggcgauguuuguaauuuuaauccuuuuaaaauauugguaauuaaaguaauaagcaauacuuaccaacgagcgaggcaguguacuaagcacguggguguauuauagauaacaaaaacauguauucuagacucugaaagaugcaaauaucuuaaugccuuugaauaauucuguguacugaauaauuaucuguacugucaucauccacaugugucaaaugaaauaggcuuagggaggaggguggaggcccaguuuucacccgguagcgcgacucaggguucugcucuucagcacugugugauccugccuucguuccuauugucucuauugcuacugaaucccuguagacaaugggagaacuugacuugcuuaggcacuagagcagaucagaguucacguguuaguaucacagugaugaaauaagagauuagaaauuuauugcuggauuucucaauccucugcugcauaagcuugugguuucuuuuguuuuuuuguuguaugcaucugcauaaaauuuaaauaaaauuuuaucuguuuccacuguguuuauaaacauuaaugaaaaagcaaaacaacauuuuuuuccuagucccuacaguugugaacacaacucuuuuucucucuuuauuauuaucauuauauuuuuuaugaauuaaggcauaagguaaucaguuuugggaaaugaaucagaagaauuugaauuuuccugauuucagaggaaaauaguuuauugggauagugucgugacaaagaaugauuuaacuuuauaaauuaucuuagagaggauuacuuuuugauaucuuauuuuauuuuuuuguuuugagacacaguuuuacucugccacccaggcuggaguguaauggcacggucucgguucacugcaacuucugccucccagguucaagugauucucaugccucacccuccagaguagcugagacuacaggaacacgccaccacgcccagcuaauuuuuuguauuuuuagucgagaugggguuucaccauguuggccaggcugguuucaaacuccugaccucaauuaauccauccacuuuggacucccaaaagcgcugguauuacaggugugagucaacgcaccuggcugguaucuuauacuagauuaauucugugucugauagugaauuguugggaugauuauguuuaauccuuuuuuuaggacuuuaagaaguaaauuuaguaaaauugcuuguuugaauauacucuuccagauuagugauuugucagcugaaguuuuaagaccaaacuuauuuguguuuguauguguauguuauauguauguauaugauauucuaaaaauuucuaauauuguaaggcauacuauaguuaaucucauugucuguuaguaucauacuuuauacuuuaccuauggguuuuuauauuaauuuuguaccuucuuucuuucuuaacuggccuuucuuggcgggggugguggaguuaauuuguauugugccuucagugguuuccaauauuuugauuaggaguugggauacagcuacguggaacugaaugcaagugacacccggaguaagagcaguuugaaggcgauuguugcugagucacugaacaauaccagcaucaaaggcuuuuauucaaguauguggcuuuuugaccuccuguuguuguuauauaagaaaaauauguucauuucaauguucaguaaccaguauugaacacagguugugugccaagcacccuacuaaauucuggggcuaacaagagaauaagaaagccgucugacaucacucuuauggggcaguacuuacccuuucguaggucuuagagguuucuaagaaugugauaaaaauguguacaugcacauauucguuuuucaugauuuuagaggauucacaggugaauccuguaaagagagaaagaaaauaaaaaaccauguguaaugcagugugacuuauuaccucauuaccuuauuaaccucacucugcauguauguaauaaaguauguaauacagagugagguaauaaggccagcagaugaagaaguaauuaugcuuggggcauugaguuaaaggggugauaauuguuuugaaagaccucaaagaaugagaaagaaaacuauuuggagguggaagaggucacugcaggcaaagguaguaaaagagaagacagugugcaaaugcccacuguguuucagguuguagcuagugguccucuauggccagaguucauggaaaauaagaugcucaaguuaaggaccgcacagugccuauuuagagucuaugguguguuguuuugucaccugaauucuuggugccuucacauuguucaaaauaauuugcucaggaaaugucacucuuagacguggcuggugggaggguagauugguacaacucuggagagaguccagcaauauuucucaaauuacacauaccgucuagcccagaaauuccaauugcuggaauuuagcuauuauuuuauaugugcaaaguggcauauauaugccauauagauaaggauagucauuuaguaugacauaauagaaaaaagcuuggaagcauccuauauauuucauuaauggugauuaaguaaagugugugauacaaguguagaauggaguauuaaauugccuuaaaaaaugaaguguucuguaucuguaagauaaagaaugaaucaccaaaauacauaaaaugacaaaacuggcugggcauguuggcucacgccuguaaucccagcacuuugggaggcugaggcggacagaucaccugaggucaggaguuugagaccagccuggucaacauggugaaacaccgucucuacuaaaaauacaaaaauuagcugggugugguggcgugcgccuguaaucucagcuacuugggaggcugaggcaaaagaauugcuugaacccgggaggcggagguugcagugagccaauaucgugccauugcacuccagcuugggcaacgagugaaacucugucucaaaaaaaaaaaaauucaaaacucaguuguauauuuuuaugcacauauguguacaauaucucuuaaaggacauauaagagacuguuguuugccucugggaagggaauuggggucugcaggggaagggguggcagggagaguuucucuucucugcauauucuuuuuuuuuuuuuuucuuuaacaacacucuguaguccagugcugcauauucuuguagcuuuugaaguuuaauaucuguuacauaauuuucuacagagcagcaguuuuugagcaauuguuauuuuguuuuugucucaucccauugcuccucaaccugggucagauggagcagccucuucaguaagcacgaaacaugcucucaucauggaugaaguagauggcauggcaggcaaugaggauaggggaggaauucagguaauucaagugcuguauuuuugcaguuucacuguugauaauuuagauuguuagaacauugucauucucucauacuuagggcaguuaaggcauguugcugaggagauuuuuagaaccuaaaauagcuugugugguauuugucauuuuuaaaauaauuauuuuuguguugcaaacuugccuuucaggaauuaauuggccugauaaaacauacuaaaauucccauuauuuguaugugcaaugauagaaaucaucccaagauucgcucucugguucauuauuguuuugaucuucguuuucaaagaccucggguugaacagauuaagguaugaugauugaaauuuuuuuuccaucacacuagccuauuuauuuaagggucaauuuuuaaaaguaccugauaaauauuuuuaaaauaccugauuauaugaguuaaaaaucauugaggacuccucccuugucaauuucagggugcuaugaugucuauugcauuuaaagaagguuuaaagauucccccuccagcuaugaaugaaauaauuuugggagccaaucaagauaucagacagguaaauuaaauauauaucauguaacaguuguugauuauuuuuaacuaaugcuuucaaccuuguagggauggggagcaacaggauuuuccuaucuugacguugucuuauuugugauucuuuuagguuuuacauaaucugaguauguggugugcacgaaguaaagcauuaaccuaugaccaggccaaagcugauucucacagagccaaaaaggauaucaaaaugguaaaauaaauguccaugucuuaguuacuuuccuaagccaaaacacuucuuguucuguagguagcuugauagaaguaguuauuauaguuccuugguaugccuguggaauccagggauauauaguaggaaguauagacagcugcugaaaguguuucuaauucaaaugauuuuuuucucaaagauugucaaugucaauuauaaauuuugagaaagggauaaauuuuaaauuauacuuaugcuucaacaauuauaaaauggcuuuuccagaguucuuuauguuuggcuuucguguuuggaaugguuuugcacuguucagaauaauccaugucaaaugguuuaguuuaaugaccucucugaaacuagagguauguaucaguuuccucuguguuguauuuuaccuaguugcuaaucagaauuuauaguuagagcaaugauuaagcagguucuaaaaaaguuaauacacuuucuuauuuauuuaaauuuucaaaauuuuugguagagacagggucucgcuauguuuccccgacuggucuugaauuccuggccucaagugauccuccugcuguggcccccaaggugccgggauuauaggugugagccaccacgucuggccuauacgcuuuauuuuuuagagcaguugaggcucaggaguuugagaccagccuggccaacauggugauccaugccuggccuauggauuaaaaauggaguggaagguacagagaguucucacauacuucaugucccccucacacgcacagccucucccacugccaacaucccccaccacagugguauaucuguuacaaucgaugaaccuacagugauaccucauuaucacccagaguccguaguugacauuagcauucccucuugguguuguacguugugugguuuugacaaaugacauguauucaccauuguaguaucauacagaauaguuucacuguccugaacauccucugugcucuaccuguucauucuuccuuuccgcuuuccucccuacaaccccuggcagccacugauccuuucacuguguccauaguuuugccuuuuccagaaugugguauaguuggaaucauguaguauguggacuuuuccaguuggcuuuuuucacguaguaauggcauauaagguucuuccauaacuuuuuuguuuuuguuuuuguuuuuuuugguuuuuuuuuuuucggagucuugcuuugucacccaggcuggaguacaguggugugaucuuggcacacuguagccucugccucccggguucaugugauucucuugccucaggcuucugaguagcucggguuacaggcaccugccaccacaccuggccaauuuuuuauuuuuaguagagacgagguuuuacuauguuggccaggcuggucucgaacuccugaccucaagugauccgcccaccucagccucccaaagugcucggauuacaggggugagccaccaugcccugcccccccaugucuuuucauggcuugauagcucacuucuuuuuaauguugaauaauauuacauugugugaauguaccacaguuaaauuguuuauuuaccuacuaaaaggacaucuugguugcuuacaacuuuugguaauuauaaauaaaacugcuuguaaacauccugugcagauuuuugugugaacauaguuucauuugggugaauaccaagaagcgugguugcuggaucgcgugguaagaguauguuuaauuuuguaagaaacuaccaaacgguacaguuuugcauucccaccagcaaugaauggaauuccucuuguuccauauccucguuagcauuuggugauguuaccguuuugaauuuuggccauucuaauaggugugucccucucuuuuuucagggcccauuugauguugcccggaaaguguuugcagcuggagaggagacugcucacaugucacuuguggacaagucagaucucuuuuuucaugauuauucaauagcaccccucuucguccaggaaaauuacauacacgugaagccuguagcagcagggugaguguccagagcuggugagaggugugcuuaguauccagcacugcgaaggcuaaauacccgugaagaagggaccugggguguggagagugggauaauccagacugguucuuuccugcaggggugacaugaaaaagcaccugaugcuuuuaagcagagcagcagacagcauaugcgauggugaccuaguggacagccagauccggaguaagcaaaacuggagucuucugccugcgcaggugagcagagggcucucccuaacaugcaggcucugcuuuuacuaagagaacuaaauagcuuuuagcugcuguacuuauuuuauuuuauuuuguuuacuuuauuuuugagaucgagucucgcucuguugcccgggcuggaguguagugguaugaucucggcucacuggagccucugccucccggguucaagagauucuccugccucagccuccugaguagcugggacuacaggugcccgccaccauacccagcuaauccuguaguuauuuuaaauaccagauaaauguuauggcucuuguggcaaaaauauagucuguuacagauuauaauacucugugguaacuaucgucuguuuccuaaucuggccuuauuuuucuuuuuucuuucuuucuuuuuuuuuuuuuuuuuuugagacaguguugcuguguugcccaggcuggagugccguggcgugaucuuggcucacugcaagcuccgccuccuggguucaugccauucuccugccucagauuccuggguagcugggacuacaggcgcccgucaccacgcccagcuaauuuuuuguauuuuuaguagcgacaggguuucacuguguuugccgagaccagcucagucggggagacccuaacccagcggcacuagaggaauuaaagacacacacacggaaauacagaggugugaagugggaaaucaggggucucacagccuucagagcugagagccucgaacagagauuuacccguguauuuauuaacagcaagccagucauuagcauuguuucuauagauauuaaauuaacugaaaguaucccuuaugggaaaugaagggaugggccgaauuaaaggaauagguugggcuaguuaacuguagcaggagcauguucuuaaggcacagaucgcucaugcuauuguuugugguuuaagaaugccuuuaagcgguuuucugcccugggcgggccagguguuccuugcccucauucccguaaacccacaaccuuccagugugggcguuagggccaucaugaacaugucacagugcugcagagauuuuguuuauggccagauuuuggggggccuguucccaacaguguuggccaggauggucuuaaucuccugaccucgugauccgcccgccuuggccuuccaaagugcugggauuacaggcaugagccacugcgcccggcccaaucuggccuuauuuuucuauauuucaaaaaauuuuuaauguaaauggacacauagaaauaggaauguuagauuuugguuguaagaugugaaucaaaaguuucauuugcuguguuuuaccuuaagaauccuuguuuuuuuauuuuuggucauucuuggcucucccagguggucacugaguagcggcuucuagaagcagugcagcuagggcaggccagcagccaugucucugaugcauucauucggauuuucuuccuugcuaaaaaggcaguuuuauauuggguacuguauuuagguugagaucuuuaacucgaaacagaauuugauagacauuuguaauuaagagaguuauucguucuuuuugacuuuuguauaguuauacaggauuauuggccugaguaauaaaauaaguaagacgcuuccagaaagccuaaugcuucucuugauuccacucacacauugcuugaaaacaagaaacaaaauuucauucuggagauacagaauuuuuuuuuuuuuuuuuuuuuuuuuugagacaaggucucacucugucaggcagucuggaaugcaauggugugaucauggcucacugcagccuugcccuccugggcucaagugauccucccgccucagcccugcaaguagcugggaccauaggugugcgccaucaugccagcuaauuuuuguauucguuguagagacgggguuucgccauguuggccaggcuggucuugaacuccugggugcaagcugucugcccaucucccaaagugcugggguuacuggcaugagccacugcaccuggcccagaaucuuuucuuuuacauuuuauguguuuuguuuuguuuacuuaauaauuguagcuuaaaggcauaauguuuuaacacaggaaaagcuuaauguacaaaaauacuuccuaaaguguucugauaacaaaaaguuggagaaaaucuccaugucuagcaguaggagaauaauuaugaugaauccucuugaagaaguauuuauagccuuuaaaacuauuugcaaagauuaucuaauaugaaaaagugcuugugagggaauuacuagaguaaagcagcauacaaaauuuauguaaacuauaauuccagccuuuaagaaagugaagugcucgcuucggcagcacauauacuaaaauuggaacgauacagagaagauuagcauggccccugugcaaggaugacacgcaaauucgugaagcguuccauauuuuuauggaacagaacagagcccucagaaauaacgccgcauaccuacaacugucugaucuuugacaaaccugagaaaaacaagaaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcaugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaccaaauuuacaagaaaaaaacaaacaaccccaucaaaaagugggcgaaggacaugaacagacacuucucaaaagaagacauuuaugcagccaaaaaacacaugaaaaaaugcuaaucaucacuggccaucagagaaaugcaaaucaaaaccacaaugagauaccaucucacaccaguuagaauggcaaucauuaaaaagucaggaaacgacaggugcuggagaggauguggagaaauaggaacacuuuuacauuguuggugggacuguaaacuaguucaaccauuguggaagucaguguggcgauuccucagggaucuagaacuagaaauaccauuugacccagccaucccauuacuggguauauacccaaaugacuauaaaucaugcugcuauaaagacacaugcacauguauguuuauugcagcauuauucacaauagcaaagacuuggaaccaacccaaauguccaacaaugauagacuggauuaagaaaauguggcacauauauaccauggaauacuaugcagccaucaaaaaugaugaguucauguccuuuguagggacauggaugaaauuggaaaucaucauucucaguaaacuauugcaagaacaaaaaaccaaacaccacauauucucacucauaggugggaauugaacaaugagaucacauggacacaggaaggggaauaucacacucuggggacuguggugggguggggggaggggggagggauagcauugggagauauaccuaaugcuagaugacgaguuagugggugcagcgcaccagcauggcacauguauacauauguaacuaaccugcacaaugugcacauguacccuaaaacuuaaaguauaauaaaaaaaaaaaaaagaaaaaaaaaaagaaagugaaaacccuggacauagaagacaucuaagguuacauuuuuaaaaaacuuuucucaaaugccaguuuaauugaccguaaucauuagucuuucuaugcuuuaaucuaccuauguugucagucauuuauguuaaagaccaucauaucccucuuaaguaauuauuugcugugacguuggcaucggugagguaaccgguauguugagauuaguugcuugaggaggcugaguuggcgacaugaucucccugagggccauaacauguuggaucaagguguguaccgcaaucuguuguuuucucugggagaaguuuccuguaccagcagaucagaguuauagaaagggucugacugcccuguagguagguauuugguacaguguugcuuuaucuuccguagacuguuuggaagccaaugacuauuaaggaaguaacuuuguacggaacauaaauucuggacugcaauugauuuuuuuucaggccauuuaugccaguguucuuccuggagaguugaugaggggguacaugacccaguuucccaccuucccaagcuggcuggggaagcacucgucuacaggcaaacaugaucguauuguucaggaccuggccuugcauaugagucucagguaggugggauuacucuguuucggguauuuuaucgauuugguguauuuggccuuuauccaguaaugaucaugugagucaaaagauuuguguuuuaguuuuuauuuuauugguaacuagaugaaugauccuggauaaguuccuuauauuuuaugggccugaguuuuaucaucuguaaucaguauaacacuuguuuugccacuuaaaaggauacuuuggacaauaaaaugguagaugucauaauuuaaaauuuuaaagacugcguaagucugagguggcacuguuacuguuauuguuauuaugccuauuagugggaauagcuucgcagcuucagaauaauuaauaggaaaauaauugaacuauuuaaagaaaugaacuauuuuuuaccaauuuacucuaguaguaaacugaccuagucauuugggauaggaaauaacaguuuagcauguaacaggaggaggcugcucagaucauugaaaaugaaugugcuuggaaaaguuuaaggaaguucaaaaauacuugcauuugguacaguuuuguugaacuuuagaaacuuggaaaaugugcauaaauauuaaguacacuuuauggauucuucuuuuuauucuuuuuuaagacaaggucacacucugucacccaggcuggaaugcagugaugcgaucucugcucacugcauccuccaccuccggguuuaagugauucucccaccucagccuccugaguagcugggauuauaggcgcacgccaccguguccggcuaauuuuuguauuuuuugguagauaugggguuucaucguguugcccaagcuggucuugaacuccuguccucaaguaaucugccugccuuggccucccaaaguguugagauuacaggcgugagccgccaugccuggccuauggauucauuuuucuuuuuuuucuuuucuuuucuuuuuuuuuuuuuauugagacagagugucacugcgucgcccaggcuggagugcaguggugugaucuuggcucacugcaagcuccaccucugagguucaagcaauucuucugccucagccucuugaguaguugggacuaaggugcaugccaccacaccuggcuaauuuuuguauuuuuuaguagagacgguuucaccauauuggucaggcuggucucgaacuccugaccucaggugguccacccuccuuggccuccgaaagugcugggauuacaggcgugagccacacgcccggccccuggauucauuuuuaaccaugaacuacuugagugaucuuaauuugccaucuggucccuggaaggaauauuaauauuugaucccccauuccacuuuuaaguuuugguuagagcugaccugagcuaguuccuuuuuucuguuccuguaaaauucuauuuuauuaucuuguucucuuucuaaccuauggcaugagucuuuugugcuacccauguauuaguuuucuguugcuguuguaagaaauuacaacacacauaauggcuuaaaacaacacaaauuuaucaagaucuuagaaggcaucaacccucaguccugaucuugagcugggaagauuuuccuggauuaucugugcaguuaucacaagggucuucauaaagggagucaguagugucagagucagaaaggucugaggaugcuacgccaggccuugagaagagagacagggaccaucagccaagacaugcagguggccuccagaagcuggaaagucugcuuuccccauggcucuucucauuggcaaggcugcggcugccucuugcuguuuuccugcuccuuaccuggcguuuuuaaaggucauggguugcucugcccuaggguagcccucucagaugcucccgcuagacuccauguagauuuugagcccuggacuuccggguuguuuuauggcuauucuucacuguccucuucccucauuagaccaaacauuuuugggggugggaacugcggccuccucaucuaguaguugggucauauuuaggccauuauuaucagcaaagacauuuauagugaauucauaauuuuuaaaguaaauuaagaccucccuacuuuuuaacccugaucaagucacugaacuuuuuguagguccguuucucuucuuuaaaaaauggaagagugaucuuauugguuuguaaccuuuuugggagucauagaugcuuuugagaaucugaaugcuuugauuuuuauuccccugacaaugcacagauccacaaagaaaacacuuuuaggggaauuacagauuccugagguuaagaacccuugguuuaggugcacuaaauggcaucuuugacuuuucuaugagucuauuagaagaugaugauacuguaaaacauuguagaacaguuuuggaaaugguuucaugauuucuggggguacuguggcuuagggacucacacugcuuccuuuaaguacuagcgugcuuaauuauggaagacaaucuagaggaaauggaugaaauuaaacuaggagaguuuuaaaaacucuuugucuagguaauaguugcgagggugagucuagauuucugaucaggaaaaaagcuguggcuucuuaugguucacacauucaguuccuugaaggcaggagcaggacccauagacaauuuguaaagaaucauuucuuuuugcuucugaugcugguucugauaacaacaacuuuugaaguuuuacguauacaggcugggugcgguggcucacgucuguaaucccaccacuuugggaggccaaggcggguggaucaccuguuaggaguuugagaccagccugggcaagauggugaaacccugucucuacuaaaaauacaaaaaaaaaaauuagccgggugugguggcgggugccuguaaucccagcuacuugggaggcuaagucaggagaaccuccugaacccgggagguggagguugcagugagccaagacugcaccacugcacaccagccugggcaacaagagugaggcuucgucuuuaaauaaauaaauaaauaaauaaauaaauaaauaaauaaauaauguauacauauaaaugccugguuugaagauagaggcagcuggguuggaaagauuuaggaugguggcauuugaaauauuguuuuguucaguugcuuucugucuuuaagaagugacaacauuuaagagagaaagaaagagucauuuuaugauaacauucgaguucucagcagaccagagacuguuucccuaaaccuuccucuggccacuguggaucacuuuuugauuuugugggaacacucuguaauuuucuuagauuuggagaaaagccggcucuagaacugacgauuucagaguaacaguauuaggaaaugugagggaagcauucauauaugauuuuguguguuauaaucagggaccaaaagguguuauacacauucacacacuugagauagggaauuucauugccuuauacugaugcuuuuaauauuuuggaacuuggaacgagucauauuuaugaacacaaagaaacauucuguugccugggccuuaagaguaggguggaaguagaauccacguauguuuuucagucacugauguagguaaguagaaaauuuccuuugggcacauugauguguacccauuacccucaugcuguggugcugggcuuucuaaacuacaccagcuggcugucaaauaguaggcauuccauucagcauuauugaaauuggauugaacucugccugauuaacucagugcuguuaugcacaguaugacuugaguugauacuuugcuguugacuaugucucuuuuguugugguuucagaacuuacuccagcaaaaggacuguaaacauggauuaucugucgcuucuaagggaugcacuuguacagcccuugaccucacaaggaguagacggaguacaggauguuguugcacuuauggacacauauuauuugaugaaagaagacuuugagaauaucauggaaaucagcagcugggguggcaaaccuagucccuuuucaaagcuggaucccaagguaaaucaugucacucacugguucuucgucacuuucuauuaccagguuuguacugacaauacuucggagguguuuuagaugcuuuaagauuuacuucuuuuuccccucaaaugcuuguugcuucuuauggccuauauuuuccaaagauacuauuugaaugcaguauuaagaguagacuucugggcuugacuuuacaauuuguauuuuuaucuuugcuuuaugcucaguggaaaagcaagaagugaaauuugaggagcaaauauaaauauauucuuuauaaaggaugaguggaugagucuagggaauuaaaaguugagcggugagcucuggugguaauggguuguaaaaauaaaauauguuuauuggcugaggauuuguacaaauuuucuuuuucuuagucuaccuaaucuguggauucaguauuuauuccaguuggauaaucuucucuguaauaauguauccccacuuuucuuauaaugagacgaaaaaaacuaaagugauacaucaugaauauguaacauccaauacccaacucuugcaccuguguaaugaaugcguuuuagaagacauauucucuguaguuugcccuccccagaauuuugacccgacuuuaugguuaucaguaaauucucacagcagacauccauuguuagaauucauggacuaauucaggaauuauguuuagaagcuugaagguaagacuuucaaguuacuuaguauuuugaaguaacuacucuuauuauggaaaagguaucuaguguuuuguggaaauuaaaggccaacuuauaucuugugaugagcucccccaaccuuuuuuuuuuuuuuugagacagucuagcucuguugcccaggcugaagggcaguggugcgaucucggcucacugcaaccucugccucccggguucaagccauucucaugccucagccucccaaguagcugggauuacaggugcacuccaucacgccuggcuaaguuuuguauuuuuaguagaaaugggguuucccuauguuggccaggcuggucucaaacuccuggccucaugugaacugccugcuuuggccucccaaagugcugggauuacaggcgugagccaccacacccagccgagccccuuuuugauuuacugauucacugauuaacuuugcuuacuacuuuguagaaauguggagaaugcugaauagguaaacaugaugacuugaagugaccuuuuguuuguuuguuugccuaaaguucccaaauauauauauacguauuuuuuuuuuuuuuagacagaaucucacucuguuacccagccuggagugcaguggcgcaaucucagcucacugcaaccuccaccuccuggguucaagauucucauggagaagcaugagccacugugccccaccuucagucuuuuuugucaugggcucuauuaagaauguuaugaaaaauauggaacuuauccacagaaaaaugcacguacuuagauuuacauguauauacauaaauacuuugcaaacaguugcagggggcucccagggucucuuuaggcuuacagaguuuaaaagaauuguuugggacuuagauuuuuaaaaacuccaucuacuccuuucauauaggugaaagcagccuucacaagagcuuacaauaaggaagcccaccuuacuccauacucacuucaagcuauaaaggcaucuagacacagcacaagcccaucccuggauucggaauacaaugaagaauuaaaugaagaugacucucaaucugaugagaaagaccaagaugcuauagaaacugaugccaugaucaagguaguauuuuaagccacagacaggagaaccucaaaauagaugaucuuuccuugccuggugaauaauagggccuuuucagcacauagcagaauaacuugaaaauacuucuuaaguuuuuuuguucaucaugguugaggguggagaagguagagauuucauuuuuauaaaguuucuuaugguagucgaagagccaaacagcaagaaaacaggccaugauauugacggccauauguucuguuagaaaaaguaccauuuuuauuuaucuagccauugguguaugcuuucaagaaaaauguuuguaacaaaacaguuucuucuguugcuuauguuuugcuauagccacuaaacugcuuuguagaaguuucuuagagcaaaacauucuugucuuuugaugggaaauaugaaaaccaauugugguaucagccugcuguguacagcuggcugagccaaggaaccucaucugauccuccucuguccuucgcugggugugggugcuucuugcccuucauuucuguuuucuguaugcaggaguaggaauaguggccuucuucacuguggcucccaugucgacccuaacagguggucuuccucucucccucucuucugcuuucacaaaaugacuguuuacaccucuaaucugaaacugaaagaagaggaaauucuucaucuaaacauuacccuauuugucaauuaccucuugcuuauuuugucuuuccuaaguauaccucuguucuaaauccaagaaacugucuuacauggggaacggauccuaguucuaaauucuaaacuaaaaguuuuuacugccagcuuuuaaaggcuguaaguggcgcaguuguugcuguaagcgcuucauggguugcaguaguucaagaucucgauguuugcagccucucuucuuuuuuaauuaaguugcagguaaagauuagauuuguuauagagaugaacuuauuucauuuacucauaaacacagcuauuaacuauuuuguuaucuucccccuaacagaaaaagacaaaaucuucaaagccuucaaaaccagaaaaagauaaggagcccagaaaaggaaaaggaaaaaguucgaagaaaugaaaccauuuuucacuagcgacagccacuuuuuacucucccuccugaccaguccagcuggucuagagaaagccuuguuuuuucccagagcaaccauguuuuagcauaaugggaugaccuggugucccauuauaaauaaagggugguauggcuagaaggguaugagcaguaggcuuauguacaccucuuauagagguugauaggacugcuuggguccuccacuguccucugucaaucuaguuagacgugcuucugaaugacuguagaauuggaacuagaaacuacaccugggcuuuggagucagauuuuaguuaacaauaaugagccugggagcaguaguacuaaggcgucuuuuguaggcuuaagaauuuauccuaauggccuuuauaggaccaaugcugauuuuuuuuaaaggcaguuccuauuauguggugaaauuuuguaaauaaaugauuauacaaaacagucaccaccuagaacuggguauucuuuguacauugucagauaucuuucaaaguauaaauuaggaauaaaaauguuccacaugauauguguacaaauucuuuuuaagauugucaucuuguacagcaaaauauuauguugguauauuacuuccuuauuaauuugcaaaugauuggauuaaaaaagcucacuguauuccuuacuaaccuguugugugaaacauaacauuggcagucgaggagucagaacucggauucccagccucacucccucuguguguguugaccacgucucugcugugaauaggauuucaugcaguggucuguuauggggcuuugcagcguggggggcugcagaagauucucagacauucuuauccuucuggagucucaacccaucagguucagaccaguaggaaccaggcugggucaggcucuuaauuucacuauggugggggacaaaaugaacacuggcuuuuguucacuuugccccugagagaucuaguccuguccugugauggcuuccacaaacccuguuggaaguuuggguuauuccuauaacuguauguguugaguggccgugaggcuauggaccuagccuggaauuuagaugucuagcuauuuuuuaaucuuguugguaaaugcucagaggucugugcuaccucugugagguauauacuaaaaugaauguaaaauaaggaucguauucccugcuuuaaggaacugguagucuuguuugggugaugagacaaaguucuugagacauuuaaacuguauuuaccagugugaaaaaugucauuuauggagauuaauucauuauggaaauaaaacauugccuaagcccuugccugcug

SEQ ID NO: 191473 - RNA, 18607 nt, Homo sapiens
guaauuucgaccuguccuuucccgggaguuagcgaucccucaaccccugcacugcgcuaguccuaaagaggaaaugucucuacgcugcggggaugcagcccgcacccuggggccccgggugagcggcggggcgaacggguuugggcgugggguggggggauccuaucccuucagagcgcccaugcccaauaauaaaggccagugcauuuacugaacauuuacuacuagccaacggcaguuuuaaacguuuuucguguaaucucauguaauuaucccgccagccccaugauauagagucucuggcaucaguuuguuugcaagucucucugggccagcaccgaggacuuauuuucugcuuagagugguuuguacccuauauuuauggagcacugcagugagcaccccacauagcuauucugucuuggacucuuacugugugugagacaccacucuagccgcagagaacacaaaccuguccgcuaggcuucagcggcagacauugagaagugcaguagcaaucgugcaacacccuaacaggcacucuuugaguugucgaagguucuuuugagauacaugugcagacucguggauuuuguaguguuuuggcuaucucauacacguuuguguucagauguaaaagccgaauaccaugauuucuuauguucuugacugccacguucaaacacagaaacaauguaaccuagaaaguaaaaacguucauccuggccaacauggugaaaccccgccucuauuaaaaauacaaaaauuagcugagcgugguggcgugcgccuguagucccagcuacucgccaggcugaggcaggagaaucgcuugaacccgcgaggcggagguugcagugagccgagaucgcgcaacugcacuccaaccugggcgacagagcgagacuccaucucaaaaaaaaaaaaagaaaaagaaaguaaaaacguuaggcuugguuuuaaccuuccaguugucugaaacuaauugggcauuauuaaccuacguuucaacaauuauucaaagcucgagagauuuauugcacacuucacuuuaaacgccccugauucaagucaggaccagaacaguuuuaaacuguggcaccuucuucaguuauugcaguucaaucuuguugaaagacaaacaucuaguuccugguagguggaguacaugaaagugugauauauguuaguuccagagauuuucgggccgggugcgguggcuuacgccuguaaucccagcacuuugggaggccgaggcagguggaucaccugaggucaggagaucgagaccauccuggcuaacauggugaaacccugucucuacuaaaaauacaaaaaaauuagccgggcgugguggcgggcgccuguagucccagcuacucaggaggcugaggcaggagaauggcgugaacccgggaggcggagcuugcggugagccaagauugcgccacugcacuccagccugggcaacagagcaagacuccgucucaaaaaaaaaaaaaaaaaaacagauuuccaaaucuauucuaaacucaguaguaaacagucaacucuuacucucuuuuagguuugguuccuucagucaucuuuuauauucuaaugcccuagaauacuagagcuccuaguuugacauaauuucugaaucacuuuuuuggcuuuacccuuccguuuagguguuaugauggguuaaaacuaaauuauuacggacuccacuaaauaaacgucauaauuaacucuuucuuuagguauuugggagauauuuuugcagcccagucagaccguuaagcuccuugccagauaaaaaaaaggaacuccuacagaauggaccagaccuucaagauuuuguaucuggugaucuugcagacaggagcaccugggaugaauauaaaggaaaccuaaaacgccagaaaggagaaagguaauugaaaauuugagauaauuuuaacgucccguuccuuuauugugcauuauuuucagauauaaccaagcccuagaaucuguuuuuaauaucagacuuguuaaauuuagcuaaaaaucauuagaaagaugugauaacagaacuagauagaacaaguaagcagaugaaauuuuuggaaucuuucucuuuucucuugcccuuacuauguuacacugccaucuccccauuuucuacccagcauccaacuucuucagaguaaagauuacugcuuugcuacuagucuguuagaucuggguuaguagcuguugaugaucuaacuugugcuucuccuagucaauuuacaugugaccuauggauaccuugccuuaauuuaaaagaaugauggaauuuuauguagaagguagauugaguugaaagauaacuuaauccugcuccuucuauaucacaaguggauggaagucauggagaaccaaggauacacagucuccaguccaaauuuuagaucuuuuuuccauugaguaaccacuauaaaaucuagaauguagagcagacagugcacaguugugaucuuuccucagucuaaacaaguagaguacuuuuuggcaguaucauucaugagggaugagauauuugaaaacuugcucauucucuuauuagaauaguguaacucugccuuugcaaaaaagguagacgugaguauagcgcccuguuacacuccauuauugguguuuucuuuuuguuuguuuguucuugagacagucuugcucugucacccagguuggagugcaguggcacaaucuuggcucacugcaagcuccgccuccuggguucaagggauucuucugccuaagccucccaaguagcugggacuacaggcgccugccaccacgcccggcuaauuuuuguauuuuuaguagagacagggcuucaccauauuggccaaacuagucucgaacuccugaccuugugauccgcccaccucggccucccaaagugcugggauuacaggcaugagccaccacauccggccauuauugguguuuucuaaagugguuugagcaaggcuaaauuugauucuguguucuuacuccuaugacagaaauuauaagaguuauucuaagguuauagaaaaaauuauuaacuaggaauuguaauagaagaaauuaacuucaaagcuguguaauuauuuggcagcauauuuguuaauagauaguuauguuuggcuuuccuuagguuaagacuaccuccauggcuaaagacagagauucccauggggaaaaauuacaauaaacugaaaaauacuuugcggaauuuaaaucuccauacaguaaguugucaaaguguaaacuaucccucuucaccaaaagccauguuucuacguuuauauaacuuaaaaauuauuaauaaauauauaaauaauagcaaagaaaguaaauauguuaagugauacauuacuaccaggaauggaaauauauuuagaaucauuuuuccggcaaacaaagagauuuuuugcccuacgaguuuggaaacaaggcuuuguuuguuuuauauugcaaauuagauauaugauuuguuggaaagaauauaaaauuaaauaugaagguaugucacauacgcaaugccauauauaaaccauacuccuuuaccuuuaacucuucaguauauaaucuuucagacuuuuuuauuugcacauaugaaguauauacauucguaaaguuuuuaauuuaaaaauuggauuuuggccaggugcgguggcucacaccuauaauuccaguacuucggaaggccgaggugggaggaucaccugaggucaggaguucaagaccagccuggccaacauggugaaaccccgucucuaauaaaauacaaaaaaaauuagcugggcgugguggcgugagccuguagucccagcuacuuggaagucugaggcuggagaaucacuugagcuugggagguggagauugcagugagcugagauggcaccacugcacuccagccuggacgacagugagacuccaucuuaaaaaauaaaaauucaagucuguccauucuuacauaauuauguaagggaguacaccucuauaggacaugcucacuacacucuaaucuuaauauagaguugggcaguuuaacagccuuuuuuuuuuuuuuuugaagacagggcauugcucuguugucuaugcuggagugcugugguacaauugccuugaccucccaggcucaagugauccucucuccucagccuucugaguagcugggaguauaggugcacauuaccacgccugacuaacuuugauuuuuuguagaggcaggauuucacuauguugcccagacugguuccagacuccugggcucaagcaauccuccugccucagcuucccaaagugcuggaauuacaggcaugagccagcgcacuuggucuuaacagcauuuuugaauagugaaugucuucaaaaauauguuguaaacaaugagaaguuuaaaaugucuaaucacagucaccaacuguuuaguugguggauauugucaaccuaaugguguuccauuuccuuuugcauacagguaugugaggaagcucgaugucccaauauuggagaguguuggggagguggagaauaugccaccgccacagccacgaucaugguagggccagccucaaccucuauggcuuuagucuagaaacugaaagggacuauuuugugucuuccuccuaaaaaugugcauuaugaaucucuggucagauuuuucauuacauuugcauuuaugaaaaauauuaagaaaaaaccugauggaauaauccaaccuguuguaaucucacccuucucugaauaaaucuauuauugguucuuucauuuaugugauaguuaaucacgugcugccuugagauaccucuccuaucaauguuuggaaacauuauucaugauugcuuagcuuuuuauguguuuucuguuuaacauauucaacaagaaggagcugugcuuucuguuuuuacauccauagagaccuguacauugaucugucauauauuuuaugucuuuuaaaaucaucuuuuuuuauuauugaauagauauaaaaguaucuucauaggccgggugcaguggcucaugccuguaagcucagcauuuugggaggccaaggcaggcagaucauuugaacccaggaguucaagaccagcugggcaacaugguaaaaccuuguccauacaaaaaaaaaguuuuuaaaaauuagcugggcaugguggcacuugccuguauacccaacuucugaggaggcugaggugggaggaucacuugagcccaacagguugaggcugcaguaagacaugaucaugccacugcgucccagccuagacuacagagcaagacccuguuucaaaaaaaaaaaaaaaaaguaucuuauaaacuguguaaguuauaaagaauaacacaacagacacccucauaccuccaguuugagauuaaaacguuagcauuaucuuugaauaccccucuguacccccuaaacuguauauuagaaucccauuuuucaguuguguuucuauuuuguuuuaagaaaugggggucucacucugucacccaggcuggagugcaguggcacagucauagcucacugcagccucgaacuccuaggcucaaguaauccuccuaucucagccucccuaaauaccugaggcuacagguacaugccacuacacuagcuaauuuuuagagacagggucucaccguguugcccaugcuggucucagacucuuaacaauccucucaccucagcuuccagaguagcugggauuacaggagcaagccacugcacccugcuuuguuuuuaaauuuaaauuuugcguccuuuccugaucccauccccuuuccccugaacacuauucuuauugcugaguuuauuauuucccuuuuuaguuuuaucacauauauuuauguuccuugacuaucauuuaguuuugaauguuucaaauuucuuauaaacagaaccaaacuguaugcauucuuugcaacuugcuuuauucucucaacauuauguccuuaagggucaucugucuauuucauuuaaauuguaacauuucuauucuaguugaugggugacacauguacaagagguugcagauuuuguucuguuaagacugcaagaaauccuccuccacuggaugccagugagcccuacaauacugcaaaggcaauugcagaauggggucuggauuauguuguccugacaucuguggaucgagaugguuagugugucaucauggccucuaccagaaacuggcucuaaaugaugacaucauccugagcaguggauucuuuuguuucuagauaugccugaugggggagcugaacacauugcaaagaccguaucauauuuaaaggaaagguacuuauuuuugcauuuguguaauuuaaggaccuuuuuggacccauaugaguuaaguuuaaguucauuaccuugaaacagggauuauucacuuuuugaggaguuucauaguuuucugauaauucacuggaaauuauguacacauuucuuuggaaaaagcauauuuguauguacagauacauauuugcagagaauuuuaggggcucagugacaugaacuuacccauagaccuuuagcccauagaaucccucccucauauuagagcauuagucuaaacuuugaauaauuuucuuuaaaaaguauaaaccuggucuucuuaguaaugauuuuuuuuuuuuuuugagauggagucucgcucuuuugcccaggcuagagugcauggcaccaucucacugcaaccucugccucccaguucaagcauuuauccugccucagccucccgaguagcugggauuagaggcccacgccaccaagcucagcuaauuuuuguacuuuuaguagagauaggguuugaccauguuggccaggauggucucaaacuccugaccucaauugauccacccaccugagccuaccaaagugcgggauuacaggccugagccaucacgcccggccuguuuuuuuggguuuguuuuguuuuuucuuuuaagagacagucuugcuuugucaucuaggcuggagugcagcggccugaugaucauagcucacugcagccucaaacuucugggcucaagcaauccuucugccucagccucccaaguagcugggacuacagguacacuaccacgcuuggcuaauguuuuuacauuuuuuuuuagagacggaaucuugcuauguuccccaggcuggucucaaacuccugaccucaaccaauacuccugccucgcccucccaaagugcugagauuauucuaauuuucuacagcucaguacuaguuuggcaccuaagcgcacuuaguaaauuuuuuaaaugauucccuaguauuuucuauuuucuauuuacuauaguucauuuuugaaaaaucuguuugcaauccacuagguuuauuuuacaagcuucagugggucucagcuuucaguuuaaaaaagcaauagaaccaagcacagugguucacgccuguaguucuagcacuuugggaggccaaagcaggaagauugcuugaggacaggcguucaagaccagccugggcaacauagggagaugcugucucuacaaaaaauaaauuaaaaaaaaaaaauagcuggaugugguagcaugugcccauaguccuaccugcuugggaggcugaggcagaaggauugcgugagcccaggaguuuaaaguuacagugagcuaugaugcacugggcaacagagcaagacccuguuuuuauuuaaaaaaaaaaaauuauaggauauguucuuugaauaucucuuauauucaugauaaggguguacauguggucuuuucuacaucuguucuuucagggaacaacuccagacacuuugccaguggguuugugaaaaaaugugucagcuguuucagucguuuuugcuggugucaaagggaacagcucugugacccaguucacauuauaauacuuggaugaauagauauagccacaauauaaauaggaagauuaauguuuagcucguacuucguuuaacaaagcucaugacucagcaacccagaaaauaguuuuuaaaacccguagcacuugugaaauauuugccuagaggaagggaggagagcaugauuugaugacuuuuuaaagaaaucaaaauuaaagcaaucaaauaauacucacauuuauauaagaaauacuucaauuuacuuuccaaugaguaaaguuuuauauuuaauguuuuaauauuucauauuuuaguuucuugcaauuauuuacuuuuucuaaaaccuacuuaaauuagguuuaaaagucuacuauauauaauuugaaauuuuauucaguuugccuacagguguguuuuaaccacuguguacauaguauuuaacggucugcuuuuuuuuuuuuaauaaugguucauguaugaacaucuguauguucauacuuuucuugacaaaguucuaaagguuacuguguugaagcauacugaacgauuacugauaauuucuauuuugaggaacagguaugucaguucuuucucucuguuugauaauucucucuuuuccccuuaggaauccaaaaauccuuguggagugucuuacuccugauuuucgaggugaucucaaagcaauagaaaaaguugcucugucaggauuagauguguaugcacauaauguagaaacagucccggaauuacagaggugaauacguguacaaaguaauguugggaaguuaggcgggucaaaauaugccauauauucuugccuuuuccagggcugaacuuugccauugacuuuuacaaaguaaacucuauucuuuuuuguuuuuuaggcaaacucaaucuaugucucuuacauaaaaaucagaaaauaucaccaacaaaaucagcauaaauaucacccauaauaguauuuccacccagcaauaucaguuacuaacaccuuaguguuuauauuauaaacacuauauuuauacuacauauuuguauuuuuauauuuauaauauacuuaauuuuuauauuacaaacauuaagauguuaguaacucauauuacuaaguuacuguguguguuuuaauacccacaaauaauuaacaucuuuuuucuuuuguuuuaaaauaauaucauacugcaaauuucaauaaguuguuuguuucccccuccccacaaauaaaguuuucaaaggagggaaaaaauuacacuagagcaauugcuuugguuguaauucuaaagaaaagacuucaaaaauauauuuggcuggaugcuguggcucacgccuguaaucucagcacuuugggaggcagaggcaggcagauuaccugagguugggaguucgagaccagccugaccaacauggagaaaccccgucucuacuaaaaauacaagauagccaggcgugguggcacaugccuguaaucccagcuacucgguaggcugaagcaggagaagaaucacuugaacucgggaggcggagguugcagugaggugagauugcgccauugcacuccagcuugggcaaaaagagcgaaacuccaucuagaaagagaaaggaaaaaaaaaauauauauauauauauauauuuuuuuauauuauauauauucauauauauuuauauauauauauucagcacuaauauguguaauaaaugaugcagaagaaaaacucguggcucacgccuauaauccuagcacuuugggaggccgaggcgggcggauuaccugagguugggaguucaagaccagucuggccaacaugaugaaaccccaucucuacuaaauauacaaaaaauuuuagcuaggugcagaccuguaauuccagcuacucuggaggcugaggcaggagaauugcuugaacccgggaggcgaagguugcggugagccgagauagugccaugguacuccauccugggcgacagcaaaacuuugucucaaaaaaaaaaaaaaagaaaaaaacucauaucauucagauguacuuuuuaaaaaaaguagacacuaugcuuucuuauuccuaauaauuucaguaauuaagacuaaucauuggcaaguaacacugauguaagaaaaaaaguaaggauuguuauccacauccauucaaauuuuagaaaaaugaacauuuuaagcuucgggcaagaguaauaucauuuuuuucuuuaauuuuagcauuuagcagugauuuuauuagcuucuacauaugaucugugucauagagccugaaagaaguuacaguaaacaauaaccaccauuuucacuaaaucauaaacaguagagaccauaacuuaauuucaguggagaaauucuguuaaaaagugauuucuauaaugucaguuucaguuacuuuuaaguucauaaauuuguuucuucucuuuccuguuaacuagucuccaaugaaaaacaauuacagaaaauaaagcugcauuagaauugaaaugaaauccaguuuaacaucagaagcuuucuggccuuuuggcuuaaaggauaagucauuuaagccauggugguuuggccauuguugaagucuaggacacagccuguuccaaccucaucaugauaccaccaccagugggugccaguuucccugguuucacuuaaaaacaugauccuuuccagugaaaauuccagaaucaugcauuucuuuaccuaauauguggcaguguuguauacuuaccagcagagggcagcuuagucuucagaaaagaaaugaacuugaaaguuucaacccucugacauguggguucagcuuauuuuuuucuuuguucaguauggagacucucuuacuucugcuuuuuuuccuuucucuucuaauuuuucgcuucagaauucugguuucucaaugcauaaacugaaguaauuucuuccauucuacuuuucucugccccaggcuugagauagaacuagggagcccagugaggccuuuucuuuccuaaauuaacaggcaucugugcauaaaugcuaccuuugaacuaugugauuuaagauaaugugcagaauguacuucucuggucuuucagguugcuugcauaacuauguacuugguugaacuuguaauucuugcugacaacaguccugcuguuuuccaguaagguucgugauccucgggccaauuuugaucagucccuacguguacugaaacaugccaagaagguucagccugauguuauuucuaaaacaucuauaauguuggguuuaggcgagaaugaugagcaaguauaugcaacaaugaaagguaaagaaauugaaaaaugaaaaaucuuucccauguaauuugaguaauagcaggaacccacucacuuugaaggcccuucuaagaacaaagaaaaguauaugguuauagauggcagcaugaaaaggaaaccaacuugcacaugcacccucaaaucuaaaauacaaguuaaaaaaaaaaaagcaaaggaaauaaauuuucuuggaauuucauggagugauaugcaugacgcucaggauacaaaauuuauaucccauuuuauuccccauccuuugcauccacugaaagcaugauuucauccacuuuucucauucuaucauuggacacuuuuggagagccagccugguaccaggcacugacaguucauagaucaaugagacuaauccaggccucugagaaagagcuuacuuguagcauugucacauaacauggugugcuuuggacuuugcugaacuuuagucccguaaguccauuugcuuugugauucuuggacuuuuuaaacuuuggaauuucaaaguuuuaauuuuagcugaggacccuuggacuacuuguaguuauuuagugguucaaagaguaauaaguucauauaauaaucaagaccugcuguuuaccacauugcacacaguuuauuagaaagauucugauaugucauaguuuaaaucacagcccccauagcauaucuugugcauugaguaaaagccuaaugcaacauauuugcucuauaauauaggugcauugagguuuuugcauauaccauuucccauaccuuuucuaccagacuccuacucuaaaauacccuccacuacuauuuuagcauugauuccauaguauuagaaguauuuauccuuguauguaucagcccuacaugacugucuuaauuauuauuguuuucaguccuuaccacagucccuggcacauaauacuuuugaaugaauagauguugucuuauuccccaacaugaagauuauggacugucauaaaguucacaccguuuuuaaauauuccuuaggaaaauuaugcuuagaucuacaauuaaaguauuugcuaauguaauuugugcuuuucuuccuacagcacuucgugaggcagauguagacugcuugacuuuaggacaauauaugcagccaacaaggcgucaccuuaagguacauguaucuugauuugcuuuuuuuuuuuuuuuuuauuuuuaaagauggaguuuugcucuugucgccugagcuggaguguaguggcacaaucucggcucacuguaaucucugcuuccuggguucaggugauucuccugccucacccuccugagcagcugggacuacaggcgggugccacuacauccggcuaaaauauacauauauauaauuuuuuuuuuuuuuuuuuuuuuuuuuugagacggagucucgcucugucgcccaggcuggagugcaguggggcaaucucggcucacugcaaccuccaccucccagguucaaaugauuuucaugcuucagccuccugaguagcugggauuacaggcacacacuaccacacccgacuaauuuuuuuguaguuuuagagacaagauuuugccauguugcccaggcuggucucgaacuccugagagcucaggcaauccacccgcuucggccucccaaagcgcuaggauuacaggcgugagccaccgcacccagccaauuuuuuauauuuuuaauagagaugggguuucaucauuuuggccaggcuagucuugaacuccugaccuuaggugauccacccgccucagccuuccaaagugcugggauuacaggugugagccacugcgcccagcccauguauagcuuuugacucccaaaaaaacauaacuacuaauagccuucuguugaccggaagccauaccaauaacagucaauuaacacacauuuuguauguuacauguacuuauauauauacguauguguguguguauaucuguauauacacacacacauauacacacacacacacacacacacauauauacacaucuuauucuuaugauaaagucagcuagagaaaaaauuuuuugaagaaaaucauaaggaaaagaaaauauauuuacuagucauuaaguggaaguggaccaucauaaaggucuucauccucaucaucuucauguagaugaggacaagggagaagaggaggaguuagucaugcugucucagggguggcagaaauggaagaaaauccuuguauaagugggccugugcaguuaccauguuguucaaggcucagcuguauucuuauaagucccaguuuucauuuuauuaucuacauaaaucagcuacguuugcacauauuugcugccucccccauucucuucacaaauuucacaacucaagugaaccuagagaaaaagaauuuaaaaguugggaaauggcacucauuuacacuugguuauuguguaacuuguuuuuguuauguuagagccagaggcgaagaaagaaugggaaaccauucuuucuauuucuaucauggacauuuauccauucauucaagaagcuuguguugagcagugaccaugugccagucacagugcuaagcagaagauacaaguugaguaagacagucuuguccucaagaaucagauaagcaugaguaauucuugaauuuagcuguuaacgaaggaaaaauauagauaaauaauaucuguagauaaucucuucuuucucuguccuuuggaauagccauuguagcacaaaauugauaugcuucccugucucuguaauucccuguauuuacaucccaauagaguggccaaaaaguaaccaguaaacacguagucagggaggagggagaggacaaaagccugggggugggggcaagauaaauuacgcagugaagagcauucugcauacauagguauagacuuucugcagaaucaaaguggaauucuaaaaucugaucagaaguaauuauuuaaaucuagguugaagaauauauuacuccugaaaaauucaaauacugggaaaaaguaggaaaugaacuuggauuucauuauacugcaaguggcccuuuggugcguucuucauauaaagcagguaaguuagauuguggggcaugguuucauuuaggccguuaacuuuccacauuaaguucuaccaccagucacuaaaacucuugacaaauucuaauaccuuugguggucuugguagagggcguaguuuuucuucuggaacauccuuaggagcuuugcuccauggggaucauauuaagaaaaguuucucuuaaucuuuuguuucuuaaacaaauucagcccccugcuuuguaacucagcuacuauaguaaaagcagaaacaauuaguuuauuaauuuuuucuauguguagauuucaguaguagguuauucagaaaugacagagcaugucaagcaucuaauaggguuuucugagaaauacauauuuauuuggaaaugaugccagcugcaucuccagacucaguuucaaucaguuuaagcacugaaaaguaucuuauuugauagcauugcuugcaucauuaaauuucuuuguauuuuucccccagaggcaacagaaaaauauccauaagauuauuuuucuccguaggaacguuuaguuguuuuacuagcuacaaugcaaauuuuuuuuacuuuuggaauuucagcucuuauuuuaaucaauagcuugaauugauuuaugaaaagaaaaucauuuuccaagggauaaaaagucaugugauaaugauugucggaggauccaaaagaacauaucugaagaccgaauuuaaucuagaaaguguuuaugaugucccugucaguuggacuuaacaauuauaaugauuaagaauaaauuggcuggccaggugggguggcucacaccuguaaucccagcacuuugggaggcugaggcgggcaaaucacgaggucaggagaucgagaccauccuggcuaacacggugaaacccucuccacuaaaaauacaaaaaaauuagccgggcaugguggcgggcaccugcagucccagcuacucgggaggcugaggcagcagaauggcaugaacccaggaggccgagcuugcagugagccgagauugugccacugcacuccagccugggcaacagagcaagacucugucucaaaaaaaaaaaaaaaaaaagaauaaauaggccaggcaagguggcucaugccuguaaucccagcacuuuggaaggcaguuggauuacuugagccuaggaguucaaggaugcagugagcuaugaucgugucacuacagcuccagccugggugacagagcaagacacugugucucaaaaauaaaauaaaaaaaagaaacagcuaggccaggugugguggugugugccuauagucccaacuucuugggagaccgaggcaggaggaucgcaugggcccaggaguucaaauacagccugagcaacauugugagaucucaucucuuuauuuuuuauuuuauuauuauuauuuuuuuuuuagaugcagucucucuccaucgcccaggcuggagugcaguggcacaaucuugacucacugcaaccucugccucucagguucacggcauucuccugccucagccuccugaguagcugggacuacaggugcccgccaccacgccuggcuaauuuuuuguauuuuuaguagagacgggguuucaccguguuagccaggaugaccucgaucuccugaccuugugauccgcccaccugggccucccaaagugcugggauuacaggugugagccaccgcacccggcugaccuugucucuuuaaaaauaaacuagguauuggccaggcgugguggcuaaugccugaaaucccaacacuuugggaggccgaggugggcagaucacaaggucaagagauugagaucauccuggccaacauggugaaaccccaucucuacuaaaaauacaaaaauuagcugggcauggugcugcgcaccuguagucccagcuacucgggaggcugaggcaagagaauagcuugaaccugggaggcagagguugcagugagccaagauccugccacuccacuccagccuggcgaaagagcaacacucugucuccaaaagaaaaaauauauauacaaaaauuagccgggcaugguggugugugccuguagucccagcuacuugggaggcugaggcaggaaaauugcuugaacccgagagacagagguuguggugagccaagaucaugccacugcacuccagucugggcaacagagcaagacucugucucaaaaauaaauaaauaaguaaauaaauaaauaaacuagguauuuuuuuuuuuuaucuaaaguggugauguuuuaaaugauugcuuuauauauuggggucuaaaucuuaaauauguuuaaauuagacaaauucuauuugaaaaaauuaaugcuccaguauuaguaauauucuguauguuccuaguuccuauaaagacauuuaaggccgggugcaguggcucacgccuguacuccuagcacuuugggaggccgaggcggguggaucacuugagcccaggaguucaagaccagccugggcaacauggcaaaaccccaucucuacaaaaauacaaaaauuagcuggguggcugaguugcugggugguggugggcaccucuaguucuagcuacccaggagguugaggugggaggaucaccugagcccaggagguugaggcugcagugagcugugaucgugccacugcacuccagccugggugacagaaugagaccccgucucaaaaauaaauaaauaaaaauaguaauuuaaaacauuuuaaugaacuaguagcucaucauaguuugaaaacccaagaauuugauucagcacugagugacagaauguggggacuuugaaaaccaguaauuguaagugauuuagucuucaagcagcacugcuggcaagcuaaaaauacaugugaaggauagaaccacuaucagcuucuagaaugguuagaguaauguccuuugaaaggaguuuuucuuuugcuaaagaaaaauuucuaacauaaaaggaaguaaauuaugaacuuucugaugcuuucuaaauuaccaggaaaagaucagauucugguauaugaugagcauuagacuaaaaugauggauuagggucugauaaaguuggugcuacucccacgacauuuggaggagguauggagcagcauggauuacuuggcuggguuaugagccuugggauuugcagagauuauauguagauagacucaucacaguucuacucauauguaagaugacaaagagaaguuaaucagacuccucauaaaaucaggccucuagugcugcacucuaccaauaagcauugagucaugcuguaagagcaauagacuaaauggaacacuaauggccuaaaaagagaaugugcccucuaagcugcuaacuuauugcguaggcacaacucaggcgguggggagaaagcccauuacaaaugaagagcucuugcuucccuagaggggaauaagcuaaagagauuccaucagaugcgucugcucagcugcaacgagaucuguuuuauaaacaucagauccagccuaauaauguagcaaaauugcucuuggaaaugaauuuugccaagagcaauacuuugacagugaugagggauagauagugcacauaaaguagaauuaaugugcagacccauauauacaguagggucacccuuuguaauauuggcuuacuagaaagaauaauaguaggagacucuagucauuauugcuggggagaaaggccaaagauaauaggggauauuuagguuagaaaaauauugccauugagguuugagaagagagaagugccaauaaauacaaaagucuucuuuaaagggggaacaccaaaaauauaauucugaaauaguugucucacuguuauuuacuuuaaauugauauuaauguguuuuccuuuuuccuaaauaggugaauuuuuccugaaaaaucuaguggcuaaaagaaaaacaaaagaccucuaaaacuucaacaagaccuucaagaucacagaaauuuuuaaaauuugauuccaguuaauaacagagguggugccagaaugccuggacugcaguggaugugccccaccucuuugcuuaaaaaaaaaaaugucaauagccaggcauaguggcucacgccuguaaucccagcacuuuaggaggccaaggcggguggaucaccugaggucaggaguucgagaccagccuggccaacauggugaaauccugucuccacuaaaaacacaaaaauuagucaggcgugguagugggugccuguaaucccagcuacucgggaggcuaaggcaggagaaucacuugaaccugggagggggagguugcagugagccaagaucgcuccauugcccuccagccugggugacaagagcaaaacuccaucucaaauaaauaaaaaggaaaaaaaagucaauaaacuguacaaauuuaauuacaguaauucauuuggcuuuuaguguaucuucuuugucccaauuaaacaguugcuugcugugauguaaucuuaa

SEQ ID NO: 191474 - RNA, 155094 nt, Homo sapiens
uaaugcugcauuucuugguuuuauuugaaacagugcauauuuuuagcauuuuaugguaggauuuuacacuugucauuuacacaaauuacaagguucugcuucaaguuuuuaaaaaaaauuuaaaaauucagcccaugugcagcacaagaauaugcaaaacuacuuuacauuauacacacuuuuuaucaaaggagauacaaaauucuggcuuguuguuuuagacaaauacaagaagcuucaaacuagacacaaaggguuaacauuaauucucaaauauaagucugcacuuuuguguuguaguucucugagaugugaauaccaaauuccuaagggauuuuaauguuuuccuuugaaaaggaaaacuaaaaaaauucccguaaacaagucccuccccaucagcuuggucuuuccacaacccuacucuugcuucccuuagugccagacacuugcaucauguuacaaaauuggggugggccacuuacaucauacaaggagcaaauccuuuuaacuucucuccugcaaaaaucuaaacaggaauauauugaugcagaugguucugcuacauuuuauuuaauaugauguaacacuugguaaucuaguaaacugugaugccgggcaauuaaucaaagggaggaagagacaaaggucccuaucaaugcacuuuuuguuggugacacacuggaaaccuuaggaaucaaguugucugaugcuaagagaacuuuaaacucucucuaaauagaacacaccuacugauugcuugagggacuucucugauacuuaugcauagauacucuuuuucagcauguuggaggcaauauuuuauacuuucuaaaggguucugaagaggcaauaaggaagaguggggauuuuucugccccuguaaagguaucauuuucuaucauugguauccauuguucccuaagcaucuucugauaccuaaauguguguaaaugcauauuuaaaauaauuacccaucuuucagucaauacacagccaacucuugauuaucuaugagaaacguaagugacauuuacucucaaacuucacucuaacagaaucauccaccuuugauacacuuguuuguuuuacaucccauguacacuacagccuaucaagacgaaguuauaacacaaauguuguuuccucugacccaugcuagaaacguguaaggaaauggagugagcacauucugcuagggcuuugcggaugacccuacaguggacagugggggcaggauagaacucuggacaugagaaaagacaaauuucauguuccuccagaaucaggucuuacaugccuucguuauuuuguuaucacaaaauuaaaaaccugaggcuuagucacuauuuuauauagauaauggagaguugacuguaaucauguuaugacuuuagcucuuuaacaugaaaaaauucacaagaaagcauaugauaaaaagauuaaaaagacugccaugacaucuagaagcauuuauuuuaugcaaaaaacuuaaauaugauuauguguacacauaaagugcacacauuaccuaugcugaacaaugccaagaaacauaauauauugaugcaacaguuuucuaaaauaaacauaaaaaugagcccagaccaucagacaaaagcaaaacacuuauuuccaaauagcacaaugcugaaaauugauagcaauccuaaaacaccuccaacuuuccuuaaaagcugccaaaguccaacuauuuuuuaaaaauugauuuuuuuuacauuaauaaaaaucuggugacaaacauuauaaaaccaaaugcuggacagucuuuacuccuuuaaaauuccaaauauuccaacauaaucacaggaguaaaaaccauuuuaaagugauaugcuuuaugaaacaaacaacaauauguacauuuauugcaaauuauauuaaacuaaaaugaggggaaaucaaaauaugaacuguuuacuacuugcaaaucaauaauuuuaauuuucucacucugauaaaaaucagaaagcaacauuuauaaaauugcuaccacaucacuuuucauagcagggaaccgaaaucuguacaucucauuuuugcagaaaaguaggcaggcagaaagaauuauacauaaaaguuuccaaaaggaaaaacaaagaaauauuuaaucugaucucuuuucuuuuaaaaaauuaauucaguagacuucuauuuuuuccuguguaacaugggaauuccuggcucuaaaauggaugaauuuucagugucaguguaaagacaucuuguuacuuucuuuaaaauaaaaacugcagcguggaaauuaaugguguauuacgcauuuaaacuccagauaggcaggaacuggaaccaaguguuaagcaauuugcuuaauuauugacuuuucguaagaaaagucuaggggaagggggagaacagaguugcuuuuagccucucucucaagaguuucugcuguacauuuccaucagaggacuuguggucaugugaaaaggaaguaauagucucuuuaguuuucaaggcagagaguguguguucugaagugagcuucauuuucuguucagggacauuugugaauccaaguuuuugcagaagcuggagccugcuucuguuuggccuucauuuucucccuuugcaaaugcauuuuuaccuuaggguuaagaauagaacgcaaaguuagaaaagauguggagaagauauaaaccaaacgaaaaugauuucauuuccauaguuguuaucuaaaaucuuuuuuuuuuuuuuuaaacuuaagcaucaggaucucacucugucacucaggcugaaguacaguggcacgaucauggcucacucagccccaacuccuggguucaagugguccuccaggcucagcguccagccugagccucccaaauagcuagaacuauaggcgcacaccaccauggcuggcuaauuuuuaaauuauuuguacagacgggaucucauuauguugcccaggcuggucuucaacuccugagcucaagcgaucugggaagccugcgcuucucagauucacuacugggauuacaggcaugagucacugugcuuggcauguuaucuaaaauccuuaaaaaguuuuuucauuuuuucaccugaaacuugguuuaaagagccuuucccuaaacuauauaaaaaccaaacaccaauaaagaaguuuuuguuuucaaugacuuagugcugcuauccaaugcccuauuugcuuacaacauuaaaagcuauuuaucauacuauggcaaaaugaauuuauaagcagcaaaauaacuucugacucaugagcuggguaaacauaaacguuuuagcauacuaaaaacaucccaaccaaacuggcguguuuuuuuuuuuuuuuuaaacgcauuucccuaauagggagggaaauucugaucccuggaagcacaggagagugggacauggccucuuucucaccuccucucaccuacuccucuuugggagaaggaggaacucaucuaauagaugagauuagggaaaaggaaugagcauguugggauugacuucaucaauauuuguucuuuugcccugagaagugcauucugguuugucuguggcuguucaauucaguggcaaggcauuagcagcccaacuugccuaauucauuccacauuuuuauuuauuuauuuauuuauuuauuuauuugagauggagucucgcucuguugccaggcuggagugcaguggugugaucugggcucacugcaagcuccaccucccggguucaagcgauacuccugucucagccuccugaguagcugggacuacaggugcgugccaccaugcccagcucauuuuuuguauuuuuaguagagacgguguuucaccauguuggucaggauggucuugaacucuagaccucguggucugccugccucggccucccaaagugcugggauuacaggcaugaaccaccacgcccggcccauucuacauuuuuaaucagccugaucaguaguaagacugucuccuuuuccacaauuuuacaccuaaaagagaaagaaagauauauucccaaacuccuuuacuacauacauauuuuauaaagguaacaaugcuaaaagagcuaagugauuauuacaauucauacagagacuauuaauuuguuauacuauuugaagcaauuuuaacaauaugcuauuaaagaauuuuuuuuuuuuugaggcagagucuugcucuguugcccaggcuggagugcuuggcaugaucucggcucaccacaaccuccaccucccagguucaagcgauucuccugccucggccucuugaguagcugggacuauagguugcgcccccacgcgcagcuaauuuuuguauuuuuaguagagaugggguuucacuauguuggccaggcuggucuugaacuccugaccuagugaucagccugcuuuggccuccaaagugcugagauuacaggcaugaaccacuggacccggccaaagaauuauuuacaagcugccugcuacaccuucaggaagcuucccuuuccuagcccugaguccucuguauuucuugggcugcucucacagacuucugaaagacccaggucacuggaagagcuccuggacuugauucuauguaccaagaugaacugccaucacugcaagcacuuggcuucugaaaaauuucauguuauuuugagaaaaauucacuuguuacuaaaaaaaauucauauugaacuaauauauagcuguuuaacacaugaggauacacauuugaggauauauacuuagggguuaauuuugagauacgaacccacaugaugggaggaaaccuucucauuauacaaaugagcacaaaaacucagucaauucuuugcuuuaagaaaaacaaauucuaagauccuugaacacucccacacuaagcaugcuaaacaaaacauguuaauccaacgacuagaaacccacagucuguuauccuacagauauucucuuuaaauucaaauuccccagaagucacaaauuugggguuauuuuuccauugauguuuauugacaagcucaucuucaaggaagaauuuggccuuaaguguaagcaaaacauacucaacaaucagcaaaucuauucagaacauauuuucaauucacaacaccgggaacuguuugcccucugaaugauagccuuaacacaaagaggaaaaacaagugaacuaaacuacugaaaugaucauuccuucauccgaaacucagagacccaacacuaauguccagcuaauacuguugacuguuuccugaccacacugcaaauggcugauuuuuacugguuuuauugggugaacucaaggaauuuuugcaaaaggaauaacaagucuaaaugcagcccaaaacauaaacaggaauacuuacugaaacccacauacaugcaaauagcugagggaauacauuuaccacaaaaauccgaucuaaaaauucuaacguuaccuuuacaaguuaaaaccuuuagcaucagcucccagcuaaaacugaggccaggagaauuuugcauaucuuccucucucuguuuugguggaauaaaguauccuugaaccaguaaauaaacccuauagguaggaaucaagcuaaaaauaaucauuacugaccuaauguuuugaguaaaaaccuaguaagaggaauucugcgaggguuagcacuugccacauauuagaaguuauggcugugguauuaaaauggcucuagaagccucacacaucagaaaucuaccuaaaagagcugaagaugaaaugaaguuaacaaaccuaaaguguaaacuguaguuggcauauacuagggccucaaaaaugguuuucacuaauuaaugauaauaaaauaugauaguaaauaccaaguaauacaacugcacaagcuuucuggagguggugcaaguguaaaguaccacucuggggugggauucuguacucagaucgacaaaagagcaccuauagaugacuggggugagguuaagagguaagcucuuuugagauauuacugcagaguugugaacagagccgaaaaugaucaucuaggaagugaaaaauaaagcaagugaaagguguggagaaucaugcaaggaaaaauaaaagacugauaaauugggcaccuggaguuagaaugcagggccacagagaagcacaagggugccaggccuucuuuaucaaauaaaacccagggcugaacuuagugcagcaaucccgaucagacuccacaaugcaaggccccuaaggagagcugauucuaucacccuguagcucagcgguguguuugauugcucucagguuuggcaccucuaugucuucucuuaccaguuaguugguugaaacuguaaugauauaaaaccuuaacaggaugauccucaccaggucucaggaaaaugcagguggaaugucaaaucacucacagggaauacuagcaguuaaugagagcuauguuuagaaucuuguagcaagguggaagcugcaguuccacaugaaauaaaaauaguuggcacuuucaggauuuugaccauucaacugaagggcagucaaaacaucagcugaggccgggcaugguggcucacaccuguaaucccagcacuuugggaggccgagguggguggaucacgaggucaggagaucaggaccagccugaccaauauggugaaaccucaucucuacaaaaacacaaaaauuagcuggugugguggcacacaccuguaguucuagcuacucgggaggcugaagcagaaaaauugcuuuaauccaggagguggaggucgcagugagccaagacugcgccacuacacuccagccugggugacagagugagacuucaucuccacaaaaaaaaaaaaaaauuuccggccaggcgcgguggcucacgccuguaaucccggcacuuuuggaggccgaggcgggcggaucacaaggucaggagaucaagaccauccuggcuaacacggugaaacccugucuccacuaaaaauacaaaaaauuagccgggcgugguggugggugccuguggucccagcuacucagaaggcugaggcaggagaauggcgugagcccaggagguggagcuugcaaagagcugagaucgagccacuguacuccagccugggcgacagacugagacuccaacucaaaaaaaaaaaaaaaaaaaaaaaaaaaaaaaaaagaaauuuccaagcuaccgccaugagcaguaucaugaggcagacagacaauaagugauaugcugggaucuuaagccaugcccuguguagcacuagccaagugaccugagcaagguccguucaggucuucauuucuuuaugcucauauagugugauacuugcuuaauaauggauguuggcaggucagauaucugcucauaaaacacuuccuacugucacuacuaauacagaugccaggcaccuaucacucaggcuggaguacaguggcacuaucauggcccacuggagcuaugaacacugaggcucaagcaauccuccugccacagcaucccaaguagcugggaccacaggugaauaccaccaugccgggcuaauuucuuuuuaaauuuuuuguagagacagggucuugcuauaguaccaaauaacauuugaacuaauuuuuguuaauuuucauuuuuuugagacagaguaucacucuguugcccaggauggagugcacuggcaagaucuuggcucacugcaaccuccaaccucccagguuuaagcaauucuccugccucagccuccugaguagcugagauuacaggugugugccaccacgcccagcuaauuuuguauuuuuaguagagauaggguuucaccauguuggccaggcuggucucaaacuccugaccucaagugaucugcccaccuaggcuucccaaagugcugggauuaaaggcgugagccaccaugcccagcccauuugaacuaauuuucaccccagucuuguucuuggcauuggguguuagauucaauuaaaguaugccacuuucaaaaacaucugaucuaucucucgguuuuccucucuaauccuaaaaugcaaggauuuuguuugcauguacuaccaaaagaggugaaaaagaugaguagaauuggucuaauuuaacccgugauuauuucaaauaaacuagugcuuuuacuuacaguucugccgggcgcaauggcucacgccuauaaucccauuuauguaagggaucaaaagcuacauagcccuuuauaccuggguuuccuccacuuuugggaggaaaugauaguacuggggagaaugcaguacuuagccacauagaguuguuuuuguuuuuugagauggagucuuguucugucauccaggcuggagugcauggugugaucuugguucacugcaaccuccgccucccaaguucaauugccuccuggcaauucuucugccucagccuacugaguagcugggacuagaggcgcgugcgccaccaugcccggcuaaauuuuguauuuuuauuauagauggaguuucaccauauuggccaggcuggucuugaacuccugaccucgugaucugcccaccuuggcauccuaaagugcugggauuacaggcgugagccaccgugccuggccauagaguuguuuuaaggauucaauggguuaacaaauaaagagcuuauuauugagcuugacuuauaauaagcacuauauuaccauuagcuguuuuuuaaugcagcaaaauuuaaaauuaugauaaaauauauaucaaauacaauuuaucauuuuaaccauuuuuaaguauaaaguuuaauggcauuaagaauauaaagggaugggugcgauggcucacgccugcaaucccagcacuuugggaggccaaggugggcggaucaccugaggucgggaguucaagaccagccugaccaacguggagaaacccugucucuacuaaaaauacaaaauuagccaggcuugguggcgcaugccuguaaucccagcuacuagggaggcugaggcaggagaauugcuuggacuggaaggcggagguugcggugagccgagaucacaccauugcacuccagccuaggcaacaagagcgaaacucgucucaaaaaaaaaaaaaaaaaaaaaaaaaaaaagaauauuaggggucuggcugcccaacacggugaaacccgucucuacuacaaauacaaaaauuagccgggugugguggcgcacaucugcagucccagcugcuccggaggaugaggcacaagaaucccuugaaugaacccgggaggcagagggugcagugagccgagaucucaccauuguacuccagccugggugacagagcaagacuccauuucaaaaacaaaacaaaacaaaaacccaaaaacaagaauauaaggggucuucaaaaaguuuguggaaaaugaauguuacgaaauaauuaugcauggauuucaauuauuuuuuuuuuugaguuggagucucacucugucgcccaggcuggagugcaguggugugaucucugcucacugcaagcuccgcccccuggguucaugccauucuccugccucagccucccgaguagcugggaguacagaugccugccaccacgccuggcuaauuuuuuguauauuuaguagagacgggauuucaccguguuagccaggauggucucgaucuccugaccucgugauccacccgccucccaaagugcugagauuauaggcaugagccaccguuccuggcucaaaauuuuuuuuuugcaccaaaauaaacucauacuaacuuguuaugucugaucaggaucuaguuugaggcacugaaaauauuugagaaguuugagggcuggggcaggaagauugcuugggggcaggaagauugcuugauuccaggaguuugagaccagccugggcaauacagcaagacccaaaaaauuuaaaaagaaauuagccagccaugguggugcacaccuauggucccagcuacuugggaggcugaggcaagaggauugcuugagccucagugcucucauagaacaaagugagccaugauggugccacugcacuccagccugagugacagagugagacuggucucucaaaaaaguuugaagaggcugggcgugguggcucacgccuguaaucccagcacuuugggaggccaagguggguggaucaccugaggucaggaguucaagaccagucuggccaacauagugaaaccccaucucuacuaaaaaaaagaaaaaaauaauaaauaaauaaauaaauauauauauaaaauuagcugggugugguggcgggcgccuguaaucccagauacuagggaggcugaggcaggagaauugcuugaaccuaggaggcagagguugcagugagcugagaucgugucguugcacuccagccugggccacaagagugaaacuccgucucaaaaaaaaaaaaaaaaaaaaaaaaagaaaaaaguuugaagagagucccuaucagagcaauaggauucugcuaaaauugaagcaagaaaagcaucaaaugucuggugaagcuuggguggaagaauggcgaaaucacugaugcuuuaggaaaaguuuaugagacaaugccccaaagaaaucaguagcuuaaaauugguauuuugugugugugugacagggucuccucggucacccaggcuagggugcagugaggaguggcaugaucaugacucacuguagccucgaccucccaggcucaggugauccccucaccucagccucugaaguagccaagacuaugggcacauaccagacaccuggcuaauuuuucuauuuuuuuuguagauaugggguuuugccauaucgcccaggcuggucuuaaacuccuaggcuccagucaucugccagccucagccucccaaagugguaggauuauaggcaugaaccaugaugaccagcuggauaaauuguuucaggaaggguugagaugauguugaacaucaugcccuccacaucaauuuacggggaaaaaaauucaucuuguuucugccgauucaagaggacugacaagagcagaaacaauagccaacacuguggucauuucaacugguucagcuuacaaaauucugacugaaaaauuaaaguugagcaagcuuuccacucaauggcuguuaaaacccuuugcacccagaucagcuguagacaagagcagagcuuuggauagaaagucuagacaaguacgaucaagauccugaagcacuuauucgaagaacugcaauaggaacugaaacauggcuuuaccaguacaaucccgaagacaaagcacaaucaaagcaauuuagcugggcacaguggcgcgugccuguagucccagcuaccagggagguugagccugcagugaggcaagaccgcaucauugcacucuagccugggcaagagagccagauauugucucaaaaaaaaaaaaaaaaggguacuaagaggucaaaguggccaagugguccagugaaaggaaaagcagacuggucaagaguaaaggucauggcaauaguuuuuugggaugcucaaggcauuuugcuuguugaguuucuggaaagccaacaaaugauaauaucugcuuauuaugaguguuuggacaaagucaaagcuuuagcagaaaaaugccugggaaagcuucaccagagaguccuccuccaccaugacaauguucucgcucauuccucucaucagacaagggcaauucugcaagaguucccaugggaaaucauuaggcauccagcuuacaguacugauuuggcuccuucugacuucuuuuugcuucuuaaucuuaaaaaaauuuuuaaagagugccaauuuuucuuuggucacuaaugaaaaaaagacuguuugaaaugguuaaacucacaggacccucaguucuuuggggauggacuaaauggcuucuaucauugcuuacaaaaagugucuugaaguugauggagcuuauguugagaaaguuucuauuuuuaucucuuaacuccaguuuuccaugaccuuucugaaguggccaauuauuuauauuguguacaaccauuaccaccauccaucucuagaacuuucucacguuccccgauugaaacuccauccccauuaaacacuaaagccuauucccgcuaaccucagccccaggcucaagcaauccucccaccucagcucccugaguacaggcacacaacaucaugcccgacuaauuuuguauuuaauuuauauuuuuauuuuugagauggagucucacucugucguccagacuggagugcaguggcacaaucucugcucacugcaaacucuaccucccggguagcugagauuacaggggugcgccaccacacccagcuaauuuuuuguauuuucaguggagacaggcuuucaccauauuggucaggcugaucuugaacuccugaccuuaaaagaucugcccaccuuggcuuggccucccaaagugcugggauuauaggugugagccaccgcaccuggccauaaacauuuaauuuaaccaccuacugucacugagauuagaaaaccaucacagaauacuguauucugaauaacacacugcccauugaucuacuacuagcauauuuaagaucuguaaugugccuuuucagucuguaaagagaaggccaaaugccauuugaugauauuggggcacauagugcagcuaaaagcaaagcaauggauuuuacaaugcuguauaugagagaaggucuaaaugcuacugaaaaaguuuucaggguuccagcauguauccguuuuuuugucuuucuguuuuuuugagacagaguaucgcucuguuucccaggcuggaguguaguggccggaucucggcucacugcaacccccgccucccggguucaagcaauucuccugccucagucucgcgaguagcuggcacuacaggugugcaccaccaagcccagcuaauuuuugcauuuuuaguagaaaugggguuucuccauguuggccagacuagucugaaacuccugaccucaggugauccgccugccuuggccucccaaagugcugugauuacaggcgugagccaccgugccuggccacaaguauguaucuguacauuuuaguuagaugguacagggacagcuaaugggagguaaggucagguggcuuagguagccugugugugaugauuaguacuuuuuuguguguaggugaagaauaggacagaucucuugaaaccguucagagaauuuuggcaaucuccagggaaacguucaacuuuuguauaacugaaaauguauguuaagggguaaggaaacuagaauuuaaaacaauaguaacaauaacaguugggcguuuauuuuguacuaggcacuuugcuaggcgcuuucuuuauauuuacugauccauuuaauucguagagcaacccuuuaagauacauacuuucauacuaaugaaaaagggaggcagagguucaauaaagguccagguuugagaagaaagucauguaaaauuugucccuaauacuggcuuucauuacuacacuuauuaguuaauagaaacagaagugaguaggaggaacacacuaguacucagaucagguuugagccuucuggaucagaugccaugagaggaugugaaagauugccaagagggcacuuagaugauguagaaauuuaauagcccaaaauuucagaauuccguaaaugcuaauuuuuuuguuuuuuuugagauggagucucgcuuugucgcccaggcuggagugcaauggcgcaaucucugcucacugcaaccucugccuccugggcucaagugauucuucugucucagccuccugaguagcugggauuacaggugcccaugcccacgaccacacccgggauuuuuuucuauuuuuuuuuuuuuuuuuuuuguauuuuuaguagagaugggguuucaccauguuggccacguuggucucaaacuccugaccucacgugaucuacccgccguggccucccaaaguguugggauuacaggcgagagucacugggcccagcucauaaaugauaauauuuuaaauguuuuuacacacaugcuucaguaacuuuuuuuuuuuuuuuugagacacagucuccuucugucacccaggcuggagugcagugucgcaaucuuggcucacugcaaccucugccuccuggguucaagucauucuccugccucagccuccugaguagcugggauuacaggcaugcaccaccacaccuggcuaacuuuuugcauuuccuuuuuuuuuuuuuuuuuuuuuuaguagagaugggguuucaccauguuggucaggcuggucuugaacuccugaccucaggugauccacccaccuaggccucccaaaguguugggauuacaggcaugagccacugagcauggccugacauugaguuuuauaaaaauacugaagcaggauaguggggguauccugagcugaucaaaucugggacucuucccuagaagaaacucaaaugccuacagucuaauucagggguaaaugaguuagguauguaaggaaaaaaggaggaugaguuaaguucuaaggccaaggugaaaggagccaccuucuagauuuccaacaggaaaagucugaaaucucagcacaagaaugaucaaagaugaacaguuugguaaguuguuuuucugggcaggguggggaagauguaaguuguugaccuguguuagaauuaacuauaacacgaagaauuaaagagugggaccuauuaccuauugacauuucgugacuguuuucuccauuucugggaccuuguauccaaaagguagcccuuauuuuauguaaaccucugcaaccacuugaaaggcacuaagcaaaagaaauauuugucuuguuaauaaaaauagaaauaucaaaauaccauauccuaaauaaaaauuacacaaagaaaaaagauuuuucuucaaauuugugccuuaaaacuggaaguuaugagauaauaacagaugcuauuauaaacggacccaggaaaaccagaugcagguuucucucucaaaugcuuagguguuuggggugacuggcacuaagaauauacuacgaauaaaacaaaaugucuaaauucccacuugaggaagaauggcguacauuaccuuuguaagucaauuugucuuucugcuggugcugccuuuuuggcuaaaucuugcaguuugggugcuuuggcauuaccugcuuccaaacccccagggcucuccugacccacugcagcucucuuccuucccuuguuaauagguuuauuuagaucaucauuuuugguagcauugcccugagauucagacuugggucgacguccucuccuggguuuggaaggggcgggaggucccgauucaucuacuuucucaucuguuuuuuguuggauauucucugcaccagcugcuguuacuguucuuuucuuuccucggucacugcugauguugcccuggguagccugaucagaauuaauuuccuaaaaaagcacaaaacaauucuauaaacacaaauuccuuaaauauuaaugaucucuauuagaaaagaguguuuugaaaguauuuuaaaggagucuggauuugagggcuuccaguuaacugcuuacaucacauuaggaaaguaagcuccuugaggagagugacugugccugguaccuaccaugguguauagcauauauaaugugcucaauaaaugcucauuaaaaagcaaaggcugggaacaguggcucacgccuguaaucgcagcacuuuaggaggcuaaagcgggaggaucgcuugagcccaggaguuccaaacaauccccggcaacauagugagaucccaucucuacaaauaauuuaaaaaauuagccgggcaugguggcuugugccuguagucccagcuacuugggaggcugaggugggaggauugcuuaagccugggagguugaggcuacaguaagcagagauuaugccacuggacuccagccugggugacagagggagaucuuaucucaaaauaguaauugcaagcccggcacggugccucacgccuguaaucucacuacuuugggaggccgagacggguggaucaccugagguugggaguucaagaccagccugaccaacauggagaaacccugucucuacuaaaaauacaaaauuagccaggcaugguggcccaugccuguaaucccagcuacucaggaggcugaggcaggagaauagccgaaauugcaccauuguacuccagccugggcaacaagagcaaaacucugucuuggggggaaaaaaauugcaauaauaaaaauauaaagcacaaauaguacuugaaaaauaaaaucuaacucucaauguaacucaaugucuauggcaauaugcauuuuucuauguaaguuuguuuaagucaagacugcuuaauuuuacacaaggaucccacaauauucuaaucuauugguaucuggauucuaagaguuuugauaauaagagguaacuuguuaccugaauccacugacaugcuguguuucaaacaccaagcagaaagaguuuagauagcaagagauugaucuaaaaauguaacgucgggcgggcaugguggcucacggcuguaaucccagcacuuugggaggccaaggcggguggaucacgaggucaggaguucaagaccagccuggucaagauggugaaaccacaucucuacuaaaaauacaaaaaucagcuaggcaugguggcaggugccuauaauccagcuacucaggaggcugaggcaggagaaugguuugaacccaggaggcggagguugcaguaagccgagaucgcgccacugcacuuuagccugggcaacagagaaagacuccaucucaaaaaguauccucauguagcugaguucagaaaaugagaguuuggauaggaaaaguuaagcuacugugguguaacugcauaauccuaguauauuuaauguacccaaggguaauaucuaaaauauuugaugacuacaauaaguauauggugagcaauaaaaagauaagcacuucaagaauaugauucuggggggggggggcaggggaggaaauaauaucuucaagccauucuuacugagauaaauuaccaauuucauuuaauaguugagccguaauuccagcacuuugggaggccaaggugggcgaaucacgaggucaggaguucaagaccagccuggccaacauggugaaaccccgucucuacuaaaaauacaaaaauuagcugggcaugguggugcgugccuguaaucccagcuacucaggaggcugaggcaggagaaucgcuugaacccaggaggcagagguugcagugagcugagauugugccacugcacuccagcccaggcgacagagacuccgucucaaaaaacaaaagaaaacaaaacaaaacagaacaaaaaaaaaacaacugaaagaagaccagagaagucaagcgaccugcucaagucaacacuuagccagugaguggcagagccaagaggcaaaagucagauaugugugaugcuccuaucgauuaugcaccacuccucuccugccaaaaaauuaagaaauuggguugggcauggugagauccuguuucaaaacaaaacaaaacaaaauugggcgguaucguuuaaagaucaacaaagucgucaagcacggcucacgccuguaaucucagcacuuugggaggcugaggaggguggaucaccugaggucagguguucaagaccagccuguagcacaguggcgugaucuuggcucacugcaaccuccaccuccgcgguucaagcaguucuccugccucagccucccaagcagcugggauuacaggugcacaccaccacgcccagcuaauuuuuguauuuuuaguagagacgaguuuucaccacguuggccaggcuggucuggaacuccugaccucaggcgauuugccugccucggccucccaacguguuggaauuacaggugugagccacugcgccgggucgccucccgcauagcugggacuccaggcaaguaauuuuugcacuuuguuagcagagacaggguuucacuucaggugauccaccaagucucacucuugucgcccaggcuggaaugcaauggcaugauguuggcucacugcaaccuucaccucgaggguucaagugauucuccugucucgaccucuugaguagcugggauuacaggugugcgccaccaugccuggcuaauauuuuguauuuuuaguagagacgggguuucaccauguuggccaggcuggucuccaacuccugaccacaagugauccacccaucuuugccucccaaagugcacgauuacagguguaaguuacugcacccagccaagaugaacuuuuaaaaacacaguagaaacaaagcaaagggcugaucucuggugggaaucaacaaacuuuugaaauauuucaaaaacucucaauuccuuuuuugagacagagucucgcucugucguucaggcuggagugcaauggcacgaucuuagcucacugcaaccuccgccuccuggguucaagcaauucuccugccucagccuccugaguagcugagauuacaggcgccugccaccacguccaguuaauuuuuguacuuuuauagagacgggguuucgccauguuggccaggcuggucucaaacuacucaccucaugauccacccgcuucagccucccaaagugcugggauuacaggcaugagccaacgcaccaggccucaauuccuauucuuuaaaagaguugaaauggguaguauaggaaaaggauaccacuacggguaggugaccacacaaauuuuuuuuuuuuuuuuggaggcagagucugccucugucacccaggcuugaguacaauggcguuaucucagcucacugcaaccuccaccuccuggguucaagcaauucuccugccucagccuccugaguagcugggauuuuggugccaaccaccacgccccgguaauuuuuuuauuuuuaguagagaugauuacagguguaagccacugugcccagccagaccacauaaauucuuauaaaguggguggagguaagcagaaucauuuuugggaaguauagccggggugcgggaagcggggagaaggugugugguaauacacacaaguuuaaaauguagcaugugcauugaaguguuggcuguagauuucuuaucccuacggaaaaacuguaauaaucuccauggaaaaaauccacuuguuaaauuuuaaaauuuaccuuauucuuuacugggucaauauucuuuacaggugugacugaaauaauccucacaggguucucuucauuuucacuaacuccaguuucugcugccucugaacucuguucccuguuuaaaacaaauaaaccaagacuucauauuuccaugaagagaaaguucacucucucaccguaccaauaaagaaaggcuuaggcugguuucgaaaccuugacaauugaagcaacaauagcaagauucggauacucuguaguuauagacuauugcuuuaaaaauaucauuuuccauuuagcuuugauaaagugguaucaauuuccauuuugccuuaauaacauuaagacagaaaugacugccuaagacuacuugacaaaaggguuaauugucaagagacaaaauaacacaaccacuguaagcuuuaucuuuugggaauagaaaauccuaaaacaaaaauaaaacuacagaccauaguauaguugucauuuccauaguguucuacuaaaaagggggcugucagaagaggcuauuugguagguauuugaggccccacuauucuuuaaaccauguuaacugauuucauaucuugggcuucauuuuugcuaaaagugguuuaaaacaucauugguugaguuuauucuuaagauuucauguguaagaauaauaucuauaaaaaccacaauauuaaguguuccuaagaguagggucagaaaugauaaagguuugaugugacggauauccuaauuacccugauuugaucacuauacaugcuaugcauauaccaaaauaucacaaacaccccauaaauauguacaauuauuauauaucaaaauaaguauguuuaugaaaaaaauugcagguagaaauucuuaugcaguagcuaauauacugaauacuuaacauguuaaaauaaacauggaauauuuuuauaauuagaaaauguuagaacaauguaaacuuauccuauuuuuauauauauauauauauauauauauauauuuuaagagacagggucuuaggcugaaaugaaauauguaaucauagcugauauagccuagaacuccugggcucaagugaucuuccugccuccgccuccugagcucccaaguagcugggacuacaaguguaugcccccaugaugcccagauugguuucgaacuccugggcuccagugauuauccuuccucggccucccaaagugcugggauuacaggugugagccaucacacauggccuuuucuuuuuauuaagagacagggucuugcuuugucacccaggcuggaguguagcagagacaucauagcucacuuuagacuugaacuucugggcucaagugauaauccugccuuggccuacuaaagcgcugggaucacagccauaaggcacuacacccagcccuccuauacuaauuugaguuaaaaauuaaaaagcauuucaauuuauuuaaaaguuaauguuuucauaguuuuccuaaggguugaauuuucuuacguauaaaaaauaaacauuuugggccaggcgugaugguucaugacuguaaucccagcacuuugggaguccaaggugggcagagacuagccuggcaaucauggugacacccugucucuacuaaaaauacagaaauuagcugggagugguggcgugugccuguaagcucaggaagcugaggugugagaaucacuugaaaccaggagguggagguugccgugagcugacaucccaucacugcacuccagccugagugacggacagagacacucugucucaaaaauauuaaaaauaaguauuuugauauaaauugguuguauuauuaacucuuauauuauuuucuguuaauuuuucuauacacuuagaaugcuauauauuaauaguuucaaagugugcaguacauucuugauuuccucauugaaaauacuaaaaugugcccaggugcagugguuugcgccuguaaucccagcacuuugggaggcugaaggggguggaucacuugagcccaggagaucgagcccgaccuggggaagaugacgaaacuccaucuuuaugaaaaguacaaaagaaaauuggcuggggguugguggugcaugccuguagucccagcuacuugggaugcugaagcgagaagaucccuagagcccaggagucugaggcugcggugagcuaugauccugccacugcccuccagccuaagcaacaaagugagacccugucucuuaaaaaaaaauuacauaaaauuaagaaaaaaaagaaaauacuggcugggugcgguggcuuacgccuguaaucccaacacuuugggaggcugaggcaggcggaucaccucaggucaggaguucgagaccagccuggccaacauggugaaacaccgucucuacuaaaaauacaaaaauuagcggggcgugguggcaggcgccuguaauuccagcuacucgggaggcugaggcaggagaauugcuugaacccgggaggcagagguugcagugaaccaagauugcgccauugcacucuagccugggcggggacaagagcgagacuuugucucaaaaaaaaaaaaaaaacaaaaaaaaacccagaaaagaaaauacuaaaauucaucaauauuauuuuguaccagaacaccgcuaaugacagaagaccauuuuaugagacagcacuuuaggaauaaaagauaaaccaaguagugagugcuaguaacaaaauaauuggagagaaaaguugccuugaucgauuuccgguugaaggguucagcucugaauuuacauuaauauugcuuccagucucagugccagugcuucuaacauaggguuuccuucccguugcugauaaaggcuuauuuacugcaccuaguacuccagcaggcuuuggcuaaaaacaaaaacaaaaaaccccccaaaaacacacacguuuauaccuuaccauguauacauguaaauuuagacacaaguaagagauauuguuaagugcuaauuaguuaaauuuaccagaaauguucauucugggccaggcauacuggcuccugacugcaaaucccagcacuuugggagguggaucacuugaggccaugaguucaagaccacucuggccaaaagagugaaacccaaccucuaccaaaaauacaaaaauuagccagguguggugguauaagccgguagucccaucuacucgauagacugaggcaugagaauugccugaacccaggaggugaagguugcagugagcugagaucgcaacauuguacuccagccugggugacaaaaugagacugucucaagaaaaaaaaagaucauucuguaaaauuguguuugguugccuuaauacaaucaaaagucauaagcauaucucuacuuaauaauaacuagguaauauuaauguauccuuuauuauucaaucaaaauacaaaguuccccuaaaauauagcaaaauacauacauaauaaaugcuccuauaaauaaacuauuggauauauauauaguaauaguuuaggaacuauuuacaaaaaacuaaauuuccuuuugcuguuuuaggugucaccauauuacuuacauagaacaugaauugucuaauucauuaguaguauaaaauuauuucuuuuaucuuauauaccuaaguugguuauaccauuucccaggaaagucuucuuugugaauuguaaauaaacugugcuuaacauuacugaugagaacacacaguggcauuucagaggagugguugcuggcagaaaaauucuaaaagcauggcugcuuuagaugcuuuaaauccauaaugugaucccuaagaaucaggaacuauacaaucuaguggucauuuaaagguauuucuaggaauagcagaagcaagauacacaugaaacaaagaucucaaaauuauuaaguaaauaauaccuuuccuguuaacagaaguacucuugucucuucugaaauauaacucuuaucguuacagaaguccuauuaaaaaaaaaaaagaaaaagaaaaaagaaacaccaaucaaaggaacaugaguauuuuaauuaucucaauaaggcuuuuuagguauugugccuugcaauaauaaauacacuugugcuaacacauauaccaauuuaucaaacaaucaaaacaaucaaagccauaccauaagucuagcuuuaaauuaaacugauggcacgcagacuuaggcaaaugucaaagauaaauuuccuaaaucacaccauaaauaaagcacacacauguuuucauacgguucaaugcaguuuauucauuaaauuuauucacugaauuccaccacaucauaaauucgggccggguguggugacucaugccugugagccucaucccagcacuuugggaggccaaaguggguggaucaccugaggucagaaguucgaacccgccuggccaacauggugaaacccugucucuacaaaaauacaaaauuagcuaggccggguggcaugcgccuguaaugccagcuacucaggagguuauggcaggagaaucgcuugaacucgggaggcagaggcugcgguaagccgagaucgugccauugcacuccagccugggugacaagagugaaacuccaucucaaaaaacauaaguagaccaacugucaaaauacaauuaagugaauuauguucuuugacagcugugauauuaacaauacacgauuuaaaccaaauguggaaaaugauagcacuuugagaguuauaucuauauaaaaauuaggaguucaaacuugaucucuugaugccuuuuccugcuuaauaucugaaaauggcaaacaaaccacaauguugugucagugaagcaaaacuagcuacuaaacucaggaaauauaauuaaguuuuaaauaauccuauuaaaaaauauuuuuuauuguauuaaauuuaccuucacagaaguaggaaagaacaaagugugccugugaggaaaucacaguuuugucaugugugcuaggcaaagcuguaucauuucuuuugcacaaagucuucuaugcagcuaaaauaaacauuaagaaaccuguguaccaaaguucauucacuucauucauaaagauauaguauagcuucacuagguugacuaacuucacaaaccuaguguucuaggguuuaugaauuuauaacacauuaaaagcaacauguuacauaaauaaggaacguugcauacugaaaacagaaaaaccuaaguuguuauuauuaagaagacuaaaacucuguaacacugaagguaacaaaagaaaaaaaaaauuguuaucuaugaguccagauaagguguagugacaaguaggaauuuaauucuugaugaugguaucaccacuguuacauagauucuauuugguacuauucuauucaugaugguccugggucagcaacaggauuaauuuuaauucaacagcucacuuaagaauaucuuauaggcugggcaugguggcucaugcaaucccagcacuuugggaugcuggagguggguugaucacuugagcccaggaguuugaggccuggccaacaugaugaaaccaccugucuacaaaaaaguuaaaaaauuagccaggcauggugacacaugccuguagucacagcuacuugagaggcugagguaggagaacugauugagccagggaguuggaggcugcagugagccaagaucaagccacugcacuccagcgugggugacggagacucaaaaaaaaaaaauuuuuuuuauacagaucaguggauucaauuagagagcauacuuuugcaaauucucauuauuucuaucaaaagcaaggcacaguuauguguucaauacuaaaucaguaauaaaaaucagauuacauuuuagcaaacuuuuaguaaaguacggcauucaaaguaggaagcuccauuuauuucuuggaaugugcauuuggagaauucucuaagcuaggggucuccaacccacgaacugcagacugguauggguuaugggucaugggucugcggccuguuaggaacugggauacacagcaggcagugaguggcuggcgagcaagcauuaccaccugagcucugccuccugucggaucagcggcagcaugagauucucacagaagcacaaacccuauggcgaacuaugccugcgagggaucuaggcugugugcuccuuaugagaaucuaacuaaugccugaugaccugaggugaaauaguuucauccugaaaccaucucuccaccucaauuucucuguggaaaaauugucuuccacgaaacuggucccaggugucaaaaagguugggaaccacugcucuaaggggaucauuacugaggcauauauauacauuuauaggagaaagugaaacaaguuuaaaauaccaccuaacagcaggaaauaaacaaaagcuuuuaaaaauccaaauuagcuggaaaaacuuacagagccugcguuaccugaaaaauuuacuuacaugggaaacaguuugcugaaagcagaauagaugcacuguauauuaauuaauaacaccauuuauugaaugguuuuaugugauaaacucuucauauaaaccuagauauuagcaauuguccauauguauuauuaacaucugcauuauaaagaugaagaaauggaggcuuagaggagagaaccugucccuccuuacacugugccaaagauuuaaaauuuuucuuaucugcaaaaauacuacccauguuucaauaaaaugagauuaaaauaauuuuaaaaaucugaaaacuuuaauacuagaaauuccuagaauaaacauaagaucaacaguauguguagucuucuguucaagucagaauaauguucagggcuguguaagacaauuucccacucuuugauaaacccagauuuuuucuuuacucuguggucaagacaauucaauauuugccacaaugguugaugguaauugacauugaaaucaguuuagugugguaggaaaaaugagaggaagaaaauuaccuuuucagguuguguaaaaaauuucauugggaggacuggguccuuuggugaaucugcauugcacaaagcacuuuuacuauuuauaacacagagagccacaucacauacuguauacaguuucuagggaggaaaacgaaucauauauaacuuuuaguauugcaaaauaaucauaauuaccaauuccacuaaauguauaauuuagaguuaaaagaaggauacugugguuguuauuuauuccuugaacauuccauauuucuguucagcacuguuuaugcagccuucugauaaauaaaaaucccucuauaugaauuuaacauggaugccaauaugcauggaaaauaacaaacaaaugaaccaacccaaagaaagcacacaaaaagaauaagcauuugucuguaacucuuacuguaaguucguaauauaccauaguuguacauuuuauucuuauccucuugcucuaagguuauaaugucuuuucagaguacuaaagauuccugaaauaaaauucacuuguaaugaagugcaauaaaaacugacuacacauuuacuuuuguaaacauucuaaaauuuaaauuacuacguauggccaaaaaaaaaaaaaaaaaaccaagugggacaauauauuuuucuauuacaucuuaacacccacuggccuaacacucaucuuacuucauuugucuuggauucaucuggagacugggcaucucugguuaacuugauguucucugccaucuucuucauaaaggcauggcuauuguuuucauucuuugucauuaaaacuucaagcaugaaccauaggcaccuaaauguaaacauauuaaagagacuagacguagauagaugcuuuagcuuaaagcaauaaauauguuagcugggaauuucuguugucugaauaaaauaaaauaaaaugaucaaccuuaaugacuaauauauguuauuauccuaauaauauucuauucaaauggaaaauuaaagcauaaaauaacauauaaaaaaugaaaacauagcuuaauaugagaaagucugacaguuucauaaggcauauaaagauucacccuagcuggauaugguggcucgugccuauaaccucagcacuuuggguggcuaagguggguagauugccugaacccagaaauucgaggcugggcgcgguggcucaugccuguaauccuagcacuuugggaggccgaggugggcagaucaagaggucaggagaucgagaccauccuggcuaacauggugaaaccccgucucuacuaaaaauacaaaaauuagcuggguguugguggcaggcaccuguagucccggcuacucgggaggcugaggcaggagaauggcgugaacccaggaggcagagcuuacagugagcugagacugcaccacugcacuccaaccugggugacagagcgagacucucucucaaaaaaaaaaaaaaaagaaauucgagacuagccucgugagaccccaucucuacaaaaaaaauacaaaaauuagcugggcaugguagugggcuccuguagucccagcuacuuguggggcugaggugggaggaucgcuugugguugcagugagccauaaucacaccacugcacuccagccugggcaaaaaagugacacccucucaaaagaaaacacagauucacccuauagguaaguuuacauaaucugauauaacuuaacacccagcaauaaugagcaaaucaacacacagcagucuugggauuuugauuauuuguaagcuaugcagaaguucuacaauugguaugcaguucugccgagaaacaagucuaaguugcauguauuaugaggcugaugugugugguacccagccacccaauuaaggagucacaaucucaaaccacuuuugcuauuccacacuugucacuguauauucauuuaacacauugugucugaagggaacauuugaauuucuaaguaaaagugaaccccaaaucaggcugaacauuagaauuguuuggauaacuuaaauagacaaaucuggaaauggggccuguuuuuacaaagaucccaguauuuucaggcagugacaugacuacugcauuccugcaucaacaggggagaaacuauuugaugauacucuguaaaagcuucuuuuccuacauuccacauaauuguuuuaagagacuacuguagcaugcauuaguuuuuuagcuuaauggcuuaaaugauaguugguuguuucaauaauauuuauuaacuuaggcaaagaguugucaacucuacuuagauacuggauagcugcuagaauccugaucaaagaaaggaacagaauaaugaauaacaacaaauauaauaaaaauuagcaaauauuuaaugagugcuuacuaucuacuaggcauuaggcuaagcacuuuaccuucauauaauccucaugacucuauaaagaauaagaaaaaucgucaccauuauauauagaaccuauuuuuuuuuuuuuuggucugucuuuugagacagagucuugcuugccucucaggcuggagugcaguggcgugaucacagccccagcaaccaugguguccugggcucacacuauccuccuaccucagcuuccugaguagcuggggcuacaggcaugugccaccaugucuggcugauuuuuauagagcugggguuucgccagguugccgacuggucuugaacucccaggcucaagcaaucuaccugccuuggccucacaaagugccaggacugcaggcguaagcuaccacuccuggcuaucuaaauauuuuuuuugaggcauuaaguaaccuguuuagggucacagagauaaaaagauggagcuaggauuagaaccaggucugcuuuuauacuuuuaacaaaaauacacaaaauaaauauaauaaacauuaucugagcaacuauauacuaaacaaaggugacaacacugaacacaucgguucuauagguuugaggauucuauuuguuuauauaaacacugaaaucauuuccuuaauucuugggucagaauucuguugaguuucuauuaacuugaagauuuguuugaucccuuuccacagaaguauagggucaggauuacucucaguuuuaggggauaaggugaggaagcauuccuaugcaggguuucuuuaaaaaguuguaacaaaaaaaucuugcaauaagguuuuaaacauuaguauauacauaaaauacuugaauguacaucaacauaauagagaauuuauuccuugaaguaacuggaaaaaaguaugauugucuugugauaagaaugccaauuccaccuuaauuuuaugcagauaugcugagacuaaugugcuaucuaacaugaaccaauugacucaauaaauuuuaguacuuggaaguuguucaauauaauguuacauuuaaaacaggauacaaaacaauacauauauguauuauaaaacaauauauaauagauauuaaaacagcauuuuuugaaauuagaauauguugaaaucccuggggccaugucucacuucugcauccucaauacugcccaagaaauguaaucauuaauguuuacccauccuacgaaguacacagauucccaugauccucugcuucuucuugccuuauccaagggagcuaauuccucuccaucucguaucuuuucacugaacucucuagaauauacuuucccuccaaaaagaaucuucaaugaaugcucacuucaccuuuuugccguaacugaaaccauacccccaccccaagaaugcuugccuugcauuccccuaaaaguuauaacugcucauucuauuagaugaugcauacuuagggucagagagugaguucagcuucuaucauccccaaagcuaauuccaguuauucuuccagguuuauguaaaauuacuccuaggaagcuugugccauuuggcugcuucuaccauccucuccuugucaauguuaucuaucagcuucccuauguuccuugcguugauuuaguuucuggaugacauuuuuccuugacuccaucuuuaaguccugccaauuuucugggcaaucuguucaacacgauuuccuaauuccuuggcuguucuaauccugguaaauuuuaucuuugccuaagacauuucacugccucagacauuccuagacuuuguuaaucuuuagaaauuguucgccugugaaauuauaaauucacugcagccuaccuccugggcucaagcaacgcuccugccucagcagggacugaguagcugggacugcagggacugaguagcugggacuacaggcacauguuacaacaccaagccaauucaaaaaaauuauuuguagagauaagauccugcuauguuguucaggcugguccugaaauccuggacucaaauaauccucuugucuuggccucucaacauuuuaaucacuuuuuugaaaacaguaucaacucuuaacaauuuuccuucugguacacuugcuuugaaaaacucaagaacaauccaaaucuuuggcuucuugacagcuauauuuagaauuguuuaaugcuacagaaaaaccauguagcugagaagcuugauauaauuauaaauuuaaaauuuuuagcuugguacuuuaugcuacccagcuauccuaugugucaccaggauuuuuagccacuucuucacagcagcuguuuccaaucuuuacucuacucauaucuaauucugucacccucaccuaccaguagacucugcuccuauaucauuuagaaaccuaagucauuaagaugagacuuccucaacuacuuaacagcaguccuggaaaauuauuuuuauuuccuggccuucccuuuaucuaucuuuaagaucccaccaccccauaaauucuucuuuuugaagaccucaccucaauuuauuaccaucguuucuuuuaccuacaaccacacuuuuuccccuggcuccuuaaauacuuucuauugccuucuuccuccccaauucauagccaauuuuuaaaaaagauuugucuaaacgauauguauuccuuaucuuuuggcaauuuggcuuucaccugcauugcuuuacuacagcugccccugccaagguuaucagugagugcuuuguugcuaaacacauuuuaaacaauuuuuccaaccaguaagcaaauaaacacaguuuguucuuaaauucaaaggacacguauuagcugugugacuuuacccuugcugguaucuucauuuguaaaaugggaacaacaggaugcgugcgguggcucacgccuguaaucccagcacuuugggaggucaaagcagguggaucaccugaggccaggaguuugagaccagccuggccaacauggcgaaacuccaucucuuaaaaaaaauacaaaaauuagcugggcaucguggugcaugccuguagucccagcuacucgggaugcuaaggcaggagaaucacuugaaccugggaggcggagguugcaaugagccaagaucacaccacugcacuccaacuugggcgacagaacgagacuccaucucaaaacauaaacaaaaacaaaaauaaaaugggaacaacaguaauuaucccauuguuuugaagaauaaaugagguaacauuuccaguacacguaacauauaauaaaaagccaaugaauguuagcugguuccugaucauuuuuccaaacugcuguuccuuugaccuccaauauucuuccuccaggucguuuucugauucucuguucuuuccaguagugguaugucugaagucuacacuauuagaaguucugcucuacagauuauuuuuuucuuccuccucuuuuuaacuucugacucccugcaagugugaguuaugugccuauucuagguacucccacaauagcagagcauauaucacauaucauauuguaaccaccucuuuaucuuucuucaucuuccauuagauuguaaaccuuaagggaauauauaugauauucauauuacauaaccucacaacccaagaacuuagcguaccuggcacauugaaaguacucuauaaauauuuguuaaggaaauaugaacauaugaagaagaaaaaguguugaaagauacagaccaaauuguuaacagcaaugaagggcuuuuaggggguauaauuacgaauaauuguuuucuucuuaaugaauucauuuucaauuuuuucuuacugaauaucaauaaaggagaaagguaauuauuaaacauuaaaggcuauauuuaaguacgauuuuucaaauucaaauacauuauuacugaugucagaaaaauggcagaguaagaaauuucagauaucaauugcaacaacaaaacaacuauuaagcuggaaaaaaacaaucauaaucaccugugcagaacucuggaaccucaugggacccagcaaccagggguaaacaccuggucugauggaggaagaggggaugaaccucaacagugaagggaaucuaugucagggucacaggcugaccauaaagauaacagaacuauaacuucaaggucuacacaaaacaaggaauacagacuuugugaaaguaguuuggaaaagucagaaugguggacugcgcccuacaagaaccaaaagcaaucuagaaagagaggaagaaccagauuuuuagaguuaucacauuauaguacuuaaaauguccaauuccuaacgaaaaacuacaaaucacauaaagaaucaggcaaauaugacuaauucacagggaagaagaaagaauuaggaauuaacccugaggaggcccagauuuuagaguuacuagucaaagacauuaaaucaacugucuuaaauaugcucaaugagauaaaagaaauaaagauaaucauauguaugaacaaguagagaauacugauaaagagacagaaauaauuaaaaggaaccaaguaggaauuccaggacagaaaauuauaacagcugaaauuaaaaauucacucuaggaggauucaauggccgacuacagcaggcagaaaaaagauucaguaaaccuguagacaaggcaauugaaaauacucagucugaacagaaagaaaagagaaugaagaaaaacaaucuaaugaaccugcaagaaacaaucagaaauacuaacauuagacaucauggaauuuccaaacggaaagacagaaaguagcagaaaaaauauuugaugaaauaauggucaaaaacuugcaaauuuuaugaaagaugugaauuuauacauccaagaaacucagugaucuccaagcaggaugaaaucugaaacccacacugagacacaucagggucaaaugguugaacauuugauaaagagauaaaggauaaaggucucuugaaagcagccaagaaggaagugacucauguuaaaggauccucaauaagaauaacagcugauuucucaucagaaaucauaauggccaagaggcagugggaugacaucuccaaguucuaaaaaaacaaaaaacaaaaaaaccccaacaacucgucaaccaagaaucuuauauccuauauaagauuugucuuuguccaagaauaaagacaaaaucaaaacauuuuccaaauaaacaagagcaaagggaguuugucaucaguagaccugucuuaugagaaaugcuaaagugaguccaucaggcugaaaugaaagaacacuacauaguaauuuaaagccauaagaagaaauaaguaaaucuggugaaaguaaccauacagguacauuuaaaagacaguauuacuguacuuuggcucauaacucacuucuuucauacaugauuuaaaaggaaaaugcggcugggugcaguggcucaugccuguaaucccagcacuuugggaggucaagguggguggaucaccugaggucaggaguucaagaccagccuggccaacauggugaaaccuugucucuacuaaaaauacaaaaauuagccaggcgugguggcgggcaccuguaaucucagcuacucgggaggcugaggcaggagaauugcuugaaccugggaggcagagguugcagugagccaagaucacgccaccgcacuccagccugggcaacagagugagacucugucucaaauaaauacauaacuaaauaaauaaauaaaaggaaaaugcauaaaacaguaacuguaaaucuaaaucuaaguaaaugggaauacagccuauaaagaugugauucgugauaauaaaaaauaaagggagggaaaauacagauguagaagagcaauguguccauaugcuauugaaacaaauuugcuacuauucaaacuagguuguuagaaguuugagaugucagcugugaucuaaaaccuaaugaaauacuaaaaauggccgggugcaguggcucaugccuguaaucucagcacuuugggaagccaaggcagguggaucacgaggucaggagaucgagaccauccuggcuaacacggugaaaccccgucucuacugaaaauacaaaaaauuagcugggcaugguggcaggugccuguagucccagcuacucaggaggcugaggcagaagaauggcgugaacccgggaggcggagcuugcagugagccgagaucgcgccacugcauuccagccugggcgacagagugagacuccaucucaaaaaaaaaaaaaaaaaggaaagaaauagcuaaaaacuuuuacaaaagagaagucagaagguucaccacaaaaaagccaacuaaauacaagacaaagaggcaaaauuggaggaauucaacaaaaaacaaauaagacaugcagaaaauauacagcuauuuugcaaaacuaacuccuuccuuuucaguaauuacuuuuaauguaaaaggauguaaagauauuucauguaacaguaaccauaagagagauaaguggcuauuuuauuauuagauaaaauagauuuaaacucaaaaagguaagaagagaccacaaagacuguagugauaaaaggucaauccagcaagaaaaugugacuguaauaaauauauacaaaacaaacaagaaagucccccaaucuaugaagcaaaaaauggacagaacugaagggagaaauagugagugccuuaauaagaacuggagacaccaauaacccauuuucuuuuuucuuuuuaauuuuuaaaaauagagacagagucucacuaugcugccaggcuggucucaaauuccugggcccaagcaauucucccgccccggccucccaaaguugcugagauuacaggugugagccaccaugccuggccaagaauaaaauguuuagaaauaaauuuaaccaaggaagacgaagaccuauacccagaaaacuacagaacagugcuggaaaaauaaauaaaugaauacauaaauaaaauaaaaaauuaaaggucuaaauaaaugcaaagacauccugugcuaauagauuagaagacuuaauacugguaagauaacaauaucacccaaggcaauauacagauucagucccauuccuaucaaaaguacaauggaauuuuuuagaaauauagauaaaugcaaccuaaaauucacaggaaauaucaaaagccaaaacaaucuugaaaaagaacagaaaucagacuucucaauucugaaacuuauuauaaaguuacaguaaugacagaguuacauggcauaaggccagacauacagacaaauuaaauaggauugagagcccagaaguaagcccuugcauauauggucaguugauuuuugacaagggugccaaaaccaaucucuggggaaagaacagucucuucaaaaaugguacuggaaaaacuggauauucacaaacaaaagaaugaaucugaauguuuaccuuauaccacaugcaacaauuaauuuacaauggaucaaagaucuuaacuaaagagcuaaaaacuauaagucauggaagaaaaugcaguaaaauuuucuuuuuuuuaagaugcaguuucacucuuauugcccaggcuggagugcaauggugugaccucggcucauugcaaccuccaccucccagguucaagcaauucuccugccucagccucccgaguagcugggauuacaggcgcccuccacaacgcguggcuaauuuuuuauauuguuaguagggacaggguuucaccauguuggucaggcugguccugaacuccuaaccucaggugauccacugugcccggcugaaaacacaguaaaaaauuuuuaugaacuuggauuugguuccuuaauuauaacaaaaguacuguauaggcaacaaaagaaaaaauacacugggcuucauuaaagugaaaacuuuugugcaucaaaggcuacuuacuaucaagaauguaaaucauauaccugauaagagauaaauacccaaauauauaaagaacucuuacaacucaauaacaaaaagacaacccaauuaauaaaagggcaaagucacuggacauuucuccacuuaaauguaugauuaaaagugguaaaaaacugcaaauuuugcuauauauauuuaccacaauuaacaaaaaaauuguuucugacacaauaacuuacuaauuuccauaaaguuauguaacuacauuuugaaaaacuuaaaaaaacaaacaaacaaaaaaaaccagacuggguuuccugucacccaggcuagaaugcaguaacuggaucagagcucacugcagccuuccacuccugggcucgggcaauccuuccaccucagccuuccaaguagcugggauuacaggugagacccaccacacccaccaugaaaaacauuaguuggaacuucaaauuacaugguaauuuaaacauuauguuuaaagauacacaaaaguggaaaugauuucagcaagauaguagaacaucuagaaaacauuuaagacaagaauaccaucuuuaaugcaccugaaguagggggagaagaacuaagugaugccaccacugguaagagaaacaguucaauuucagagugcaccacccuggucuccuaaacugucagaacaccacucgcacacaauuucccuagacucgugguuucugagaugagaggaacuagauguggaacuccgagcucuccacaagucugggaagcccacuccaguccugucccaugggaaccacugggagugcuagaugggcagaaccaccugggaugaacuggggacaaagagcagggcacugacugugcuuaaacucuggugacuacucacugcuccaaucaguggggacaccauguugaagcuacuauggaaaacaguaugaugguuccucaggcugggugugguggcucaugccuguaaucccagaaauuugggagaccaaggugggaggauugcuugagcccaggaguucaagacuagccugggcaacauaacaagaucgcaucucuauaaagagagagaaaaaaaaagguuucucaaaaaaacaaaaacagaucugccauauaauccagcaaucucacugcuggauauauauccaaaauaaaggaauucaguacaucuuggccgggcacaguggcucaugccugcaaucccagcacuucggaaggcccaggcggguggaucacuugaggccaguaguugggagaccagccugggcaacauggugaaaacuggucucuacuaaaaauacaaaaauuagcugguuguggugguacacgucuguagugcuaacuccuugggaggcugaggcaugagaauagcuuuaaguggggaggcaaagguuacagugaguugagaucauuccacugcacuccagccagggcaacagaguaagacacuugucucaaaaaaaaaaaggaaaaaaaggaaaaaaagaaaggaaauuaguagaucuaagagauggaugcauuuccauguuuacuguagcacuauuuacaacagccaagauauggaaucaaccuaagugucccucaacagauaaauuaauuaggaaaauggaggauauacacacauacaaugaaaaauuacucauccauaaaaaagaaugaaauucugucauuuucagcaaaaugaacagaacuugaagucauuaugcucagugaaauaagccaagcccagagacaaauaucgcauggucucacucauaugugggcacugaaagagugaaggccaggcacaguggcucacgccuguaauccuagcacuucaggaagcugaggcaggagggucgcuugaguccacgaguuugagaccagccugggcaacacagugagaccccaucucuacaaaaaauacaaaaauuagcugggcaugguggcacauguagucccagcuacucaggaagaugagguaggagauugcuuuagcccaggaggucaagguacaaugagcccugaucacaccacugcacuucagcccgggggauagaguaagaacuugucucauuaaaaaaaaaaaaaauagaauaaaaaugaagaucuuauacaggcagacaguagaagggugguuaucagagccugucaaguguagaagggaagggggaauaaagagagacugguugccaagugcgguggcucacgucuguaaucccagcacuuggggaggcugaggcagggggaucacaaggucaggagagcagccuggccaacaugguaaaacuccaucucuaacaaaaauacaaaaaaagauuuagccaggagugguggcaggcaccuguagucccagcuacucgggaggcugagaugggagaaucacuugaacuagggaggcagauguugcagugagccaagaucgugccacugcacuccagccugggcaaaagagcaagacuccaucucggaaaaaaauaaagagagagagacugguuaauggguacaaaaauacacuuagauacaaggaauaaguucugacauuugauaccaugguagggugacuauaguuaacaauaauuuauuuguauuuuaaaaauuuuauuguuacuauuauuuuucagagacagggucucguucuaucacccaggcuggcaugcaguggcuuaaucauagcucauugcagcuccaauugccugggaugaagaggaaauggauaucuuaauuacucugauuuucucauuacacauuguaugcauguaccaaaauauuacguguaccucauaaauguauacaauuauuauguaucaaaauuuuuuaaaagauauuugaaaguguugcaugcuagagagaacaaagaauaaaaaauaugcuccacuguuuucaguuccaacuccaauuauuucacauacuucaguacucuucccauauucaaacccucucaauauaaauaguaaaaaucaaauauaauaacuaagauaaccaaacuaaccuauuucaaagacuuagauagcuuaacuagcugcaaacaaacagaaaaugaacaaccaaaaccugguagaugggaaaauuuuugaaagacgaaacuggaaauuuauaauaaaugaauaaaaccauaaggagauucuaauucuaauguaaauaauaaauaaaaauaauaaacaaaaaauuuaccauuuuuugaaaacuaaacauaauuuuuagaguucuugaaaaacaacaagacuuacucuuugauaucacgaagcugaucaacaucuugugaucuuguaaaaucuggaucaugggcuagcaggugaaucauguauggaacuacauauucaggcaacagugauaauaauuucucugaaguaaaaacauuauuaaaaacaaccuuuauaaaaugccuuaguggacugaguucuaaccacuuaaguuuucauuuuuucccucaguuauuucuaaauuaggcacaacaugauaccuggauacuaaaauacuuuacacuucacuuuucaauuucuuuuucugguaccugguaugcaguuguauuucacuuuugaaagauacugaagucaaagguaucagauauuaaacccauuaaacaacaggucccuggcaaagcuaggaaaaaauuauuuagucugacauccgagcaauauguucaaauuaaacuacacuccugaucccauaggaaaaaugcaguuugccagaguuaaugcagcauaaauaggacucaggaguucaguuuuuaaguacaucauaacuacaaugacagcauucuauaaaacucccaguuuuauuauaaacuauaauagaaacacaugacaagaaaaaaaaaaccuaaaaauggauacauugacaaaauauauuugcacacggagaacucugaguuacuuaccaguagccauaggauucugcuuaauguauucccugcguauacugauauuuuucaguaaacauugucgugcgugugcucuucucuccuucacaggaucuuuggcacacaaggcaaagaucgccauauacuccaaugggagcaguaacuucacaagugccuuaugcagcuucugagcaaauaucugccuuacuugguaacacucauccuacagcagcacagaaaaacuuaaauuggcaaccauuuauuaaauaaaaaacagcaguuuaaguauuuuuagugucuucaauuaaaaagaagauaauuauaugggagaauaaauaauguaauaauuggaagacaguuaaacagguaauaauaguagugacuuuugugcauauauucacauuauaaauggauuuguauccauagaaaaguaauguauucaacuuugaagauaaguaauugacaaaaauaagauuguuacuuacauuaauaacaagugcacagagcugaaacuguucugggguaauaauuucaugguaacaagguuccugagcaagcuucauuauggcacuaccagcagcuaaucgcaagcgagacauaucagauuuacuauaaacaaacaaaaaagaaauaaacauuuccuauaaccacuaucauucauaaaaaugcuuucgucccuuuuugaauguaagguccuuagagcauaauuuauguuuaaaaugacguacaaauaugggaaagcuacuuugaguccaugaacuuaacacaggggauugugacuuucacaaucaaaucaaaucauugugacuuucugauuacaaauuuaccugccuucauuucuagucaaacucuagcuuagauacuucaccacaacccaaaaacucugcuuauucuugcaaccauaguaauugcaaggcuaggaaaaacucuuuacaucaggagcuguaucccucauuuuaagagaaauacauauugauuguagaaaacuugauuaaaguggccaggcaugguggcucacaccuguaaucccagcacauugggaggccgagguggacggaucacgaggucaagagauugagaccauccuggccaacauggugaaacccuguuucuacuaaaaauacaaaaaauuagcugggugugguggcacgcacuuguagucccagcuacuugggagacucaggcaggagaacugcuugaaccugagagguggagguugcagugagccaaggucgcaccacugcacucuacccuggcaacagaguaagacucugucucaaaaaaaacaaaaaacaaaaaacaaaaaacaaaaaaacuugauuaaaaaaaccacaaagaauuaaaaaaaaaaucaccuaucaucauuuaaaaucuauuuccugcauauaaacauguaacaggaaucuaguuuaaugccugcugaaauggcagggcugcaguuaagagugaagaaguaucagacaaauaccuaaaggauaugaaauauaagaggccagugucugucuuagguacuaguuccuggggcugaucuccuuuugcagaguaaaguuuucaaauggaaccuaugaagccuuggcacucccaccccgacacuguggauuuuuauuacuuacgugguaaaaugugguaaugaaugggauggcaugggagucuuucuacuucgacuucuauguggaacauagcauggcuuuuguauuuauugugaccacuuuacgaaaugcagaaagcuagccggaacccacugggacuguugcuaagcauagagagaagaaaaccuggcacucuuggacaacaggauuguuaaaaugagcacugguaacaaugagggagccucaaaugguuucuauggcauucauucaggaaucaaaguuaauagcuauuaugugagugcuuacuccgugccaggcaggugugaaaaacacuuuauaggcuuuaucucaauuaauuuucacuccauaagaugaggaaauugaggcuuacaaaagguaauacuauauuauaugauauccaguuaggaucuguccaauggguguucauucuaugguuaaccauuccccuauuuuuugugauggaaaauaaugcuggaggaacaugcuuguguauaagcuuucauaugauucuuuuauacucaugaauuaugaguguaaaaauaaagagucaaggauaacauuuuugaggaucuagaugcaaaaugccaaagaguccugcuaauuuauacucauaggaguaaugaaggaacccauuuccaugaucauacugaggaaugauugcuuauaacguuuuuuuuucuuucugauuuguaaugaaaagagguauugauuaaguuuaaauuguauugacugcauuuagugauguuaaacuuuuaaaaguaaacugauaauagcuaaacuucaucuccacuggggguccugccuagguaucacugacuuguaagagcucauuauuaugccuuugccauguacuguacauaauuacccccaauuuaaagcuuucauuaucccuaacucagcucuaaacaguguuauaaaaggcugccuuuggcuuauucuaugauaaaaauagagcguaguggugcacaccuauagucccacuacucaggaggcugaggcaggaggauugcuugagcccagcuagccugggcaacauagugagaucccauuccuaaucacaauaauuuuuaaaaaaauuaauagcauagcaguaccacauaacuagccaaagcuggaguacaauggcgugaucuuggcacacugcaaccuccaccuccuggguucaagugauuuucaugccuuagccuccccaguagcugggauuauaggcacguaccaccacaccuggcuaaauuucuauauuuuuaguagagacaggguuucaacaugaccucaauugaucugccugacuuggccuaccaaagugcugggauuacaggcguaagccacugcacucagccucauaaagaaugauuaaaccucuguccucuaaaacaaauuuuuaaaaaggaaugcaucauauguagaauacuuuaguuaucuauguugguaaucuuggccccuacuaaaucaagaauuugacagaaaccaggaucaugaaaaacugagcuucuauuuucaucuuaaaaugagauggcaauuuuagagauuaaaagugaaaauguguaacaauguaaacaaucucugugugcacauacaaguguacacacccaaaucuguagaacaacaagaaggcuucaacucucccuugaguugccauugcaauuuuuauuuuuauuuauuuauuuauuuugagacaggcucucgcucuguugcccaggcuggagugcgguggcacgaucucagcucacugcaaccucugccuucugguuucaagcgauucuccugccucagccuccugaguagcugggauuacaggcaugugccaccaugccuggcuaauuuuuguuuuuuguuuuaguagagacgggguuucaccauauuggccaggcuggucuugaacuccugaccucgugaucugcccgucucggccucccaaaaugcugggauuacaggcauaggccaccgcgccuggcugccacuuaaauuuuuauuacuuucaugggacucaagucacuccacuuauuuaaucgcuuuaauacagggaugcucuuugaaggcagggacuuuuccuacuuauuuuugcugcaaugcuuuucacaguguuuuaugaaguagaaguuuaacaaauacuuguuuaauugaaccaaauguugaugcuaacuguaauaguacaauauagugauuaugauuauguauuuacuggaaaaaguuccucuucuuuaggaaugaagaaaaauauauuggcacuauuaaaauaacaauacugacagacagacaaacccuaaaugaguacauaagaucugacccugaagaucaugguguaauuacaccauucaguauucauuagguaaauaauuccuauguaaauuccaccaaaauuucagcacuaagaaaacuggaaagaaagaaaaaucucaccugauccucuuuugcucugucaggucacccucacuaaccaacaucgcugauaauaaccgaaggguugaauuggcagauuuagacugguuguuuuucauacccaacagccaccuuaccagaaguuuaauugccuguaccuauaaaauauuaacaugcuaaaaaaagaaagcaacuuaaaauuccaauuaaagggaaaauuaauuuaauuagauuaaugagauuacucaucuccaucagcagacauuuuauuaaauaagucuaugggauaauaacagcaacaauacgaacuaauauuuacucugugcuuaaccagugccaggcacuuuucuuagaucuguaaauguauuaacuuauuuaaucucccaaaaaauucuuaugaggaagauuuuuuuuuuuccaacagauaaggcaauugagacacauuauuaucauagauaacuugcuuaaaagucugguuccagaauuuaggcuucucauacuuagauguuugugcaagauuuugaaacuauuugaaaacauauacuuuaaaaacaacaauuuaaacuauacaggccggggguggugacucacgccuguaaucccagcacuuugggaggccaaggcagguggaucacuugaggucaggcguuugagaccagccuagccaacauggugaaaccgugucuauacuaaaaaaccccgucucuacuaaaaaaaaaaaaaaaaaaaaauuagucaggcaugguggcacacgccuguagucccagcuacucaggaggcugaggcaugagaauugcuugaacccgggaggcagagguugcagugagcugagauugugccacugcacuccagccugggugacagagcaaaacucuguuucauaaaaaaaccaaaacacacacacacacacacacacacacacacacacacacacaccccacaacuguacugauuguggugacugaaaauaacuugagaguuucaguuuugugguauugaaaaacuacuuugaagaaaccaucaagucugauucagucucauuuaacauugugaccaaaaaaaugggauuuuguguaauuauugguagucauaauuacuuagaaaugucuagucaaaagauuguuaccaauauaugugaaaaagcuagccaaaaaaucaaaguauuauuuauuauauuuauugacaaccuggaaaaaugaacugauagaauauaugaugacuacaaagcaacacaaagugaaagauuaucaaagaagaugauacaaucuuauuuuaaaucccaaaucugccacuuuucaacugagcuuuacaucuauuaaaugucacaaauuuaguaacaaucaucucuaucugcucugucacccaggcuggaguguacuggcaugaucacaacucacuguagccuugaccuccugggcucaagcgauccuccugccucagcuuucugaguagguggaacuauagguaugcaccaccacacccggccaaauuaucauuauuauuauuugagaccgaguuucacucuguugcccaagcuggagggcgguggcgggaccuuggcucacugcaaccucuaccucccagguucaagugacuguccugccucagccuccgaaguagcugggauuacagaugugcaacaccaugccuagcuaguuuuuguauuuuuaguagacaagggguuucaccauguuguccagacuggucuugaacuccugaccccaagugaucugccugccucagccucccaaagugcugggauuauaggcgugagccaccaugccuagcccaacuaaauuauuuuuaauauuuuguagagacauggcucacuaugcugcccagguuggucuugaacucuugggcucaagcgauccuccugcucugccucccaaagugcugggauaauaggugugaaaaacaaaucaaaguauuauuuauuauauuuauugacaaccaggaaaaaugaauugauagaauauaugaugaugaugaagcaacacaaagugaaacagauuaucaaagaagaugauacaaucuuauuuuaaaucccaaaucugccacagugcccagcuugacaauuaccuaucuuugccaaguuaauauucauaugcuuguagauaguggugaugaggcuggauuuaagaugccucugagcaccgucauucuauaaacagucucucuauaaaacagccucauuaagauugcuuuagcaggcagaagacacugacauguaauaaacaaugacaaccacaaugucuucaauaaaccauuuuuugcaauggauuuuaaaauaaaguaccuccuuaacaaaugcuuauuaacuauuagguuuaauuaaaaaaggcucccagcuaggcacgauggcuuaagcucauaaucccagcacuuugggaggcugaagugggaggaucagcugagcccaggaguucaagaccaaacugagcaacacagcaagaucccaucucuguuuauuaaauuuuuuaaaggugaggaagauaacuacaaaaugucccuuuuuuaaacaugaagauuaucaaggccuaaacaaauuuaccuuugcuaguacuucaggggaaaccucuucaucuggagaccacaguuuuccauucuuuucaccuguugacuauagacaauugaauaaauuuagcuauuagcaugaaaaaaaaaauuuauguuuuugcugauuaaguuuuucauguugaucaacacagccucugagaaaccuacgggaacaucaccaaccagagcuuggaaaaggacaaaguuagaagacucauacuucccaauuuugaaacuuacuauaaaaccuacaguaaucaagacaguguggcugguacuggcaaggauagacauauagacuaauggaauagagaacucagaaaacccuugcauauaugguaauucauuuuugacaaaggaugccaagaccaucuuuagugaaagaacagucucuucaacaaauggugcuagaaaaacuggauauucagccgggugcagagggucaagccuguaaucccagcacuauggggggaugaggcagguggaucacuugaggucaggaguuugagaccagccuggcuaacauggcaaaacccugccucuucuaaaaacacaaaaaaauuaguugggcaugguggugcaugccuguagucucagcuacucgggaggcugaggcuggagaacugcuugaaccuaggaggcagagguugcagugagcugacauugcgccaccucacuccaggcugggcuacagagugagacuccaucucaaaaacacaaaagcaaaacaaaaaaacuccuggauauccacaagaagcaaacacacaaacaaaaaaagaaacuagauuguuaauacauauaagaauuaacucagaauuaaucaaauaucucaauuuaauagcuaaaaccauaaaacucugaaaagaugacauaggaagaaaucuucaugaucuuggaucugguaaauagcugacaaagguuuaauauacagaaaauguaaauaacucuuaaaacucaacaagaagcaacccaacuaaaagugggugaaggcagcaugggcaacauggcgaaacccugucuguauaaaaaaauacaaaaauuagccaggcaugguggcgugugcugauagucccagcuacucaggaggcugaggcaggagauauugcuugagccugggaagcggagguugugaugagccaagguugcgcuagugcaccccagccugggugacagagugagaccaugucucaaaauaaaauaaaauaaaauaaaauaaaauaagaguggggugggggaaggaauuuaauacacagcucuccaaagaagauauacagguagucaauaagcacacaaaaaauauccuugacaucaucauucaucaggaaaaugcaaaucaaaaccacaaugagauaucacuucuuauccacuaguauggcuguugcuuuuuuaaaaaggaaaaugacauguaacccaacaauguuauuccuagauauauacccaagaaaugggagaacaggaacauaaauguuuauaucagcauuauucacaacagccaacacguagaagcaacccaaguguccaccaaucaacaaaaaaaugugggauauauacaaacaaaaauauacauauaaaagaacacugcuuagccacaaaaggaacaacauucugauacauacuacaacauggaagagcccugagaacaugcuaagugaaauacaacagacacaaaaggacaaauaucauauaagagauaccuagaauagguagucauagagucagaagguagaacagagggcaauggagaguuguugcuuaauggguacagaguuucuguauggggugauaaaaaauucuggagauggaugggguggugaugauuagguaacaauguggcuauuauguuagugaauuuuaacacuuaaaaauagcaaauuugauacuauguauaguuuaucaccauaaaaaaagaccgucugaaaacacaaucuaucaacaaucaucauuuaagagguaucuuaaauuucacauuuguugaaaaccacaucuaucgaaaguaaaaauaacagcaaggauauguaaggguagaaaaugagacuuaggccacguucuucucuucuugucugcugcguucaaaaguggaaggugguacaaauacagaaggggcacuagcaggugucuuuaaguuccugauacugaggccucaagauuaccgaaacaugugagaguuaggaacuuuggauaagcuggauuuguggcaaacuaacacuuaaaugaaagucauccacaaugauccagcauaucugugucuuuauucaauaacaacagauuuaauuuagauccauuugguaaagcagugauucuuuuauuuauuuauuuauuuuuuugagacagucuugcucuugucgccuaggcuggagugcaauggugcaaucuuggcucacugcaaccucugccucccggguucaagcgauucuccugccucagccucccgaauagcugggauuacaggcacucgccaccaagcccggcuaauuuuuuuguauuuuuaguagagacaggguuucaccauguuggcuaggcuggucuugaacuccugaccucaggugauccacccaccucggccccucaaagugcuaggauuacaggcgugagccaccaagcccugccaguagugacucuuaaucaagguguguuuccgaaaucauuuggggagucuuuucaaucuauacauuccaacccagagguaauaaaucagagcacacagacaucaauaaaucuagugccaaaaguacaguguauuaucuuaaaaauuagucaaauucaaguccacuuacuuuuuuuuuuuuuuuuuuuuugagacagaguuucgcucuuguuguccaggcuggagugcaacugugcaaucauggcucacugcaaccucugccuucuggguucaagugauucuccugccucagccuccugaguagcuaggauuacagcugccgucaccacacccggcuaauccacuuacauuucuaacaauguuugauaaaacaaauuuuagcccggcaugguggcucacaccuguaaucccagcacuuggagaggccaaggcggacggaucaccugaggucaggaguucaauauaagccuggccaacauagcgaaaccccgucucuacuaaaaacacaaaaauuagccaggcguggugacaggcaccuguaaucccagcuacuugggaggcugaggaaugagaggaggccaagguugcagugagccgagaucgugccacugcauuccagccugaggcacagagcgagacucuugucuucaaaacaaaaaacaaaaauaacccaauucuaacauuccagaaaaugauaaacugucuuuugagggucaggaaaauagcuuuuacuuauauguaacuuucaugauucaccaaucccguguucuaauuuuuguuucuuaagugugaaauucuaguaguaauagcuaccaugaaauaaggaaguaguuucgaauuuaaauaaauaaaaaauaaguagaaccaauauagaauaauuuaaaagaaaaagagaauuacacagaaacagaaguguuucugugaugaagauguaaacagccuuaaucucaugauucucaauuuaauuaaaugagaaacuuacccugucauucauuagcagaucuuucacaauaaaauuugcuacuacagauuucauuggggaagcaaacugaucuggugcuaacauagaaauguggcccaaugaaacuaauggaguuauaaguuguucuggcacaucagcauucagacuccuacugaguggcuauaaaaauaaaacagacaaaauuaccaauuuguuugauaaauaucuagacacucuacugaaacaguacauuuuccugaguccuccugaauuuaccaugcccaaaccaaucuucucuaauacgaucauaacuaacuucaaccauguuaagacaccugguucuuaauucaccuacuaaaauuuagcaagauugaaagaauguagaaaaaagauaaaagaaaaaauaaaauccaacaaaaagaaguuuaaagaaaaacauuuuugcuucaucaaaucagcauuauuuuugacuaaucuacaacaauggauuugcuauaccagugguuuucuuacccuguggaagcauuuuaaaugaccuuaaaucauacaaaguaagaguucacuggguuuuggucacacuaucuccaauuuaugauaauaggaauacauuucuaauaguaaaaugaggccagucauuauauguaaaaaaaagggaaacaggauuaauuuucagguaggguucuuagguacuuuaaacuggauuguucaaaauuaucuacuaauacuuuccgaggauaaaugcaccacugaaccaauaaggcuaaaauuaaguaaaauguucuaacauaaacacauaaggcuaggugugguggcucauguguguaauccuagcacuuugaaagacugaaguggguggaucgcuucaguccaggaguuugagaccagccugggcaacauggcaaaaccccaucucuauaaaaaaauccaaaaauuagcuaggcauggugguggugccuguacucucagcuacuugggaggcugaggcagaaggacugcuugaaccuaggaauucggggcugcagugagcagagauugcaucacuguacuccagcacuggugagaaagugaaacuuuaucucaaaaacaaacuaaaaaacaaaaaccacaaaacccuucaauaugagguguuugaacauauaaucugaucuacaggcugggaaugcaguaccacauaaaauagacagaauccuugcucacaaggaauuuauagucuaagguaggacuucauauaaacagcuuuaaaaaaucuagcuuccaucuucaucaaacuauagagcuuaaaaaauaaagaccaauauaaacacaaccuauauauuagauauaccucaaaaaucugugcaagcuggacuucuuuauuugugaauauggcguguauacagugcacagccuguuuugcuugguguggaguaccccucuuugcuuuuugauguaaaaugggaauuaagguccugcaaaaaauaauauaguuguuuuuuuuucuuaaacccauaaaccaacaaguauuccuuugguugacuuccacuuccccuauauggauggaugcuaguagagaaggcucucuuaaaaauuaucugaucuaaagaaaguuguaaaaaagcuccaucucugcccccaaguauaaaccaagaaauacaaugccucaagaaaaagccuacuucaggagacaauuuuuauuuuaaaguuaccucacaaauaugcaaaauaacaagcaacccuuaauucauaaucuaaagcuuaccccaugacauauuuuugcauuuaccuucuaaguagcaauauugcuaauuuuucaauucccuuuuauaauccccuucaguuauuucaaaguagcuacagaaagagaguagcaaaaggccaaguuguauuaaacagcugaaauaauacuagugaaagaaaguaugcaaagauacagcuacauauauaucaguagaauggcaauaaaaauaucuaacuauuaugugccaggcaccauucuagguauuuccgcauggauuaauucaacuaauguucacauccacccaaagaagacuaucauagucauuacacagaugagaaaauuaaagcacaaagauguuauuuaagccuccuaagaugacgaagcuaggaaacugggaguugggauuugaaaauuagcauuucuuucaaaauccacauacuuaaccucuacacugacaaugaagaguaaacuaaaacagucuucuuuuaggaugacagaaaaacauaaagcauucuucaaaaauuaaauguugaugacaugaaaaagcauuagguagaaugaagaaaauagugugcauauaugaacuuauaaaaaauagacaaacacaucuaguagaugaacauucauagaaaguauauauaucaaauguuaauggugacuauuucguuauauuuuuucuaguuucaguuugcuacaaugaacguaaguauuuuuauaaucagaauaaaauugauaaaacgaaacaaacauuuaaggaaagauauuugucauauauuuaauguuauuagagaagagccuauuuuauaaaguuaguggcaucaaaugcaagggugacaaugcccucuuaugauaauggaaggcuacauaugaaaccuauacugcaggcuccaggccaugcacuuuaaccaaaaaugggaacauaugcuaguugguaugaaucugauuugacauguauaaauaugccugaaguuugccucuauggacuuuggaauuaugagauagggauguccaugaccaaacagacuuccuugacugaguauugacuaugcuucuaaauggaagaugucuuuccucucuccuaucuguuuagucuuucaccauuccauuuaccagacugagauuucuuauaacacuggugaaugacaaaggaagauaguuucaaucaaacuguuguuaaauguauuauuauuauuagccaaauaaaauaauacagaaagucaacuuuaaccuuucuucuuguuuuuucuagagcaguauaaucuagugaugccaucagaguuguuauugaggucuuuagcauugugcuuuucugcuuuccagugauuaucuccuuucuucuccauuggucuuaugaauaagguauuuuauuccucacauccaaaguuaacucuuccaccuaugcucauuuucaacuguguccuuugggguagaauuccucuaagaauaguuucuuugccuugaaaaaauguauaggauuuccucccuugaaaaacucaucaaaaacuauccuauugugucagugaucuuuuucuaauaauguauaaaauuuauuauuucuagucuauaaacuccuugagggcagggacuaauugugguaacuuuuuauuauuagccagaacaaugcggagaaugaagagaauguacaauggacacugaauuauuucacaaguuaaacuauuagcucacaaauuuaauaaaaacuucaggagacugcuuguucuaugauuaucaugugaggaaaaugguauguaguugaauauacucugaacuaauugccaauacccugaacauaugauucaacugccauuugcaauguauuguuuccuucaaaagaugucuucugcauauuuuaagucuaaauauaacaucucagcacaaguuucaccuuaaccuuuuuaagaugccaaagugaacuauuugccccauuuuuugguaggauagcaaagugacaguuauugaauuuauaacccauuuauagaaaaaaagaugaauauacauggauuagaaagacauuagucauaaauauaauaaaacacuaaauucugugauaacuuuugauucuuaauaucuuaaaauacuuuuguuauaaacaaacauguaguuucaguuuauucugcugccugcauucuaauggugggagaggggugugaagcaagggaaagacaaagcagaggaggacacagaaaaguagcuucuaaaucaaaguugucuuucuucccuccuaucuuccuacacagaaggaaaacaaugauuuuaugguucccauacuuagaaacuuuuguauuuaccacgggagaaaaaauguacucacgaucguaucuggggaaggucuguuucuauuuugugaccuguauuucuaaaaauuugaauagcagcuucugcuaccuugucauccuccauucuuaggcacuguaacaaggacucauaugucucugcagaguggaacgagguaggauguguaaaagacagaaccugaaaaaacagauacagcuuuagaaguacagacaaugguuuuaauccauuaaaaaagaauuacuucccgcaaaagaaaaaaaaaauuaaauucugggguaaauaugcuagcuacacagaauagagauacaucuccuagccguccuugcaguuaguuauggcuaaucagaaauacuguauggugugguagcuuccaguuauuccuugacacaacuaacagacagccuuuguccuauuuucuucuucaccucuuagucuacucugcuacuuagaacacaaaacacauggcuccuuuuuuauggaaugugauuuacaauauuaauaacuauuaucaguuuauaaauauauuguauuuaggugaaggaaugcuuacuugagauaaaaccuccauacguaaugacucaaucuuuguguaacguaaacaaaaugcaaacucagagcuuucuuugacuggcaaaaagauaaucuaugagaauuuuuuuuuuucuuuuuuugagacaggauuucacucugucaccuaggcuagaguacaguggaaugucacagcucacuggggucucaaccucccaccucagucuccugagcugagacuacaggugcaccaccaugcccggcuaaauuuuuuguuuuuuuuguagagaugaggucuagcuauguugcccaggcuggucuccaaccccugugcucaagagaucuuccugucuuggcugggauuacaggcguaaaccauuguacccagccaaaaaaauaucugaagugaaaucuaucacucaacauaauuaucaacaaagaagccacuauugugaacuuuuaauuaugauuacaauauauaauuauucccuuauuauaacaccagcacgagccuguccuuaaauaacuuuuagcaaguuagauacaugucuaaagaguuaaccuuccauaaaguagaaacaauucaguuaguguaguaucaagauuaggaaaauagagaagcagggagaaaggggaaugagcagauggucuucauuaauuuuucaauaagcacuuauuuaauggucauuaaguguagacacugucucacuuggcaagguuuggagugauaauauuuacuuacgugguuuuaauuauuuacagaaaauuggagaauuaaauuagaaaaauguaauaaaaagcaaucuacuggccgggcgcgguggcucacgucuguaaucccagcacuuugggaggccgaagcgggcugaucacaaggucaggagaucgagaccauccuggcuaacauggugaaaccccaucucuacuaaaaauacaaaaaaaauuagccaggcaugguggcgggagccuguagucccggcuacuugggaggcugaggcaggagaauggcgugaaccugggaggcggagcuugcagugagccgagaucaugccacugcacuccagccugggcaacagagcaagacuccaucucaaacaaacaaacaaaaaaaagcaaucuauuaaaaaauguuaccuuaaaggugguuucacuuuuaaaacaacuuaaaaauacaacucaauuacuaaaaacaauuaaaaucuuauucaugaggcaucauaucaauucuauuaaugaaaugauuuuuuuuucuuuucuuuuucgacagucucacucugacgccaagcuggagugcaguggugugaucucagcucacugcaaccuccaccuccuggguuccagugauucuccugccucagccuccgaaguagcugugacuacaggcgugugccaccacgucuaccuaauuuuuguauuuuuaguagagacgggguuuccccauguuggccaggauggucucgaucucuugaccuugugaucugcccgccucggccucccaaagugcugggguuacaggcaugagcugccgagcccagcugaaugaaaugauauuuaagacccuuggaauaugaucccaucauucuuuuucuaucuaacauccauugcacugguuugucucuucuccuguaugucacagugguaucaugucucuuugccuucaauuucuucccuucuuuuacucaauccaaugaaagcucuaucaagggcugcagcugguuguaagccagguuaaaagcccgugacacuaccuuucuuacccaguggcacucgacaaucuggaaccaaccuugucucccaucauuccccaaagcaccccuuuuuucuagucaugccagucucccaagaaucccacaaauauaccaagaaauacucccuuuaaugaugauauucccuccucuagauuuagucacauacccuguccacaaagucuaaagucacaucuugcuauuacuaaguuaagaauagauuguacaguaaucacuaccaagcauagaaggcauggaaaugauaaacagugaaacaaauauuaauuuauaauguaaaauaauuacauuauuauauuauguuguaaaaacauuacuuuuacaucaucuaauuuccaacacaaguuuuaaaucuuucaaauaguuuccugugaaauaagccugacucuugcauauccugaagggaaggcaaauuaugaccccacggaaauacauggcaacaaaacuguuucaaaaauaccuuaagaaguucaaguccugaacggauagcuguaucuggacuuacacccuccucuucaucaucugcuguccccucuauugacuuauucaucaauuucacuagugcacuauaaaaagaagaaaauauaaaucaguaaccacuguaguaguaacuauauccuaaucacacugugacagaacauauauagaaccuuaaaauauuaaauucaaaggaguuucugugggggaaaaaaguucaaccuuguccucuacuugauaacuaaacuucuacuuaguuuaucccccuaaaaaacuuaauguauaagaguaacucuucuaaaaaauaacaaaacuaaaauuaaaugacacagcacucugguaauauauucacauaaguaauuuaauauucauuuccauauauacagagaucauuuucaguuuuaagaaaaauaauaauauaguaguugcuaagugagcaaugacaacugacucaaaaaaauacaaauaauaaacauacacauggacaaaugaauuaaucacugauaauuuacugaaucaguaacuuuauuucuauaaacuuacagcaaagaagcaagucauuggaagcaucaugcuguauuuauaaagauucauuaauuaggaacaauuuaauugucaaaaauuaaggaauuaguuuuucaaaauaccuaccaccaggaaauagaauauuaucuggucaauaaaaaucagaugauguagcaacaugguacuauuuuaaguaaaaacaaaugugacuucugguuuugagaucaguaaacugaagaagauauuacccuauuaugagaacauucaauuauuauuacaaauguucaaaacaagauuuuggcuaauuuuuuuuuccuuugguguuaugucaaaguauucauuaaaaaaaauuuaaguaccaaauaugcauaggaugcagauguugaaauucuuuucacuuauaaaaaauuaacaaaaauuauaaauauucaugggguacacagugauguuuccagacauauaaugcauggugaucagaucaggauaauuaacacauccauuaucuuaaacacuuaucauuucuuuguguugggaacauucaauauuguccuagcuauuugaaacuauguuauuguuaacuauagucauccuacugugcuauggaacacuagaauucauccacccaucuagcugugauuuuguauccuuuuuuguaauuuuguauuucucccuaauccucccuucccacuaccuuuuccagcuucuuguuuccucuguucuguucuuugcuucugagagaucuacuuuuuuuuuuuagcuuccaccuaccagugagaacaucugguauuuaacuuccuguuccuggcucauuucacuuaacauaauguccuccaaugccauucauauugcugcaaaugacagcauuucauucuuuuuuuuauggccgaauaguauuccauuuauuuauguaccauauuuucuuuacccauucauuccuuggacacagggugauaccaaaucuuggcuauugucaauaaugcugcaauaauaaugaguauacggauaucccugauaaacuuauuucuuuuggauguauaccuaguagugggauugcuggaucauaugguaguuguauuuuuuaguuuuuuuuuuuugaggacccuccauacuguucuccauaauggcuguauuaacuuacagauguugaaguuuaaacuaaguuuagcacuuacuuuccuuucccucuuacaucacaagaauuauuuuaaaauucauuaucuucaguuaaucugauaacauuaaaaaaacaaauugcuguauauguguauaaacauuaacuuaaaguauaauauaccacacaauucccugaauuaaaauguacaacucaaugguguuuacuauauucacaagguuguaccaccuaacuguagaacaucccaucacuauccuaagucaaaccccuuaccuguuagcaggaacucauucaccauuacucccuccagcccuaggcauuuacuaaucuauuuucuccccuaaacacuugccuauucugaacauuucauauuaaugaaaucauacaauuucauaggguuuggcuguguccccacucaaaucucacuuugaacuguaauaagccccacaugccaagggcggggccagguagauaacugaacaugggggcaguuuccuccauauuguucuugugguacugaauaaaucucaggagaucugaugguuuuauaaaggggaguuccccugcacauacucucuugccugucaccauguaagaugucacuuugcucuugcuucaucuuccacugugauugugaggccuccccaaccacguggaacugcaaguucauuaaaaccucuuuccuuuauaaauuacccagucugggugacagagccagacucugucucaaaaagaauaaauaaauaaaacaaaauaaaauaaaaauguaaaaaucugaauuugcauuucccaaaugaguauuaauacuaacuguccuuucuugugcuuauuuaccgucuuaacuaguaccuguucaaauaugcccauuuuaaaacugagucaucugucuuauugaguaguuccuuauauagccuggauauaauccuuuaccaaauacaugcuuuucaaguauuuccucccagucuguggcuauuauguucccucuaagaaaucuuugccuauccuauauguuuucuggaaauucuagcucugacuuuguauuuuaaagauucauucaauuugagaaaauaauuccaaauugagcuuuuuauuaagaaauccuagucaacauugcuugaauuuaacaaaauuacaaguguguuucaaaaaaauuuauaaauauguaaauacaugugauagguuccaugcacacgauuauuucaugaguauuuauuaacuaccugucaugugccaagucuuauggucuaccugagaaauacaguaugaaaugagagacauaaucucugcuaucauuguaauguugguaaucaccaguaugcgucaaggagcuauaagcgaaagagcaaagucuucaaaccagguucacaguccuuccucuuauaaaguauuuuuccucuuuuauaaauuaaauaaauaauauauauuucacagggcuaucaugaugaaaaagacgaucucaagugccucuucaaaacugcuugggaagucuaugcuauacaaccacuguuacaaaucuucaccauucuaaacgaagucuaaauacucccauuggcaacuucaucuuuaacagaaggaagaguaguaauggacgccuugagugaaaacucuucuaauuuuccauaccuaaucuucuaaccuccucuaauuuguguguauuauuuugucaugucauagguuaagauguccuucuucuugcucugcuuccuuaggaaugcugcucccucauaccuauauuccccuucccuuaucugcaaucugucuucuuuucaacuagcaucuuuuuuuuuaaaaaaagaagaagauggagucucacuuuuugcccaggcuggagugcaauggugcgaccucagcucacugcaacuuccgccucccagguucaagugauucucaugccucagccucccgaguagcugggauuacaggcacgcaccaccacaccuggcuaauuuuuguacuuuuaguagauaugggguuucaccauguuggccaggcuggucuugaacuccugaccgcaggugauccgcccacuucggccucccaaaguguugggauuacaggcgugagccaccacacccagccuucagcuagcaccuuuucaagguauuuaaauauucaaaauuauuuagucaaaaacaacagcagaagauucuucuucaagcuuacuccguuuccaucaucuuauuuuucuguuacuuuucuuuugaggcucaaacucugacuuuagcccaguuuuuuuguuuuugucuuuuuuugagacacagucucauucuguugcccaggagagagugaagugccgugaucucagcucacugcaaucucugcuuccugggcucauucuuccaccucagccucccacauagcugggaccacaggcgcaugccaugguauccugcuaauuucuguauuuuuguagagauaggguuuugccauacugccuaggcugguuucuaacuccuggacucaagugauccacccaccuccgccucccaaagugcugggauuucuggcgugagucaccacacccagccuucuccuuugcuuuuuuuuuuuugagucucgcucugucacccaggcuggagugcaauaaugugaucuugggucacugcaaccuccgccuccuagguucaagugauucuccagccucagccuccugaguagcugggauuacaguugcgugccaccacgucaggcuaauuuuugcauuuuuaguagggacgggguuucaccauguuggucaggcuagucucaaacuccugaccucgugaucugcccgccucggccucccaaagugcugggauuacacgcaugagccaccaugccuggccuccuuugcuuuuuauccaagauuggcgcugucuacacugauuguccccacuggugcugucaauuuaucuccuaagcaggguuuagaagggugacaaggcuauguaucccuuuaacaugcucaagccucaguguagccaagugguaccuaguggcuuucuauugagcugggccaguaaaaaacagacucaguagucuucucugccuaaguaauacugaucaccuucucuguguaccacgauguacauguuggaaaggacuguccuaugccuuucugaauccauggcauucuggcuuuguccuugcuaccgcacagaaacugcucuguucauugugauuuuuucccauuuccuaauccauucgaugauucuuaguauuuaaucaacuucuggauaucaucugaccccuccuuagccccucuuugguuucugugauaacacucuuucccaauuuucugcuuuugacuaugucugcucaaaacuuaaaaagaaaauuuaaguccguuaucuucugccagccucuuaauugcuaauuucccucacgauucaguccucaaccuuuuccuuuuuaaaauuuuacuuucaccuggguuccagccaucauuacaaugacuacuucauuuucaucuacuuccuauagaccauuaacuaacuguagcacacauaugucaagguguauggacauauguauaggggggaaauugauuauauuuagaaugauuuuauauuaaccccaauccuuucuuucaaaauucuaggccaggugcaguggcucaugccugaaaucccagaaauuugggaggccgaggugggcagauugcuugagcacaggagcucgagaccagccuggccaagauggugaaacccugcucuacuaaaaauacaaaaaauuaaccuagcaugguggcgcacaccuguagauacagcuacucgggaggccgaacccgggaggcagagguggcagugagcugagaucgugacacugcacacuccagcccaggugacagagcaagauuccuucuuaaaaaaaaaaaaaaaaaaagaaaggaaaagaaaaagacaaaagaaaggagaagagaagagaagagaaaaaaaacuucggcaugguggcucaugccugaaauaccagcauuuuggaggccaaggugggcagaucacuugugcccaggagcucgagaccagccugggcaacacggcaaaacugcuucucuacuaaagaacuuuuaaaaaaauuagcugagcauggugacgcacaccuauaguuccaccuacucaggaggcugaggucugagaucguuugagccuacacaacagugagccaggaucgugcauuucagccugggcgacagagugagaucguguauccaaaaaaguaaagagaaaaagaaaagaaaaucuuaauaaaaaagggcugcguauaguggcucacgccuguaaucccaacacuuuuggaggccgaaguggguggaucgcuuagguccaagaguucgagaccagccuggacggcauggugaaacccugucucuaccaaaaccaaaacaaagcaaacaaaaaacaaacaaaaaaaaacacccucacaaaauuagccaguugugguggcaugugccuauggucccaucuacucuggaggcugagggaggagcaucaccugagcccaggaggucaaggcugcagugaacuaugaucaugccacuguacuccagccugggugacagagcaagaccuugucucaaaaaaagagaaagaaaaaaaagccaauuuugauuuuuuuguauguugagagaugagagauagcggucuaguuucauucuucugcuaaucaguuuuccuaccacaauuuauuguagagacuaucccuucccuccuuguauguucuugacaccucugucagaaaugagcgggccaaaaaagcaccaauauguaucuggguucucaauucuguuccuuuagaugugucuaguuuuuaugccaguaucauguugauuugguuacuguaguuuuguaguauaaagucagguaguuugauggcuccagcuuuuguucucuuuccucauauugcuuuggcuauuugagucuuuugugguuccauguaaauguuaggauuguuuuuucuauuucugugaagaaugucauuuguauuuugauagauauugcauuuaauuuguaaauuacuuugaguaguacugucauuuuaacaauauugauuuuggccgggcgggguggcucacaccuguaauuccagcacuuugggaggccgaagugggcggaucaccugagguugggaguuugagaccagcccgaccaacauggagaaaccccaucucuacuaaaaauacaaaauuaggcaggugcaguggcgcauaacuguaaucauggcuacuugggaggcugaggcaggagaauugcucgaacacaggagguggaggcuguggugagccaagaucgcgccauugcacuccagccugggcaacaagagugaaacaccaucucaaaaaaaaaaaaauuuuuuuuuaauuuuuccauuucacgagcauggaauaucuuuccauuuuuuguguguuuccguuaauuuccuccaucagcguuuuaaaguauuucuuguaauagaucuuucacuuauuugcuuaaguugauuauuagguauuuaauauucuuuguagcuauuauaaauaagauugcuuucuugauuuuucggauuguuugcugucggcauacguagaugcuacugaguuuuguauguugauuuuguauccugcaacuauacugaauucauuuaucuguucaaaacaguuuuucgguggagucuuuagcuuuuucugugauaaugucaucugcgaacaaggcuaauuugacuuccuucuugcuaaauuuggauggccuucuuuucuuuugacuaauugcucuagccaggacuuccaguaauuuguugaauaaaggugguagaaguggcuuccauaucuuauuccagguauuagaugaaagccuuucaauuuaccccauucagcacaauguucagugugggugugucacauauggccuuuauuauuuugagguauguucccucuauaccuauuuuguugaggguauuuaucauaaaguaauguugaauuuuauugaauguuuuuucagaaccuauuaaaaugacuauacgguuuuuauucuugguucuauuaauaugaugaaucauguuuaucgauauaugauuuaugaaccaucucugcaucccugggaugaauuccacuuuauugugaugaauauuuuuaauguguuauugaaagcagguugcuaguauuuuugaggauuuuuguaucuauguucaucagugauagaccccuaucccucacccucuaaaaaaaucaaaucaaaauggauuaagaccuaguggaugaaacuacuagcagaaaaugcuaggauaaugcuuaaagacagugaucugagccaaguuuguuuguguuaacaucccaaaaguacaggcaacuaaagcaaaaauagaaaaauaggauuacauuaagcuaaaaugguucugcacagcuaagggagcaauaaaaaaagcgaagagacaacccacagaaugagaaaauauuugcaaauuaucccugugucaacggauuaauaaccagaacauguaaggaguucaaacaacucaauagcaaaauaacaaaacaaaacaaaacaaaacaaaaaaacaccagacaaacaaaaaaucaaaaccauacaaaaaaauccaauuuaaaagugggaaaacaggccaggugcaguggcucacgccuguaaucccagcacuuugggaggcugaggcgggcagaucacgaggucaagagauugagaccauccuggccaacauggugaaacccggucucuacuaaaaaacaaaaauuagcugggcaugguggcaugcaccuguaguccuagcuacucgggaggcugacgcagaacugcgugaaccugggaggugaagauugcagugagccaagauggcgccacugcacuccagcuggugacagagcaagacuccggcaaaaaaaaaaaaaaaaaaaaaaaagggcuuuuuaucaacaagacagggaauaacggaugccggcgaggauguagaaaaaagugaacccucauacacuguuguuggaaauguaaauuagcauagccacuaaggaaaacuguauggagguuccucaaaaaacuaaaacuggaucuaccauaugaucuagcaauuccacuacuggguauauauuuuuuaaaaaggaaauuaauauauugaagagauaucugcaguccuauguuuauugugucacuauucacaauagccaaauauggaaugaaccuaagugcacaucaacgaagaaagaaaaugugguauauauguacaaugaaaaauuauucagccauaaaaaaagaaugaaauccugccauuuguagcaacauguaugcaaauggagcucauuauguuaaauaaaacaagccaagaacaacaaaaaaaaaacaaauauugcauauucgcagucauauuugagagcuaaaaaugugaaccucaugaugacacaguagacugguaguuacaagaagcugggaagggugagaaaggcggaaugaagagagguuaauuaauagauauagaacgacuaguguuuuagagaucgguagagugacuacaguuuaauagcuaaagagaauuugaauguuucuagcauaaagaugaauauuuaaggugauguauaucaccaauacacugauuugaucuucacaaauuguauaaauguauuaaauuaucagacauagccugaauauauguacauuuauuauguuaugggcugacauguguuucucccaaauucauaugaauucuaauccccaguaucucagaaugugacuguauuuagagauagggccuuuaaagagauaaucaagguaaaauaagauugaauggguggggccuaauccaauaugacuauuguuccugcaagagauuaggacauagacaugcugcgugcacagagaaaagaccacaagaggacacagugagaaggaagccaucuguuuaugaagaugagaggcuucaggaaaaaaauuaaaaauugcugauaccuuggaucucaggcuuacaccuccagaacugugagaaaauaaauuucuuuuguucaggccaggcacugggguauuuuguuaugaaagcccuagcaaaugaauauaaucagcauuucaauacagccacaucagugauucaccuaaggugaaauaaacagcgaagcuuggguacuggaacugaucucugaauucuaggcuguuuggaaaaagaaccaacaagugcugcauaguaacugaauauggaaagauauauagcuuaucuacuggaaaaaugauuggugcaagagaaaagcauuaccagacguuugaaaagucugaaaucaugagaauacguaauaaaaaaucaauagcucuuaacuaaugucuaugaugccaggcugcuuaccuuuuauauauuaccucaaauuaacauaaucauccaacaagauuuuaugcccauauuaaaguugaaaauaaaugaaaauucaaagacaauccaaagccacaaaguagacuuauguuuugaaaccaaauuugccuaaagauaauccucuccucuuuccaacauaccauucuguucucacacaucaaaugaacagugguauaauauguacuacagaauauuacagggccauuaaaaugcuuaagaaaacucagagguuggucaacagccacacagaucuaaaauauuccuuuuucugucuuucucuuuguucuaaguuuucuuuaaugagaacgcauaagcuaaaaauaaacauaagaacucuuuaaaaacagaaagcauuauauaaagccaaagaucauaaaaugagaaggcuuucccuucaacuugaaugauguacaacccugugauuaaaaagagacauacagagguuuucagguaucuuuaggagcccagaauuuaaauuaacaacauugucguugcagauuauuauuuauuuuugagcgaauauacuucuuggcuuaccuuauggcuucugaaucaaugugcacaggugcgauucuuuccaacagaaauuugaccaucucuagaaaaggauuuguugguugcuuaggauuugcaaguuuccgggcuauuucucucuauagaaagaaaggaguuuuaccaaaaacgugauuugcuuucauauuuuugaaaagaaaaaugacuaaggaacugaaauauucaaaaccagcauaagugguuaagaauugucugcucuagacccugacuaaaauuuuuacaccccgagcaaugacugaaaaaucuggacagcagagaaaagaaguggaugaugugguuucugagugaacacagccuugccucacaauucuuugaugaaauuauugguugauauagcaacuuuuuuuuuuuugagacgagucuaacucugucaccaggcuacagugcaguggcacgaucucggcucacugcaaccuccaccuccuggguucaaaugauucuccugccucaggcuccagaguagcugggauuacaggcacgugccuccaugcccagcuaauuuuuguuauuuuuguagagacggggcuucaccauguuggccaggcuggucuugaacuccugaccucaagugauccaccugccucgaccucccaaagugcugggauuacaggcgugagccaccacacaccuggacuauggcaaccuuuuuaauacucuaauuuagaauaaaaacaauuuguacuuuuauggguaugcuuuauugguuuuaauuauuucauaauuugacagaacauuguguuuuguuucaguuauuuuuuuuuuugagcuggagucucgcucugucagucacucaggcuggaaugcaauggugcaaucuuggcucacugcaaccuccgcuucccagguucaaacaacucuccugccucagccuccauagcagcuggguuuaaacaugcacgccaccaugcccggcuaauuuuauauuuuuaguagacaugggguuucgucauguuggccaggcuggucucgaacucccgaacucaggugauccaacccgccucggccucccaaaaugcugggauuauaggcaugagccacugugccuggccaguuaauuuguuucuuaaaaaauacauauucaggccgggcgcagguggcucacgccuguaaucccagcacuuugggaggcugaggcgggcggaucaccugaggucaggaguucgagaccagccugaccaacauggagaaaccccaucucuauuaaaaauacaaaaucagccgggcuugguggcgcaugccuguaaucccagcuacucgggaggcugaggcaggagaauugcuugaaccugggaggcggaggcugcggugagcugagaucgugccauugcacuccagccuggggaacaagagcaacuccaucucaaaagaaacagaaacacauauucguacauauauauauauauacuugcaaaauuuuucaguucuggaagaacauagguggaggauaaaugagaacucuguacacccuuagaauuuuauuuauaaguuagacauacaguuauggaaggcugauagauaaccccaauaauaaaaguaacucucagccaggagcaguggcucaugccuguaaucaaagcacuuugggaggccaaggcagguggauugccugagcucaagaguuugacaccagucuggaaaacauggcaaaacccuguuucuaccaaaaaauacaaaaaauuagccaggcgugauggugcaugccuggggucccagcuacucaggaggcugaggugggggggaucacuugagccugguaggcagagguugcagugaccaccugagauugcacagcugcacagacucugucucaaaacaaaaaacaaaaaacaaaaaaaaguuaacuauccauuuaagcucaaagauuaugguauuaggccgggugcaguggcucaugccuauaaucccagcacuuugggaggccgaggugacggaucguuugaggucaggaguuuugagaccagccugaccauucucagaggccauucucagauuugucuucucuuucauuucuucucuaccuccuccaagugauguaauugugcuaauauauagaaccaggccugaaucccaacacuucugaacacaacugcaaagacgcuaucuucuucccuaaagcaucuccucugauauccagucagccaaacugaaaauauagcagucauucuucacacaauggucuaauuccuauucauccuuuaagacucaacuuaggagucacuuauucuagaagaagccauuccuggaccuauuuccaccccugccuggaaugaguaaugcuucuuuauuuuaccaaagcacacaauucaauggaaauauuugucagccucugucacuuauucugcaagcuccaugagaaaccauguauuauaaaauuuauuuaaucaugcagugaauuauaacagugugugcuugaucaagaaagaagauauuuggacuucugaagauauaaugcauauccagguaacuagguagaggaggguuuuuaaaaguguaguccauaaaccacucauguugaaacuugguuaaaagauggagagauucaugaugcuacaucauaaccuauuuuaaagaugccuacucuuuguaaggguaagaccuauaaaaaugaccauuuauugaaacccuguaggcagugcaggggggcccugcauuaggccacauauaaaauuucauuuuacauuauucuuuuaaaaauucuaugagguugauaauauuuauaggugaagaaaaugaauaaggaggcuugaaaauacugaguaacuuacuaaaggucauacugguaguaaacgauauucaaaccaaggacuguuucauuaaaugucaaauaaacaagcuuccuggaaaauauuaaaauuuggggaccacucucauggggaggggggcaauggagcauaaacuaugacgcacagcugaagcuauggcaaguaugugguccuucucuagggucaagguguagaaaccuaaaaccugaauucuaaagggaaaguaaaucuauauaucacauuucaauuccacugcucacucucauucauuauaucccccaccccacacacaaauacacgucucuuuugauaaucuuugcucaaaguauguuugcuaagauuuuucagaaauggaacuuggacaaagagggaagaaaauauuagauuucuaugccuacuaacucucguaucaaguaauaucuaccucuugagaagugagauaugaaaauaaggagguagugacaaauacgcauuaggguacagagaaggaacucucaaggauggaaugcaagcuacauagaaugagagaaacuaaauuuuacauuugcauuauuuuucuuuauucuucuacaucagaaaaggaauggggauauuagaggaaauauguaaauaauauucaguagcccauaggggaaaggacaaacucauaaagguacucuagcagagguuuguuuucaugugugccuaagggagguauucuaagucccacuuuacguaugagaacacauaguuaaauaacauacucaagucacacaaugcuaauauaagagcuaggaaagaagguauaaugaacucaugcucuuaccacugcaagugcaguauucauuucuaccucacugguuccuaauaucaagagcacugauuggcuauacuguguggcuguugcagucacaguguugggauuacaacagugagccaccgcgcccagccuuuucaagcuauuucauugucugaucuaauuauaauaguagauucucugcaggacacaguacucuggaacuagaauucuaaaugccaaagaagucaaugaaacuuuuaagcguuuucagcaaauuacucagcucagaaguacaaagcuuauugggcaugguggaucaugccuguaaucccacuacuuugggaggccaagguggguaggaucacuugaguccaagaguucaagaccagccugggcaacauggugaaaucucaucucuacuaaaaauacaaaaauuagucaggcaugauggcgcaugccuguaaucccagcuacuugggaggcugaggcaggaggaucauuugagcccuagaugcagagguuacggugagcugagauugugucauuacacuccagccugggugacagagcaagacccuaucucaaaaaaaaaagaaaaaaauaaguaaguaaauaaaauuuaaaaaagaagugcaaagguugagguugucugggcauuuggcacauccacauucauagcccugagagacaagcccacucuucucuucccuaaauugguuuuccuccccauguccuccuaauuauugguauuuguaaugguauucagaucucuaugcugaauaaaagauacauguucuaugcagcuagaccucuccacauauacaucuauuauaguccuuauccuuuauaaguuauuuuaaaaccaucaacucuaaucccuucuagaacaaaguuagacauauguaauugaaauuacauuucucuuauuugucucuauaagccuggucccaagcauaguacuugacguuuaugucuaacauugugagaaggauuauuuauuuaaauccaauagggcagugcagggcccuuauacagagaaauacauacccucccccugcccacacacacaaagaauuauccaucacucaaugguggagacagauuuugagaaauguguuguuggccaggcacgguggcucacaccuguaaucccagcacuuugggaggccgaggcgggcggaucacgaggucaggagaucgagaucauccuggcuaacauggugaaaccgcgucucuacuaaaaauacaaaaaauuagccgggcgagguggcaggagccuguagucccagcuacucgggaggcugaggcaagagaacgcagugagccaagaucgcgccacugcacuccagcuugggcgacagugagacuccgucucaaaaaaaaaaaaaaaaaaaaaaagagaaauguguuguuaaggcaauuucaucaugugaacauuagagugcacgcacacaaaccuaaaugguauagcguacuacuucuaugcuacaaaauuguacagcauguuacuaugcuaaauacuguagggaacuguaacacagugguauuuguguauuugaacauuaucuaaacacaggguaaaaauauaaaagauaaaaacacaauauaaaccauauaauaaaaaugccauauaaaagauaaaaaacaguacaccuacauauagagcacuuaccauaaaugaagcuuacaggacugcaaguugaucuggguaagucagugaguaaguggugagugaaugugaagaaacaggacauuacaguacacuacuguagacuuuauaaacacuguacacuuaggcagcacgauauuuaaacacuuuuucuuucuucaaugauaaauuauccuuagcuuuuuguaauauuuuuacuugaugaacuucaaggguuuguuuuuguuugauuguuuguuuuugagacagagucucgcucugucgcccaggcuggagugcaguggcaugaucucagcucauuacaagcuccgccucccagguucacaccauucuccugccucagccuccagaguagcugggacuacaggcgcccgccaccaugcucagcuaauuuuuuuuuuuuuguauuuuuaguagagacggggucucaccguguuagccaggauggucucgaucucccgaccucaugaucugccaaccucggccucccaaagugcugggauuacaggugugagccaccacaccuggcccgguuuuuuuuuuuuuuagcuuuuaaaaaaauuuuuggagacaggaucuuguucugucacccaggcuggaaugcaguggugugaccauagcucacuguaggcuuaaaauccugggcucaagugauccucccaucuuggccucuggaguagucaggacuacaggugugcgccaccaugugcagcuaguuuucuuuaauguuuuguagaggcggggguuuugauauauugcccagguuggucucaaauuccuggcuucaagugauccuccugccuaggccucccaaagugcugagauuacaggugugagccaauguacugaucuuuuuuuuuuuuuuuuuuagcuuuuugacucuuuuguaguaacacuuagcuuaaaacacauuuuguguacagcuguacacaaaaugguuucuuuccuuauauccuuauucuacuagcuucuuccuauuaaaaauuuuuuuggcugcaugugguggcucacaccuguaaucccaauauuuuguggggcugaggcagguagguuucuucagcucaggaguuccagaccagcuuggacaacauggagaaacccugucucuacaaaaaauaaaaaauuagcugggcaugguggcaugugccuauagucccagcuacucaggagauugaagggagaggaucacgugaacccaggaggcugaggaugcagugggccaugauaacaucacugaacuccagucugggugacagagcaaaacccuguuuaaaaaaaaaaaaagaaaguuuuaaaacuuuuuuuugugcaaaacuaagauacaaccacauacaauagccuaggccuacgccaggucaggaucaccaagaugucacuaggugauaggaauccuucaguuccguuauaaucuuuuuuuuuuuuuaaugcuuuaaguuaugggauacaugugcacaaugugcagguuuguuacacagguauacaugugucaugguaguuugcuacacccaucacccugaguucuguuauaauauuaugggacucccaaaauacauguggucuuaucuuuggccaaaauguugucaugcaguauaccauuuuagauacaucaagaaucuuuugccuggguguguggcucaugccuguaaccccagcacuuugggaggccgagguggguggaucaccugagguaaggaguucaagaucagccuggccaacauggugaaaaccuaccucuacuaauaauacaaaaaauuagccagaugugauggcucaugccuguaaucucagcuacucggaaggcugaggcacaagaaucgucugaacccaggagguggagguugcagugaggugagauaaucacuugaaggaguuugagaccacccugggcaacacagagacaaaaauuuuuauuuuuuccuuuucuugagacagucucauucugucacucaggcuggugugcaguggcaugaucucggcucacuacaaccuccaccucccgaguucaagcaauucuccugucucagccucuugaguagcucagauuacaggcauguaccaccacaccuggcaaauuucuguauuuuuaguagagaugggguuucaccaaguuggcuaggcuggucucgaacucccaaccucaggugauccacacgccuuggacucccaaggugcugggauuacaggugugagccaaugugcauggccuccaaaaaauuuaaaaacuuagcuggguguggaugcgugugccaauaguucuagcuauucagaaggcugggguauaggaucacaugagcacaggacuuuaacgcuguagugaacuaugauugugccacugaacuccagccugggugacaaaagcaagacuaucucaggaaaaaaaaaaaaaaagcugaauaaaugaaugcauaaguuuucccuccugauagcuuuaagaauauugguuuuaaaugaguucaagagaagaaugaagacaaaagucuagauaggaauuuacuuuaucuguaaaugaaaccagauauauggcaauguuacuacuacuaauuuauugacgauuauuuccauucuaauacaugaaagaagaaaaugcacauguacacaagcauucagaaaauacuuaucauuacucaaugaaugucuacuaaguucaaaguacuuuaucuuguaaaauuccuaagaccaaucucccuggcuuaguucuuuaguuauuuuccuggaauguggcugagagugaaugguaaauagagaauuaacuugacaauagauauacuccaaaguaauucagagcucacaauauuguuacauuuacacaaaucacuguauguaaaacaggcuuuaauaaaauacauauuucuguaaguaaagcuagagaaaaagugugaaguaugauuuacuaaccacacaaauaucugcuuguuugcaagaacagguugggcuaauuaauaacuccaacugagaccgaaguuucucaucaucgccgagaaccugguuaaauuucuucacaaaaucuugugcuuucccggggucaggcaaauucucuauaaaauuaaaagagaaucaauauuagagaaggaaaaaaaaaaaacuauucuacuaagcuaaaaacaggugccaucaaaauauugcggagccacuaaaagaaaaucagccuagcugguucuuagaaacaaaauuaagauaaagauuauuuucuuuuacuuaacauuaaaucaguagucccacuggguaaauacuuugucugcauuuacguuuacuacauguuuagugaguaaauaaacauacucacuugcuauggucaucaguuuuccaaacauggcagaacaguuagccucugacugaaauuuaaaacagaaacaaaagaacaacuagucauauguguuaacaaauuucccuaacaaaaaucaauacucauuacuguacauuuuucaugacguuaaaaaauaaaguucaucacagucugcucaauggaaaaugguuuuaccacauauauacgcuaaacuaacaacaaagaauuacauaguagcaacuauuaagacaaauagaaggaaaggagauguugggaggaagguacuuaaaaacccacaaguauauaacuuucacaggaaaguuacauugccagaagauugaaaaaagaucaaugaagcaaucaacauauaaacuuaucauaucagaauuacuaugaaacuacaugccacaaaaaauuaacuaaaaauauagagaagaaacuuuuuuuucugcaauagaguucuguuagcuacuuuguggcccguuacuuaaauaccuucaggaaaaccuccuuucuaaaacguacuucccuuuccuguaucccauaaaacauuacuuauuaguuuucauuuauacuaaauuugaauaauuuaguucaaaaguuagaaaacuaugcccccaugagcuaccuguuuuuguuaguaguuucgauggaauauagucauguccauucauuuauuuaucguguaugacuaauuuugcaaaggcaggguugaauaucugaccacagacucuaugccuugcaaaauauguuuuugcuaucuguugauuuauuuucaaaguuugcuaggcuaggugcaguaucucacaccuguaauccuagcaauuugggaggccuaggcaggcagacugcaugagcccaagauuuugagaccagccugggaaacauggugaaaacucaccucuacaaaaaacauacaaaaccuagcuggguaugguggagcacacccguagucccagcuauucagaaggcugaggugggaggaucaccucagcccagugacaucgaggcugcagugagcugugaucaugccacuaugcgacagccugggcaacagaguaagauccuguguauuaaaaaaaaaaaaaaaaaaaaaaaaaaaaguuugcccgccccuguuccagcauccauguguccuugaggggucuguuuauaugguccccugguuaagaacaccuauucuagugaacacacguaaaaauguaaaguuuuuuuccccaaccuugcaaaaauuuaauggcauuucuuuuuuaguuugccauuggcauauuuauaggauugauaucugauauucacucuacacugagagaccaugaaucaugcagugaaaaagaaauaugauguuuaauguaauuuuaucucaaaauuuaauucuaauuauuugaaaauugauuaacuauaaacucuuagugucugaaaacuuuauauaaacuagaaaacaccauuucuuugcucacacuagaaaauaagaguuuguuauauuuauuuuaaauggaaauuuagcuuggacaacuacagaaauuauauuuaacugacauuuggaaaauaaaacaacugagauacuuuuucccugcuucauuacguagaacuacagaaaaucugaacagugacuauaauaaacuaugaauuuaaacaaaucaugaaccuacuguaggcugcuugugcaaauccaauaguucgcguacauggcuccgaagcauguucugacacuuccacauuucguugagagcucuguaaaguuaugaauaugaaaacacacauuacauaacaauacuggaaauuauucagcuuuacaaccuuucuuguugcaugcuguauauacaccauucuucuacaucuaccuaaaaguuuaaauaccgggaaauauauuuauuaggauuuaaaacaauuuaguacaaaugguaaauauaagccuucuuaugagagaaaauauuugagagguuuagaaagauuaauaaguaauacagggauugaaagauguacuaaauacagguagcuagaaaguuuugguacaaggaaagaaaaucucaaagugcaagggacauaaaacaaacugaaaaacauguauacgcuuggagcacaaggcauguguguggagcauaaggaagcuggagcauuccacagacacagaucaaaucaugaaggccuuauuaaaaaggcuaaggcauauacaugaagcacuauagacuauuuugaaaaaugaaguaucaaaaaugaugcagauucaagaugccaaauuuacauuauuguguuuauucuaaacuuuucucucuccaggaacacagauuuucuucucucagaaaucccauccauauuuccaggugcccagaugaccucugagaauuacuaaucucuaaacacucuuugucagauauuuugaaauguaaacaaacaucaaaaccuuaagcaaggaaagggauuaguaaccaugauacaacacuaucguaauagaauuucugccaaaaugacagucuuuuuuucuuuucuuucuuuuuuuuuuuuuuuuuuuugagacaagucucacucuguugcccaggcugcaguacaaugggauaaucucggcucacugcaacaucugccuccuggguucaagcaauucuccggccucagccucccuaguagcugggauuacaggcgugcaccaccaugcccaacuaauauuuuuguauuuuuaguagagaugggguuucaccauguuggccaggcuggucucgaacuccuaaccucaaauuaucugccugcccuggccucccaaaaugcugggauuacagggguuagccuccacguccggccuaaaaaugcagucuuaaucuaauaaugcaggaacacuugaagaagccacaauggcaaacagucaaauuccuaacucaaaauucucucucuuuuuuaagacagaaucucacuacauugcccaggauggucaagcuucuaggcugaaaagauccuuccaucuucagaucagaauucuuaaugacaucacucauuuacuuuguguauuuuugacaaaaauuacauauacgaugguguacaacauaauauauguauauauuguaacauuuacuuuaaaaaaaaaaucuauuaaagugaaaugaccacacauccugguuggccugggacaguuugauuaugcuauuuaaguaaaaauaucaauagugaucccuuucagucugaaaauaauccaguuggaccauuaaucauauggccaucuuacacagagaagaucugaauauguucacccaacaaagaaucaguauucaguuauuaggcuuaauauuuagucuggaaggauaaagcaccaguaguuuuagacacuagccacagguauuuugacguggucauuuauuugaacaccugaaaccauccuacuacugaccuggcugccaaacaagccuacacauauaagaauaaccugaacauaaaucguaacauuuugucuauaaauauuuaccugagguucuugauucaacuauagaagcagcaacaauccaaucaauaacaacuaauuagauaagaugaaguaauuuuacgaaauccuuagaaaauacagcaguuauuugaaaaguaacuuacuuuacagcauuuggauccaaacuagcauauaaguaauauaagcauuucauucucucuucuguuuccagguugugggggacaagauacugagcaaagauuuucucuaccaacagucuaggaaauaacaacaacaaaaaaaaccuaagugacacaauuauuccauuuuuaagaagcaauuuuuuuuuuuuuuuuuggagacagggucuugcucugucacccaggcuggaguacaguggugcaaacucggcucaaugcaaccucugucucgcagguucaagcgauucucccaccucagccucuccaguagcuaggacuacaggcgcgugccaccaugcccagcuaauuuuuauauuuuuuguagagacaaggugucccuauguugccaaggcugaucuggaacuccugagcucaggcaauccgccugccuuagcguccugaagugcugggauuacgacgggcaugaggcaccacacccagccaacauuuuaaguuuuaaccaucuuaugccaggauaccauaucaagauaauagcuaugugugcacauacaauggaagauaucaguuuauaaugacuuccuucuuggaaagcuuucaguacaguuuaacuuuagagacacgguuacugucuguggcuuuauaauuugucaguaugaaacauuuguucuagaagguuuaaauguuauuccuaaacacagggugcuaggcuguuccgccuauucuucuucagcagucuagaacaaaagcaaauucauuaacgcaacauauaaagcuaugauccgcgguagagcuaauucucaagaaacucauuaauuuccucugauuacaguucagcccauuuuccauguugucacauaguuaaaaacagggggaccccccuucauauuacuuccagaaaauguaguuuuuccuguguacaucugauuauuguucucuccaugaucuaaauuccuuaccaauauuggaauauccuucuugcuaguaccuauugcuuguaucuucuugcuucuauuauuuaauaucacuggauuaagaauauacaagaucucuuaauuaacaaaugaaauacauauccagugaugccagagaaguuaguuuaauuaaacaaaacaauggaaacuauucugcacacaccaaguaucauuuguacgauccaauauagaauuauaaguaauauucagaaaaugaaaacaacuuaguaauuccucuauugguagugguguaaaaaggaaaguaacuagcaguuaacucaauagugcucucuugccacacauugggcuaggaugcuuuauauucauuauuuuauuuaaucuacaugauaauccugugggaaaggcacuauuauuuuuccuuuuuauauaaaacugaagcgcacaagaccuuaaugaaccuauguaagaauacacaucuaauaaagggcagagugaacauuuggucucuaacuccaaaguucaugccuauuucauauuauaaggcuaccuuauaaucguggacagucuuguuuaaacacaguacauaaaaauauguaaaaagcuaucucuaaacuuagaaauaaaugauuaaucaaguugaauaaacuuaauuuuauuuaugaaguaaauacauaaaaauaagaaauuacuaaaauauuaaauagacauuuuuuaaguaaaaaguaguuuuacacucaaccauucuaccaacauauuaaacucacuugucgucaaugcuguucugauaauaaauaugcagaaguuuguccuuuauccagcugacuuucucugcagcuuccuuuccugcuucaccaugaagacaguauuucuuauaaagcugagccagacccaucauagcuucuuuucuuacucgccacuaaaaagcauaaaauuuauuagaugagcaagauaacaaaacucuguacuaaucuccaaagacugccuuggcuucauuagguuguacagucuuaugugugccuuuauaaacuggcacacuauuucucuucaaaagaggcuuuacaaacaauuuuauuuuuuuuuugagacggagucucacucugucgccuaggcuggagugcaguggcaggaucuuggcucacugcaagcuccgccucccagguucacaccauucuccugccucagccucccaaguagcugggacuacaggcgcccgcacgcccggcuaauuuuuuauuuuuaguagagacgggguuucacccuguuagccaggauggucucgaucuccugaccucaugauccgcccgccucggccccccaaagugcugggauuacaggcgugagccaccgcgcccagccuacaaacaauuuugaaucuguuccuauuuagaaauuuuccaaugcaaauauugcuaaaugaucuacuuuuuucuuuuuaaagaaaugggguuucguuacguugccuaggcuggucucaaauuucugggcuaaagugauccuccugccuuagcauccugaguaccuagaacuacagguuacugauuuuuuauuucccuugaaaacuauuaauaaccuuaugggagaguucauuugauucuauugaaagaaaauucaccaaguuuuagaagugauuauaauuccccuugcaaacaaaaccccuauuaucuggaauguuuuaauugccaguuacaucccuuuagauguuaacuucggauaagaacaaaguucacuaucaagaauucugggccaggcaugguggcucaugccuguaaucccagcacugugggaggccaaggcaggugcaucgcuugagcucaggacuuggggaacugacuacccagugaaucuaaaauccuaguaaaucuaaaauuguagugaaucuaggaguugagcuggcugacuaaccagugaaucuaaaaauaugcucacaagcugacaaaaccugcccacucaaacagagcuuccaaucagcugugcagugagucaguuaaaaaucugaccaagggcgggcaugguggcucacaccuguaacccuaguacuuugggaggccgaggcagguggaucaccugaggucaggaguucgagaccagccuggucaaaauggugaaacccggucucuacuaaaaacacaaaaauuagccgggcaugguggcacgcaccacuaauuccagcuacuugggaggcugaggcagggaaaucacuugagccugagaggcggagguugcggugagccaagauugcgccacugcacuccagccugggcgacagagugagacucugucucaacaaaaaaacaaaaaacaaaaaacugaccaacuauucaaggaucaucagaccuuugaggaacgcuuucaacaguaaagagagggaccaaaacaaacaggccagaggaggaaaacaggacucagcagaaacagagauaauacaggcaguaaaagacacuuccaaacauucucagggagauaagauuuuacaccauaaaauaagacucaaugccucugacgaagaaaggaaggaagauagggagagaggcagggagaaaaggagggaagaaagcaaggaagaagaaaaggaaaggagggaagaaaaaaaggaaaggaggcagggagaaaggaaguuagaaaaauuaaugauucaaucugaggaaacugauuuaaaaaauaaaaaagaaaagaaaaacaaagacaaauuagauaacaagaggugcuuuuggaaauuaaaaauggagaugaaguaaaaaaaaaaaaagauaagaaaauuaaacuaucaguccaagaauuucaacaucaaauuaaagaguucccaaaagagagaacaggcucacgccuguaaucucaacacuuugggagguggagguggaagcaggcacagaucccuugagcccagaaguucgagaccagcuugggcaacauggugaaaccccgucucuacaaaaaauacaaaaauuagccaaguguaguggugcacaccuguagucccagcuacuugggagacugaggugggaggaucgcuugagccugggaagaggagggugcagugagcugagauuacaccacugcacucaagccagggcaacaaagugagacccugucucaaacaaaaaaaaaaaaccuuagugaucaccguaagugaacuuccuuacguugcaaaccuaaaaggcaaacgauuuagcuaguuggcagaagauucuuugggacuuuuagagguugggaagguuuaauaggguaggaaagaaaaguuguaagagaagagacaggaaaggagaccauaaaaacuuagaaugaggaucaucauaagauguaagaaaaauaauaguaaaaaaaaaucuguguauuaaaaaaaaaaaagcagcagcagcagcagcugagugugauggugggagccuguaguaccagcuauucaggagaaugaagcaagaggaucacuugaauccaagaguucaaguucagccuggguaacauaguaacacaccaccucuaaaaaagaggggugggugggaguauauuaucuuugguguauuuaagucaauacuucuuuauaaauuuuuuuguaucauuuucucauuuuuuaggccccuuauuagauggaauaaaacuuuguuccuauguaacagguuagcaaaagccuuuugagauuucuuacauaaaaaaaaaaaaaaaaaaaaaaaaaacaagcaauaaaaucuuaagaugaaauccuguucccaaauuucuagaggcuauaaccaaggacaucuaacuuauuaaaccaaaauaugggucagaaaauauccaguagguguuacuguuaccacaccauacaguuucaguuaggaagauucauuuauucaacuuucugaaacuaugaaaaaacuguaauaguagugaaacuuuuuaaaugggggaagggaggaaugccaaauaaccacuagggagagagucauuucauuuaaauuaaagccaagggaaaaaaaucuucaaaguuaaaauuacuaacacuguugaacaacuuaaaagguaucugccuuuuuuuaaacaucuggcuccugugacaauuuuaaaaguaaaaacuuaaagaauaccucuuucuauauuuuaaaacccaaaccaauuacuauucuacccugaaauuauaauacucauuugcagacgaaaguaauuuucaacuacaccucaaauaaaauaauagcauguugcaagguaaucaugaaacaugcuagaaauguuaggccuaaucagccugccuuacacaucuguuucuuguuuacaccugacgcuauucauuaguuguauucuuaacacuacuuuuccuuaacaauccauguuuucuuuucuuuucuuuuuuuuuuuuuugagacagagucucgcuuugucacccaggcuggagugcaguggugcaaucucggcucacugcaagcuccgccucccggguucacgccauucuccugccucagccucccgaguagcugggccuacaggugcccgccaccaugcucagcuaauuuuuuguauuuuuaguagagacgggguuucaccguguuagccaggauggucucgaucuccugaccucgugauccgcccgccucggccucccaaagugcugggauuacaggcgugagccaccgcgcccggcaauccauuuuuucaacugcaucaaauggagaaaaucacaggaaaaauaacuaaacauauaaccaucauuauuguccuuagcuuggcacaucaauauguaaacgucacuuucuuaggaaguaaaguucaaugaauggcagacccagcuaaguuauucaagaaagucauaugugaaaauguuaacuauaagaauagacgaucaaucacuauucuuuugaaacucaucauguaaauaaaaagguaaaauuuugauuaacuuagugguucucuuaugaagguaugauagaaaagaaacccaugcuuaagaucucaaaagguauagaauccauuguauuuauucauaaggauaauuaaaagauaugcaggaaacauacaaauuaggagcucuuuaucauuguuauuaauuugauuuucacacagaaagacauuaaauguaacagaaaaugauacccaauuguauuuagcaauuuaaacaguaaauuacagaagaauaaaaugccucagauuuuacccguuuauccaguguucuuucccuuacaaagccaagcagcugaucauuuacuaaggccaggucccucuuggcagcuguuauuauaguaacaaugacaucaugacgaauagcuucuucuggaucaugugaucuaaccuuuaaauauucuguaauaagagaaaaaaaacuuaggcuaaauguuagcuauguaauuugucaugauuuagaauggcaagaacagaaauauguuaaguuuuuguccauacuaaagcaauguuuguaaaauauggcaugaaauuaaaucauguuauuuuuacagcagcaguacucuacuguaaucacaaaacugcacuuuaaacucccaaguuggccaggugugauggcccacaacuguaauaccagcacuuugggaggcugaggcaggcaggcaggucgcacaagcucaagaguucauaccagcuuaggcaacauggcaaaaccccgucucuacgaaaauuaccaaauaaaaaaacucauuagccagaaguguaguggcccgccccugcagugccagcuacuugggaggcuaaggagggaggauaacuugagcccagaggucaaggcugcagugagccaauaucaagccacugcacuccagccuggguaacagagugacgcccuguaucaaaaaauaaaauaaaauaaaauaaaauaaaauaaaauaaaauaaaauaaaauaaaauacuucacaguuacaucuuuuuuuuaauuuuuauuuuuuguuguugaaacaacaacaaaaacagccugucacccaggcuggaguguaauagagcaaucucggugcacugcaaccuccgccgcccagguucaagcaauuuucguaccucagccuccgauuagcuuagauuacaggcaucugccaccaugccuggcuaauuuuuguauuuuuaguagagaugggguuucaccauguuggccaggcuagucuugaccuccuggccucaagugaugcacugccuuggccucccaaugugcaggggauuacacgcgugagccaccaugcccauaguuacauuuuaauaauguauuuucaucaguuauccuggaaaagucaacucacaaugcaguaucugaucuaugucagcuugaauuucaguuacuaauuaaaaagcuuaaaagaaaaacagugaaaaugcuuauggcaauuuagcugacagguauauacuugcaaauuacacaauauaaaauccagaauauuuuauaaucuguucaaaaaauucuuaaauaauuuauaauacaaacuaaaucuaaacaaaaacauguuguuuccccuguucuuuuugguaaauaacagccugcugauaaaaaccacuuaugugcugcuaccaaaaagguagauuuaaaugcucuagauucaaaagaaugaaaaauucuagucuagugcagaagauaaucauguucccacuuauuauuaaaugccacuauauuuaauuaaauagacauaaugauuucuacccaaauccaaugucuuaagaaauacacuacuuccuuaaauuaugauuuucaaaaaauuucaaaggauuaaaauaugaagauuuuaagcugggcauuguagcacccgccuguaauacucgggaucucaaagugagaggucacuugagcccaggagugaaagccuuucucuuaaaauaaacaaacaaacaaauaaagagauuuuaaauguaauuuuauuacaugaacaugaaaucauuucuuagugcacaacaaaugaaaacacgagaccauaccagaguuaaaaccuacuuggaaagugaaguuaggucacaagucauaucuacaauauaguuguaugguuaugcuaauauguguaauaaaccagcuagcuuaccugugagauccuucgcuaaaucugggugauucauuaaacaaugacuggcaaauuucacacuuucuaaucucacaggaacaugaauaucauuaaaucuacacagaaaaagauugcuaaacauuaauuguaaggcaaaauaaucacucucaaaucagguauaucuaacaugaaaauacuuauacgcaacaauaguuacugauuagaaaauuuguuaugagcuaagguauucugaaggaagaauauaaaguacacuauaaggugaaaggauacaauuucacaaaaacauauucacaaacagaauuucuuuaccaugcuaaaacuaacuaacaaaaaacaguauaaacaaacacauccuucaacccaaacuauacacuuuauggaguuaaaaucugagagcuuaauauuaugcuacaaaguaaaaaauauucaaaacacacaaaaucaguuugaagaauaaguuuauaggagauuccaggcacgguggcugacaccuguaaucacugcacuuugggaggcggagacagguggauugcuuguggccaggaguuuaagaccagccuugaacacauggcaaaacccugucucuacaaaauauacaaaaauuaggcaggcaugguagcaugccucuguagucccagcuauuacucaggaagcugagguggguggauugcuugcacucaggaguucaagaucagccuugaaaacacagcacagcccugucucuacaaaaaaacacaaaaaucagccgggcguggaggcauuccccuguagucccagcuacuugggagggugagguggaaggacugcuugagcccaggaggucgaggcugcaguaagccauaauugugccacugcacuccaaccuggguaacagacccugucucaaaacaaaacaagacgaaagguuuauaugagacaaacacugggaaacuugagguagagagcaaaccauauauaaggggcaaauccagaaguucaaagaugagugcagaaaauguguuacuagcucaggcaugguggugggugccuguaauaccagcuacucaggaggccgaggcaggagaauugcuugaacccgccaggcagagguugcagugagcagagaucacgucacugcacuccagccugggcgaugaaguaagacuccgucucaaaaaaaaaaaaaaaauuuguguugcacugucucaccacuuaaguuucuuuuggccagcaccaacuuguauuacagugcucuuuuaaaggucuaguauacguuaagaauucaauuaacauacaacacaauauguagacucaaaaaugcacauguuggccgggcgcgguggcucacaccugcaaucucagcacuuugggaggccgaggcgggcaaaucacgaggucgggagaucaagaccauccuggcuaacacggugaaacccugucucuacuaaaaauacaaaaaauuagccgggcgcacuggcgggcgccuguagucccagcuguuugggaggcugaggcaggagaauggcaugaacccgggaggcgaagcuugcagugagcagagaucgcgccacugcacuccagccugggcgacagagugagacuccgucucaauuaaaaaaaaaaaaaaaaaaaaugcacauguuaaggauaagguaaggaacccucaaauuuaaaacagauuauuaggcaacuuuuaaaauauacugauuaaugauaaauaaugugaucugaaauagcuggaaguauuuuuauuuuugaaaugaucucauaaaaaaaccaaguaaacaaaaauuguuuaauaaacgucuuaaugucuauggccucccacuuucuuacccagauaaaauuuucauguguuaauaaaauacugcauuuaggauuuguaauucucuggcuggcagagaaaaauuauacauuauuaaugaucaaguaauuacaaaguaucaaaacacuuaacgcuauaauuauggaaaauaauacugcagacugugacuuguuucuaugaaucagagacaccacuacaguuagcagugaguguaaaauaaugagugucagaaacuuauauugggugauuucauuuuuaaaaguaaccaaagugaaaaaugaagccuugcguuuuugcuuaaaugauuuacaaaaaauauuugauguccauccugggauagggaauuccucccccauaacuuugaaagugcaguugcuucauucccaccauucaaaauucucauggagucacauuuaguuauucaacuauuuagcauuuauuccuauaagaccuucaaaauggcguguucugggcaaguaacugcuaagauagcaguaggccuugucagcgauuucucagaaccuaggauuaguaugagaacuauuauggugaauuuacaucaagaaaaauucuggcaccaacuacugaaucaguugaacuaaaacaacggagaaucucgaacaucuccagaauauuaauaguaaauaucuacuuuccaaucagcuuuuaaagcaaaacagguaaauggaaugcaaggagaaauuuaaugaauuucauaaauuugucaacacuacuaucaagccaaauagaauuuagucauucuaagcucuugagaagaaacauuaaaaacuaucugaguuaauggcaaucauauuuuccacuuaaaaaucauacaauuauaccaaauuaguuaaaacacaccauacaauguguucagauaaguuacagacccaaacgacaagcacuaguaaaugaaaaaguugguaggcugacaaauggcacagguucuuaaauuuggaucaguauguauucaguuucaugauuuaaagaucuuaagacuuagaauauacugcaaugcuguuuauuuauucuaaugacuuucuuuuuuuuuuuuuuuagacagagucucacucugucacuccggcuggaaugcaguggcuugaacucaacucaguacaaacucugccucccggguucaaggauucucccgccucagccucuugcguaguugcgguuccaggugccggucaccaccccugguuaauuuuuguauuuuuaguagagacaccauguuggucaggcuggucuccugaacuccugaccucaagugauccgcccaccucagccucccaaagugcugggauuacaggcaugagccaccacggcuggccaugacauuauuuuaacacaaagaaguuaaaaagaguuacacagauaaaauacuaagcuuucuucauaaaaaauuuuucauacaauuuauuccauaagaaggauggaaacacagaugacaaugaaaccaacaucuauuaaugaaaguuuugauauguauaguuuuaaucaaguggacugcacccuacugacuauuuucuaaaauauaaacaucagaauuauauguucucuuaccguccaagaaaacauugccaaagaggacgauucuguguugccaaaucagaaucuuuggagccaaacaauuuagcuagaagucgaacaacagcuaaucgcucuucuccaucauugcucuaagaagggaaaacagaaagugaagccuaagcuuuauucaccagauuacagaaaauaucuugaaacauucucaagaagauacuauuucauauuucugcuuauaacugugagaaguuuaaaauaucauauguccucacuuacuaugcagaaauugauuuaauuucauguuagaucaucuggguuuuugcucuuauuucacacccucccaacugcuaauuuaugucuacuucacugauuaauugcauucuauacauugguuauggacacuguacaaauaugagacauacaauucacuucuaacauuaagaacccuauaaaaacaucuaugaaggacaaaguuacaguuaccacccuaauaagcuuacuuuauaggaaaucugcaauuuacguuccaacauaaacacacaucaauuaaaguuuugauauacaaauuuguuuuuuuuuuuuuuuuuuugaggagucuugcacuguuuucccaagcuagagugcaguggcacgaucucagcucacugcaaccucugccucccggguucaagagauucuccugccucagccucucgaguagcugggauuacaggcgcccaccaccgcaccaggcuaauuuucacauuuuuaguagagaugggguuucaccaucuuggccaggcuggucucgaacuccugaucucgugacccaaccaccucggccucccaaagugcugggauuaugggcaugaaccaccgcaccuggcugauacacaaaguuuuaaugaaggauccccuacgacuggagaauacgacacuacagaauuucaugauucauggaaacucauuuuaauagcaaugcaagaaucaaaagaugaucugaaggucagcuuaaauacuauaaaaaagcaaaacuucauuguuuucuaguaagauuauauuuucuuauccugaaacaguauaugcgauaaaaauucuguuccaguuucaguagugaugccaugcuuuaauguaaaauaaguuauucuaaaaccauauggugugugaaacuuuucaaaaaucauauucacuaggaaaauaaacauaguaucuaaaagcaacugcuaauuuuuuuuagguguucaaauauaauaugugccuaaagcaauaccagauauccaauaaacaaaauaguuuuggaaaagagaaguaaaaauagaaaaauaaagaccacaggauaaaauccuuuccuuaugaauguuuuaacguucaagaacagggguuuuguggguaaaacaggcacacuuaaccaauguaaaaaugaaaauuacaucaaguauuaacuauuuuaauuuuaaaugacaaaaaugauuuuuuuuuuuuaagagguaagagucuugcucuguugcccaggcuggagugcaauggcaggaucauggcucacugcagccuugaacuccugggcucaagugauccucccaucuuagccuccugaguagcuggacauacaggugugcaucaccacaccuggcuaauuuuuuauuuuucuauagagacagaaucuuaccaugcugacaagguuggucuugaacuccuggccucaggcaagccuccuaccucagccucccaaaaugcugggauuauauggacaugagguaccacaaccggccugauuuuuuuuuuuuuuuuuuuuuuuugggugagacaaggucuggguguggcucuaucacccaggcuggaguacaguggagcaaccucgguucacuauaaccucugccuuccaggcucaagccauccucccaccucagccuccugaguagcugggacuacggguguguggcaauaugcuuggcuaauuucuguauuuuuuguagagauggggugucaccauguugcccaagcuggucucaaacuccugggcucaagagaucugccugccuccaccucccaaagugcugggauuacagguaugagcuaccgcacuuggcccagccugauuuucuuugacaaaauuuuucucaagcaaaaugacaauaaugcagaguagcacaaccuucuaauaaguucaauuuauuagccaauaugauuuacuucuuaaagaaaaaguaaucuaucccuuaaauaugaaacaauauauggaaauuuuauucuaauagcaaguaacuguuuuaguaaaucagugauuauuucaaaagaggacauuucacaucuauaaacuacagaaguaaaacuaacugaaaacucgccccucugcuauuuguaaaagucaaaauauauuccuugaccaggcucaguggcucaugccuguaaucucaguaauuugaggccaaggcaggagaauugcauuaggccaggaauuugagaccagccugggcaacauagugagaaccccucucaaacaaacaaacaagcaaaaaauugccaggcauggugagguauaccuguagucccagcuccucaagagacugagacaagaaaagccgggcacuccagccugggcgacagagcaagacuccgucucaaaaaaacaacaacaacaaaaaaagagacugagacaagaggaucacuugagcccaagaguucaaggcaguauuaaacuuuuacaaauagcagaggggcaagaauuacgaauuacuugcucaguugucuauaaaaaauagauauacuauuuuuaggacagucaaauuucuguccuuaaucuguaccaugaaaaggucauaaaauuguaagcaauaccauaugaggauuacauuuaaaauauuuugauguucuaaaacauaucuaucuaauaauggauaccauuuaauaccaacauguauuauaaaucucuaagauaauaccauuuuuccuaucuauugcuugugucacugugauuaucaguagauauuuaacaauuaaaaguauuauaauuuuguggccaggcgugguggcucacgcuuguaaucccagcacuuugggcagccgaggugggcagaucacaaggucaagagauugagaccagccuggccaacauggagaauccccaucucuacuaaaaauagaaaaauuauaugggcauggugguuugcaccuguagucccagcuacucgggaggcugaggcagaagaaucgcuugaaccuggggggcaaagguugcagugagccgagacugcgccauugcacuccagccugagcaauaacagcaaaacuccgucucaaaaaaagaaaaaaaaagauaaauugaagucacacuuuauucuucuacaguuacagaaaaauuaugcgguauacauuuuuccuggaaaguuuaaagggcaugaaaauuggucaauuuuacauugugccugcucuagaaacaaaaaaauuaaaaaaaaaaaaagaaaacuggucaaucuuaccuuuaguuugaauucaagcuguggcaugacggauaauaauaaaugaggaucuauagcaaaaaguuccugaaucagaucaaauacauguucugacaaaucacuuacugaugaucuucccagcaccaggacuugauugaaaaacuguaagagauauuaaaaacaaaaagaaaacauccaguucauuuaaaaacauggauacauuuuuaauaaacauuuuuuauaaauaauuuaauuagguauuacauauacaauugaaggaggugauacaaacaggugugugauuacuaauauauaauaggacagucaucuaaacagcagaagaaauaauuuccuaauaauaucaaaucaugaauguuacaaggagaaaagcaaaaaaaaauugguuuguuggguguauuucaaauaaggacauuucuaggaaucuuuguuuucauuaaaacaauuuagacagucuguguaguucauuacaaaggauuuuagaaaaauuuccuuguagcagagaaaaauuacaaagucucaaucuuugauuuuuuuuuucuuuuuaugagauggagucuggcucugucacccaggcuagaguacaguggcgugaucucggcuuacugcaacuuccaccuccgagguucaagcaauucuccugccucaaucucucgaguagcugggauuacaggaacccgccaccaugcccagcuaauuuuuguauuuuuagcagagacaagguuucaccguguuggccaggcuggucucgaacuccguaccucaggugaucuacaggccucggccucccaaaguacugggauuacaggcgugacccauugcgccuggccucaaccuuugauuuuuaaaaaaaucaaaggcacagcagcacacgccuguaaucccagcacuuugggaagccgaggcacgacaaucuugagcccaggaguuggagaccagccugggcaacacagugagacccuugccucuacaaaaaauaaaaaaauuaucugggugugguagugcaugccuauagccccagcuacucaggaggccacggcagggggaucauuuaagccccaggaagucgagguugcagugaguugugaucacaccauugcacuccuccugcaugggagacagaacaagacccugucucaaaaaaaaaaaaaaaaaaacagaauaauuuuuccaugaguuuaguaauaaagaguauuuaaagcugaaggauuuuuuuuuguuguuggguuguuucuuuuaauacucagagaaagucaaauauguuuugacucgcaugacaaaaagaacaaaaaguugguaauacaaaagcugauuuuuuuuuuaaaugcuagacagaaauaaagaguauacaaggccaagagcgcaaauuaaaagauaccagcacugcacaccaccgucacacaugcagaagaauuaaauuuuuaaaaugccucaggggcaauuguaugcaacugauacaagcauacacuucugguaguaucauaaguugaaaagcagcaugaauuaaguuagaaaauauucauuauuggccaggugugguggcucacaccuguaaucgcaguacuuugggagucuggggcaggcggauuaccugaggucaggaguucaagaccagccuggccaacauggugaaacuccaucucuacuaaaaauauaaaaauuagcagggcgugguggcacacaucugcaguacagccacuaaggaggcuggagcaggagaaucgcuugagccugggaggcggagguugcagugagcugaaaucgcaccacuacacuccagccugggcaacagggcgagacuccaucucuaaucauucccacuggauaagaguaauaucaaaaaauucauauuuacuaugcagacauugaaaauaaugaagaagauaguuuuaucaaaauauaugcauacacacacacaaaaaagcacagaauacuacuucugaaaggauauaagaaaaccuaauggggaugguuauuucugagaauuaagaaauguauucaaggcugaagacagacacuucuuuacuacuauuauuguuuaaucuguuuaaauauuaauuuaguaauccaaguaauacuaauaggauaacauuuaaauuaaaagccucauuuggauuuuuauccauggaaaauaauucaacaauauauaaauguuagauucacaaagaugauuaggaaaggaaagaaacacugaaaagaccuagaucuaugacaauaaggaaauacguaucaagaaacauuuacagucauucuuauauauuuaaaaagaaugucaaaauacguaaauacaaauaugacgauaaaaauuuuacauaaaauagccgggugcgguggcucacgccuguaaucccagcacuuugggaggcugaggcaggcagaucacgaggucaggagaucaagaccacccuggcuaacacggugaaacccugucucuacuaaaaauacaaaaaauuagccaagugugguggcgggugccuguagucccagcuacucaggaggcugaggcagcagaauggcgucaacccgggaggcggagcuugcaaugagccgagaaugcaccacugcacuccagcuucagagacagagugagacuccgucucaaaaaaaauuuuuuuuucauaaaguaugugggaaaauaguuauaaauaugagcaaaugaacaauggaauuaguugcuauaagguagugagauugcaaacuuuuuuuuccaaauuauugauuuuuuuaggaaaaacaaacccagaacaaauuccucaguaaaccuuuuuuuaacuauuacuauguagcaacuaucacaaucuuucauuacugaaaaguauuuaaaucuuugccaaaaacaacaggcaaaacaaccaaaccauuuucuaaauaaaucucuguaaucuuaaaaaaauaaaauaaaaaaaaaaggaagaaacauuacaggacuucagaagaaugacccaaaagaaacaaagaaaaaaauauauagagagagacacagagacccaaggaaaauaugaaagagaucagcauaucugggagacaaugaaauaaacauaaauacaaaugcagauaaggggaugggaguugcagacgacuuuucuuauaguaauauccacccuuuaaaaacgucaugaaacuuaugcugcauuucucuaacccuggucacaucuggacauaaguuauuuuauauuuauaagcuaaauaaacuuuuauguaagagguucuaauaaauuaauacaauggauuaagaauuacaaaauauagaauaaacauagaaagaaauacauacauuagcaaugcaugccucaauagucuggacuguucuuuucaauagcacuuuugcaaggucaaaggacuguuuauuuaaguucugaaaaauaauaaaaacauggaaaguuacaaauaaauguuaauuuaugagauaguaacauuagaauacuguagucuucaaaucuguaauaaaauaugaauuuugcuucacuaaaauaugaagcaaaaauaaaaauaacugaguucucuucaagguuuugccaaauauccucuagucaagugaucuuaaaugcagacguugcaaaucgaacuaauuuauuaaucaaaaacuaaaauggguuaguuagcaaaagcacaacacuauauuguuuuauuaaacucaaaacagaccuaaugcuuuuugguuuuaucuguuaaccaauguaaacugacaacuacacccacguaucuuaaacacauacacucccugaucuaacacaacaugcucaauuauuucauuguuuaaucaaugcgugcucuggagaagaguagaccugguaagcguuucaaauaaaaagcguucuugaucaauuguauuuuugaaaugcuuaauacuaugcucccguuucaagagucccaauguacucaaauaaauuaaaggaucugagaaggaccuuagaaaauauauuauuuaauuuuuuuuaaaugccugaaaagggaauucuuguuuugaauaauaccuauuaacauugcuauaucuugaaguuuuggaucaaacagauucauucaccaucaucuaacaccucuuccaaaacaaggcuaggaaacccuacacucuaggccaggggucagcaaacuuuuucuaugaagggccacaugguaaauauuuuagguuuugugggucauacaaaucacugcaacaacuacacaacucugcuguuguagcaugaaagcagauauaaacaaaacgaaaacgaaugaacauggcuguguuccaauaaaaucuuacuuacauaaauaagcaauaguccaaaucugaucaacaagccauagcuucuugaccccugcucuauacuuuuauuucauuggcaaaggauaagauuugcuuaaaauuaaguuaacauuucuauuucuuaaaagaagucuauuuccuacuacuaauaaaaaugcucucaagccagaugugguugcucaugccuguaaucucagcacuucgggaggcuaaaacgggcagaucgcuugagcccaggaguuugagauaagccugggcaacauagcgaaacccuguuucuacaaagaaaacuuaaaaaaaaaaaaaaaaaaaaaagccagguaugguggcacaugccuguauugccagcuacuugggaggcugagguaggaggaucacuugagcccaggagacagaggcggcaaugagccaagauagugccgcugcacuccagccuaggugacagagugagacccugucccaaaaaaauaccaccaaccuacuuaccuaguauauaaaaaccaaauauacugucuuaaucugccaaaauauacucuccuuugccauagucucagaauuuuuauaaacuacagaauuuuguaaacuacauuugaauuaauaaaauguaaauaauauuuaaacucgagaagaauuuaaaauuaauuauaucuuucugugaaugaguauaauuggacagauuuuuccucuaaugucugauaacaggauacugaaccacuagaagaaaagagcaggagagcaaauaucaacauugggguaggccugaguagagcccagugguggagccugagggcagccaaguccuucagauucuuaggaggaucugguggagauaaauagaaaaaggaaacagggaagaaugauacaccuuugaaucauccuuuucuucuuaacauuaaccauauagcuucugcccaaaucuuuuucugagaguaccuaagaaaaagguacgauacggauucugaaaagaaauccaaacuccuauguuucacaucuauguuaaaaaggaggaaauacauuucuuuuccaaacaaaguuaaccaaaaggcaacaccccuaaccccuuacaauucucagauuauuugugugaauacaaaacauuuucaguuuccagaaaacagcacuuaaaugaaugaaacuccuacaugauauguuaaucaauauauuuuguaaaaauaauagccacaagacuaaugcauguuauuuuauuugagguggagaacggucaugagaacaauuacaugggauugcaaauggccauaaaacaacuguucauucuuauguguggcgugacuguuaaacauuaaccuugaauaucuucauacuuuacagaccuuaugugcaggaaugagguuaauaagaauggaguccaauaauucuugaguaacuccaucaccuuccaugaugauagaacucaucaaaucuagcaugugcauuuguaccuucuuauuguggcuauugcuauaaaaaaaaaaaaaaaagaauaaguaguaggaggaggaaaagaagagaauucaagcuucuaauaggaaauuaaacguccuaguuuaaaacaacaaucucacauguaaaggauuuucacuugagggacagugccaauaauggcagagaaauuuuggcugcucuauuuucuuucuccuuuuguugacuauuacaacaguuguaagguacuguuguauuuuauaaaaacaaagacaaaccuaauuucuaauaaacuacauuuucuuccauucacuuuuuuuuaaaaagaaaagaaaaaggccgggcacaguggcucggaccuguaaucccagcacuuugggaggcugaggcagguggaucaccugacaucaggaguucaagaccagccuggccaacauggugaaaccccgucuuuacaaaaauacaaaaauuagugaagcgugguggcgggcaccuggaauuccaguuucuggggaggcuaaggcggaagaaucacuugaaacugggaggcggaguuugcagugagcagagaucaugccacugcacuccggccugggcaacagagugagacuuuguaucaauuaaaaaaaaaaaaaaagaaaaaaaaaaggaaaaggaaaaaaagaccuuuuaaaauaaauuaagucuuuacacaacuaggauuccaaaaguaaauuaaauucugccuuaaaaaaugucaauuuuagccugggcaacauggcaaaacccugucucuacaaaaaaauuaaaaauuggccagcugaguagccccagcuacucagaaggcugacaugggaggaucacuggagcccaggaggucgaggcaucagcaagccaugaucgugccacugcacuccagccugggggacagaccaagacccugucucaaaacacacacacacacacacacacacacacacacacgcauccacuucaaggaaagaacacuucugcuuacaugccccagauuuuuaaaggugauaaaauuuuaaggaaacaaacaaaaaaguauacaauaauaaaggcagacauuuuuuucaacucccacaccuuaagucuuaauaaauuccucaaacuaagauaaaaaccuauuuaaacacccccaaaugcauaagccaacauaagcaauuauugcuguauccuugccacuagaaguuuuaacucaccaauacugaaaaucaaaaguuucaucuaaaaugcuuucaauaacuagaaggcuuuucugaaaaugucauccuaguaccuccuaaagaauuucaaacagacaaaugaaaaaucaauaaagcauaaaauauaaggccaagaaucacuuucaagugcuuccacaaugaggccugcccuuucuugcuacuuuugaacccagucagcauacgaacaggccugggcuguccuccugaauggaugagacaugugacccaguucuaucacuucagcccaccucagcuuacggccagauauugaccagauauccugccaacugacuacaaacacaggugcaaauccaacccaaauaaaaucaacugccaagcagaaucaugagcuaaauaaaaugguggcugucuuaaacuaucaaguuuuagguuacuuuguaaugcagcaaaagcuaacaaacacaaagguuuauauguucuaucauuuacuuuaagggcuuacugcuagucaaaugccacagaaguuucuucucaugcuaucuuucuacaagcuucuauccuaugccaagcuggagugauccuuuccuguuuguuucaggauaaugucuaauccuaccauuccaucuaaggaaaaagaaaauaugauauagcauucauuaaaacucuggaaaugugcuguucaauaugcaagccauuugccacauauggcuggugaacaugugaaacaugaggagggccacauguuggaaugaaaauacuuuuggauacaguggaauaaauaacauauauuaucaauaugaauuucacuuguuuuuacuuuucuauuaaugugacuacuagaaaacuuaugugagguauguuugcauauaauguaaugcucuagaacacuucucauaacagugcuuaauuuacuauacaaaaaacaaaccaggcugggugugguagcucacaccuguaaacccagcacuuugggaggccgagguggguggaucacuugaggucaaaaguuuuagaccagccuggccaacauggcaaaacucuaucucuacuaaaaauacaaaaauuagccgggugugguggcacacaccuguagucccagcuacucaggaggcugagacaggaggacugcuugaacccgggagguggaaguugcagugagccaagauggcaccacugcacuccaguaugggugacagagcaagacacugucucaaaaaaaacaaaacaaaacaacccacacagaauaaaacaauaacaacaaaacccacacacaaaaaaaaccaaaccaaaacaaaacaaaaaacccacaaaccaaaaaacaugggcuaaaaucagaauuugagccuccuguccagcaacugguccuugggcaagccacuacacuuccugacucuggauuaguuucccuauuucuauaaagagaaggccaauuuaggcaauguuuaagauuuuuuucuaggucuagaauaagaaguugucaaaguuagugagcuuaaagacugagcuauuacgucucccagaacuaaugguacauacaauaugcauaauuucuaccucauaauuuaauacuucauuguauuaacguaagguuucagacgauuugcuuuacaaccauaugugguugccucuauuagauaguaagucccuucaaaacaagagcaccacuuuauacuucucuacugguccauggccuccaggacagccugggcgacugaagagccaaccaguaaauugguaccauaauuuaaaauucguaguauaaggucaaaggcaguguucggacaacagaauuuuuacuuuccccuuuauguuaaguuuucuaaggaaaacaauuccuuauaacucugaaauaucuuaguguacauguagaguauacaacaucugaauacauaaucaagaaaaagagacaaacagaaaugcuuaaaaaauaacuuacuugaucacugagaagagaguucuaaaaagcugaauaaaaauuucauugcaaucuuccaauucaaagcagauguuauaugauuuaacccaagcuaaauucuuaaauaaauaaaaauaauuauugaauuauacauauauacagaauaguuauauaauaaaaaacucaguaaaaaauuaauuuuuagaguuagaaacauauuaaagucuauaaagacucaacauauaaaauuuuaaguguuaaucacauauucugaccuugaaaaagauauauaccugauggcaucaauuuucucaaacugaaaaauacucaauauuuuuaaguugguagauauauuuccauacaaaauuuaagaagcaguaaaaaucuguuuuuagaauagaaaaaaauaaaaauaaaaagauagaggccgggcccgguggcucacgccuguaaucccagcacuuugggaggccaaggugggcggaucaccugaggucaggaguuugagaccagccucaacauggagaaaccccgucucuacuaaaaauacaaaauuagccgugcguggugguguaugccuguaaucucagcuacucgggaggcugaggcagaagaauugcuugaaccugggaggcggagguuguggugagcugagaucacgccauugcacuccagucuuggcaacaagagugaaacuacgucucaaaaaaaaaaaaagaaagaaauagauacaaacaaaagauauaguuucaaauaaucuacaguuuuuccaucagaauauacuuuaucucuucaggauaggaagaaaaauaaaauaauauuuuccuuaugaaauguaaaagacauuuuauuauaggcuuugaauaaaauaaacacucauuuuacauuacaaaguuaacaugaagaauuugcuaucaugugaaauaauguuaauaguuauuaaaguuuuuuuuuuuuuaccucuaauaaauaaaaguaucuauuaaacuguggacucuuuguauccuccaaaccuuuuaauugucugguaauaaacaaaaauauguccuguuaaaaaaaaaaacacauuaauuuagacacaaauacuuuucuuucacaacacacuaauaguauguaacuuuauuauuuguguacaaacuacaauaaaagaaaauucuccuuuagaugaaugucuugggauuggccuaauccauuauucaaaaugauucaaaagauccaaucaaauaaaauuauacucuuuagaagcaaaaauaaacuauaaaucuuuaggcuuucucuuucagagcggaccacaggcucuauaucucauuauaauuucuucuacuaucgugcuuucacuuuacucacuaucuccaccuugcaucggggcaaaaacuaucuucauuuuaaggaguuggauaugaguauuuccauuacuauuaccuacaaguaaauaguaauuuuuagccaauguuuugaaguugauguaugauuacgaaguugugugugaaaaaaggcaacagacuaguccaaugguucuaugauucaugaugguagucuuucauuucuuaauaagcuuucuuuagaaauuuuaacucacaguaguaucaauauaauacaaaaugauuuuaggacuauuuuuaaagaaagcagucuacaggauuaaaauuugccaagaaugaaauuauucaaaauacaaaaucuccccaagagaucaauguuaagaguuccacaaacacuugaacaaaggcagaacaaccaagaugagcauauaguuuugcaugcugaauaacuuauaggggaaaauagucauaugaauauguaaauucugguaugcuauuauuuuaaaaaguaucauuaaucugcuauuuaucccuggaacauagcuaucugggcuuuugugaugaauuagccagaaaauuggauuugagcauacagggacuaguuuugaacuauaccuuucuaugcuucaaaucaaacaaccaagcaacccagucauuuguggaaauacuaacugaaugaauaauuuugcaacuuacaauauauucuuaagaugaagagacuaauaugaaaccuauguucauaaagguaaaauauaaaaauaaaaguauaccuucugaacaguggugaaugaaaaauacaauaaagugaaaaaggcuguauuuaccuuaaguuuaucaugggaaguauauggagcuucuggggcauagauacgaaagauaucagccaaacaacaugcuacaaggagacgcacaucuuuauugggguuccugaggaagaauucagaugcaagaugcaaggcuagugggagauacugcuguuuuucaucuucugaguccugauccauauccauaaagguuuucacuaccaucuguaaaaauguacaaaaacacaaaauaauuaacuccuggaauuuagaaaucaguggaggaugugauuuaaaaaaaaaaaagucaucuccauuagcaaucgguggccaccagacaguucacagucaacuuuuuauaaaucuucauuuaagaauuucagaaaagaucacaagcaugaaacggcuagucuaaaaaacccauaaacaaguaucaccuucucaggcacauugucugcacuaguaccucauuuaugaggaacuuaagccucuuauuauucauuuuaaaucuagcccagauaguuccuggccccauauggacaauaacauucauuugauauuuggcaacaucauuaacuaugcuucuuuuauauuuuauuauuaaaggagccuucuucaggcuccuuaaaauugcuauuucauuucaugcuuuaaugaguuuuacacuucauaauaaaaagucauuuuccaugcuggacaacauggcaagacccugucucuacaaaaaauacaaaaaccagcuggguaugguagcaugugucuguagucccagcugcauaggaggaugagauaggagggucccuugagcccaggaggcggaggcugcagugcgccaagaucacaccacugcaauccagacuaggcaacagagugagacacugucuuuaaaaaaaaaaaaaaaggcauuuuaaaauuauauuaaugcaguuguauuucuaauuaaaacauuuaauuaaccugcuuuuaugguuauaaaauuaaccaaugcacacuuuggaaucauuauaaaaugcaaagaaucaugaaaaaaaauaaaagaaaaauccauaauuuaucaacuccagaaacuaccauucacauuuuuguguacuuuaugcuggccuguuuucucuguaauuaugcaaauaacuauaauucuuuauguaucaaaucacaauaauuuccucagaucuuaaaaaugauucucuaauuauaaaucacaguuuacuuaaucugugugaugguuaauacugagugucaacuugauuggauugaaggauacaaaguacuaauccugggugugccuguguguguguugccaagagauuacauuugagucagugggcuggggaaggcagguccacuguuaagcuggugggcacaaucuaaucagcuuccaucgaauauaaaguaggcagaaaaacaugaaaagggacggcgggacuagccucccagucuacaucuuucucccgugcuggaugcuuccugcccucaaacaucagacuccaaguucuucaguuuugggacucggacuggcucuccuuccuucucagcuugcagauagccuauuguggggccuugugaguuaauacuuaauaaacuauauauauauauauauauauauauauauauauauaucccauuaauauccuacauacauauaucuccuauacauauccuauuggggcguguguguguguguguguguguguauuccuguuaguucugucccucuaagagaacccuaauacaaucugucgccacugucaaauauucaagcuauauuuuuauucugccaagauuuuuuaucaugaguguaaaauuuuauuauuauuauuuuuuuuugagaaagggacuugcuuuguugccuaggcuggagugcagugaagcgaucucagcucauugcaaccuaugccucccagacucaagugguccuccaaccucagccucccaaguagguggaucuacaagcaugugucacuauaccuggcuaaucaaaaaaaaaaaauuuggggggccgggcgagguggcucaugccuguaaucccagcacuuugggaggccgaggcgggcagaucacgaggucagaagaucgagaccauccuggccaacacagugaaaccccgucucuacuaaaaauacaaaaaauuagccgggcacaguagcacacaacuguaaucccagcuacucaggaggcugaggcaggagaaucucuugaacccgggaggcagaaguugcagugagccgagacugugccacuugcacuccagccugggcaacagagugagacuccaucucaaaaaaaaaaaaaaaaaaaaaaaaaaaaaaaguuuuuuuguuuuuuguuuuuuuuuuuuaagagacaggguuuugccauguugcccaggcuggucucgaacuccugggcucaagcgaccugccugccucagccucccaaaguguugggauuacaggcauaagccaccaugccugggcuauugaguauuuuuugacaccuauugagauaaucauacuuuuucccuaauucuguuaauauaguaaaucccaauggcugauuuucuaauuuuaauucaaguuugcauucuaauuuuacuauuuuaguccaaguuugcauugcuaaaauaaagacaacuuggucauaacauuuuaagguauuacauuuuauuugcuauuacauuauuucuauuucuuuguaauuauaugaaagaaacuggcuuauaacuucuuaagacaaccguaucagguuuuaguacuaaauuauacuggcuugaaacaaaauaagcagugaucccucuuuuuuucuaacauaguauaucaaaagugugauaguaagacugguuuuauuucuucccuaaauauuuagggaaguauaacugauaaaagaaggaaucauaacggaaaugagaaaauauuuugaacugaauuauaauguaaauaugaacuaccaaaacucauaggaugcacuuaccacuguacuuaaaggaaauuuauaaucuuaaauguguauuuuacaaaagaaagaaugcaaucaucuauauuuccaucuugagaaauuagauaaauccaaagaaacuagaaucaggguuugugaaacaaaagauagagaagggcuggaugugauggcucacaccuguaaucccagcacuuugggaggccaagucaggaggaucgcuugagcccagcaguuccaagacaagggucuggcucugucaccuaggcuggaguacaguggcgcaaucucagcucacugcaaccuccaccucccaggcucaagaguuccuuccaccucagcccccugagcagcugauacuacagcacacgccaccacaccuggcuagguuuuguacuuuuuuuuuuuuguaggaugggauuuugccauauggugcccaggcuaaaaaaauuuuuuuuaauuauugcuauguaacaaaauaccccaaaacucagugccuuaaaacaauaacauguauuuaucauaugugguugaagaauuggaaaguggcuuagcuaagucgugugggccuggaaucucucaagaggcuguaccuggucaaggcugcaguuaucugaaggcuugacugggcguggaggguguguuuugaagguaacucauucuuacgguucuaaguugacacuugcuguuguugaaaggcuucaguuccacacuacaugggccuuucuagacagcucaagugaaaaggcaguugguuuuccccuggugcaagauccaagagagcaaauaugaaguggcagucuuuuacgaccuaaccuugaaaagcauacauugucacuucuaccacagccuguuccguuacucaggacagccccguucaguguugcaggggacuauacaagggaguaaauacaaggaaauaaggaucauucagagcuaucuuggaggcuaugauacaaugccuucucauauguauaccuuauauagucuucuuccacaaugacucuggauuuggucaggugacuuuuuuuuuuuuuuuuuuaagacagagucuugcucugucgcccaggcuaaacugcaguggcaugaucuuggcucacugcaaucucugccucccagguucaagggauucuucugccucagccucccaaguagcugggaacuacaggcacucgccaccaagucuggcuaaguuuuguauuuuuaguagagacaggauuucaccacguuggcuggguuggucuucaacuccugaccucagaugauccaccugccucagccuccccaaaugcugggauuacaggcaugagccuccaugcccaguccaugugacuuauuuuggccaaacagacauuagcaagccugaugcaagaacaggccugauaagcauuuguacguugagauugcaaugccccuaugggaauguacccaccaugcuauuaggaaucccagacuauucaaaaaacagaggcuguguauaccacauagacuacguggaagagaacuaagguggccuaauugagcugccaucuaaacuuagccauaagagugacccuguagaagcaaaguagagcuucauaaauacacacaaccaaggggagaaaaccugugguggcugugaagguccugaugccauguaugucaaacugguaucuuccgauggucaugaauuuauuguaaaaagagaacaugcagcgcuaagcgcggugggucacagcacuuugggaggcugaggcaggcagaucacgaggucaggaguucgagaccagccugaccaacauggugaaacccugucucuacuaaaaauacaaaaauuagcugggccugguggugcgcgccuauaaucccagcuacucaggaggcggggcaggagaaucgcuugaaccuaggaggcggagguugcagugagcugagaucacgccacugcacuccagccugggcuacaggagcaagacuccauuucaaaaaaaaagagagaacaugcacuaacaugaggaacaaucaaaaggccaugcugaagccaagcacaguggcucaugcuuauaaucccagcacuuugggaggcugaggagcguggaucacaugaggucaggaguucgagaccauccugaccaacauggugaaacccugccucaaucaaaaauacaaaaauuagccgggcaugguggcaggugccuguagucccagcuacucgggaggauggggcaggaguaacgcuugaauccaggaggcagagauugcaguaagccaagaucgugccauugcacuccagccugggugacaaaagcaaaacuccgucucaaaaccaaaaccaaaaccaaaaccauguugaaugacccagaucaguuugcugagaaugaacucauugagagcaauuuuagagaggucuguucaugugugcuaucaaaaguauguauguauugucaagaaugguggcuugcacuuacaaucucagcuacuugggaggcugagacaagaugacugcuugagcccagaaguucuaggcugcagugagcuaugaucaugccaaugcacuccagccuggugacagaacaaaaugcuaccucuagaaaaauaaaauaaaaguuaaagcaugcauauauuuuuaccuacgagauucacuaaacuaacaguuccacugaaauuucugaauucccaauugcacuugauauugcacuagaaccgcugaugcagacuucccagauuguuauuaaauuaaaauaaacuguuuaaaaaaaaaaccagugaccccagaaggcaccacauggaaaagaaggaccacaaagucuauucacagaauugaaagaaacaauuauucauuuuaagccacuagauuuugcuuuaccacacaggaacagaaaugaaauuccauucauucuucccuuuuuuaaauaugucguuacugugcacauuuuuaaugugcuguacugaggcaggaaagauaaaagcuacauuuccuagauucccuugcaauggaguugaagucauaauucucguauagcccaucagaggcacuuauucaagauuuggaaggugaaaguucagaagagguggugguguaguuucugcuguugucagcuggcaaguauggagugagcuguuguguguaugugugugcgggcaggcacauacacagcagcuuucuacuaacuggcuguuaguauugugaagauagagggaagaagcauccauuuugugcugguacuaaucuauuaaacugugugaggcucuguaccaaauuauaccaauggugacuuccuaaucacuggauuacggcuaaacgugugucccuacuuaagagcuccaggguggcuuccugauuuucccaccuuucugauuagagcacaggauucagcucuccuugugggccagcuauacgaaguguucucggagucuaguccuguaagccugaauuaagggugcucuuccagcaauuccaaaucacuuuuuaaauagcaaguucccugucugcuuaaaauaacauaacuaaagcuugacugguguuugaaacaugacucugauuuucucucagauccuucaacaugucagaauccccugugccauucaggccuuuuuaaaugcuauuggcucuuuguagacuaaucucuucuuaccucaucuaauuuaucauacacuuaugagaauuaaacaauuucuugguaagucugugugaauuuuuuccuguggauuguguuuuaauacccucuggcuauuuaucuauugcggucuuaguauuucuuuuuuuuucuuuuuuuuuuuuuuuuuaagaaaugagcaggaaaaaaucaaacuaaguuuuuuugcccacagcuagguuuuuauaauauugauaaaaaagaaacacuaacaccaauacuauuaauaaugauuaacauuuacugaauauuuaccacauuccagcacucuauaaauauuuuuuugagacaaauuaacucaaaauuaagcaucuuuucacguauuugccaccuacucuacguuuucuuggugacgugccucuccaaaucucuuuucuuuuuuccuuauguguuuucagcugucauauauucuggguaccaauccuuuaucagauacguauauugcaaauauuuucucccagucugaggcuugucuuuaacagcauagaaaaauuuaauugaugaaggauuuaacguaaucuaacuuuaucaauuauuuucuuuuaugguuugugcuuuguguguccuaccuaagaaaucauuaccuaaccaaaaguuguaaagauuuucuccgcugugguauugauugauugauugauugacugauugggacggagucucacucuguugccuaggcuggagugcaguggcacaaucucggcucaaugcaaccuccugccucagccucccaaguagcugggauuacaggugugcaccaccacacccagcuacuuccaguagagaugggguuuugccauguuggccaggcuggucucaaacuccuggccucaagugaucuacccgccuuggccucccaaagcgcugggauuauaggcgugagccaccgcgucuggccuuccgauguguucuuggaaaaguuuuauaguuuuagguuuuuauauguaugucuauauucauucugaguuaauuucuguauguacugaaagcuuuugggucgagguguucaagccucauuucuagaaaagacuauucuuucucuuuuucuacaggauuguuuuggcaucuuuguugaaaaaaacugcuauaccauguaggccuauuucuggacucuguuguguuccuauuuucugugcccuuuuaccaauaccacauagcuuugauuacuguagcuuuauuaaaaaguuuugaaaucagguaguaugugaaucauccaacucaacauaaaaaugaggaaaagaucugaacagacuuaacaagagaaacauacacuggagguagauauauaaaaugguacaaccacuucagauaacuguauggcaguucuucauaaaauuuaaagaugcauuuaacauuuaagccaaaaauuccauucuuaagaauuuacugaaaacauuucacacaaauacaaguacguguuccuaacagcuuuauucagcauaucacaaaacugaaaauaaccaacuguccuucaaaagguaaauggauaaauccauugugguauacccauacaaaagacuucuaauucgcgauaaaaggaaccugacagaagcaaggcgcaaauggggagcagagaggacuaaaaagcaaaaggaggaaacuuaugagggugauaaguucacuuuaauugaagugaugguuucaaugcuguguauguaugucaaaacuugucagguuguuauuccccgacagcaauucucugacaccaaauagguguccuacauuucaauucaguucugacacuacccaccuuagcgcagaaccccacaggcaaaguucuucccaagacugccuccacuuccgaugccagccccaauucucagggacaacuuccauuucugacagaccagcuauaaauuucagguuuccuauagccuccucagguuuaaaaauuugcuagaauaacucacagaacucaaugaaagcacuauauuuauuauuuauuauuuaucuauuugagacaguuucgcugucacccaggcuggagugcaguggcacaaccguggcucauuauaaccuccgccuccuggguucaagugauucucaugccucagccugcccuaauagcugggugcauaccaccacaucuggcuaauuuuuuuuauuuuuaguagagacgggguuacaucauguuggccaggcuggucucaaacuccugcccucaggugaucuucccaccuuggccucccaaagugcugguucacacauuacaggugugaaccacugcaccuggccugaaagcacuauguuuacugucacaguuuuauuauaaaggaaauacuuggaagccuaaacaagauugagccugcucgaucuuggaugguagaucacuggggaauaccaggugcugugagcuagaaggaaaaagaaagaaacagaaaauaacaagguggaagaaaaguauguaacucaagaacagucaaacugaagagacacaucagccaaagucuugggggugaagagggguguguggaugggauggggacacagagcuucguauacucuucucauugaaucuggacauguaauccucccagcauaucacuguguucaccaaccacuaaccuccccugagcuuuaguguucacaggauucacugggcuuuaugacgcaggcaugaaugauaaaaucaagacugaacucaaucuccagccucccucuucuccugggagaaaguuucaauccucuaauuuaagugaccagccccauccugaagcuaucuaguggcacugccaggagcugccucauuagcguaacaaagacacucucacuugggaaauuccaaggguuuuugaggcucugugccaagaaucagaacaaagaucagaucgauuauuauaugucauauaauuuaaauauguccaaauuauuguucaguaauucaauuacaccucaauacagcuauuaaaaauuuuuuuuaauuuuauuuuuugagaaagguucucacuuugucgcccaggcuggacugcaguggugugaucagggauuacaacagccucaaccucccuggcucaagugauccuccugccucggucuccugaguagcugggaccacagacgaaugccaccaugugcaacuaauuuuuauuuauuauuauugguagagauggggucuuguuauguugccuaggcuggucuccaacucuuggccucaggugauucuccugccuugacuucccaaagugguguaagccacuguguccagccaaaugaacuuuuuguaaguccaacauagcaaaugagaacucucacucacuuuuuaauugaaauguaaauugguagaaccacuuugcugcuuucaguuaaguagaagacauacaugcccaaugauucaacaauuucaccucugguggugcccuaaagcagcuagaguauguauacaaggaugacuggaguguuaaguuuagccuaaagcugcuuccuugcauaaauucagccuaaaggauucuccauacauagugagcuguaccuaaccagauuguaaaaagacuguaaccuacucuccuaccaaucacacagaauuguggccaaucacagguggcugacuguucaaaccgugaucaaauaaggcaaacacugagcuguaaccaauucaccuauuucuauaccucacuuucguuuucuguauaucacuuuccuuuuucuguccauaaauguuaucugaccacuuggcagcucuggaacuguucugaaccuacucaaguuuggagggggcugcccaguuugugaaucauucuuugcucaauuaaauucuguuaaauuuaaugugucugggccgggcacgguggcucacaccuguaauccuagcacuuugggaggccgagguggguggaucacccgaggucaggaguugaagaccagccuggccaacauggugaaaacccaucucuacuaaaaauacaaaaaucagccaggcgugguggcaggugccuguaaucccagcuacucgggaggcugaggcaggagaaucacuugaaccgggaggcggagguuguagugagccaagaucgugccacugcacuccagccggggugacagagcaagacucugucucaaaaaauacauauauauauaugucugaaguuuuuauuuuaacaacagcaaugugguuuguaaaagccaaaaaacuacaagugaaaaaugucaauagaagacugauuaaacuguauaaugaaauacuauauaaguuaggccaggcgcaguagcucaugccuguaaucccagcacuuugggaggcugaggccgauggaucacaaggucaggagaucaagaccauccuggccaacauggugaaaccccaucucuacuaaaaauacaaaaauuagcugggcgugguggcgcaugccuguaauuccagcuacucaggaggcugaggcagaagaaucgcuugaaccagggaguccgagguugcagugagccaagaucacaccaccgcacuccagccuggcaacacagcgagacuccaucuaaaaaaaaaaagcaauaauacaaaacucaaacauaacacugaagacacaguaacacaaggaaccauauaguaugauucuagccauauaaaauugaaaaaguaaaacuagaaaaaagccagucauguuggccaauaccuguagucccagcuacuugggaggcugaggcaagaggauggcuugagccuagaucaaggcuauggcugagcuauaguuguacauuguacaguggcucaugcccguaaucacacuuugggagggcgaggcaggaaaaucgcuugagcccaaguguuggagaccaaccugggcaacauaacaagaccucaucucuaccaauaauaauaaauaaaaauuagcugugcauggagacaugcgccuguagucccagcuacucaagagaaugagaugggaggaucgcuugaaccuaggagggugaggcuguaaugaccucugaucacaccacugcaguccagccugggcgacagagugagacccuuucucaaaaccuaaaaugaaaaaaaaaauuuuuuuuaaauagcuuuacugcggcugggcaaaguggcucacgccuuaauuccagcacuaugggaggccaagguggguagaucacuugaggucaggagcuggagaccagccuggccaacaugcugaaaccccuucucuacuaaaaauacaacaauuagucaggcaugguggcacacgccuguagaaaucccagguacuugggucacugaagcaggagaaucacuugaacccaggaggcggaggcugcagugagcugaaauugcaccacugcacuccagccuggacaaaagagcaagacuucguuuccaaaaaaacaaaaacaaacaaacaaaaaaacagcuuuauuaagguauagcugaacuacuguauaauacuuuggauauauuuaaauugagcuaugguuguaccaguguacucuggccugggcaacagagacucugucuaaauaaaguaaaaaauaaauaaaacuagaaaaauaugaaacuggccaggagcagagucucacaccugcaaucccagcacuuugggaggccgaggcaggagaaucacuugaagucaggaguuuaagaugggccuggcuaacauggcaaaaccccaucucuacuaaaaauacaaaauuuagccgggcgugguggcaggugccuguaaucucagcuacuugggaggcuaaaugagauaaucacuugccacugcacuccagccuggaugacagagcgagacccugucuggaagaaaaaauaaaagaaaaaagaaaaaaagaaccuauuauuuuuaagaaauauguagugaaaauguaagaaaaccaaggagacugcauuaacaugguaauggaggaauuacgaaugaaggaagaagcuuaugauugaggggaacacacaacuucugggggugcugaugauauucuauuucuuuauacguauauucacuuugugguuacuuauuaaacugcauuuguuuuaugcaccuuuuauguuacauuucagauauauaagaaucuaaagauauauaagaauuuuagauacauaagaaucucagguucucuuuaaagcaguuaaucuaaccaccuuuuagauaauguaggggcuucagaaaugugaauuccuucacauaaaaauaaagaagagacgaggaggaacaggagagaaagagaggaagaaacagaccuacagauuuuuauuuuaauuuuuuggagacagggucuugcuuugucacccaggcuggagcgcagaggcgcucacugcagccuccaccuccagggcucaaaugauccucccacuucagccuccugagaagcugagucuacaggcaugugccacuaugccuggcuaaauuuuggggucuuguuguuuguuuuuauuuuugcagagacaggauuucaucauguugcccaggcugacucaaacuucuaggcucaagcaauccacccgucuuggccucccaaaguccuggaauuacaggcaugagccacuaugcucagccuagagauauuaacugaagaaacauaaugaguuaaugguaggucuagaacugaaaacuaaaacccagguuucaggauugccaaucuaauacuugcaaggacaccauuuuaacucauaugcuguaaaagcacuuucucuucguaguuuuacuuuucuccaauuuuucuuacauuuuacuugcuuauucugucuuuccugcacuagacuuuuaaguucugugaaggcaauagauuuaaaaauuuguguaguccuagagucuacaaaaaaugugccucauacagaguaaguacucaguauuucuugaauuaaugaaacuauuaucccagaaaacuuuacauguauaccaaucuuugagcaacaaaaaucaaccugucagguguaaagacaaagugaguucugaauuaaacaggccaucuaacuuuuauauuaaaauggcaguuuacucacugagcauauacauggacugcuggcuaagauugagaaugaacaaccuauuugccaauacgugcuucuuugcagcuuccuuuccuauuucguacuauuauuuguaacauagcccuuuuauuuauuuaauaugcauucaaggugaaaacuacagcagguggugcaggagcacaguuaaugcauaaagccauuagaauugaaaguccaccuaauacacacaaacuaacuuuggaguuuagcacauuagagcaacuuuugggccuaaagcucaaguugaaguggcuuacugaccaaguuuaucacaucauuauuaugccuuuucauugcaccuagaugguaaauuccuuuuaagaaaaccucacaggcaggagugguggcucauucuguaaucccagcacuuugggaggcugaagagggaggagcccuugaggccaagaguucaaguucaaggcugcagugaacuaugacugcacaacugcugcuccauccugaaccacagagcaagaccccaucucagcaacaacaaaaaaagugagcuaguuucauacugaauaaaguugguaacauuuagauuccauugccaaaaugcuuaguuuaggcccuuauugcaucauacccaacuugagucucuuuagauuuuaaaaccaaacacagugcuccuaaauuaauguuaucccaacucaaagagugauuuccuauggccgcauuccuuaugacauuuuaaacaucauaaucaauuuuauaauuuuguuugccuuuuccacgucuauacuuauacauauguauauguuuauauauaauuauaaaacauuauguaaugucaacccuccgcucuagucaaacuggguuaauucauuaucuuccaaaaauaucuugagccucuuuacagcuuuacacagaaaaaagaaagcucacagaguucgacacuuuuuuaaauaugugaauauguccuagaauugcuucugcuccucaauacauaccuacccuacccaaacauacgcucuuacuaaauucuuacccauccuuaauguuuuugcccaaauuccauuuuuucuugagacagggucucacucagucacguaggcuagagugcaguggcauaaucacaggucacuacagccuuaagcucucagccucccgagaagcuuggacuaaagucaugcaccaccacacucaccuaauuuucguaucuuuuguaaagaccgguuuugccauguuauccagacuaguccuggacuccugggcucaagcgauacaccugccgaggccucccaaugugcuaggacuacagguaugaguuacuacaccgucaacuuccucuucugaagggaucauugacuccuucguacuggaaacacuguaccaauuaugaagcaauuauuuuacagcaucuaaugcuguggucauuagcauaaaaaucgugucuucucaagaagacacuaaucccagcacuuugggaggcuuaagugggaggaucguuugaugccuggaguucaaggcugcagugaacuccuaaaggaucuccugaaggaugggggcuguguuuuacauauugcacaucugcccuacacacuaagacauauguacaagguauuuucugaaggaaugaaaugcauuaguauauuuuuuacauauucuagauuucaguaauugaccaagucugagaacagaaaugccuccaaaauuugcauuuggcaaaaacuaugcaaauacacacacacacacacacacacacacacacacacacacacacacacgcacgcacacauauauacauauaucucacaauacuaaguacuauuaauaaagcaacaaagacaacaaagcaucaaaauauuucuuucaauuucauucaauuucaacaaauuauucuuugggaaaaauucaaugaccuguuuuucuaauacaccagcauagacuacuugauauauaauuuauuacuaauauauuuagucaagguuagcauuacuuaauaagacaagguuauuauuucauaccuaaauuguguggugcagaaaaauuagaugccacacauuuuacuagcuucuuccugaacuccaaacccaauucuauuuuaaagauccauucuggccaggugcagugacucacaccuguaaucccagcacuuugggaggccagggcaggcggaucacuugaggucaggaguucgagaccagccuggccaacauggugaaaccccguuucuacaaaaaaaaaaaaaaaaaaaauacaaaaaauacaaaaauuagccagaugugguggugcgcacuuguaaucccagcaacucggggggcugaggcauaagaauugcuugaaccugggaggcggcgguugcagugagccgagaucguaucacugcacuccagccugggcaacaaagcgaaccguaucaaaaacaaacaaacaacaacaacaacaaaaagauccauucuaccagaccuaaaccauuuaacaagcacauacuacaaaauacacuauuagucggccgggugugguggcucaugccuguaaucucagcacuucaggaggccgaggcagguggaucacgaggucaggagauugaaaccauccuggcuaacacagugaaaccccaucucuacuaaaaaaacaaaaaaauuagcggggcgugguggcgggcaccuguagucccagcuacucaggaggcugaggcaagagaauggcgugaacccaggaaggcggagcuugcagugagccgagaucacaccacugcaguccagccugggaaacagagugagacuccgucucaaaaaaaaaaaaaaaaaaaaauacacuauuaaucauuauggaagguuucuaauguagguaagaaaugguuuacuccauuuauuuccgccuucaagauaacccacaaacacgauucuuaaaaauuaccuggauacugacuguaacagaacaaucauaauagaaguuauuuuuagccucaaggggaauucauaagguccuaaaacauuaugaguggccuuaaaggcugagaguguggcggggcacaguggcucacaccuguaaucccagcacuccgggaggccgaggugggcggauaccugaggucaggaguuucacaccagccugaccaacauggagaaagcccgucucuacuaaaaauacaaaaacuuagccaggcuugguggugcaugccuguaauaccagcuacucgggaggcugagguaggagaaucgcuugaaccugggaggcggagguugcagugagccaagaucacaccacuacacuccagcccgggcaacaacggcgaaacuccaucucaaaaaaaaaaaaaaaaacaaaaagcugagaguuugauacaugcauggcggguucaaaggcuuugagacuugguuuuaacauaaccucagaugcucucuaaucuuuggguauuuguaagauggaagaauaaaacgagugaagacgauaugauacaaacaaaucauucuauauuuugacccucacauaauaaauccucuauucuuuuuuucuuuacagcucaaacuguuuccauuuuauuuucuuuacaaauucuuaauucuuaaagccuauuuguuuauaggaaccacuugcaauaguacuaauagcugcuaacauguauuguguuccugcuaugcgucagguacauuucaaauaauuugaauacacuauuaacuuauguaauacaaugauaucuaugagaagcauuauuauuaauacccccguuuaacagaugaggaaacaggccaaauaaguuguccaagggcauaaaaaucuaaaugcaggcggccgggugcaguggcucacaccuguaaucccagcacuuuggaaggccaaggugggcggaucaugaggucaggagaucgagaccauccuggcuaacauggugaaacccccgucucuacuaaaaauacaaaaaauuagccaggcgugguggcaggcgccuauaguuccagcuacuagggaggcugaggcaggagaauggcaugaacccgggaaguggagcuugcagugagcagagaucacgccauugcacuccagccugggcgacagagcgagacugccucaaaaaaaaaaaaaaaaaaaaaaauuaaaugcaggcaauguagcuagucacucacugcuuaguacucuuaccuauauguuacauauaguauaguaggaggaaugcuuccccaaaugacuacugaaauacacacauuauacuauaaaaacuguacuguauuaguuauaacuacuaagugauuauguucccaggcaaacucaaaaagccuacuuugucacaauuuaguuagaugaagacuacaguagaaaauuuagaugggagcaucuagcaacuuaauagaucucuuaauccauuaacugaaugucaaguacucuggcuuuccuuuuccuucauaaagguaaaucguuugccuuaugcuuaaaaugaucaaacauuauguaagguguuuuugcucaaaaauaaaauaaaacacagcaguuuuucuaagguuaaacggauuaagaguugaaagaaaaaaaagcaggacaggcgcaguggcucacgccuguaauccuagcacuuugggaggccguggagggagggggggaucacuugaggucaggaguucgagaccagccuggccaacaaggcgaaaccucgucucuacuaaaaacacaaaaauuagcugggcaugguggcaggugucuguaaucccauauacuugggagguugaggcaggagaaucgcuugaacccaggaggcagagguuacagugagcugagaucacaucacugcacucaaaccugggugauggagugagacuucaucucaauaaaaaaaaaaaaagaaagaaaaaaaaaggaaaggaaaagagauucaagcagacaagcguacauaugugggaaaaaggcagauggaauuaauuauggcaggagcagugagaguuuagaggaaaaucaacaguaaguauagggaaauuccccuacaggcacgaugagaaacggguggugggaaaaagcagacaguggcagagaagcagaagugggcaucgccuuccuauaucaguugccaaaaauauuaccacccagaagaacaugauggcagcuagagaaagggaaacaaaaagcugguucuuugaaaacaucaacaaaacugacgacuuuucagcuagacugaccaagaaaaaaagaccaaauuacuacauucagaaugaaaauagacauguuacuaauuaccuuacagaaauaaaacccauuggccaggcgugguggcucaugccuguaaucccagaacuuugggaggccaagacaagcggaucacuugaggucaggaguucgagaccagccugggcaauauggugaaacccugucucuacuaaaaauacaaaaaaucagucaggcguggcgggcaccuguaauccuagcuacuugggaggcugaggcaggagaaucgcuucaacccaggagguguggauugcagugagccaagauugcaccacugcacuccagccugggcguugcagcaagacuugugucuugggaaaaagagaaauaaauaaaacugaucauaaaggacuacuauaggcuggaagugguggcucacaucuguaaaaccagcacugugaggggaugaggugaggggaauuacuucaggcccaugaguucgagaucagccugggcaacacaggaagacccuaucucuauugagaaaaaaaaauuaauuaaaauauguuuuuuaaaaauccuauuucuauacacuuggaaugaauaaucugacaaagaaauuaaacaaacaugaccaggcauggugguucacgccuguaaucccagcaauuugggagggugaugcuggcggaccacuugaggucaagagcucaagaccagccuagcuaacauugugaaaccccaucucuacuaaaaauacaaaaaauuagccugggaugguggcaugugccuguacucccagcuacucaggagacugaggcagauaacuugaaccgggaggcggaggcugcagugagccaagaucaugccacugcacuccagucugggugagagagagacugucugaaaggggggaaaaaaaagagagaggaaacaugaaauaaacaugagggaguaaaccugcuuucuaacaguaguguccaauccuuuggcuucccugggccacacuggaagaagaauugucuuggaccacacauaaaguacacuaacacuaaugauagcuaauaaccuuaaaacaaacaaaaaaaauugcacaauagucucauaauguuuuaagaaaguuuaugaauguguguugggccacauucaaagccauccugggucacaugugacccacgggcugugaguuggaccaagcuuguuuauaagaacccacuuuuuggguaacuaauccagucccagaagagugagaacucacucucacaagauggcauuaucuauucaugagggacuggccccaugauggaacaccucccaguaggccccaauucccaacacugcugcaaugagaaccaaacuucaacauaaguuuuggugaggacaaaccuuauccaaauaauggcaauguccacacaaaaauuugcacauaagccaggaaugguggcucacucccaugaucuuagcaauuuggaaagacaaggagggaggaugccuugagacaaggaaugcaagacuagccugggcaacaacugcaagaccccauuucuacuaaagauuuaaaaauuagcuggguaugguagcacguaccaguagucucagcuacuugaaagacugaggcagcaggauuccuuaagcucaggagguaggcaacacagcaagauaucccgucucaaaaaaaaaaaaaaaaaaagaaagaaagaaaaagaaaagagaaauuugcacaagaauguuuauagcagcauuauucacaauagccaaaaggugaaucaaaccuuuuuuuuuuuuuuuuuuuuuuugagauggagucuugcucugucacccaggcuggagugcaauggugcgaccucggcucacugcauuacugcaaccuccgccucccggguucaagcaauucucugccucagccucccgaguagcuggguuuauaggcgccuaccaccaggcccugcuaauuuuuguauuuuuaguagagaugggguuuuaccaucuuggccaggcuggucuugaacugcugaccucaugauccaccugccucggccucccaaagugcugggauuacacgugugagcuaccacgccuggauuuuuuuuuuuuuuuuuuuuaaagaccgagucucacucugcugcccaggcuggagugcaguggugccaucucagcucacugcaaccucugccuccuggcuucaagcaauuuuccugccucagccuccugaguagcugggauuaaaggcaugugccaccaugcccggauaauuuuucuauuuuuaguugagauggcauuucaccauguuggccaggcuggucuugaauucuugaccucagauuaucugcccaccuuggccucccaaaguucuggaauuagaggugugagccacugagcccagcccaaccccauuuauuaucaacuaacaaacggauaaacaaaauuugguacaccuauacacuacaguauuaucuggccauaaaagguauaaugaaagccaggcaugguggcucacaccuguaaucacaguacuuugggagaccaaggccagagaucaccugagcacaggauuuugagacugggcaacauagugaaacccugucucuacaaaaaacaccaaaaaaaaaaaagauagccaggugugguggcacauguccauagucccagcuacucaggaagcugaggcaggaggauugcuugaaugcgggaggucgaggcuucagugaacccagauggagccacuacauuuuagcguggaugaaagagcaagaaccuaucucaaaaaaaaaaaaaaaaaaaagaacugaugguaugacugggcgaaauguuaugcuaacugaaauaugccagccacaacagaccacuugcuuaugauuccauuuauaugaaauguccagaucggggaaauguacauagacaaaaaguagguuagugauuccuuaggacuguggggaggaauaugaggguaauagcuaauggacacagggacuucauuuugagaugauaacuguucuaaaacugacuacgagcuggucaaaguggcucacacaaucccagcccuuugggguucugaggcagguggauggaucauuugagcccaggaguucaagaccggacugggcaacaggugaaaccccaucucuaaaaaaaaaaguuucaacaauuagcuuggcaugguggcgcacacccggcuacgcaggaggcugggguggcacaaucacugaacuugcaggggccagggcugcagugcauugcaccacugcacuccagccagggcgacagaauaagacucugucucagaaaaaaaaaaaaaagaaaaacaccacaaaaaaccugacuguggcaaucacugcaagcauuugugaugauacuaaaaacaaccauacauuuuauuuuauuuuugagacagaguuugcucuuguugcccaggauggaguguaauggcaugaucucggcucaccacaaccuccaccucccgaguuuaagugauucuccugccucagccuccagaguagcugggauuacaggcaugcgccaccacgcuuggcuuauuuucuauguuuuuaguagagaugggguuucuccauguuggucaggcuggucucaaacucccaagugauccgcccaccucggccucccaaaguggcgggauuacaggugugagccaccgcacccagccaauuguacguuuuaaauggguaaacucuaugguaugagaauuauaucucaacaaagcuguuuuuaaaaaagaaaauuuaggccgggcacggugggucucaccuauaaucccagcuacuuagaaggcugaggcaggagaaucacuugaacccgggagguggagauugcagugagccgagaucaugccacuguauacuucagccugggugacagagcaagacucugucucaaaaaaacaaguuagaaauuauuaagauggccaggcacaguggcucccgccuguaaucucaacacuuuggaggccgaggcagguggaugaggucaggaauucaagaccagccugggcaacauggugaaaccccaucucuacuaaaauaaauaaaauagaauuuuguuuguuuuugagauggagucuugcucugucgcccagacuggagugcaguggcaccaucucagcucacugcaaccucuaccaggucauggguucaaaagauucuccugccucagccucccaaguagcugggacuacaggucuacgcuaccacaccaggcuaacuuuuguauuuuuaguagagacaggguuucgccauguuggccaggcuggucuccaaccccuaaccucagguaauccaccagccucggccucucaaagugcugguauuacuacaggugggagccacuaugcccacccugaauuuuuuuuugguuuuaauuuuuaaaauagauagggucuccccucuguggaccaggcuggaauacaguggcacaaucauagcucacugcagccuugaccuccugggcucaagcaauccucacaucauccucccaaguagcugggacuacaggaaugcaucaccauacucagcuuuuuuuuguacagccagggcuucacuauguugcccaggcuggucucaaauuccugggaucaugugacccucaugccucaaucucccaaagugcuaggauuacagaaauaaaccacuccaucuggccucuguucugccucuuaauggauagguaaucugaauuacuuagucuuucugugacuacauaaugaggacagcaauauaaucuuguaagauuugauauuuagagaugauaauugccagaucuacugucuggcauacaugggggcugugauaaauuaaauaaccauguuuuaugaauucuaaggcucagaucucugaaauugugaugugucucaaaaucagcaguuuuccaaugagagacagccagaagcaauuguaaggaaacuacuguuacuugcacuuacacaaauuucacuuugaaaaucuugugcugauaacaacugauaacaucuagaaagcacaagcaucaaaucuugcagcauuaaguguuaauggcucagaagaacaucucagcaacaacaguuggagcacucaaaagaauucuacaucacgcugggcaagguggcucacgccugugaucccagcacuuugggaggccaaggcggguggaucacgaggucaggagaucuagaccauccuggcuaacacggugaaaccccuucucuacuaaaaauacaaaaaauuagccgggcaugguggcaggcgccuguagucccagcuacucaggaggcugaggcaggagaaucgccugaacccggaaggcagagguuacagugagccaagaucgcgccacugcacuccagccugggugacagagcagagucugucucaaaaaaaaaaaaaaaaaaaaaaucuguaucacuaacacuacuggugaugacaacacuguguggaaaaacacaagcaucaauuacuaguuuuaacaaaaaagaucacaagggucaaacuaugaaugugaauguaggaauaacaaccaauuguccaggcacgguggcucaugccuguaaucccagaacuuugggaggcagaggugggcggauuaccugaguucaggaguucgagaccagcauggccaacauugugaaacccugucucuacuaaaaauacaaaaaaacagccggguaugguggcaugugccuguagucccagcuacucaggaggccgaggcaggagaacugcuugaacccgggaagcggagguugcagugagcugauaucaugccacugcacuccaguaugggccacagagugagacuccgucucaaaacaaaacaaaaaccaauuauuucaauuuuauuuuccuuuacauauguaagaaggugauguggaaaaaauuugucuaaaugaguuaauuauaggagcucuuucagcaaguauaaaauuaaaauuuuguaaguguuaaaaaucaccagaucauaauuuguuaaucuuuuuuuuuucuaaugaugggcucauagucaucaaauuccuuggucuuucuauccuaucacucaggacagccagcuuaauaguaaaguggaauagcuuacugugauaauaccagcugaaagauaacgcgcugagaagaugaggugcuuacuuauuuuauaacaugugauacauuaccuaaaucagugaccaauaaauugucacuugucccacaguacacagaucuggaauuuuuuuuuuuuuuuuuuuugagacugaguuuugcucuugucacccaugcuggaaugcaauggcaugaucucagcucacugcaaccucugccucccggguucaaaugacucuccugccucagccuccgaaguagcuuggauuacaagugcccaccaccaugcuuggcuaauuuuuguauuuuuaguagagucaggguuuugccauguuggcuaggcuggucuggaacuccugacuuuagguuaucugccagccuuggccucccaaagugcugggauuacaggcaugagccaccacgucaguccagaucuggaaauuaaaagauugaaucagagugcccccucucauuaucauaccuaauaaccuacucaaaaaacauuuuuuccuccauccuuaaaacgcuuggucagcugguuuagaggucuugguuucuugguuuagaggucuuggaauacuucuaccuuaggacacaacaaccgcuccacuacagugaagcugaguuugucacuugaccauuuugagcucaugccaacugaaacaacaguuaaagaacaguuucaccguggcugggguaacugaucucaacuauugugagaaaccuagguuguugguaugaaauaagggcagggggaacuauuucuggagcucaucaggugauccagggcaguguuuuucaaaccaucaauggugaagaaucaguuuuuuuuuuuuuuuucauuccaacacacugggagugguggcucacaacuguaaucccagcacuuugggaggcuaagaugggaggaucgcuugagcccaaaaguuuaagaccagccuggaaaacauagugagaccuugucucuacuaaaaauuuaaauuguagcuggguguagugacacaugccuguagugucaacuacucaggaggcuggggcaggaggaucgcuugagcugggaagucaagccugcagugagccaugaucguaccacugcacuccagccuaggccacagagcgagaaccugucucaaaagaauaaguaaaguaaaauuccaacacauuuguaaaauauaaaacacugaaaugcacuuagacguucguaaucaauagcaaaugaccuauaaauguuucuguuuacucucaauuucugcauuuguccuauugugaacugacaccacacucucaauagccaaagcacaauaugcaauauuaaaaguucaugggaaacuucaguguccuaaugaagucagaaugccuuggaaugaaguuuucauacaaucuaccaaguuaaaaacaaaacaaaacccaauaggccccaacugagguacuaagugaaggaaaaagaaacaaugggaugaggcagggcaugguggcccacgccuguaaucucagcacuuugggaggccgaggugggaggacugcuagagccuaggaguuugacagcauccuggacaacauagugaggcucuaucucuacggagaaaaaaaaacaaacaaacagaaaaagaaauuagcugggcaggguggcaugugccuguagucccaguuacuuaggaggcugaggugggaggauugcuugagcccaggaguuugaggcugcaaugagccaugacggugccacugcaccucagccuuggugacagagcgagacccugucucuuaaaaaaacaaaacaugccacgaucucagcucacugcaaccuccaccucccagguucaagcgagucuccugccucggccuccugaguagcugggauuacgggcaugugccaccacccucggcuaauuuuuguauuauuuuaguagaggugggguuucaccaugauggccaggcuggucuugaacuccugaccucaggugauccacccgccuuggccucucaaagugcugggauuacagguguuagccaccgugcccagccugaaauacauugucaagacauaaauaaguacccauugucaagagauaaguaaaaaaaaaaaaaaaaaaaaaaaaaaacagaaacagagguggaccaaacgcuaaagcuaucagacagagacguuaaaauaacuaugaggccaggcagagagccucaugccuguuaauaggcaugaacacuuugggaggcugaggcaggaggaucacgugaguccaggaguuugagaccugggcaacaugacaaaccccgugucuacaaacaauacaaaaauuagcuaggcgugguagcacaugccuguagucucuacuacuugggaggcugagaugggaggauggcuugaacccaggagguggaggcagcagugagccaugaucaugaaacugaacgccagccagccugggugacagagcgagacccugucacaaacaaaaaauauaaauaaauaaauaaagcaugcugauuaucaucaggauuuaaaguaaaucagcacuuagagcucacccuggccaaacaagaaaagccaaaauuaggaauauuaaaggacaauaugcuaaaucuaacuuagaguuuaaaccaagagcauuacaugaauagaacauuugggauuuaccaugcugaaaaauauacaaggaaacaauacacgaauauggacuuugagugauaauguugugauguugguuuagaaauauagcacucuagggccgggcgugguggcucaaaccuguaaucccagcacuuugggaggcugaggugggcagaucaccugaaaucaggaguucgagaccagccugaccaacauggugaaaccccgucucuaccaaaaauacaaaaaauuacccaggugucguggcggaugcuuguaaucccagcuugggaggcugaggugggagaacugcuugaacccgggggagcggagguugcagugagcugagaucaugcuacugugcuccagcccgggugacagagcgagacucugucauaaaaaaacaacaacaaaacaaacaaauguaccacucuggaaggugacugaggggaggcauuacugugggaggcaugugugacuggggaggggaagucuuccugggggacgggaguguuacugaggagugaguccaggggguuuguugggaauacucuguacauuccagcaauuuggcugugaaccuaaaacugcccuaaaaaaaaaagucuguuuaaaaauuugaacaguuaaggccgguguggugguucacaccuguaaucacagcacuuuggggggccaaggcagguggauuaccugaggucaggaguucgagaccagccuggccaacauggcgaaaccccaucucuacuaaaaauacaaaaauuagccagacauggugguggcacacaccuguagucccagcugcucgggaggcugacgugggaggauugcuugaacaugggaggcagagguugcagugagcugcgaucucgccacugcacuccagcuuaagaaacagacugagacugccucucaaaaaaaaaaaagaacaauuuuaaaaaacaguauaagaaaaacguauagaacaauugagauagcagcaguggauuacaguauuaaacauuuggcagggugcgauggcucacaccuguaaucccagcacuuuugggaggcuauggcaggcaaaucacuugagaucaagaguuggagacuagcccggccaacaugcugaaacccuauguuuaccaaaaaauacaaaaauuagccagguaugguggcucaugccuguagucccagcuacuugggaggcugaggugggaggaucgcuugaacccaggaggcagaaguugcagugagccaagauugcgccacugcacucuagccugggugacagagcgagacugucucaaaaaaaaaaaaaaaaaaagucugauaaaauaucaaggaaauaugagaacugaacacagcaaacaaagcuauacaacauuauuucaaaaacaucuaaagacaauuuuauuuuauuacuaccugguuuuuacccuuucuucaaagcuuuauagguauaugcuucaagaagaaagacagauuuucuuacuuuuuuuuuuuuggagacagguucucacucugucacccaggcuggagugcugcggcacaauuaugguucacuguacacuuaaucuccuuggcuuaaacaauccuccugccucagccuccagagugggcaggacuauaggcgccugcaccacauccagcuaauuuuuguauuuuuuguagagaagagguuuugccauguugcccgcgcuagucucaaacuccuggccucaagugaucugccuugccucagccucccaaagugcugggauuacaggcgugagccaccucacccagccaaaagacauuuucuaaauaacuucugccagaaacaaaguauucucuuuaucuacacugacucaaucuucaugaaucuuaggaaaaauuuuuauucaaugauuuucuuuucacacacaaggaauccaccucuacuuauucuauaguggcuacgugagggauauucaauaagcauuugaaguuauaggauaauuauacauggccacagaacuuaacccaauuuucaaguauuaaacuuaacaaaauaaaauaauggcaucaauuuacuauuaagguuuacuuagggccagcgugggggcucacaccacugcacuccagccugggggacaaggcgagacuccaucgcaagaaaaaaaagaaaaagaaaaagcauacacuaagugauuuuuuaaaauucauauuauaauuaaguacauaaaauguugcuagccacucuuuaaauuuuacucauccacggcuuucacaccuauugucagaugacuauaaucucagcaacaaacaaauuuacucagacagcaucaauuagaaauggauuccugggccaggcacaguggccuguaauccuagcacuuugggaggccaaagagggcggaccacgaggucaggagauggagaccauccuggcuaacacggugaaaccccaucucuacuaaaaguacaaaaaaauuagccgggcgugguggcgggcgccuguagucccagcuacucgggaggcugaggcaggagaauggcaugaacccggcuaggcagagcuugcagugagcugagacuguaccacugcacuccagccugggcgacagugugagacuccaucucaaaaaaaaaaaaaaaaaaaagaaauggauuccuguacaaacaaagaugcuaugugaucuggacaugaggcuaaaaaaagacuccacaggccgggggugauggcucacgccuguaaucccagcacuuugggagacugagguggguggaucaccugaggucaggaguucaagaccagccugaccaacacagagaaacccuggcucagcuaauccucccaacucagccuccugaguagcugggacuacaggagcacaccaccacaccuagcuaauuuuuuguauuuuuaguagagacaggguuucaccaugcuacccaagcugguagcaaacucccgagcucaagugauccgucugccuuugccucccaaagugcugagaucauaggcaugaggcaccacgcccagccaggcauuaauuuuauaacaaaaacaacacauaaggccaggcauggugguucacaccuguaaucccagcacauugggaggucgaagcaggaggaucuccugaggucaggaguucaaggucagccuggccaacauggugaaaccccgccucuacuaaaauuacaaaauuuaaccgggcaugguggugugcgccuguaguaccagcuacucaggaggcugagccaggagaaucgcuugaaaucagaagguggagguugcagugagcugagaucuugccacugcacaccagccugggcccaagagcgaaacugugucucaaaaaaaaaaaaaaaaagguacggguagggaauuaccuaagccuuaccuaacccuaacuugccucagcacaagcaaaauaguaguacucauuucuugucuuuuuuuuuuucuuuucuuuuuucuuugagacagagucucacucuaucaccuaggcuggagugcaguggcacaaucucugcucacugcaaccucugucucgugaguucaaacuauucuugugccuccugaguaguugggauuacaggcgcacaucaccaccccugacuaauuuuuguauuuuugguagagaugggguuucaccauguuggccagguuggucucaagcuccuggccucaagugauccaccugccuuggccuccuaaagugccgguauuauaggcaugagccacugcgcccugcuguacuuauuuauuuuccuuaaacacaccaaacaugcuucugccuuucugccauucaucugccuggaauguuuuaccauucauuugccuacccaagucugagacuucaaaucccagcccaacugucaccuucucuaugaauuucuugacaaucaaaauucuuagugaucuuuuuaucuaaagaaacaaaugcaauccaaccacauaauuggcacucacauuguaaauuacaaucaucucaaaauaugauaaucucacaugaaaauccauucuacuguuauucccagugucacuuucccuuacugaacuaaaugcuguuauuuaagggcuggcuuuaccaacacaaaucacaaugccacuacuuuaguaggaaguguuaaauguuuaucucuuuuuaaauuuuuuuauuuuauacccuaguugcaagcuaaaaauguuuaaucuaaauuuuuuuguuguuguuggagauagguaucucacugucgucuaggcuggagcacaguggcacgaucaugaccacugcagccucuaccuccccaggcucaggugauccuuccaacuggccuccugaguagcugggacuacaggugcacaccaccacacccagcuaauuuuuuguauuuuuaguaccaugcugccaaagcugguagcaaacucucgagcucaagugaucugucugccuuggccucccaaagugcugggaucacaggcgugagccaccacacccagcaaggcauuaauuuuauaacagaaaaacaacacguaaggccaggcauggugguucacaccuguaaucccaauacauugggagaccgaggcagguggaucuccugaggucaggaguuugagaccagccuggccaacaaggugaaagcccgucuauagugaaaauacaaaaauuaggccaggcguggugguucacgccuguaaacccagcacuuuuggagggcaaggcaagcagaucaugaggucaggaguucaagaccaggcuggccaacacagugaaaccccgccaucucuacuaaaaauacaaaaauuaggugggcauggugguacguaaccagcagucccaccaacuugggaggcugaggcaggagaaucgcuugaaacugggagguggagguugcagugagcugagaucgcgccacugcacuccagccugggcaacagagugagacuucgucucaaaaaaacaaacaagaaaaccacaaaaaguagcugggcgugguggcacgcaccuguaaucccaacuacucgggaggcuaagacacagaaucgcuugaacccaggaggcaaagguugcagugagccgaaauuguaccacugcacuccagccugggugacggagugagacucugucucaaaaaacaaaaacaaaaacaacaaaaacaaaaaaacacauauauuauggaaguuaccaacuuuuaaaauaucacauaauacacaaaaacaaugauauguguauaaguuccaaaggcugagggauucugggucuaggcacaauuguaacuguguagaagcaaacuagcuaggaagcuaugaauuaaugucaaagaccgaaugccaacagcaagggaaagaaauuuagaaaauuucuucauuaugcuuauguucaacuuucuauugcaacaguuaucuugaacauuuuuuuuuuuuaagagacagggucuuccucugucacacaggcuagagugcaauggugcaauccuagcucacugcucaggugauacucccaccucagccucccaaguagcugggacuacaggcaccugccaccauacaaagcuaauuuuuuuuuuuuuuaacggagucucacucugucgcccaggcuggagugcaguggugugaucucagcucacugcaaccuccaccucccggguucaagcuauucuccugccucagccuucugaguaccugggacuacaggcacacgccaccaaguccagcuaauuuuuguauuuuuaguagagauaggguuucaccaucauggccaggauggucuugaucucuugacuucgugauccacuugccucggccucccaaagugcuggcaguacaggcgugagccaccacacccagccuaauuuuuuauuuuuuguagaggugggggucucaccggccuugaacuccuggccucaagcaauccuccaccucgcucucccaaagugcugugauuacaggcaugagccaccacaacuagcuagaacuuucuugaucuguugucuucagcaaauaaaaacuaucaggauuucauauauuguaacgaacuguagaauugaucccugaaaaguauaaucuuggauuucauauauuguaaaaacuccacucacuccauuaauuuuaucuuucugcaccagggaauucaagaaaucuuuucuuuccuuuuauuuuuuauuuauuuauuuuuuuugagauggagucuugcuaugucgcccaggcugaaggguaguggcgccaucucggcucacugucucagccuccucaguagcugggaggcgcccgccaccaugcccgcuaauuuuuuuuguauuuuugguagagacgggguuucgccauguuggccaggcuggucucgaacaccugaccucugguggucagcccaccucggccucccaagaugcugagauuacaaguaugagccaccgugccuggccaucuuuccuuuuuaauagagucugggucucacuauuuugcccaagcuggucuggaacuacagagcucaagugauccucuugccuuggccuuccaaagugcugggauuacaggcauguggcaccgcacccagccauguggaaauauuuuaaugugccaauaaccucagccaaacuguuuaacaauuaacugugaaaauaaaagccaacagaaauaaaauucauuaauguccuuaaaccuguucucuuacugugagcauuauauagauuucugauacaagauauauaaaucauaguauuggccuucauacaugucaauguuacuuacuucauauaugguuuuuaauaagccuuaaccuaauuucuauuuaauucaagaucuucaauuaagaccuaagugaggcuugaagcuuucaacauuauuucuguuauuaaaauucuauccccaucccuuccuacccgcauuucuccaaacuaaaaagguaucacucaauucugaguuuuuguuuuuuuuuuuugagacguagucucgcucuguugcccaggauggagugcaguggcacaaucucagcucacugcaagcuccgccucccggguucacggcauucuccugccuccaccugcccagcagcugggacuacagacacaguccgccacgcucgacuaauuuuuguauuuuuaguagagacgggguuucacuguguuagccaggauggucuugaucuccugaccuugugauccgcccgccuuggccucccaaagugcugggauuacaggcguaagccaccgcgcccggccucuuccugaguuuuuaaggaaaucuagaguucuuaccccacugaaccucaacaugacacuuauguuuaauuauucucacacagaacuacucuuguugccaggaagcaauaaguuggcuucauuggaaaacauuaauuagcuuauuugacugcaaauuaaaaguaggcagguugggcgcaguggaucaugccuguaaaccuagcacuuugggaggccgaggcgagcagaucacaaggucaggagguugagaccauccuggccaacauggugaaaccccgucucuacuaaaaauacaaaaauuagccagguguggugacacaagccuguaaucccaucuaguugggaggcugaggcacgagaaucgcuugaacccaggaggcggagguugcagugaacacaccacugcacuccagccuggcaacagagcgagacuccgucuggcgaggaagagggggaauuaaccagaggucguggcacaugccuguagucccagcuacuuuggaggcugaggcaggagaaucacuugaaccugggaaguggagguugcagugagccaagacugcaccacugugcuacagccugggcgacagagcaaaacuccaccucaaaaaaacaaaaaauaauaaaaaugguuaagagaguaaauuuuauauguuuaccacaauuaaaaaaaaaaaaaucaggccgaccugguggcucacgccuguaauuccagcacucugggacaccaaggcagguggaucacuggaagucaggaguucaaaaccagccuggaccaacauggcgaaaccccgucucuuuuaaaaauacaaaaauuaggccaggcacaguggcucacagcuguaaucccagcacuuugggaggccgaggcaguuggaucaccugaggucaagaguucgagacuagccuggcuaacauggugauacuccaucuguauuaaaauaacaaaaaaauuuagccgggcaugguggcaggcaccuauaauaccagcuacucagggggcugaggcaggagaaucgccugaaccuagaaggcggagguugcaguaagccgagauugcaccacugcacuucagccugggcaaaaauagccagacuccaucucaaaaaaaaaaauuagcugcacacaguggccuguaauccuagccacucucaaaauaauaauaauaauaaagcaaggauuacauuugccaguggaaauaaacgguugacugggcacaguggcucaugccuauaaucccaacacuuugggagguugagguggguagaaugcuugagcccagacugggaaacauggcaaaacccugucucuucaaaaacuauaaaaauuagcccagcaugguggugcaugcuuguggucucagcuacuggggagccugagguaggaggaucaccugagccuauggagauccaggcugcagcagugagccgugaucacaccacugcacuccagccuagguaccagagugggacucagucucaaaaagcgggggugggggagagggagcgucaagaaauagauauauaaauugauaaacagaacacaaagaaauuagcuuuuuuuucccccccagaccgacucucgcucugucaccaggcuggagugcaguggagcaaucuugacucacugcaaccucugccucccaaguucaagugauucuccugccucagccugaaauuagcuauuuauaaaaauugauuaacauacagaauucaaauuuaacuaacuaacaaacaugguacuucauauacuuuucaugggacaaaaagaaccacagagaaauucuguaaaggauacugguaaaguagcucuguauuuagacuguguuuacaguaggguaguacaaauaaccuuauggauguuagaggaaauccagguuuugccuguagaagacagaaauauggaauggaggaagcuuagaaguacucugugcuagagguucaaauggagguaacagacugaacucauggcugacuggcugauuaaauuauguaaauaagggggauguauuucucagcccuauauacugaaagggccugaagaaauuauaucauaauagcaaugcaagccagacucagaggcuuaugccuauaaucccaucacuuucggaggcugaggugggaggauggcuugaggccaaaaguucaagaccagccugaucaacguagagcgacccccaaaacuacaacaaauuuaaaaaguacauggugggguuuugcgccuguagucccaucuacuccaaaggccaagacaagaggaucacuugaacccagaaggugcagugagccgagauugugccagugcacuccagccugggcuauagagcaagacuccaucucaaaaaauaauaauaaaauaugcccuggugugguggcucacaccuauaaucccagcacuuugggagaccagccuggccaacauggugaaacacauaaaaauuaggugggcaugguggcacaugccuguaaucccagcuacuugggaggcugaggcaggacaaucgcuugaacuugggggacagagguugcagugagccgaggucgugccacugcacuccagccugggugacagaaagacucugucucaaaaaauaauaauaauaauaauaaaauaauaauuuaaaaguacacaugguuagcauacuuugacuugucacaagagcuccugugguagacuaaucauggcuacaaauucuuuccugcuucuauugagagguaaggcucaucuuuuuucuccccuugaguaugagcuggguuaugacaacaguacuuucuuuuaaccaauagaguaagguagaggugauaaugccauuucuggaccaauuucuggcaaccuccuccauggugucuuggaacccuuagcccaacuacucugcuagaaagacuauguggaaaacccuaaaacuacaucuuacagaaaagaacccagcuggguccagccuuucagcuguucccacuaagguaucaagcguuuaaguaaagccacuguggaucaucuagaccaaucuagucacuaguugaauaccaaugagugagcccaguagccauguguagcagacgcaagcuaaacccugccugaauucccgauccacaaaacugugagacaauaagaaaaguugcucacaauugcuaaaaaguggaaacaauucaaguguucacugacagagaaacaaaaugugguacauacauacaauggaauauuauucagcuuuaaaagggaaggaaguaauaacacaugcuauaauacggaugaaccuuaaagguauaugcuaagugaaauaagccaaucacaaaaugacaaauauuguaugauuucaauuauuugagaguaagguaaucgcuucugagccuuuuggcuaagaucaaguggagaguaagucaaagucaucuagacaaaaagcagaaugguuguugccaggagcuggggaagggaaaaaugaggaguuaagaguuuaauggguagaguuccaguuggggaagaugaaaaauucuggagaugaaugguggugaugguuucacaacaaugugaauguaccuaaugccaaagaacuguacacuuaaaaaugauuaaagugauaaauuuuauguuauguauauuuuaccauaaugaaaauuuuaaaauaccuuuuaaaaaguuuguuacacagcaacagauaaccagaacaguucuacacaaacagaagucugaaauaagaacuauacugcacuaagccucccuucacaaauguacacuggcuauuauuuuaggacaugauuuuaagaaaucuugccuccccauuuaauuuuuaauguucugagcagaaucuucugcaauacaaauauuaaaacauaugaacagaacucagaguuaaaauuauauacuuaauuacaugcaaaauuaucacacuguguagcaaugagggauaaauaaaaaucauucauggaaguaaaaauaauuacaaccaaaccaguacuucagggguccuccuggaggaaagcaaagggaaagaauuauggccguccugcccuuaaucuguucaucaccucuaacaagguuugugaggaaagggggauggcccuacguuaauaucaauuccaccauauccuaauucccacuaaaccaucaaauaggccagaugagaaugguugauacaggaagaaagauuagagaaaauauaaggaaaauacaccuggugggaaaaaacgaggauacuuucacaaaacccuacuuaauuuuucgaauucuuagcaacaaaacaguagguauuuuuauuuguuucugugacagaauaauauagcagaccaggguagcuguauuaaugucuggagcacugcucucugagaucagauaguuaagagaggaauauaagaaacaaauuucaggccgggcaugguggcucaugccuguaaucucaguccuuugggaggccaagcuggguggaucacuugaggucagggguucaagaccagucuggccaacauggugaaaccccgucucuacuaaaaaugcaaaaaauuagccggguguaguggugggugccuguaaucccaguuacucgggaggcugaggcagaauugcuugaaccugggagguggagguugcagugagcugagauuuugccacugcacuccagccugggaaacaagagugaaauucccuuucaaaaaauaaagaaaaaaaaaauuucaggcugggugugguggcucacgccuguaaucccagcgcuuugggaggccgagguggguggaucacuugaggucaggagcucgagaccagccuggccaacaagaugaaacuccauuuccaccaaaauauaaaaaguuagcuaggugugguggcacgcaccuguaaucccaacuacucaggaggcugaagcaggagaauugcuugaaccugggagacagagguugcagugagccaagagcuugccacuguacucuagccugggcaacagagugagauuccaucucaaaaagaaaagaaaagaaacaaauuucacucuauccaucccuccguuuaaaaaucaagaaaugccuggcgugguggcuuaugccuguaaucccaacacuuucggaagccgagguggguggaucacgaggucagggguucgagacaagccugaccaacauggugaaaccccgucucuauuaaaaauacaaaauauuagccaagccugguggugcacgccugugaccccagcuacucaggaggcugaggcaggcgaauugcuugaacucaggaggcggaaguugcagugagccaagaucgcgccacugcacuccagccugggcgacagagcaagacuccaucucaaaaaauaaauaaauaaaauaaaaauaaaaaggccaggcacaguggcucucuccuguaaucccagaacugugggaggccaaggcaggcagauuaugaggucaggaguucgagaccagccuggccaacauggugaaaccccgucucuaacuaaaaauacaaaaauuagcugggugugguggcagaagccuguagucccagcuacucaggaggcugagcugagauugcgccacugcacuccaaccuggcaacagaccgagagacuccaucuuaaaaacaaacaaacaaacaaacaaaaaaaacaccaauaauuaucaaggcccucuuaccuccaaaguagcaagaaagaaagaaacaaaguauguguauaguaaauagcucuguaguaauccaugauauaggauauacuacauaacuaacuuaauuccauuaagcccuuuauggaauuugcacagcuauuuauaaguguauuuuauuuuuuuaauuuuuauuguaaaugagguuuugccauauugcccaagcuggucucaaacuccugagcucaagugaucugcccguuucagccucccaaagugcuggaaauacaggcauaagccagaggacaccagaccuauaaguguauuuuaaaugucacuuauuagaugugaacccuguauuaguuucagaacccacaacuauaugggaggauggcuauuugugauucuuuuuuuuuuuuuuugagauggaguuucgcucuuguugcccaggcuggagugcaauggugcuuagauuacuuaauuauaauauuaauuuuuuuuuuuuuuuugagacagaguuucacuguuguugcccaggcuggagugcaauggcaccaugucggcucaccacaaccuccgccuccuggguucaagcgauucuccugccucagccuccugaguagcugagauuacaggcaugcgccaccacacccggcuaauuuuauauuuuuaguagagacaggguuucuccacguuggucaggcuggucucgaacucccgaccucaggugauucacccaccucggccuuccaaagugcugggauuacaugcaugagccacugugcccggccuguaauaugaauuuuuuaaaaaaucacuugcucaguguaugcuuuuacuuuuuuuuuuucucgugacagagucuugcccugucccccaggcuggagugcaguggcgugaucucggcucacugcaaccucugccucccagguucaagggauucuacugccccagccuccugaguagcugggauuacaggcaugugccaccacacccaacuaauuuuauauuuuuaguagaaacgggguuucuccauguuggucaggcuggucuugaacuccugaccucaggugauccgcccgccuaggcaucccaaagugcugggauuacaggcguaagccaccgugccagcuauuugugauucuuaauguaacaaugauacuaaacuauuggccauccuuccacauagcuaacuuuaguaugguuuuaauauuugucaauuaauauauaauuguaacuucuauuaucuaaguagcagaaguuaaugacacuuuucagcuuuaggugacuagcguuguucacaaccuaucaaauggucaguuucuucaccugaaaaauuagaacagaaauacauaaccucugaacuaccuguugacuccaaaauucuaaguacuguaccuauguuaccaucucuaagacacaaacuccuuaguuugaaaaguccuagccaggcagaguggcucacgcccuaaucccagcacuuugggaggucgagguggguggauuaccugaggucaccaguucgagaccagccugaccaacaugguaaaaccccgugucuacuaaaaauacaaaguuagccaggcguggugguggaugccuauaaucccagcuauucaggaggcugaggcaggauaaucacuugaacccaggaagcagagguugcagugagccgagaucaggccauugcacuccagccugggcaacaagagcaaaacuuggucucaaaaaaaaggaaaguccuuagcugcaauuugaaauuuuuucaaauuauccuuuacuuucaaaaauaaaaauauuucucuaauucaguauuaauacaaaauauucauucauucacuuaacaaguauuuguucagcacccaauuaugugccaggcauuaagcuuggcacugagaggaaugaaaaacagacacgguaucuguauuaauaagguuuacagagaagcuaaagagacaaaccaaauaaauguauggauaaauguaauaugaaggaguugaaggguauguaauguagaaucuuuuuuuuuuuuuuuugagacagagucucgcccuguugcccaggcuggaaugcagugaugugaucucggcuccaagaaaaaggguuucacuauguuggucagacuggucucgaacucuugaccucgugauccacccaccuuggccucccaaagugcugggauuacaggcgugagccaccgcgcccagccuguaauguagaaccuuaaaggcuucccuuaagaaguaacaaaugaaugacaaaugaacacaugggcuauuuaauguaaggaaccugucuagacagaaauaaacauggcauguucaggaaaccaaccgaagaccacuguggccugacauaacaaaaauagguaaaguaaugcccuggaaacaggaaugaaaagcucuaguauaggaaaacauaucuuagcucuuucaaagacauacucuaagaauuauugucaacgaagcuucaaagcuucacaauaguuucucucaaaugcuuaaaaaaaaaaaaaaagcuguccuuuuucucccuacaaaagaccaaacucacucucauucucuucacauuucacuguaaugucuucaacuacaugauaaaaguuacaacuuuuuaguucuacuuaguuuagauuccuuagaagaaagcaacuauauaacaaccaaaguaaauauggcguuauugccccugcccucugccacuaaacugcccugugacugauuuugguaaagguuacuugaauacuuuggccuaacuuucauuaucugugaaguaagaggagguuccagaauuuccuuuaagauccuucuaauucuaagauuaugguuccacuguaaaaccgcuuguuccuuuuuuuuuuuuuuuuuuuuuuuuuaagacaaggucucacucggucacccaggcuggagugcagugguaggaucacgguucacugcagcccugaccuuccugggcuugagugauccucccaccucacccuccugaguagcuacgaccauauuugcauuuuuuguagagauagguuuuugucauguugcccaggccuaucucaaauuccugggcucaaguguuccucccaccuugaccuccugaagugcugggauuacacaggcaugagccaccacacccagccuuguuccauucuugaaaacugacgagaacaggaccaaacaccgcugaauuccuuuguaauugccuuuaagauguuuuuuguuuuguuuuguuuguuuguuuucgagacagagucgcgcuuugucacccaggcuggagugcaguggugggaucuuggcuuacugcaagcuccgccuccuggguucaugcaauucugccucagccuuccaaguagcugggacuacaggccccgccaccacgccuggauaauuuuuuuguauuuuuaguagagaugggauuucaccuguguuagccaggauggucucgaucuccugaccucaugauccacccgccucggccucccaaagugcugagauuacaggcgugagccaccgcaccgggccugccuuuaaggucuuuuuuaaugagacagagucucacucugcugucacccaggcuauagugcaguggcauaaugccucacugcaaccucugccuccuggguuuaagugauucucaugccucagccacaggaguagcugagauuacagaggugugccaccacaccuggcuaauuuuuguauuuuuaguagagaugggguuucaccauguuggccaggcuggucucgaacuccugagcucaagagauccaccugccuuggccucccaaagggcuaggauuacaagcaugagccccugcguccgggcuuaagcucucuuuguguuuguacagcauuucaacacuguugcuauguuauaauaauaauaaacuccugaauuuauaaaauuaucaauaacuaagauucuaauaaaaaaacaaaauuucaaaaauacuuaaguauuguuaaaaaucuacauuuccaaugagacauaauacuuuaaagaaggaucccuaauuaaguacaaagucaaaauagaaaggaaggcagaagaaauacaaaaucaaaagaauuuuucagaaaacauuuuggcaguaggacauugaaguugguugauaugaacgucgauuuuaacuuccaaaagaacucauaacaaauggauaaucaaacucgaugcucauucuccacuggauuguauguccauuuauaguuaacaguacuucugauaaucgauuuucaaacagaaaauguacauaaguagucauaacuuucccaacacaccuuaaaaaaauaauauugagacacgguuggcugggcgcgguggcucacgccuguaaucccagcacuuugggaggccgaggugggcggaucacgaggucaagaguucgagaccagccugaccaacauagugaaacuccgucucuacuaaaaauacaaaaauuagcugggcauaguggcacgcaccucuaaucccagcuacuugggaggcuggggcaggagaaucgcuugaacccgggaggcggaguuugcagugagccaagauugcaccacugcauuccagccugggcgacagggcgagacuccgucucaaaaaauaaauaaauaaauaaaaaauaaaaauaaaauugagacagggucuauguugcccaggucugaaccuccugggcucaaaugauccuccugccucagcccucaaaaugcugggauuacaggcaugagccccuguacccaaccacaacuuuccuuuuuuuuuuuuucacuguuuaaggaauuuuuuauuaaaaaaagaauuuuauaauccaaauuacgcuuccuugcucaguuaucaauucuguuacuuaaaacagaacugauauuuugagcuauuccacaguaaagauuacaaggaaugcuuuaaauuuuuguacuuugcugaaaauuauuuuucccaggaucuauaaaacauuaauuugucuuuauauuuuauuauuuuuugugggguuuuuuuuguuguuuguuuuuaaaucaauaaguaaucuaggacuaauauuauguuugcuagaccuggcauuugcucgguacauaauguucaaaguuuccuuuccuuuuuaaauuuauuuuauauuuugcaauuuuuuuuuccauauuuaaguuuuucgauguuuagauauuuuucuuuggugaagcacaaguuucuuuucguggucucugaucaauuuuaaacagcaggaacaccaauggcacuguuaacugcuuucuggguagccucuuuagcuuggugggcuuguaauauagcuagcuucaugaaccuuagaacagagugacucuggacucucgagcauaugaacauuugcuuuugcucuugaggggcagaugccaacauggaagcagucaaagguuccugaccuuguacaugaacagcaggcuguugcauuguaacuuguggcugugcauuaagauguugcugaggauugcgaacucccgcagcauauuuauacuguggaacgguguggacagcaggaguagcugcagccagcagauaccaggguguuaauauuuacgugaaaaaucuugaugauaguauugaugaugaacgucuccagaaagaguuuucuccauuugguacaaucacuagugcaaaggcuaugauggaggguggucacagcaaaggguuugguuucguauguuucuccuucccggaagaagccacuaaagcaguuacagaaaugaacgguagaacuguggccacaaaaccaucguauguagcuuuagcucagcgcaaagaagagugccaggcucacuucacuaaccagcauaugcagagaauggcaaguguacgagcugugcccaaccauguaaucaaccccuaccagccagcaccuccuucagguuacuucauggcagcuauuccacagacucagaaccgugcugcaagaccgggcgcgguggcucacgccuguaaucccagcacuuugggaggccaagaggggcagaucacgaggucaggagaucgagaccauccuggcuaacacggugaaacccgucucuacuaaaaaaauacaaaaaauuagccgggcaugauggcgggcgcccguggucccagcuacucgggaggcugaggcaggagaauggcgugaacccgggaggcggagcuuacagugagccgagaucgcacccacuccagccugggcgacagagcgagacucugucucaaaaauaaauaaaaaccgugcugcauacucuccuccuagccaaacugcucuacugagaccaaguccucgcuggacugcucagggugccagaccucauccauuccaauaugccaggugcuauccccaagcugcuccuauaccaccacuuaauacuaugagaccagcuucuucacagguuccaugagucaugucaacagagcgguugcuaacacaucaacuuuccauuuuuuaaccaaauuauccaacauuagaauucaagguuucaauauucuuaauuugaaaacaauaaauauuaacgauccaucaauuguuuaaguuuuauauuucauaauuucucacucccaaaacaguguaacuuuuagaagcaucaaucaagcagcucaauucauguauaaucuuuaguaucaauauuugcuuuauuuauuuuauuuuacuuuuuugagaugaaguuucacuccuguugcccaggcuggagugcaauggcgcgaucuccgcucaucaaaacuuccgccucccggguucaagcgauucuccugccucagccucccaguagcuaggauuacagguaugcgccaccacgcccagcuaauuuuguauuuuuaguagaacuccagaccucgggugauuugccugccucggccucccgaagugcugggauuacaggcuggagccaccacaccaggcccaagauuuguuuuaaugaaaggggcugggagcaguggcucacaccuguaaucgcagcauauugggaggccgaugcaggcagaucauucgaagucaggagaucgagaccaaagugaccaacauagugaaaucccaucucuacuaaaaauacaaaaauuagcugggcgugguggcaggcaccuguaaucccagcuacuagagaggcugaggcagaauugcuugaacccgggagguggagguugcagugggccgagacgcgccacugcacuccagccuaggugacagagcaagacuccgucucaaaaaaaaaaaaaaaaaaaaaauuuagccgggugugguggcacacgcugguagucccagcuacuugggaggcugaggcagaauagcuugaaccugggaaguggagguugcagugagcugagaucccgccgccgcacacagauuuguuuuaaugaaaggaacuguugucuuauuccuuccaaaaaggcaacaaauugcagaaccaaauuaagagucugaaaacuaaaccacaggaauauuuuaaauacuguacucauuaaaaugcaacauuagguacauuuacugggcuccaagagcaagaggccaagcucauucccuaaaauacauuuggccaaguggcccaagguggaaacauugucaacaauguugcuucccucaccucccaccaauucugauugauucuaacucugaaaaguuguuaaaucauuuccuagucacuauuaccaaugccauagcccuaccugaagauuucaacgucuuucaccuagacuacuguuuacaguuuccuagccggacucacugccucuggucuuccccuacuccaaucuagcaccaauugugacaaccaaaaugucuccagcauugccaaacaucuccuggaggucaaaguugcccugacucagaaccacugcuucaagcuguuccuacaagaagaauauuacuuauuuguuaagauucuggccacaaucuaugucaguggaacagaaaccaaaaaaacuaacaaacaugagguugaaauuuaaaaccuuaaccuuaggacugccaugcuuaaacaaaauuagcugacaccucauaaaaagggccauaauacucuuaaacuccuuugaacguauagacuuaaaucaucuuacuuuaagccugaauuaugaaaagucuguaccuucugucaaaguuuaaccaccauauauacauauuuaagcuucuggauauagaaaauuaugcaaauuuuuaaaaaggacuuugcgcuuuaaucaauccccuucagaagcugaaaauaguaaacuucuuaggcaaauuacugccuacaccuaaguuugcaagccacucugaacaguauucucauuaaauaccuccagaaaaaacucuaaaaacacaaauucuuaugcuugaaaaccaguaaguuuuugaaaaaucacacuccuuuuaaauuucccacaaugguuauaucccuacaaaacucacucaaagauguuaucugagauacaacaguaccuuucagaggggguaagagaucuaaaaaacuuggaacuuuaaaggccagacugagcaggguagcaguaucacaggagaaagcgccuucuaccaaagacaucaaaauccguccagacacuuaccuucaggcguuugaucaucucguccguggugaucuugucggugaucucuuuuacccccggaggguaagcgaucuucccgucggcacucacgacgccacagagggcaguggcaggcuugggcugcgcggugaaguccauccugggggacaacuuuugguucacaguccucuaccggccucuaucggucagaaaaccaaaguucagcgggaaaggggcgacuuuguaaccucuuuuuucauuucaaaucucucuaaucuggaaaaggcccugucuccccagaggccggggacccggcagcggccucgccacccgcucuuucccagggaucgaaccccgccggccccgccaacccggcccugccagccccaggcucacggggcuccuccgcaccagccgccguggccgccgaacagcgccaggaguuucccauuccgccuuucacaaugaaauccacccccgagcaccaggguccgaaguuuggcggccccgggaggccggcaaggaccccaaggcccccgcucggcgguggggaagcacccagucccgcccggccaguccccuccgggaaaccagacccgaggccuauagggcucggcuuaggccgcaaaacuagggacccagcggacccacgcgcagcggcggcugccgggaacaaaacgcccuugcccagccgagccucggacccgggguaguccccgccgcgcugccaccccuccccuguuccgcucccucacccccgcgggaggggaaaacaagccgcccuccacccucagccccacgccaggaagcggcugacgcgccuccgcacuucacauuuuguuccuucaacuucggcugagggaccccagcugcuucucuggcccccggccgcuuggcgccuccggcaccgccgaggccuucccggcacccucgggcggccccaccgggccucggacccgcggccccccccuccagucuccccuuccguccccucccuccagcagccuagggcgggagccgagccgccgccgccuuuaccuccuccucaugcgggcggaaggugcaucgagcgcccgggccucugucaggugguugcgccgccgccccuagucgggcugcacacaaagcggcuccgcgggucccgccgccgccgccgccgccgcccgcccgcccgggagcggcgcuggggcuggcggugccgaggaggagcagccgccgcggggggagacgcggggcgagugagcgcugggcggggagacagugccgcucuccgucuggccgaggaagagcagccucgaaggcuccuccgggagugugugcgcuuguguccguccgggacccccgcggcccgcccgcacgcaccucgcgccggcccggaccgccgacucggacccggacgccccucgcagaggcgcgcgcccggccguccgugccccgggagccggggccucgcgcacacaccggccggucacgcgagcggcgcgagagcacgcgagagcagcgcgcgcuccucgcucccuccccuuccuccgccggcc

SEQ ID NO: 191475 - RNA, 155094 nt, Homo sapiens
ggccggcggaggaaggggagggagcgaggagcgcgcgcugcucucgcgugcucucgcgccgcucgcgugaccggccggugugugcgcgaggccccggcucccggggcacggacggccgggcgcgcgccucugcgaggggcguccggguccgagucggcgguccgggccggcgcgaggugcgugcgggcgggccgcgggggucccggacggacacaagcgcacacacucccggaggagccuucgaggcugcucuuccucggccagacggagagcggcacugucuccccgcccagcgcucacucgccccgcgucuccccccgcggcggcugcuccuccucggcaccgccagccccagcgccgcucccgggcgggcgggcggcggcggcggcggcggcgggacccgcggagccgcuuugugugcagcccgacuaggggcggcggcgcaaccaccugacagaggcccgggcgcucgaugcaccuuccgcccgcaugaggaggagguaaaggcggcggcggcucggcucccgcccuaggcugcuggagggaggggacggaaggggagacuggaggggggggccgcggguccgaggcccgguggggccgcccgagggugccgggaaggccucggcggugccggaggcgccaagcggccgggggccagagaagcagcuggggucccucagccgaaguugaaggaacaaaaugugaagugcggaggcgcgucagccgcuuccuggcguggggcugaggguggagggcggcuuguuuuccccucccgcgggggugagggagcggaacaggggagggguggcagcgcggcggggacuaccccggguccgaggcucggcugggcaagggcguuuuguucccggcagccgccgcugcgcguggguccgcugggucccuaguuuugcggccuaagccgagcccuauaggccucgggucugguuucccggaggggacuggccgggcgggacugggugcuuccccaccgccgagcgggggccuugggguccuugccggccucccggggccgccaaacuucggacccuggugcucggggguggauuucauugugaaaggcggaaugggaaacuccuggcgcuguucggcggccacggcggcuggugcggaggagccccgugagccuggggcuggcagggccggguuggcggggccggcgggguucgaucccugggaaagagcggguggcgaggccgcugccggguccccggccucuggggagacagggccuuuuccagauuagagagauuugaaaugaaaaaagagguuacaaagucgccccuuucccgcugaacuuugguuuucugaccgauagaggccgguagaggacugugaaccaaaaguugucccccaggauggacuucaccgcgcagcccaagccugccacugcccucuguggcgucgugagugccgacgggaagaucgcuuacccuccggggguaaaagagaucaccgacaagaucaccacggacgagaugaucaaacgccugaagguaagugucuggacggauuuugaugucuuugguagaaggcgcuuucuccugugauacugcuacccugcucagucuggccuuuaaaguuccaaguuuuuuagaucucuuacccccucugaaagguacuguuguaucucagauaacaucuuugagugaguuuuguagggauauaaccauugugggaaauuuaaaaggagugugauuuuucaaaaacuuacugguuuucaagcauaagaauuuguguuuuuagaguuuuuucuggagguauuuaaugagaauacuguucagaguggcuugcaaacuuagguguaggcaguaauuugccuaagaaguuuacuauuuucagcuucugaaggggauugauuaaagcgcaaaguccuuuuuaaaaauuugcauaauuuucuauauccagaagcuuaaauauguauauauggugguuaaacuuugacagaagguacagacuuuucauaauucaggcuuaaaguaagaugauuuaagucuauacguucaaaggaguuuaagaguauuauggcccuuuuuaugaggugucagcuaauuuuguuuaagcauggcaguccuaagguuaagguuuuaaauuucaaccucauguuuguuaguuuuuuugguuucuguuccacugacauagauuguggccagaaucuuaacaaauaaguaauauucuucuuguaggaacagcuugaagcagugguucugagucagggcaacuuugaccuccaggagauguuuggcaaugcuggagacauuuugguugucacaauuggugcuagauuggaguaggggaagaccagaggcagugaguccggcuaggaaacuguaaacaguagucuaggugaaagacguugaaaucuucagguagggcuauggcauugguaauagugacuaggaaaugauuuaacaacuuuucagaguuagaaucaaucagaauuggugggaggugagggaagcaacauuguugacaauguuuccaccuugggccacuuggccaaauguauuuuagggaaugagcuuggccucuugcucuuggagcccaguaaauguaccuaauguugcauuuuaaugaguacaguauuuaaaauauuccugugguuuaguuuucagacucuuaauuugguucugcaauuuguugccuuuuuggaaggaauaagacaacaguuccuuucauuaaaacaaaucugugugcggcggcgggaucucagcucacugcaaccuccacuucccagguucaagcuauucugccucagccucccaaguagcugggacuaccagcgugugccaccacacccggcuaaauuuuuuuuuuuuuuuuuuuuuugagacggagucuugcucugucaccuaggcuggagugcaguggcgcgucucggcccacugcaaccuccaccucccggguucaagcaauucugccucagccucucuaguagcugggauuacaggugccugccaccacgcccagcuaauuuuuguauuuuuaguagagaugggauuucacuauguuggucacuuuggucucgaucuccugacuucgaaugaucugccugcaucggccucccaauaugcugcgauuacaggugugagccacugcucccagccccuuucauuaaaacaaaucuugggccuggugugguggcuccagccuguaaucccagcacuucgggaggccgaggcaggcaaaucacccgaggucuggaguucuacuaaaaauacaaaauuagcugggcgugguggcgcauaccuguaauccuagcuacugggaggcugaggcaggagaaucgcuugaacccgggaggcggaaguuuugaugagcggagaucgcgccauugcacuccagccugggcaacaggagugaaacuucaucucaaaaaaguaaaauaaaauaaauaaagcaaauauugauacuaaagauuauacaugaauugagcugcuugauugaugcuucuaaaaguuacacuguuuugggagugagaaauuaugaaauauaaaacuuaaacaauugauggaucguuaauauuuauuguuuucaaauuaagaauauugaaaccuugaauucuaauguuggauaauuugguuaaaaaauggaaaguugauguguuagcaaccgcucuguugacaugacucauggaaccugugaagaagcuggucucauaguauuaaguggugguauaggagcagcuuggggauagcaccuggcauauuggaauggaugaggucuggcacccugagcaguccagcgaggacuuggucucaguagagcaguuuggcuaggaggagaguaugcagcacgguuuuuauuuauuuuugagacagagucucgcucugucgcccaggcuggagugggugcgaucucggcucacuguaagcuccgccucccggguucacgccauucuccugccucagccucccgaguagcugggaccacgggcgcccgccaucaugcccggcuaauuuuuuguauuuuuuuaguagagacggguuucaccguguuagccaggauggucucgaucuccugaccucgugaucugccccucuuggccucccaaagugcugggauuacaggcgugagccaccgcgcccggucuugcagcacgguucugagucuguggaauagcugccaugaaguaaccugaaggaggugcuggcugguagggguugauuacaugguugggcacagcucguacacuugccauucucugcauaugcugguuagugaagugagccuggcacucuucuuugcgcugagcuaaagcuacauacgaugguuuuguggccacaguucuaccguucauuucuguaacugcuuuaguggcuucuuccgggaaggagaaacauacgaaaccaaacccuuugcugugaccacccuccaucauagccuuugcacuagugauuguaccaaauggagaaaacucuuucuggagacguucaucaucaauacuaucaucaagauuuuucacguaaauauuaacacccugguaucugcuggcugcagcuacuccugcuguccacaccguuccacaguauaaauaugcugcgggaguucgcaauccucagcaacaucuuaaugcacagccacaaguuacaaugcaacagccugcuguucauguacaaggucaggaaccuuugacugcuuccauguuggcaucugccccucaagagcaaaagcaaauguucauaugcucgagaguccagagucacucuguucuaagguucaugaagcuagcuauauuacaagcccaccaagcuaaagaggcuacccagaaagcaguuaacagugccauugguguuccugcuguuuaaaauugaucagagaccacgaaaagaaacuugugcuucaccaaagaaaaauaucuaaacaucgaaaaacuuaaauauggaaaaaaaaauugcaaaauauaaaauaaauuuaaaaaggaaaggaaacuuugaacauuauguaccgagcaaaugccaggucuagcaaacauaauauuaguccuagauuacuuauugauuuaaaaacaaacaacaaaaaaaaccccacaaaaaauaauaaaauauaaagacaaauuaauguuuuauagauccugggaaaaauaauuuucagcaaaguacaaaaauuuaaagcauuccuuguaaucuuuacuguggaauagcucaaaauaucaguucuguuuuaaguaacagaauugauaacugagcaaggaagcguaauuuggauuauaaaauucuuuuuuuaauaaaaaauuccuuaaacagugaaaaaaaaaaaaaggaaaguugugguuggguacaggggcucaugccuguaaucccagcauuuugagggcugaggcaggaggaucauuugagcccaggagguucagaccugggcaacauagacccugucucaauuuuauuuuuauuuuuuauuuauuuauuuauuuuuugagacggagucucgcccugucgcccaggcuggaaugcaguggugcaaucuuggcucacugcaaacuccgccucccggguucaagcgauucuccugccccagccucccaaguagcugggauuagaggugcgugccacuaugcccagcuaauuuuuguauuuuuaguagagacggaguuucacuauguuggucaggcuggucucgaacucuugaccucgugauccgcccaccucggccucccaaagugcugggauuacaggcgugagccaccgcgcccagccaaccgugucucaauauuauuuuuuuaagguguguugggaaaguuaugacuacuuauguacauuuucuguuugaaaaucgauuaucagaaguacuguuaacuauaaauggacauacaauccaguggagaaugagcaucgaguuugauuauccauuuguuaugaguucuuuuggaaguuaaaaucgacguucauaucaaccaacuucaauguccuacugccaaaauguuuucugaaaaauucuuuugauuuuguauuucuucugccuuccuuucuauuuugacuuuguacuuaauuagggauccuucuuuaaaguauuaugucucauuggaaauguagauuuuuaacaauacuuaaguauuuuugaaauuuuguuuuuuuauuagaaucuuaguuauugauaauuuuauaaauucaggaguuuauuauuauuauaacauagcaacaguguugaaaugcuguacaaacacaaagagagcuuaagcccggacgcaggggcucaugcuuguaauccuagcccuuugggaggccaaggcagguggaucucuugagcucaggaguucgagaccagccuggccaacauggugaaaccccaucucuacuaaaaauacaaaaauuagccaggugugguggcacaccucuguaaucucagcuacuccuguggcugaggcaugagaaucacuuaaacccaggaggcagagguugcagugaggcauuaugccacugcacuauagccugggugacagcagagugagacucugucucauuaaaaaagaccuuaaaggcaggcccggugcgguggcucacgccuguaaucucagcacuuugggaggccgaggcggguggaucaugaggucaggagaucgagaccauccuggcuaacacaggugaaaucccaucucuacuaaaaauacaaaaaaauuauccaggcgugguggcggggccuguagucccagcuacuuggaaggcugaggcagaauugcaugaacccaggaggcggagcuugcaguaagccaagaucccaccacugcacuccagccugggugacaaagcgcgacucugucucgaaaacaaacaaacaaaacaaaacaaaaaacaucuuaaaggcaauuacaaaggaauucagcgguguuugguccuguucucgucaguuuucaagaauggaacaaggcugggugugguggcucaugccuguguaaucccagcacuucaggaggucaaggugggaggaacacuugagcccaggaauuugagauaggccugggcaacaugacaaaaaccuaucucuacaaaaaaugcaaauauggucguagcuacucaggagggugaggugggaggaucacucaagcccaggaaggucagggcugcagugaaccgugauccuaccacugcacuccagccugggugaccgagugagaccuugucuuaaaaaaaaaaaaaaaaaaaaaaaaaggaacaagcgguuuuacaguggaaccauaaucuuagaauuagaaggaucuuaaaggaaauucuggaaccuccucuuacuucacagauaaugaaaguuaggccaaaguauucaaguaaccuuuaccaaaaucagucacagggcaguuuaguggcagagggcaggggcaauaacgccauauuuacuuugguuguuauauaguugcuuucuucuaaggaaucuaaacuaaguagaacuaaaaaguuguaacuuuuaucauguaguugaagacauuacagugaaaugugaagagaaugagagugaguuuggucuuuuguagggagaaaaaggacagcuuuuuuuuuuuuuuuaagcauuugagagaaacuauugugaagcuuugaagcuucguugacaauaauucuuagaguaugucuuugaaagagcuaagauauguuuuccuauacuagagcuuuucauuccuguuuccagggcauuacuuuaccuauuuuuguuaugucaggccacaguggucuucgguugguuuccugaacaugccauguuuauuucugucuagacagguuccuuacauuaaauagcccauguguucauuugucauucauuuguuacuucuuaagggaagccuuuaagguucuacauuacaggcugggcgcgguggcucacgccuguaaucccagcacuuugggaggccaagguggguggaucacgaggucaagaguucgagaccagucugaccaacauagugaaacccuuuuucuuggagccgagaucacaucacugcauuccagccugggcaacagggcgagacucugucucaaaaaaaaaaaaaaaagauucuacauuacauacccuucaacuccuucauauuacauuuauccauacauuuauuugguuugucucuuuagcuucucuguaaaccuuauuaauacagauaccgugucuguuuuucauuccucucagugccaagcuuaaugccuggcacauaauugggugcugaacaaauacuuguuaagugaaugaaugaauauuuuguauuaauacugaauuagagaaauauuuuuauuuuugaaaguaaaggauaauuugaaaaaauuucaaauugcagcuaaggacuuuccuuuuuuuugagaccaaguuuugcucuuguugcccaggcuggagugcaauggccugaucucggcucacugcaaccucugcuuccuggguucaagugauuauccugccucagccuccugaauagcugggauuauaggcauccaccaccacgccuggcuaacuuuguauuuuuaguagacacgggguuuuaccauguuggucaggcuggucucgaacuggugaccucagguaauccacccaccucgaccucccaaagugcugggauuagggcgugagccacucugccuggcuaggacuuuucaaacuaaggaguuugugucuuagagaugguaacauagguacaguacuuagaauuuuggagucaacagguaguucagagguuauguauuucuguucuaauuuuucaggugaagaaacugaccauuugauagguugugaacaacgcuagucaccuaaagcugaaaagugucauuaacuucugcuacuuagauaauagaaguuacaauuauauauuaauugacaaauauuaaaaccauacuaaaguuagcuauguggaaggauggccaauaguuuaguaucauuguuacauuaagaaucacaaauagcuggcacgguggcuuacgccuguaaucccagcacuuugggaugccuaggcgggcggaucaccugaggucaggaguucaagaccagccugaccaacauggagaaaccccguuucuacuaaaaauauaaaauuaguugggugugguggcacaugccuguaaucccagcuacucaggaggcuggggcaguagaaucccuugaaccugggaggcagagguugcagugagccgagaucacgccacugcacuccagccugggggacagggcaagacucugucacgagaaaaaaaaaaaguaaaagcauacacugagcaagugauuuuuuaaaaaauucauauuacaggccgggcacaguggcucaugcauguaaucccagcacuuuggaaggccgaggugggugaaucaccugaggucgggaguucgagaccagccugaccaacguggagaaacccugucucuacuaaaaauauaaaauuagccgggugugguggcgcaugccuguaaucucagcuacucaggaggcugaggcaggagaaucgcuugaacccaggaggcggagguuguggugagccgacauggugccauugcacuccagccugggcaacaacagugaaacucugucucaaaaaaaaaaaaaaaauuaauauuauaauuaaguaaucuaagcaccauugcacuccagccugggcaacaagagcgaaacuccaucucaaaaaaaaaaaaaaagaaucacaaauagccauccucccauauaguuguggguucugaaacuaauacaggguucacaucuaauaagugacauuuaaaauacacuuauaggucugguguccucuggcuuaugccuguauuuccagcacuuugggaggcugaaacgggcagaucacuugagcucaggaguuugagaccagcuugggcaauauggcaaaaccucauuuacaauaaaaauuaaaaaaauaaaauacacuuauaaauagcugugcaaauuccauaaagggcuuaauggaauuaaguuaguuauguaguauauccuauaucauggauuacuacagagcuauuuacuauacacauacuuuguuucuuucuuucuugcuacuuuggagguaagagggccuugauaauuauugguguuuuuuuuguuuguuuguuuguuuguuuuuaagauggagucucucggucuguugccagguuggagugcaguggcgcaaucucagcucagccuccugaguagcugggacuacaggcuucugccaccacacccagcuaauuuuuguauuuuuaguuagagacgggguuucaccauguuggccaggcuggucucgaacuccugaccucauaaucugccugccuuggccucccacaguucugggauuacaggagagagccacugugccuggccuuuuuauuuuuauuuuauuuauuuauuuuuugagauggagucuugcucugucgcccaggcuggagugcaguggcgcgaucuuggcucacugcaacuuccgccuccugaguucaagcaauucgccugccucagccuccugaguagcuggggucacaggcgugcaccaccaggcuuggcuaauauuuuguauuuuuaauagagacgggguuucaccauguuggucaggcuugucucgaaccccugaccucgugauccacccaccucggcuuccgaaaguguugggauuacaggcauaagccaccacgccaggcauuucuugauuuuuaaacggagggauggauagagugaaauuuguuucuuuucuuuucuuuuugagauggaaucucacucuguugcccaggcuagaguacaguggcaagcucuuggcucacugcaaccucugucucccagguucaagcaauucuccugcuucagccuccugaguaguugggauuacaggugcgugccaccacaccuagcuaacuuuuuauauuuugguggaaauggaguuucaucuuguuggccaggcuggucucgagcuccugaccucaagugauccacccaccucggccucccaaagcgcugggauuacaggcgugagccaccacacccagccugaaauuuuuuuuuucuuuauuuuuugaaagggaauuucacucuuguuucccaggcuggagugcaguggcaaaaucucagcucacugcaaccuccaccucccagguucaagcaauucugccucagccucccgaguaacugggauuacaggcacccaccacuacacccggcuaauuuuuugcauuuuuaguagagacgggguuucaccauguuggccagacuggucuugaaccccugaccucaagugauccacccagcuuggccucccaaaggacugagauuacaggcaugagccaccaugcccggccugaaauuuguuucuuauauuccucucuuaacuaucugaucucagagagcagugcuccagacauuaauacagcuacccuggucugcuauauuauucugucacagaaacaaauaaaaauaccuacuguuuuguugcuaagaauucgaaaaauuaaguaggguuuugugaaaguauccucguuuuuucccaccagguguauuuuccuuauauuuucucuaaucuuucuuccuguaucaaccauucucaucuggccuauuugaugguuuagugggaauuaggauaugguggaauugauauuaacguagggccaucccccuuuccucacaaaccuuguuagaggugaugaacagauuaagggcaggacggccauaauucuuucccuuugcuuuccuccaggaggaccccugaaguacugguuugguuguaauuauuuuuacuuccaugaaugauuuuuauuuaucccucauugcuacacagugugauaauuuugcauguaauuaaguauauaauuuuaacucugaguucuguucauauguuuuaauauuuguauugcagaagauucugcucagaacauuaaaaauuaaauggggaggcaagauuucuuaaaaucauguccuaaaauaauagccaguguacauuugugaagggaggcuuagugcaguauaguucuuauuucagacuucuguuuguguagaacuguucugguuaucuguugcuguguaacaaacuuuuuaaaagguauuuuaaaauuuucauuaugguaaaauauacauaacauaaaauuuaucacuuuaaucauuuuuaaguguacaguucuuuggcauuagguacauucacauuguugugaaaccaucaccaccauucaucuccagaauuuuucaucuuccccaacuggaacucuacccauuaaacucuuaacuccucauuuuucccuuccccagcuccuggcaacaaccauucugcuuuuugucuagaugacuuugacuuacucuccacuugaucuuagccaaaaggcucagaagcgauuaccuuacucucaaauaauugaaaucauacaauauuugucauuuugugauuggcuuauuucacuuagcauauaccuuuaagguucauccguauuauagcauguguuauuacuuccuucccuuuuaaagcugaauaauauuccauuguauguauguaccacauuuuguuucucugucagugaacacuugaauuguuuccacuuuuuagcaauugugagcaacuuuucuuauugucucacaguuuuguggaucgggaauucaggcaggguuuagcuugcgucugcuacacauggcuacugggcucacucauugguauucaacuagugacuagauuggucuagaugauccacaguggcuuuacuuaaacgcuugauaccuuagugggaacagcugaaaggcuggacccagcuggguucuuuucuguaagauguaguuuuaggguuuuccacauagucuuucuagcagaguaguugggcuaaggguuccaagacaccauggaggagguugccagaaauugguccagaaauggcauuaucaccucuaccuuacucuauugguuaaaagaaaguacuguugucauaacccagcucauacucaaggggagaaaaaagaugagccuuaccucucaauagaagcaggaaagaauuuguagccaugauuagucuaccacaggagcucuugugacaagucaaaguaugcuaaccauguguacuuuuaaauuauuauuuuauuauuauuauuauuauuuuuugagacagagucuuucugucacccaggcuggagugcaguggcacgaccucggcucacugcaaccucugucccccaaguucaagcgauuguccugccucagccucccaaguagcugggauuacaggcaugugccaccaugcccaccuaauuuuuauguguuucaccauguuggccaggcuggucucccaaagugcugggauuauaggugugagccaccacaccagggcauauuuuauuauuauuuuuugagauggagucuugcucuauagcccaggcuggagugcacuggcacaaucucggcucacugcaccuucuggguucaagugauccucuugucuuggccuuuggaguagaugggacuacaggcgcaaaaccccaccauguacuuuuuaaauuuguuguaguuuugggggucgcucuacguugaucaggcuggucuugaacuuuuggccucaagccauccucccaccucagccuccgaaagugaugggauuauaggcauaagccucugagucuggcuugcauugcuauuaugauauaauuucuucaggcccuuucaguauauagggcugagaaauacaucccccuuauuuacauaauuuaaucagccagucagccaugaguucagucuguuaccuccauuugaaccucuagcacagaguacuucuaagcuuccuccauuccauauuucugucuucuacaggcaaaaccuggauuuccucuaacauccauaagguuauuuguacuacccuacuguaaacacagucuaaauacagagcuacuuuaccaguauccuuuacagaauuucucugugguucuuuuugucccaugaaaaguauaugaaguaccauguuuguuaguuaguuaaauuugaauucuguauguuaaucaauuuuuauaaauagcuaauuucaggcugaggcaggagaaucacuugaacuugggaggcagagguugcagugagucaagauugcuccacugcacuccagccuggugacagagcgagagucggucugggggggaaaaaaaagcuaauuucuuuguguucuguuuaucaauuuauauaucuauuucuugacgcucccucucccccacccccgcuuuuugagacugagucccacucugguaccuaggcuggagugcaguggugugaucacggcucacugcugcagccuggaucuccauaggcucaggugauccuccuaccucaggcuccccaguagcugagaccacaagcaugcaccaccaugcugggcuaauuuuuauaguuuuugaagagacaggguuuugccauguuucccagucugggcucaagcauucuacccaccucaaccucccaaaguguugggauuauaggcaugagccacugugcccagucaaccguuuauuuccacuggcaaauguaauccuugcuuuauuauuauuauuauuuugagaguggcuaggauuacaggccacugugugcagcuaauuuuuuuuuuugagauggagucuggcuauuuuugcccaggcugaagugcaguggugcaaucucggcuuacugcaaccuccgccuucuagguucaggcgauucuccugccucagcccccugaguagcugguauuauaggugccugccaccaugcccggcuaaauuuuuuuguuauuuuaauacagauggaguaucaccauguuagccaggcuagucucgaacucuugaccucaggugauccaacugccucggccucccaaagugcugggauuacagcugugagccacugugccuggccuaauuuuuguauuuuuaaaagagacgggguuucgccauguugguccaggcugguuuugaacuccugacuuccagugauccaccugccuuggugucccagagugcuggaauuacaggcgugagccaccaggucggccugauuuuuuuuuuuuuaauugugguaaacauauaaaauuuacucucuuaaccauuuuuauuauuuuuuguuuuuuugagguggaguuuugcucugucgcccaggcuguagcacaguggugcagucuuggcucacugcaaccuccacuucccagguucaagugauucuccugccucagccuccaaaguagcugggacuacaggcaugugccacgaccucugguuaauucccccucuuccucgccagacggagucucgcucuguugccaggcuggagugcagugguguguucacugcaaccuccgccuccuggguucaagcgauucucgugccucagccucccaacuagaugggauuacaggcuugugucaccacaccuggcuaauuuuuguauuuuuaguagagacgggguuucaccauguuggccaggauggucucaaccuccugaccuugugaucugcucgccucggccucccaaagugcuagguuuacaggcaugauccacugcgcccaaccugccuacuuuuaauuugcagucaaauaagcuaauuaauguuuuccaaugaagccaacuuauugcuuccuggcaacaagaguaguucugugugagaauaauuaaacauaagugucauguugagguucagugggguaagaacucuagauuuccuuaaaaacucaggaagaggccgggcgcgguggcuuacgccuguaaucccagcacuuugggaggccaaggcgggcggaucacaaggucaggagaucaagaccauccuggcuaacacagugaaaccccgucucuacuaaaaauacaaaaauuagucgagcguggcggacugugucuguagucccagcugcugggcagguggaggcaggagaaugccgugaacccgggaggcggagcuugcagugagcugagauugugccacugcacuccauccugggcaacagagcgagacuacgucucaaaaaaaaaaaacaaaaacucagaauugagugauaccuuuuuaguuuggagaaaugcggguaggaagggauggggauagaauuuuaauaacagaaauaauguugaaagcuucaagccucacuuaggucuuaauugaagaucuugaauuaaauagaaauuagguuaaggcuuauuaaaaaccauauaugaaguaaguaacauugacauguaugaaggccaauacuaugauuuauauaucuuguaucagaaaucuauauaaugcucacaguaagagaacagguuuaaggacauuaaugaauuuuauuucuguuggcuuuuauuuucacaguuaauuguuaaacaguuuggcugagguuauuggcacauuaaaauauuuccacauggcugggugcggugccacaugccuguaaucccagcacuuuggaaggccaaggcaagaggaucacuugagcucuguaguuccagaccagcuugggcaaaauagugagacccagacucuauuaaaaaggaaagauggccaggcacgguggcucauacuuguaaucucagcaucuugggaggccgaggugggcugaccaccagaggucagguguucgagaccagccuggccaacauggcgaaaccccgucucuaccaaaaauacaaaaaaaauuagcgggcaugguggcgggcgccucccagcuacugaggaggcugagacagugagccgagauggcgccacuacccuucagccugggcgacauagcaagacuccaucucaaaaaaaauaaauaaauaaaaaauaaaaggaaagaaaagauuucuugaauucccuggugcagaaagauaaaauuaauggagugaguggaguuuuuacaauauaugaaauccaagauuauacuuuucagggaucaauucuacaguucguuacaauauaugaaauccugauaguuuuuauuugcugaagacaacagaucaagaaaguucuagcuaguugugguggcucaugccuguaaucacagcacuuugggagagcgagguggaggauugcuugaggccaggaguucaaggccggugagacccccaccucuacaaaaaauaaaaaauuaggcugggugugguggcucacgccuguacugccagcacuuugggaggccgaggcaaguggaucacgaagucaagagaucaagaccauccuggccaugauggugaaacccuaucucuacuaaaaauacaaaaauuagcuggacuugguggcgugugccuguagucccagguacucagaaggcugaggcaggagaauagcuugaacccgggagguggagguugcagugagcugagaucacaccacugcacuccagccugggcgacagagugagacuccguuaaaaaaaaaaaaaauuagcuuuguaugguggcaggugccuguagucccagcuacuugggaggcugaggugggaguaucaccugagcagugagcuaggauugcaccauugcacucuagccugugugacagaggaagacccugucucuuaaaaaaaaaaaauguucaagauaacuguugcaauagaaaguugaacauaagcauaaugaagaaauuuucuaaauuucuuucccuugcuguuggcauucggucuuugacauuaauucauagcuuccuagcuaguuugcuucuacacaguuacaauugugccuagacccagaaucccucagccuuuggaacuuauacacauaucauuguuuuuguguauuaugugauauuuuaaaaguugguaacuuccauaauauauguguuuuuuuguuuuuguuguuuuuguuuuuguuuuuugagacagagucucacuccgucacccaggcuggagugcagugguacaauuucggcucacugcaaccuuugccuccuggguucaagcgauucugugucuuagccucccgaguaguugggauuacaggugcgugccaccacgcccagcuacuuuuugugguuuucuuguuuguuuuuuugagacgaagucucacucuguugcccaggcuggagugcaguggcgcgaucucagcucacugcaaccuccaccucccaguuucaagcgauucuccugccucagccucccaaguuggugggacugcugguuacguaccaccaugcccaccuaauuuuuguauuuuuaguagagauggcgggguuucacuguguuggccagccuggucuugaacuccugaccucaugaucugcuugccuugcccuccaaaagugcuggguuuacaggcgugaaccaccacgccuggccuaauuuuuguauuuucacuauagacgggcuuucaccuuguuggccaggcuggucucaaacuccugaccucaggagauccaccugccucggucucccaauguauugggauuacaggugugaaccaccaugccuggccuuacguguuguuuuucuguuauaaaauuaaugccuugcugggugugguggcucacgccugugaucccagcacuuugggaggccaaggcagacagaucacuugagcucgagaguuugcuaccagcuuuggcagcaugguacuaaaaauacaaaaaauuagcugggugugguggugugcaccuguagucccagcuacucaggaggccaguuggaaggaucaccugagccuggggagguagaggcugcaguggucaugaucgugccacugugcuccagccuagacgacagugagauaccuaucuccaacaacaacaaaaaaauuuagauuaaacauuuuuagcuugcaacuaggguauaaaauaaaaaaauuuaaaaagagauaaacauuuaacacuuccuacuaaaguaguggcauugugauuuguguugguaaagccagcccuuaaauaacagcauuuaguucaguaagggaaagugacacugggaauaacaguagaauggauuuucaugugagauuaucauauuuugagaugauuguaauuuacaaugugagugccaauuaugugguuggauugcauuuguuucuuuagauaaaaagaucacuaagaauuuugauugucaagaaauucauagagaaggugacaguugggcugggauuugaagucucagacuuggguaggcaaaugaaugguaaaacauuccaggcagaugaauggcagaaaggcagaagcauguuugguguguuuaaggaaaauaaauaaguacagcagggcgcaguggcucaugccuauaauaccggcacuuuaggaggccaaggcagguggaucacuugaggccaggagcuugagaccaaccuggccaacauggugaaaccccaucucuaccaaaaauacaaaaauuagucagggguggugaugugcgccuguaaucccaacuacucaggaggcacaagaauaguuugaacucacgagacagagguugcagugagcagagauugugccacugcacuccagccuaggugauagagugagacucugucucaaagaaaaaagaaaagaaaaaaaaaaagacaagaaaugaguacuacuauuuugcuugugcugaggcaaguuaggguuagguaaggcuuagguaauucccuacccguaccuuuuuuuuuuuuuuuuugagacacaguuucgcucuugggcccaggcuggugugcaguggcaagaucucagcucacugcaaccuccaccuucugauuucaagcgauucuccuggcucagccuccugaguagcugguacuacaggcgcacaccaccaugcccgguuaaauuuuguaauuuuaguagaggcgggguuucaccauguuggccaggcugaccuugaacuccugaccucaggagauccuccugcuucgaccucccaaugugcugggauuacaggugugaaccaccaugccuggccuuauguguuguuuuuguuauaaaauuaaugccuggcugggcguggugccucaugccuaugaucucagcacuuugggaggcaaaggcagacggaucacuugagcucgggaguuugcuaccagcuuggguagcauggugaaacccugucucuacuaaaaauacaaaaaauuagcuaggugugguggugugcuccuguagucccagcuacucaggaggcugaguugggaggauuagcugagccaggguuucucuguguuggucaggcuggucuugaacuccugaccucaggugauccacccaccucagucucccaaagugcugggauuacaggcgugagccaucacccccggccuguggagucuuuuuuuagccucauguccagaucacauagcaucuuuguuuguacaggaauccauuucuuuuuuuuuuuuuuuuuuuugagauggagucucacacugucgcccaggcuggagugcagugguacagucucagcucacugcaagcucugccuagccggguucaugccauucuccugccucagccucccgaguagcugggacuacaggcgcccgccaccacgcccggcuaauuuuuuuguacuuuuaguagagaugggguuucaccguguuagccaggauggucuccaucuccugaccucgugguccgcccucuuuggccucccaaagugcuaggauuacaggccacugugccuggcccaggaauccauuucuaauugaugcugucugaguaaauuuguuuguugcugagauuauagucaucugacaauaggugugaaagccguggaugaguaaaauuuaaagaguggcuagcaacauuuuauguacuuaauuauaauaugaauuuuaaaaaaucacuuaguguaugcuuuuucuuuuucuuuuuuuucuugcgauggagucucgccuugucccccaggcuggagugcaguggugugagcccccacgcuggcccuaaguaaaccuuaauaguaaauugaugccauuauuuuauuuuguuaaguuuaauacuugaaaauuggguuaaguucuguggccauguauaauuauccuauaacuucaaaugcuuauugaauaucccucacguagccacuauagaauaaguagagguggauuccuugugugugaaaagaaaaucauugaauaaaaauuuuuccuaagauucaugaagauugagucaguguagauaaagagaauacuuuguuucuggcagaaguuauuuagaaaaugucuuuuggcugggugagguggcucacgccuguaaucccagcacuuugggaggcugaggcaaggcagaucacuugaggccaggaguuugagacuagcgcgggcaacauggcaaaaccucuucucuacaaaaaauacaaaaauuagcuggauguggugcaggcgccuauaguccugcccacucuggaggcugaggcaggaggauuguuuaagccaaggagauuaaguguacagugaaccauaauugugccgcagcacuccagccugggugacagagugagaaccugucuccaaaaaaaaaaaaguaagaaaaucugucuuucuucuugaagcauauaccuauaaagcuuugaagaaaggguaaaaaccagguaguaauaaaauaaaauugucuuuagauguuuuugaaauaauguuguauagcuuuguuugcuguguucaguucucauauuuccuugauauuuuaucagacuuuuuuuuuuuuuuuuuuugagacagucucgcucugucacccaggcuagagugcaguggcgcaaucuuggcucacugcaacuucugccuccuggguucaagcgauccucccaccucagccucccaaguagcugggacuacaggcaugagccaccauaccuggcuaauuuuuguauuuuuugguaaacauaggguuucagcauguuggccgggcuagucuccaacucuugaucucaagugauuugccugccauagccucccaaaagugcugggauuacaggugugagccaucgcacccugccaaauguuuaauacuguaauccacugcugcuaucucaauuguucuauacguuuuucuuauacuguuuuuuaaaauuguucuuuuuuuuuuuugagaggcagucucagucuguuucuuaagcuggagugcaguggcgagaucgcagcucacugcaaccucugccucccauguucaagcaauccucccacgucagccucccgagcagcugggacuacaggugugugccaccaccaugucuggcuaauuuuuguauuuuuaguagagaugggguuucgccauguuggccaggcuggucucgaacuccugaccucagguaauccaccugccuuggccccccaaagugcugugauuacaggugugaaccaccacaccggccuuaacuguucaaauuuuuaaacagacuuuuuuuuuuagggcaguuuuagguucacagccaaauugcuggaauguacagaguauucccaacaaacccccuggacucacuccucaguaacacucccgucccccaggaagacuuccccuccccagucacacaugccucccacaguaaugccuccccucagucaccuuccagagugguacauuuguuuguuuuguuguuguuuuuuuaugacagagucucgcucugucacccgggcuggagcacaguagcaugaucucagcucacugcaaccuccgcucccccggguucaagcaguucucccaccucagccucccaagcugggauuacaagcauccgccacgacaccuggguaauuuuuuguauuuuugguagagacgggguuucaccauguuggucaggcuggucucgaacuccugauuucaggugaucugcccaccucagccucccaaagugcugggauuacagguuugagccaccacgcccggcccuagagugcuauauuucuaaaccaacaucacaacauuaucacucaaaguccauauucguguauuguuuccuuguauauuuuucagcaugguaaaucccaaauguucuauucauguaaugcucuugguuuaaacucuaaguuagauuuagcauauuguccuuuaauauuccuaauuuuggcuuuucuuguuuggccagggugagcucuaagugcugauuuacuuuaaauccugaugauaaucagcaugcuuuauuuauuuauuuauauuuuuuguuugugacagggucucgcucugucacccaggcuggcuggcguucaguuucaugaucauggcucacugcugccuccaccuccuggguucaagccauccucccaucucagccucccaaguaguagagacuacaggcaugugcuaccacgccuagcuaauuuuuguauuguuuguagacacgggguuugucauguugcccaggucucaaacuccuggacucacgugauccuccugccucagccucccaaaguguucaugccuauuaacaggcaugaggcucucugccuggccucauaguuauuuuaacgucucugucugauagcuuuagcguuugguccaccucuguuucuguuuuuuuuuuuuuuuuuuuuuuuuuuuacuuaucucuugacaauggguacuuauuuaugucuugacaauguauuucaggcugggcacgguggcuaacaccuguaaucccagcacuuugagaggccaaggcggguggaucaccugaggucaggaguucaagaccagccuggccaucauggugaaaccccaccucuacuaaaauaauacaaaaauuagccgagggugguggcacaugcccguaaucccagcuacucaggaggccgaggcaggagacucgcuugaaccugggagguggagguugcagugagcugagaucguggcauguuuuguuuuuuuaagagacagggucucgcucugucaccaaggcugaggugcaguggcaccgucauggcucauugcagccucaaacuccugggcucaagcaauccucccaccucagccuccuaaguaacugggacuacaggcacaugccacccugcccagcuaauuucuuuuucuguuuguuuguuuuuuuuucuccguagagauagagccucacuauguuguccaggaugcugucaaacuccuaggcucuagcaguccucccaccucggccucccaaagugcugagauuacaggcgugggccaccaugcccugccucaucccauuguuucuuuuuccuucacuuaguaccucaguuggggccuauuggguuuuguuuuguuuuuaacuugguagauuguaugaaaacuucauuccaaggcauucugacuucauuaggacacugaaguuucccaugaacuuuuaauauugcauauugugcuuuggcuauugagaguguggugucaguucacaauaggacaaaugcagaaauugagaguaaacagaaacauuuauaggucauuugcuauugauuacgaacgucuaagugcauuucaguguuuuauauuuuacaaauguguuggaauuuuacuuuacuuauucuuuugagacagguucucgcucuguggccuaggcuggagugcagugguacgaucauggcucacugcaggcuugacuucccagcucaagcgauccuccugccccagccuccugaguaguugacacuacaggcaugugucacuacacccagcuacaauuuaaauuuuuaguagagacaaggucucacuauguuuuccaggcuggucuuaaacuuuugggcucaagcgauccucccaucuuagccucccaaagugcugggauuacaguugugagccaccacucccaguguguuggaaugaaaaaaaaaaaaaaaacugauucuucaccauugaugguuugaaaaacacugcccuggaucaccugaugagcuccagaaauaguucccccugcccuuauuucauaccaacaaccuagguuucucacaauaguugagaucaguuaccccagccacggugaaacuguucuuuaacuguuguuucaguuggcaugagcucaaaauggucaagugacaaacucagcuucacuguaguggagcgguuguuguguccuaagguagaaguauuccaagaccucuaaaccaagaaaccaagaccucuaaaccagcugaccaagcguuuuaaggauggaggaaaaaauguuuuuugaguagguuauuagguaugauaaugagagggggcacucugauucaaucuuuuaauuuccagaucuggacugacgugguggcucaugccuguaaucccagcacuuugggaggccaaggcuggcagauaaccuaaagucaggaguuccagaccagccuagccaacauggcaaaacccugacucuacuaaaaauacaaaaauuagccaagcaugguggugggcacuuguaauccaagcuacuucggaggcugaggcaggagagucauuugaacccgggaggcagagguugcagugagcugagaucaugccauugcauuccagcaugggugacaagagcaaaacucagucucaaaaaaaaaaaaaaaaaaaauuccagaucuguguacugugggacaagugacaauuuauuggucacugauuuagguaauguaucacauguuauaaaauaaguaagcaccucaucuucucagcgcguuaucuuucagcugguauuaucacaguaagcuauuccacuuuacuauuaagcuggcuguccugagugauaggauagaaagaccaaggaauuugaugacuaugagcccaucauuagaaaaaaaaaagauuaacaaauuaugaucuggugauuuuuaacacuuacaaaauuuuaauuuuauacuugcugaaagagcuccuauaauuaacucauuuagacaaauuuuuuccacaucaccuucuuacauauguaaaggaaaauaaaauugaaauaauugguuuuuguuuuguuuugagacggagucucacucuguggcccauacuggagugcaguggcaugauaucagcucacugcaaccuccgcuucccggguucaagcaguucuccugccucggccuccugaguagcugggacuacaggcacaugccaccauacccggcuguuuuuuuguauuuuuaguagagacaggguuucacaauguuggccaugcuggucucgaacuccugaacucagguaauccgcccaccucugccucccaaaguucugggauuacaggcaugagccaccgugccuggacaauugguuguuauuccuacauucacauucauaguuugacccuugugaucuuuuuuguuaaaacuaguaauugaugcuuguguuuuuccacacaguguugucaucaccaguaguguuagugauacagauuuuuuuuuuuuuuuuuuuuuugagacagacucugcucugucacccaggcuggagugcaguggcgcgaucuuggcucacuguaaccucugccuuccggguucaggcgauucuccugccucagccuccugaguagcugggacuacaggcgccugccaccaugcccggcuaauuuuuuguauuuuuaguagagaagggguuucaccguguuagccaggauggucuagaucuccugaccucgugauccacccgccuuggccucccaaagugcugggaucacaggcgugagccaccuugcccagcgugauguagaauucuuuugagugcuccaacuguuguugcugagauguucuucugagccauuaacacuuaaugcugcaagauuugaugcuugugcuuucuagauguuaucaguuguuaucagcacaagauuuucaaagugaaauuuguguaagugcaaguaacaguaguuuccuuacaauugcuucuggcugucucucauuggaaaacugcugauuuugagacacaucacaauuucagagaucugagccuuagaauucauaaaacaugguuauuuaauuuaucacagcccccauguaugccagacaguagaucuggcaauuaucaucucuaaauaucaaaucuuacaagauuauauugcuguccucauuauguagucacagaaagacuaaguaauucagauuaccuauccauuaagaggcagaacagaggccagauggagugguuuauuucuguaauccuagcacuuugggagauugaggcaugagggucacaugaucccaggaauuugagaccagccugggcaacauagugaagcccuggcuguacaaaaaaaagcugaguauggugaugcauuccuguagucccagcuacuugggaggaugaugugaggauugcuugagcccaggaggucaaggcugcagugagcuaugauugugccacuguauuccagccugguccacagaggggagacccuaucuauuuuaaaaauuaaaaccaaaaaaaaauucagggugggcauaguggcucccaccuguaguaauaccagcacuuugagaggccgaggcugguggauuaccugagguuagggguuggagaccagccuggccaacauggcgaaacccugucucuacuaaaaauacaaaaguuagccuggugugguagcguagaccuguagucccagcuacuugggaggcugaggcaggagaaucuuuugaacccaugaccugguagagguugcagugagcugagauggugccacugcacuccagucugggcgacagagcaagacuccaucucaaaaacaaacaaaauucuauuuuauuuauuuuaguagagaugggguuucaccauguugcccaggcuggucuugaauuccugaccucauccaccugccucggccuccaaaguguugagauuacaggcgggagccacugugccuggccaucuuaauaauuucuaacuuguuuuuuugagacagagucuugcucugucacccaggcugaaguauacaguggcaugaucucggcucacugcaaucuccaccucccggguucaagugauucuccugccucagccuucuaaguagcugggauuauaggugagacccaccgugcccggccuaaauuuucuuuuuuaaaaacagcuuuguugagauauaauucucauaccauagaguuuacccauuuaaaacguacaauuggcugggugcgguggcucacaccuguaaucccgccacuuugggaggccgaggugggcggaucacuugggaguuugagaccagccugaccaacauggagaaaccccaucucuacuaaaaacauagaaaauaagccaagcgugguggcgcaugccuguaaucccagcuacucuggaggcugaggcaggagaaucacuuaaacucgggagguggagguuguggugagccgagaucaugccauuacacuccauccugggcaacaagagcaaacucugucucaaaaauaaaauaaaauguaugguuguuuuuaguaucaucacaaaugcuugcagugauugccacagucagguuuuuugugguguuuuucuuuuuuuuuuuuuucugagacagagucuuauucugucgcccuggcuggagugcaguggugcaaugcacugcagcccuggccccugcaaguucagugauugugccaccccagccuccugcguagccgggugugcgccaccaugccaagcuaauuguugaaacuuuuuuuuuuagagaugggguuucaccuguugcccaguccggucuugaacuccugggcucaaaugauccauccaccugccucagaaccccaaagggcugggauugugugagccacuuugaccagcucguagucaguuuuagaacaguuaucaucucaaaaugaagucccuguguccauuagcuauuacccucauauuccuccccacaguccuaaggaaucacuaaccuacuuuuugucuauguacauuuccccgaucuggacauuucauauaaauggaaucauaagcaaguggucuguuguggcuggcauauuucaguuagcauaacauuucgcccagucauaccaucaguucuuuuuuuuuuuuuuuuuuuugagauagguucuugcucuuucauccacgcuaaaauguaguggcuccaucuggguucacugaagccucgaccucccgcauucaagcaauccuccugccucagcuuccugaguagcugggacuauggacaugugccaccacaccuggcuaucuuuuuuuuuuuugguguuuuuuguagagacaggguuucacuauguugcccagucucaaaauccugugcucaggugaucucuggccuuggucucccaaaguacugugauuacaggugugagccaccaugccuggcuuucauuauaccuuuuauggccagauaauacuguaguguauagguguaccaaauuuuguuuauccguuuguuaguugauaauaaaugggguugggcugggcucaguggcucacaccucuaauuccagaacuuugggaggccaaggugggcagauaaucugaggucaagaauucaagaccagccuggccaacauggugaaaugccaucucaacuaaaaauagaaaaauuauccgggcaugguggcacaugccuuuaaucccagcuacucaggaggcugaggcaggaaaauugcuugaagccaggaggcagagguugcagugagcugagauggcaccacugcacuccagccugggcagcagagugagacucggucuuuaaaaaaaaaaaaaaaaaaaauccaggcgugguagcucacacguguaaucccagcacuuugggaggccgaggcagguggaucaugaggucagcaguucaagaccagccuggccaagaugguaaaaccccaucucuacuaaaaauacaaaaauuagcagggccuggugguaggcgccuauaaacccagcuacucgggaggcugaggcagagaauugcuugaacccgggaggcggagguugcaguaaugcagugagccgaggucgcaccauugcacuccagccugggugacagagcaagacuccaucucaaaaaaaaaaaaaaaaaaaaaaagguuugauucaccuuuuggcuauugugaauaaugcugcuauaaacauucuugugcaaauuucucuuuucuuuuucuuucuuucuuuuuuuuuuuuuuuuuuugagacgggauaucuugcuguguugccuaccuccugagcuuaaggaauccugcugccucagucuuucaaguagcugagacuacugguacgugcuaccauacccagcuaauuuuuaaaucuuuaguagaaauggggucuugcaguuguugcccaggcuagucuugcauuccuugucucaaggcauccucccuccuugucuuuccaaauugcuaagaucaugggagugagccaccauuccuggcuuaugugcaaauuuuuguguggacauugccauuauuuggauaagguuuguccucaccaaaacuuauguugaaguuugguucucauugcagcaguguugggaauuggggccuacugggagguguuccaucauggggccagucccucaugaauagauaaugccaucuugugagagugaguucucacucuucugggacuggauuaguuacccaaaaaguggguucuuauaaacaagcuugguccaacucacagcccgugggucacaugugacccaggauggcuuugaauguggcccaacacacauucauaaacuuucuuaaaacauuaugagacuauugugcaauuuuuuuuguuuguuuuaagguuauuagcuaucauuaguguuaguguacuuuaugugugguccaagacaauucuucuuccaguguggcccagggaagccaaaggauuggacacuacuguuagaaagcagguuuacucccucauguuuauuucauguuuccucucucuuuuuuuuccccccuuucagacagucucucucucacccagacuggagugcaguggcaugaucuuggcucacugcagccuccgccucccgguucaaguuaucugccucagucuccugaguagcugggaguacaggcacaugccaccaucccaggcuaauuuuuuguauuuuuaguagagaugggguuucacaauguuagcuaggcuggucuugagcucuugaccucaagugguccgccagcaucacccucccaaauugcugggauuacaggcgugaaccaccaugccuggucauguuuguuuaauuucuuugucagauuauucauuccaaguguauagaaauaggauuuuuaaaaaacauauuuuaauuaauuuuuuuuucucaauagagauagggucuuccuguguugcccaggcugaucucgaacucaugggccugaaguaauuccccucaccucauccccucacagugcugguuuuacagaugugagccaccacuuccagccuauaguaguccuuuaugaucaguuuuauuuauuucucuuuuucccaagacacaagucuugcugcaacgcccaggcuggagugcaguggugcaaucuuggcucacugcaauccacaccuccuggguugaagcgauucuccugccucagccucccaaguagcuaggauuacaggugcccgccacgccugacugauuuuuuguauuuuuaguagagacaggguuucaccauauugcccaggcuggucucgaacuccugaccucaagugauccgcuugucuuggccucccaaaguucugggauuacaggcaugagccaccacgccuggccaauggguuuuauuucuguaagguaauuaguaacaugucuauuuucauucugaauguaguaauuuggucuuuuuuucuuggucagucuagcugaaaagucgucaguuuuguugauguuuucaaagaaccagcuuuuuguuucccuuucucuagcugccaucauguucuucugggugguaauauuuuuggcaacugauauaggaaggcgaugcccacuucugcuucucugccacugucugcuuuuucccaccacccguuucucaucgugccuguaggggaauuucccuauacuuacuguugauuuuccucuaaacucucacugcuccugccauaauuaauuccaucugccuuuuucccacauauguacgcuugucugcuugaaucucuuuuccuuuccuuuuuuuuucuuucuuuuuuuuuuuuuauugagaugaagucucacuccaucacccagguuugagugcagugaugugaucucagcucacuguaaccucugccuccuggguucaagcgauucuccugccucaaccucccaaguauaugggauuacagacaccugccaccaugcccagcuaauuuuuguguuuuuaguagagacgagguuucgccuuguuggccaggcuggucucgaacuccugaccucaagugaucccccccucccuccacggccucccaaagugcuaggauuacaggcgugagccacugcgccuguccugcuuuuuuuucuuucaacucuuaauccguuuaaccuuagaaaaacugcuguguuuuauuuuauuuuugagcaaaaacaccuuacauaauguuugaucauuuuaagcauaaggcaaacgauuuaccuuuaugaaggaaaaggaaagccagaguacuugacauucaguuaauggauuaagagaucuauuaaguugcuagaugcucccaucuaaauuuucuacuguagucuucaucuaacuaaauugugacaaaguaggcuuuuugaguuugccugggaacauaaucacuuaguaguuauaacuaauacaguacaguuuuuauaguauaauguguguauuucaguagucauuuggggaagcauuccuccuacuauacuauauguaacauauagguaagaguacuaagcagugagugacuagcuacauugccugcauuuaauuuuuuuuuuuuuuuuuuuuuuugaggcagucucgcucugucgcccaggcuggagugcaauggcgugaucucugcucacugcaagcuccacuucccggguucaugccauucuccugccucagccucccuaguagcuggaacuauaggcgccugccaccacgccuggcuaauuuuuuguauuuuuaguagagacggggguuucaccauguuagccaggauggucucgaucuccugaccucaugauccgcccaccuuggccuuccaaagugcugggauuacaggugugagccacugcacccggccgccugcauuuagauuuuuaugcccuuggacaacuuauuuggccuguuuccucaucuguuaaacggggguauuaauaauaaugcuucucauagauaucauuguauuacauaaguuaauaguguauucaaauuauuugaaauguaccugacgcauagcaggaacacaauacauguuagcagcuauuaguacuauugcaagugguuccuauaaacaaauaggcuuuaagaauuaagaauuuguaaagaaaauaaaauggaaacaguuugagcuguaaagaaaaaaagaauagaggauuuauuaugugagggucaaaauauagaaugauuuguuuguaucauaucgucuucacucguuuuauucuuccaucuuacaaauacccaaagauuagagagcaucugagguuauguuaaaaccaagucucaaagccuuugaacccgccaugcauguaucaaacucucagcuuuuuguuuuuuuuuuuuuuuuugagauggaguuucgccguuguugcccgggcuggaguguaguggugugaucuuggcucacugcaaccuccgccucccagguucaagcgauucuccuaccucagccucccgaguagcugguauuacaggcaugcaccaccaagccuggcuaaguuuuuguauuuuuaguagagacgggcuuucuccauguuggucaggcuggugugaaacuccugaccucagguauccgcccaccucggccucccggagugcugggauuacaggugugagccacugugccccgccacacucucagccuuuaaggccacucauaauguuuuaggaccuuaugaauuccccuugaggcuaaaaauaacuucuauuaugauuguucuguuacagucaguauccagguaauuuuuaagaaucguguuuguggguuaucuugaaggcggaaauaaauggaguaaaccauuucuuaccuacauuagaaaccuuccauaaugauuaauaguguauuuuuuuuuuuuuuuuuuuuugagacggagucucacucuguuucccaggcuggacugcaguggugugaucucggcucacugcaagcuccgccuuccuggguucacgccauucucuugccucagccuccugaguagcugggacuacaggugcccgccaccacgccccgcuaauuuuuuuguuuuuuuaguagagaugggguuucacuguguuagccaggaugguuucaaucuccugaccucgugauccaccugccucggccuccugaagugcugagauuacaggcaugagccaccacacccggccgacuaauaguguauuuuguaguaugugcuuguuaaaugguuuaggucugguagaauggaucuuuuuguuguuguuguuguuuguuuguuuuugauacgguucgcuuuguugcccaggcuggagugcagugauacgaucucggcucacugcaaccgccgccucccagguucaagcaauucuuaugccucagccccccgaguugcugggauuacaagugcgcaccaccacaucuggcuaauuuuuguauuuuuuguauuuuuuuuuuuuuuuuuuuuguagaaacgggguuucaccauguuggccaggcuggucucgaacuccugaccucaagugauccgccugcccuggccucccaaagugcugggauuacaggugugagucacugcaccuggccagaauggaucuuuaaaauagaauuggguuuggaguucaggaagaagcuaguaaaauguguggcaucuaauuuuucugcaccacacaauuuagguaugaaauaauaaccuugucuuauuaaguaaugcuaaccuugacuaaauauauuaguaauaaauuauauaucaaguagucuaugcugguguauuagaaaaacaggucauugaauuuuucccaaagaauaauuuguugaaauugaaugaaauugaaagaaauauuuugaugcuuuguugucuuuguugcuuuauuaauaguacuuaguauugugagauauauguauauaugugugcgugcguguguguguguguguguguguguguguguguguguguguguguguauuugcauaguuuuugccaaaugcaaauuuuggaggcauuucuguucucagacuuggucaauuacugaaaucuagaauauguaaaaaauauacuaaugcauuucauuccuucagaaaauaccuuguacauaugucuuaguguguagggcagaugugcaauauguaaaacacagcccccauccuucaggagauccuuuaggaguucacugcagccuugaacuccaggcaucaaacgauccucccacuuaagccucccaaagugcugggauuagugucuucuugagaagacacgauuuuuaugcuaaugaccacagcauuagaugcuguaaaauaauugcuucauaauugguacaguguuuccaguacgaaggagucaaugaucccuucagaagaggaaguugacgguguaguaacucauaccuguaguccuagcacauugggaggccucggcagguguaucgcuugagcccaggaguccaggacuagucuggauaacauggcaaaaccggucuuuacaaaagauacgaaaauuaggugagugugguggugcaugacuuuaguccaagcuucucgggaggcugagagcuuaaggcuguagugaccugugauuaugccacugcacucuagccuacgugacugagugagacccugucucaagaaaaaauggaauuugggcaaaaacauuaaggauggguaagaauuuaguaagagcguauguuuggguaggguagguauguauugaggagcagaagcaauucuaggacauauucacauauuuaaaaaagugucgaacucugugagcuuucuuuuuucuguguaaagcuguaaagaggcucaagauauuuuuggaagauaaugaauuaacccaguuugacuagagcggaggguugacauuacauaauguuuuauaauuauauauaaacauauacauauguauaaguauagacguggaaaaggcaaacaaaauuauaaaauugauuaugauguuuaaaaugucauaaggaaugcggccauaggaaaucacucuuugaguugggauaacauuaauuuaggagcacuguguuugguuuuaaaaucuaaagagacucaaguuggguaugaugcaauaagggccuaaacuaagcauuuuggcaauggaaucuaaauguuaccaacuuuauucaguaugaaacuagcucacuuuuuuuguuguugcugagauggggucuugcucugugguucaggauggagcagcaguugugcagucauaguucacugcagccuugaacuugaacucuuggccucaagggcuccucccucuucagccucccaaagugcugggauuacagaaugagccaccacuccugccugugagguuuucuuaaaaggaauuuaccaucuaggugcaaugaaaaggcauaauaaugaugugauaaacuuggucaguaagccacuucaacuugagcuuuaggcccaaaaguugcucuaaugugcuaaacuccaaaguuaguuuguguguauuagguggacuuucaauucuaauggcuuuaugcauuaacugugcuccugcaccaccugcuguaguuuucaccuugaaugcauauuaaauaaauaaaagggcuauguuacaaauaauaguacgaaauaggaaaggaagcugcaaagaagcacguauuggcaaauagguuguucauucucaaucuuagccagcaguccauguauaugcucagugaguaaacugccauuuuaauauaaaaguuagauggccuguuuaauucagaacucacuuugucuuuacaccugacagguugauuuuuguugcucaaagauugguauacauguaaaguuuucugggauaauaguuucauuaauucaagaaauacugaguacuuacucuguaugaggcacauuuuuuguagacucuaggacuacacaaauuuuuaaaucuauugccuucacagaacuuaaaagucuagugcaggaaagacagaauaagcaaguaaaauguaagaaaaauuggagaaaaguaaaacuacgaagagaaagugcuuuuacagcauaugaguuaaaaugguguccuugcaaguauuagauuggcaauccugaaaccuggguuuuaguuuucaguucuagaccuaccauuaacucauuauguuucuucaguuaauaucucuaggcugagcauaguggcucaugccuguaauuccaggacuuugggaggccaagacggguggauugcuugagccuagaaguuugagucagccugggcaacaugaugaaauccugucucugcaaaaauaaaaacaaacaacaagaccccaaaauuuagccaggcauaguggcacaugccuguagacucagcuucucaggaggcugaagugggaggaucauuugagcccuggagguggaggcugcagugagcgccucugcgcuccagccugggugacaaagcaagacccugucuccaaaaaauuaaaauaaaaaucuguaggucuguuucuuccucucuuucucuccuguuccuccucgucucuucuuuauuuuuaugugaaggaauucacauuucugaagccccuacauuaucuaaaaggugguuagauuaacugcuuuaaagagaaccugagauucuuauguaucuaaaauucuuauauaucuuuagauucuuauauaucugaaauguaacauaaaaggugcauaaaacaaaugcaguuuaauaaguaaccacaaagugaauauacguauaaagaaauagaauaucaucagcacccccagaaguuguguguuccccucaaucauaagcuucuuccuucauucguaauuccuccauuaccauguuaaugcagucuccuugguuuucuuacauuuucacuacauauuucuuaaaaauaauagguucuuuuuuucuuuuuucuuuuauuuuuucuuccagacagggucucgcucugucauccaggcuggagugcaguggcaagugauuaucucauuuagccucccaaguagcugagauuacaggcaccugccaccacgcccggcuaaauuuuguauuuuuaguagagaugggguuuugccauguuagccaggcccaucuuaaacuccugacuucaagugauucuccugccucggccucccaaagugcugggauugcaggugugagacucugcuccuggccaguuucauauuuuucuaguuuuauuuauuuuuuacuuuauuuagacagagucucuguugcccaggccagaguacacugguacaaccauagcucaauuuaaauauauccaaaguauuauacaguaguucagcuauaccuuaauaaagcuguuuuuuuguuuguuuguuuuuguuuuuuuggaaacgaagucuugcucuuuuguccaggcuggagugcaguggugcaauuucagcucacugcagccuccgccuccuggguucaagugauucuccugcuucagugacccaaguaccugggauuucuacaggcgugugccaccaugccugacuaauuguuguauuuuuaguagagaagggguuucagcauguuggccaggcuggucuccagcuccugaccucaagugaucuacccaccuuggccucccauagugcuggaauuaaggcgugagccacuuugcccagccgcaguaaagcuauuuaaaaaaaauuuuuuuuuucauuuuagguuuugagaaagggucucacucugucgcccaggcuggacugcaguggugugaucagaggucauuacagccucacccuccuagguucaagcgauccucccaucucauucucuugaguagcugggacuacaggcgcaugucuccaugcacagcuaauuuuuauuuauuauuauugguagagaugaggucuuguuauguugcccagguuggucuccaacacuugggcucaagcgauuuuccugccucgcccucccaaagugugauuacgggcaugagccacuguacaauguacaacuauagcucagccauagccuugaucuaggcucaagccauccucuugccucagccucccaaguagcugggacuacagguauuggccaacaugacuggcuuuuuucuaguuuuacuuuuucaauuuuauauggcuagaaucauacuauaugguuccuuguguuacugugucuucaguguuauguuugaguuuuguauuauugcuuuuuuuuuuuagauggagucucgcuguguugccaggcuggagugcgguggugugaucuuggcucacugcaaccucggacucccugguucaagcgauucuucugccucagccuccugaguagcuggaauuacaggcaugcgccaccacgcccagcuaauuuuuguauuuuuaguagagaugggguuucaccauguuggccaggauggucuugaucuccugaccuugugauccaucggccucagccucccaaagugcugggauuacaggcaugagcuacugcgccuggccuaacuuauauaguauuucauuauacaguuuaaucagucuucuauugacauuuuucacuuguaguuuuuuggcuuuuacaaaccacauugcuguuguuaaaauaaaaacuucagacauauauauauauguauuuuuugagacagagucuugcucugucaccccggcuggagugcaguggcacgaucuuggcucacuacaaccuccgccucccgguucaagugauucuccugccucagccucccgaguagcugggauuacaggcaccugccaccacgccuggcugauuuuuguauuuuuaguagagauggguuuucaccauguuggccaggcuggucuucaacuccugaccucgggugauccacccaccucggccucccaaagugcuaggauuacaggugugagccaccgugcccggcccagacacauuaaauuuaacagaauuuaauugagcaaagaaugauucacaaacugggcagcccccuccaaacuugaguagguucagaacaguuccagagcugccaaguggucagauaacauuuauggacagaaaaaggaaagugauauacagaaaacgaaagugagguauagaaauaggugaauugguuacagcucaguguuugccuuauuugaucacgguuugaacagucagccaccugugauuggccacaauucugugugauugguaggagaguagguuacagucuuuuuacaaucugguuagguacagcucacuauguauggagaauccuuuaggcugaauuuaugcaaggaagcagcuuuaggcuaaacuuaacacuccagucauccuuguauacauacucuagcugcuuuagggcaccaccagaggugaaauuguugaaucauugggcauguaugucuucuacuuaacugaaagcagcaaagugguucuaccaauuuacauuucaauuaaaaagugagugagaguucucauuugcuauguuggacuuacaaaaaguucauuuggcuggacacaguggcuuacaccacuuugggaagucaaggcaggagaaucaccugaggccaagaguuggagaccagccuaggcaacauaacaagaccccaucucuaccaauaauaauaaauaaaaauuaguugcacaugguggcauucgucuguggucccagcuacucaggagaccgaggcaggaggaucacuugagccagggagguugaggcuguuguaaucccugaucacaccacugcaguccagccugggcgacaaagugagaaccuuucucaaaaaauaaaauuaaaaaaaauuuuuaauagcuguauugagguguaauugaauuacugaacaauaauuuggacauauuuaaauuauaugacauauaauaaucgaucugaucuuuguucugauucuuggcacagagccucaaaaacccuuggaauuucccaagugagagugucuuuguuacgcuaaugaggcagcuccuggcagugccacuagauagcuucaggauggggcuggucacuuaaauuagaggauugaaacuuucucccaggagaagagggaggcuggagauugaguucagucuugauuuuaucauucaugccugcgucauaaagcccagugaauccugugaacacuaaagcucaggggagguuagugguuggugaacacagugauaugcugggaggauuacauguccagauucaaugagaagaguauacgaagcucuguguccccaucccauccacacaccccucuucacccccaagacuuuggcugaugugucucuucaguuugacuguucuugaguuacauacuuuucuuccaccuuguuauuuucuguuucuuucuuuuuccuucuagcucacagcaccugguauuccccagugaucuaccauccaagaucgagcaggcucaaucuuguuuaggcuuccaaguauuuccuuuauaauaaaacugugacaguaaacauagugcuuucaggccaggugcagugguucacaccuguaaugugugaaccagcacuuugggaggccaaggugggaagaucaccugagggcaggaguuugagaccagccuggccaacaugauguaaccccgucucuacuaaaaauaaaaaaaauuagccagauguggugguaugcacccagcuauuagggcaggcugaggcaugagaaucacuugaacccaggaggcggagguuauaaugagccacgguugugccacugcacuccagccugggugacagcgaaacugucucaaauagauaaauaauaaauaauaaauauagugcuuucauugaguucugugaguuauucuagcaaauuuuuaaaccugaggaggcuauaggaaaccugaaauuuauagcuggucugucagaaauggaaguugucccugagaauuggggcuggcaucggaaguggaggcagucuugggaagaacuuugccugugggguucugcgcuaagguggguagugucagaacugaauugaaauguaggacaccuauuuggugucagagaauugcugucggggaauaacaaccugacaaguuuugacauacauacacagcauugaaaccaucacuucaauuaaagugaacuuaucacccucauaaguuuccuccuuuugcuuuuuaguccucucugcuccccauuugcgccuugcuucugucagguuccuuuuaucgcgaauuagaagucuuuuguauggguauaccacaauggauuuauccauuuaccuuuugaaggacaguugguuauuuucaguuuugugauaugcugaauaaagcuguuaggaacacguacuuguauuugugugaaauguuuucaguaaauucuuaagaauggaauuuuuggcuuaaauguuaaaugcaucuuuaaauuuuaugaagaacugccauacaguuaucugaagugguuguaccauuuuauauaucuaccuccaguguauguuucucuuguuaagucuguucagaucuuuuccucauuuuuauguugaguuggaugauucacauacuaccugauuucaaaacuuuuuaauaaagcuacaguaaucaaagcuaugugguauugguaaaagggcacagaaaauaggaacacaacagaguccagaaauaggccuacaugguauagcaguuuuuuucaacaaagaugccaaaacaauccuguagaaaaagagaaagaauagucuuuucuagaaaugaggcuugaacaccucgacccaaaagcuuucaguacauacagaaauuaacucagaaugaauauagacauacauauaaaaaccuaaaacuauaaaacuuuuccaagaacacaucggaaggccagacgcgguggcucacgccuauaaucccagcgcuuugggaggccaaggcggguagaucacuugaggccaggaguuugagaccagccuggccaacauggcaaaaccccaucucuacuggaaguagcugggugugguggugcacaccuguaaucccagcuacuugggaggcugaggcaggagguugcauugagccgagauugugccacugcacuccagccuaggcaacagagugagacuccgucccaaucagucaaucaaucaaucaaucaauaccacagcggagaaaaucuuuacaacuuuugguuagguaaugauuucuuagguaggacacacaaagcacaaaccauaaaagaaaauaauugauaaaguuagauuacguuaaauccuucaucaauuaaauuuuucuaugcuguuaaagacaagccucagacugggagaaaauauuugcaauauacguaucugauaaaggauugguacccagaauauaugacagcugaaaacacauaaggaaaaaagaaaagagauuuggagaggcacgucaccaagaaaacguagaguagguggcaaauacgugaaaagaugcuuaauuuugaguuaauuugucucaaaaaaauauuuauagagugcuggaaugugguaaauauucaguaaauguuaaucauuauuaauaguauugguguuaguguuucuuuuuuaucaauauuauaaaaaccuagcugugggcaaaaaaacuuaguuugauuuuuuccugcucauuucuuaaaaaaaaaaaaaaaaagaaaaaaaaagaaauacuaagaccgcaauagauaaauagccagaggguauuaaaacacaauccacaggaaaaaauucacacagacuuaccaagaaauuguuuaauucucauaaguguaugauaaauuagaugagguaagaagagauuagucuacaaagagccaauagcauuuaaaaaggccugaauggcacaggggauucugacauguugaaggaucugagagaaaaucagagucauguuucaaacaccagucaagcuuuaguuauguuauuuuaagcagacagggaacuugcuauuuaaaaagugauuuggaauugcuggaagagcacccuuaauucaggcuuacaggacuagacuccgagaacacuucguauagcuggcccacaaggagagcugaauccugugcucuaaucagaaaggugggaaaaucaggaagccacccuggagcucuuaaguagggacacacguuuagccguaauccagugauuaggaagucaccauugguauaauuugguacagagccucacacaguuuaauagauuaguaccagcacaaaauggaugcuucuucccucuaucuucacaauacuaacagccaguuaguagaaagcugcuguguaugugccugcccgcacacacauacacacaacagcucacuccauacuugccagcugacaacagcagaaacuacaccaccaccucuucugaacuuucaccuuccaaaucuugaauaagugccucugaugggcuauacgagaauuaugacuucaacuccauugcaagggaaucuaggaaauguagcuuuuaucuuuccugccucaguacagcacauuaaaaaugugcacaguaacgacauauuuaaaaaagggaagaaugaauggaauuucauuucuguuccugugugguaaagcaaaaucuaguggcuuaaaaugaauaauuguuucuuucaauucugugaauagacuuugugguccuucuuuuccauguggugccuucuggggucacugguuuuuuuuuuaaacaguuuauuuuaauuuaauaacaaucugggaagucugcaucagcgguucuagugcaauaucaagugcaauugggaauucagaaauuucaguggaacuguuaguuuagugaaucucguagguaaaaauauaugcaugcuuuaacuuuuauuuuauuuuucuagagguagcauuuuguucugucaccaggcuggagugcauuggcaugaucauagcucacugcagccuagaacuucugggcucaagcagucaucuugucucagccucccaaguagcugagauuguaagugcaagccaccauucuugacaauacauacauacuuuugauagcacacaugaacagaccucucuaaaauugcucucaaugaguucauucucagcaaacugaucugggucauucaacaugguuuugguuuugguuuugguuuugagacggaguuuugcuuuugucacccaggcuggagugcaauggcacgaucuuggcuuacugcaaucucugccuccuggauucaagcguuacuccugccccauccucccgaguagcugggacuacaggcaccugccaccaugcccggcuaauuuuuguauuuuugauugaggcaggguuucaccauguuggucaggauggucucgaacuccugaccucaugugauccacgcuccucagccucccaaagugcugggauuauaagcaugagccacugugcuuggcuucagcauggccuuuugauuguuccucauguuagugcauguucucucuuuuuuuuugaaauggagucuugcuccuguagcccaggcuggagugcaguggcgugaucucagcucacugcaaccuccgccuccuagguucaagcgauucuccugccccgccuccugaguagcugggauuauaggcgcgcaccaccaggcccagcuaauuuuuguauuuuuaguagagacaggguuucaccauguuggucaggcuggucucgaacuccugaccucgugaucugccugccucagccucccaaagugcugugacccaccgcgcuuagcgcugcauguucucuuuuuacaauaaauucaugaccaucggaagauaccaguuugacauacauggcaucaggaccuucacagccaccacagguuuucuccccuugguuguguguauuuaugaagcucuacuuugcuucuacagggucacucuuauggcuaaguuuagauggcagcucaauuaggccaccuuaguucucuuccacguagucuaugugguauacacagccucuguuuuuugaauagucugggauuccuaauagcaugguggguacauucccauaggggcauugcaaucucaacguacaaaugcuuaucaggccuguucuugcaucaggcuugcuaaugucuguuuggccaaaauaagucacauggacugggcauggaggcucaugccuguaaucccagcauuuggggaggcugaggcagguggaucaucugaggucaggaguugaagaccaacccagccaacguggugaaauccugucucuacuaaaaauacaaaacuuagccagacuugguggcgagugccuguaguucccagcuacuugggaggcugaggcagaagaaucccuugaaccugggaggcagagauugcagugagccaagaucaugccacugcaguuuagccugggcgacagagcaagacucugucuuaaaaaaaaaaaaaaaaaagucaccugaccaaauccagagucauuguggaagaagacuauauaagguauacauaugagaaggcauuguaucauagccuccaagauagcucugaaugauccuuauuuccuuguauuuacucccuuguauaguccccugcaacacugaacggggcuguccugaguaacggaacaggcugugguagaagugacaauguaugcuuuucaagguuaggucguaaaagacugccacuucauauuugcucucuuggaucuugcaccaggggaaaaccaacugccuuuucacuugagcugucuagaaaggcccauguaguguggaacugaagccuuucaacaacagcaagugucaacuuagaaccguaagaaugaguuaccuucaaaacacacccuccacgcccagucaagccuucagauaacugcagccuugaccagguacagccucuugagagauuccaggcccacacgacuuagcuaagccacuuuccaauucuucaaccacauaugauaaauacauguuauuguuuuaaggcacugaguuuugggguauuuuguuacauagcaauaauuaaaaaaaauuuuuuuagccugggcaccauauggcaaaaucccauccuacaaaaaaaaaaaaguacaaaaccuagccaggugugguggcgugugcuguaguaucagcugcucagggggcugagguggaaggaacucuugagccugggagguggagguugcagugagcugagauugcgccacuguacuccagccuaggugacagagccagacccuugucuuggaacugcugggcucaagcgauccuccugacuuggccucccaaagugcugggauuacaggugugagccaucacauccagcccuucucuaucuuuuguuucacaaacccugauucuaguuucuuuggauuuaucuaauuucucaagauggaaauauagaugauugcauucuuucuuuuguaaaauacacauuuaagauuauaaauuuccuuuaaguacagugguaagugcauccuaugaguuuugguaguucauauuuacauuauaauucaguucaaaauauuuucucauuuccguuaugauuccuucuuuuaucaguuauacuucccuaaauauuuagggaagaaauaaaaccagucuuacuaucacacuuuugauauacuauguuagaaaaaaagagggaucacugcuuauuuuguuucaagccaguauaauuuaguacuaaaaccugauacgguugucuuaagaaguuauaagccaguuucuuucauauaauuacaaagaaauagaaauaauguaauagcaaauaaaauguaauaccuuaaaauguuaugaccaaguugucuuuauuuuagcaaugcaaacuuggacuaaaauaguaaaauuagaaugcaaacuugaauuaaaauuagaaaaucagccauugggauuuacuauauuaacagaauuagggaaaaaguaugauuaucucaauaggugucaaaaaauacucaauagcccaggcaugguggcuuaugccuguaaucccaacacuuugggaggcugaggcaggcaggucgcuugagcccaggaguucgagaccagccugggcaacauggcaaaacccugucucuuaaaaaaaaaaaacaaaaaacaaaaaaacuuuuuuuuuuuuuuuuuuuuuuuuuuuuuuugagauggagucucacucuguugcccaggcuggagugcaaguggcacagucucggcucacugcaacuucugccucccggguucaagagauucuccugccucagccuccugaguagcugggauuacaguugugugcuacugugcccggcuaauuuuuuguauuuuuaguagagacgggguuucacuguguuggccaggauggucucgaucuucugaccucgugaucugcccgccucggccucccaaagugcugggauuacaggcaugagccaccucgcccggccccccaaauuuuuuuuuuuugauuagccagguauagugacacaugcuuguagauccaccuacuugggaggcugagguuggaggaccacuugagucugggaggcauagguugcaaugagcugagaucgcuucacugcacuccagccuaggcaacaaagcaagucccuuucucaaaaaaaaauaauaauaauaaaauuuuacacucaugauaaaaaaucuuggcagaauaaaaauauagcuugaauauuugacaguggcgacagauuguauuaggguucucuuagagggacagaacuaacaggaauacacacacacacacacacacacacgccccaauaggauauguauaggagauauauguauguaggauauuaaugggauauauauauauauauauauauauauauauauauauaguuuauuaaguauuaacucacaaggccccacaauaggcuaucugcaagcugagaaggaaggagagccaguccgagucccaaaacugaagaacuuggagucugauguuugagggcaggaagcauccagcacgggagaaagauguagacugggaggcuagucccgccgucccuuuucauguuuuucugccuacuuuauauucgauggaagcugauuagauugugcccaccagcuuaacaguggaccugccuuccccagcccacugacucaaauguaaucucuuggcaacacacacacaggcacacccaggauuaguacuuuguauccuucaauccaaucaaguugacacucaguauuaaccaucacacagauuaaguaaacugugauuuauaauuagagaaucauuuuuaagaucugaggaaauuauugugauuugauacauaaagaauuauaguuauuugcauaauuacagagaaaacaggccagcauaaaguacacaaaaaugugaaugguaguuucuggaguugauaaauuauggauuuuucuuuuauuuuuuuucaugauucuuugcauuuuauaaugauuccaaagugugcauugguuaauuuuauaaccauaaaagcagguuaauuaaauguuuuaauuagaaauacaacugcauuaauauaauuuuaaaaugccuuuuuuuuuuuuuuuaaagacagugucucacucuguugccuagucuggauugcaguggugugaucuuggcgcacugcagccuccgccuccugggcucaagggacccuccuaucucauccuccuaugcagcugggacuacagacacaugcuaccauacccagcugguuuuuguauuuuuuguagagacagggucuugccauguuguccagcauggaaaaugacuuuuuauuaugaaguguaaaacucauuaaagcaugaaaugaaauagcaauuuuaaggagccugaagaaggcuccuuuaauaauaaaauauaaaagaagcauaguuaaugauguugccaaauaucaaaugaauguuauuguccauauggggccaggaacuaucugggcuagauuuaaaaugaauaauaagaggcuuaaguuccucauaaaugagguacuagugcagacaaugugccugagaaggugauacuuguuuauggguuuuuuagacuagccguuucaugcuugugaucuuuucugaaauucuuaaaugaagauuuauaaaaaguugacugugaacugucugguggccaccgauugcuaauggagaugacuuuuuuuuuuuuaaaucacauccuccacugauuucuaaauuccaggaguuaauuauuuuguguuuuuguacauuuuuacagaugguagugaaaaccuuuauggauauggaucaggacucagaagaugaaaaacagcaguaucucccacuagccuugcaucuugcaucugaauucuuccucaggaaccccaauaaagaugugcgucuccuuguagcauguuguuuggcugauaucuuucguaucuaugccccagaagcuccauauacuucccaugauaaacuuaagguaaauacagccuuuuucacuuuauuguauuuuucauucaccacuguucagaagguauacuuuuauuuuuauauuuuaccuuuaugaacauagguuucauauuagucucuucaucuuaagaauauauuguaaguugcaaaauuauucauucaguuaguauuuccacaaaugacuggguugcuugguuguuugauuugaagcauagaaagguauaguucaaaacuagucccuguaugcucaaauccaauuuucuggcuaauucaucacaaaagcccagauagcuauguuccagggauaaauagcagauuaaugauacuuuuuaaaauaauagcauaccagaauuuacauauucauaugacuauuuuccccuauaaguuauucagcaugcaaaacuauaugcucaucuugguuguucugccuuuguucaaguguuuguggaacucuuaacauugaucucuuggggagauuuuguauuuugaauaauuucauucuuggcaaauuuuaauccuguagacugcuuucuuuaaaaauaguccuaaaaucauuuuguauuauauugauacuacugugaguuaaaauuucuaaagaaagcuuauuaagaaaugaaagacuaccaucaugaaucauagaaccauuggacuagucuguugccuuuuuucacacacaacuucguaaucauacaucaacuucaaaacauuggcuaaaaauuacuauuuacuuguagguaauaguaauggaaauacucauauccaacuccuuaaaaugaagauaguuuuugccccgaugcaagguggagauagugaguaaagugaaagcacgauaguagaagaaauuauaaugagauauagagccugugguccgcucugaaagagaaagccuaaagauuuauaguuuauuuuugcuucuaaagaguauaauuuuauuugauuggaucuuuugaaucauuuugaauaauggauuaggccaaucccaagacauucaucuaaaggagaauuuucuuuuauuguaguuuguacacaaauaauaaaguuacauacuauuaguguguugugaaagaaaaguauuugugucuaaauuaauguguuuuuuuuuuuaacaggacauauuuuuguuuauuaccagacaauuaaaagguuuggaggauacaaagaguccacaguuuaauagauacuuuuauuuauuagagguaaaaaaaaaaaaacuuuaauaacuauuaacauuauuucacaugauagcaaauucuucauguuaacuuuguaauguaaaaugaguguuuauuuuauucaaagccuauaauaaaaugucuuuuacauuucauaaggaaaauauuauuuuauuuuucuuccuauccugaagagauaaaguauauucugauggaaaaacuguagauuauuugaaacuauaucuuuuguuuguaucuauuucuuucuuuuuuuuuuuuugagacguaguuucacucuuguugccaagacuggagugcaauggcgugaucucagcucaccacaaccuccgccucccagguucaagcaauucuucugccucagccucccgaguagcugagauuacaggcauacaccaccacgcacggcuaauuuuguauuuuuaguagagacgggguuucuccauguugaggcuggucucaaacuccugaccucaggugauccgcccaccuuggccucccaaagugcugggauuacaggcgugagccaccgggcccggccucuaucuuuuuauuuuuauuuuuuucuauucuaaaaacagauuuuuacugcuucuuaaauuuuguauggaaauauaucuaccaacuuaaaaauauugaguauuuuucaguuugagaaaauugaugccaucagguauauaucuuuuucaaggucagaauaugugauuaacacuuaaaauuuuauauguugagucuuuauagacuuuaauauguuucuaacucuaaaaauuaauuuuuuacugaguuuuuuauuauauaacuauucuguauauauguauaauucaauaauuauuuuuauuuauuuaagaauuuagcuuggguuaaaucauauaacaucugcuuugaauuggaagauugcaaugaaauuuuuauucagcuuuuuagaacucucuucucagugaucaaguaaguuauuuuuuaagcauuucuguuugucucuuuuucuugauuauguauucagauguuguauacucuacauguacacuaagauauuucagaguuauaaggaauuguuuuccuuagaaaacuuaacauaaaggggaaaguaaaaauucuguuguccgaacacugccuuugaccuuauacuacgaauuuuaaauuaugguaccaauuuacugguuggcucuucagucgcccaggcuguccuggaggccauggaccaguagagaaguauaaaguggugcucuuguuuugaagggacuuacuaucuaauagaggcaaccacauaugguuguaaagcaaaucgucugaaaccuuacguuaauacaaugaaguauuaaauuaugagguagaaauuaugcauauuguauguaccauuaguucugggagacguaauagcucagucuuuaagcucacuaacuuugacaacuucuuauucuagaccuagaaaaaaaucuuaaacauugccuaaauuggccuucucuuuauagaaauagggaaacuaauccagagucaggaaguguaguggcuugcccaaggaccaguugcuggacaggaggcucaaauucugauuuuagcccauguuuuuugguuuguggguuuuuuguuuuguuuugguuugguuuuuuuuguguguggguuuuguuguuauuguuuuauucuguguggguuguuuuguuuuguuuuuuuugagacagugucuugcucugucacccauacuggagugcaguggugccaucuuggcucacugcaacuuccaccucccggguucaagcaguccuccugucucagccuccugaguagcugggacuacaggugugugccaccacacccggcuaauuuuuguauuuuuaguagagauagaguuuugccauguuggccaggcuggucuaaaacuuuugaccucaagugauccacccaccucggccucccaaagugcuggguuuacaggugugagcuaccacacccagccugguuuguuuuuuguauaguaaauuaagcacuguuaugagaaguguucuagagcauuacauuauaugcaaacauaccucacauaaguuuucuaguagucacauuaauagaaaaguaaaaacaagugaaauucauauugauaauauauguuauuuauuccacuguauccaaaaguauuuucauuccaacauguggcccuccucauguuucacauguucaccagccauauguggcaaauggcuugcauauugaacagcacauuuccagaguuuuaaugaaugcuauaucauauuuucuuuuuccuuagauggaaugguaggauuagacauuauccugaaacaaacaggaaaggaucacuccagcuuggcauaggauagaagcuuguagaaagauagcaugagaagaaacuucuguggcauuugacuagcaguaagcccuuaaaguaaaugauagaacauauaaaccuuuguguuuguuagcuuuugcugcauuacaaaguaaccuaaaacuugauaguuuaagacagccaccauuuuauuuagcucaugauucugcuuggcaguugauuuuauuuggguuggauuugcaccuguguuuguagucaguuggcaggauaucuggucaauaucuggccguaagcugaggugggcugaagugauagaacugggucacaugucucauccauucaggaggacagcccaggccuguucguaugcugacuggguucaaaaguagcaagaaagggcaggccucauuguggaagcacuugaaagugauucuuggccuuauauuuuaugcuuuauugauuuuucauuugucuguuugaaauucuuuaggagguacuaggaugacauuuucagaaaagccuucuaguuauugaaagcauuuuagaugaaacuuuugauuuucaguauuggugaguuaaaacuucuaguggcaaggauacagcaauaauugcuuauguuggcuuaugcauuuggggguguuuaaauagguuuuuaucuuaguuugaggaauuuauuaagacuuaaggugugggaguugaaaaaaaugucugccuuuauuauuguauacuuuuuuguuuguuuccuuaaaauuuuaucaccuuuaaaaaucuggggcauguaagcagaaguguucuuuccuugaaguggaugcguguguguguguguguguguguguguguguguguuuugagacagggucuuggucugucccccaggcuggagugcaguggcacgaucauggcuugcugaugccucgaccuccugggcuccagugauccucccaugucagccuucugaguagcuggggcuacucagcuggccaauuuuuaauuuuuuuguagagacaggguuuugccauguugcccaggcuaaaauugacauuuuuuaaggcagaauuuaauuuacuuuuggaauccuaguuguguaaagacuuaauuuauuuuaaaaggucuuuuuuuccuuuuccuuuuuuuuuucuuuuuuuuuuuuuuuaauugauacaaagucucacucuguugcccaggccggagugcaguggcaugaucucugcucacugcaaacuccgccucccaguuucaagugauucuuccgccuuagccuccccagaaacuggaauuccaggugcccgccaccacgcuucacuaauuuuuguauuuuuguaaagacgggguuucaccauguuggccaggcuggucuugaacuccugaugucaggugauccaccugccucagccucccaaagugcugggauuacagguccgagccacugugcccggccuuuuucuuuucuuuuuaaaaaaaagugaauggaagaaaauguaguuuauuagaaauuagguuugucuuuguuuuuauaaaauacaacaguaccuuacaacuguuguaauagucaacaaaaggagaaagaaaauagagcagccaaaauuucucugccauuauuggcacugucccucaagugaaaauccuuuacaugugagauuguuguuuuaaacuaggacguuuaauuuccuauuagaagcuugaauucucuucuuuuccuccuccuacuacuuauucuuuuuuuuuuuuuuuuauagcaauagccacaauaagaagguacaaaugcacaugcuagauuugaugaguucuaucaucauggaaggugauggaguuacucaagaauuauuggacuccauucuuauuaaccucauuccugcacauaaggucuguaaaguaugaagauauucaagguuaauguuuaacagucacgccacacauaagaaugaacaguuguuuuauggccauuugcaaucccauguaauuguucucaugaccguucuccaccucaaauaaaauaacaugcauuagucuuguggcuauuauuuuuacaaaauauauugauuaacauaucauguaggaguuucauucauuuaagugcuguuuucuggaaacugaaaauguuuuguauucacacaaauaaucugagaauuguaagggguuagggguguugccuuuugguuaacuuuguuuggaaaagaaauguauuuccuccuuuuuaacauagaugugaaacauaggaguuuggauuucuuuucagaauccguaucguaccuuuuucuuagguacucucagaaaaagauuugggcagaagcuauaugguuaauguuaagaagaaaaggaugauucaaagguguaucauucuucccuguuuccuuuuucuauuuaucuccaccagauccuccuaagaaucugaaggacuuggcugcccucaggcuccaccacugggcucuacucaggccuaccccaauguugauauuugcucuccugcucuuuucuucuagugguucaguauccuguuaucagacauuagaggaaaaaucuguccaauuauacucauucacagaaagauauaauuaauuuuaaauucuucucgaguuuaaauauuauuuacauuuuauuaauucaaauguaguuuacaaaauucuguaguuuauaaaaauucugagacuauggcaaaggagaguauauuuuggcagauuaagacaguauauuugguuuuuauauacuagguaaguagguuggugguauuuuuuugggacagggucucacucugucaccuaggcuggagugcagcggcacuaucuuggcucauugccgccucugucuccugggcucaagugauccuccuaccucagccucccaaguagcuggcaauacaggcaugugccaccauaccuggcuuuuuuuuuuuuuuuuuuuuuuaaguuuucuuuguagaaacaggguuucgcuauguugcccaggcuuaucucaaacuccugggcucaagcgaucugcccguuuuagccucccgaagugcugagauuacaggcaugagcaaccacaucuggcuugagagcauuuuuauuaguaguaggaaauagacuucuuuuaagaaauagaaauguuaacuuaauuuuaagcaaaucuuauccuuugccaaugaaauaaaaguauagagcaggggucaagaagcuauggcuuguugaucagauuuggacuauugcuuauuuauguaaguaagauuuuauuggaacacagccauguucauucguuuucguuuuguuuauaucugcuuucaugcuacaacagcagaguuguguaguuguugcagugauuuguaugacccacaaaaccuaaaauauuuaccauguggcccuucauagaaaaaguuugcugaccccuggccuagaguguaggguuuccuagccuuguuuuggaagagguguuagaugauggugaaugaaucuguuugauccaaaacuucaagauauagcaauguuaauagguauuauucaaaacaagaauucccuuuucaggcauuuaaaaaaaauuaaauaauauauuuucuaagguccuucucagauccuuuaauuuauuugaguacauugggacucuugaaacgggagcauaguauuaagcauuucaaaaauacaauugaucaagaacgcuuuuuauuugaaacgcuuaccaggucuacucuucuccagagcacgcauugauuaaacaaugaaauaauugagcauguuguguuagaucagggaguguauguguuuaagauacguggguguaguugucaguuuacauugguuaacagauaaaaccaaaaagcauuaggucuguuuugaguuuaauaaaacaauauaguguugugcuuuugcuaacuaacccauuuuaguuuuugauuaauaaauuaguucgauuugcaacgucugcauuuaagaucacuugacuagaggauauuuggcaaaaccuugaagagaacucaguuauuuuuauuuuugcuucauauuuuagugaagcaaaauucauauuuuauuacagauuugaagacuacaguauucuaauguuacuaucucauaaauuaacauuuauuuguaacuuuccauguuuuuauuauuuuucagaacuuaaauaaacaguccuuugaccuugcaaaagugcuauugaaaagaacaguccagacuauugaggcaugcauugcuaauguauguauuucuuucuauguuuauucuauauuuuguaauucuuaauccauuguauuaauuuauuagaaccucuuacauaaaaguuuauuuagcuuauaaauauaaaauaacuuauguccagaugugaccaggguuagagaaaugcagcauaaguuucaugacguuuuuaaaggguggauauuacuauaagaaaagucgucugcaacucccauccccuuaucugcauuuguauuuauguuuauuucauugucucccagauaugcugaucucuuucauauuuuccuugggucucugugucucucucuauauauuuuuuucuuuguuucuuuugggucauucuucugaaguccuguaauguuucuuccuuuuuuuuuuauuuuauuuuuuuaagauuacagagauuuauuuagaaaaugguuugguuguuuugccuguuguuuuuggcaaagauuuaaauacuuuucaguaaugaaagauugugauaguugcuacauaguaauaguuaaaaaaagguuuacugaggaauuuguucuggguuuguuuuuccuaaaaaaaucaauaauuuggaaaaaaaaguuugcaaucucacuaccuuauagcaacuaauuccauuguucauuugcucauauuuauaacuauuuucccacauacuuuaugaaaaaaaaauuuuuuuugagacggagucucacucugucucugaagcuggagugcaguggugcauucucggcucauugcaagcuccgccucccggguugacgccauucugcugccucagccuccugaguagcugggacuacaggcacccgccaccacacuuggcuaauuuuuuguauuuuuaguagagacaggguuucaccguguuagccaggguggucuugaucuccugaccucgugaucugccugccucagccucccaaagugcugggauuacaggcgugagccaccgcacccggcuauuuuauguaaaauuuuuaucgucauauuuguauuuacguauuuugacauucuuuuuaaauauauaagaaugacuguaaauguuucuugauacguauuuccuuauugucauagaucuaggucuuuucaguguuucuuuccuuuccuaaucaucuuugugaaucuaacauuuauauauuguugaauuauuuuccauggauaaaaauccaaaugaggcuuuuaauuuaaauguuauccuauuaguauuacuuggauuacuaaauuaauauuuaaacagauuaaacaauaauaguaguaaagaagugucugucuucagccuugaauacauuucuuaauucucagaaauaaccauccccauuagguuuucuuauauccuuucagaaguaguauucugugcuuuuuuguguguguguaugcauauauuuugauaaaacuaucuucuucauuauuuucaaugucugcauaguaaauaugaauuuuuugauauuacucuuauccagugggaaugauuagagauggagucucgcccuguugcccaggcuggaguguaguggugcgauuucagcucacugcaaccuccgccucccaggcucaagcgauucuccugcuccagccuccuuaguggcuguacugcagaugugugccaccacgcccugcuaauuuuuauauuuuuaguagagauggaguuucaccauguuggccaggcuggucuugaacuccugaccucagguaauccgccugccccagacucccaaaguacugcgauuacaggugugagccaccacaccuggccaauaaugaauauuuucuaacuuaauucaugcugcuuuucaacuuaugauacuaccagaaguguaugcuuguaucaguugcauacaauugccccugaggcauuuuaaaaauuuaauucuucugcaugugugacgguggugugcagugcugguaucuuuuaauuugcgcucuuggccuuguauacucuuuauuucugucuagcauuuaaaaaaaaaaucagcuuuuguauuaccaacuuuuuguucuuuuugucaugcgagucaaaacauauuugacuuucucugaguauuaaaagaaacaacccaacaacaaaaaaaaauccuucagcuuuaaauacucuuuauuacuaaacucauggaaaaauuauucuguuuuuuuuuuuuuuuuuuugagacagggucuuguucugucucccaugcaggaggagugcaauggugugaucacaacucacugcaaccucgacuuccuggggcuuaaaugaucccccugccguggccuccugaguagcuggggcuauaggcaugcacuaccacacccagauaauuuuuuuauuuuuuguagaggcaagggucucacuguguugcccaggcuggucuccaacuccugggcucaagauugucgugccucggcuucccaaagugcugggauuacaggcgugugcugcugugccuuugauuuuuuuaaaaaucaaagguugaggccaggcgcaaugggucacgccuguaaucccaguacuuugggaggccgaggccuguagaucaccugagguacggaguucgagaccagccuggccaacacggugaaaccuugucucugcuaaaaauacaaaaauuagcugggcaugguggcggguuccuguaaucccagcuacucgagagauugaggcaggagaauugcuugaaccucggagguggaaguugcaguaagccgagaucacgccacuguacucuagccugggugacagagccagacuccaucucauaaaaagaaaaaaaaaaucaaagauugagacuuuguaauuuuucucugcuacaaggaaauuuuucuaaaauccuuuguaaugaacuacacagacugucuaaauuguuuuaaugaaaacaaagauuccuagaaauguccuuauuugaaauacacccaacaaaccaauuuuuuuuugcuuuucuccuuguaacauucaugauuugauauuauuaggaaauuauuucuucugcuguuuagaugacuguccuauuauauauuaguaaucacacaccuguuuguaucaccuccuucaauuguauauguaauaccuaauuaaauuauuuauaaaaaauguuuauuaaaaauguauccauguuuuuaaaugaacuggauguuuucuuuuuguuuuuaauaucucuuacaguuuuucaaucaaguccuggugcugggaagaucaucaguaagugauuugucagaacauguauuugaucugauucaggaacuuuuugcuauagauccucauuuauuauuauccgucaugccacagcuugaauucaaacuaaagguaagauugaccaguuuucuuuuuuuuuuuuuaauuuuuuuguuucuagagcaggcacaauguaaaauugaccaauuuucaugcccuuuaaacuuuccaggaaaaauguauaccgcauaauuuuucuguaacuguagaagaauaaagugugacuucaauuuaucuuuuuuuuucuuuuuuugagacggaguuuugcuguuauugcucaggcuggagugcaauggcgcagucucggcucacugcaaccuuugccccccagguucaagcgauucuucugccucagccucccgaguagcugggacuacaggugcaaaccaccaugcccauauaauuuuucuauuuuuaguagagauggggauucuccauguuggccaggcuggucucaaucucuugaccuugugaucugcccaccucggcugcccaaagugcugggauuacaagcgugagccaccacgccuggccacaaaauuauaauacuuuuaauuguuaaauaucuacugauaaucacagugacacaagcaauagauaggaaaaaugguauuaucuuagagauuuauaauacauguugguauuaaaugguauccauuauuagauagauauguuuuagaacaucaaaauauuuuaaauguaauccucauaugguauugcuuacaauuuuaugaccuuuucaugguacagauuaaggacagaaauuugacuguccuaaaaauaguauaucuauuuuuuauagacaacugagcaaguaauucguaauucuugccccucugcuauuuguaaaaguuuaauacugccuugaacucuugggcucaagugauccucuugucucagucucuuuuuuuguuguuguuguuuuuuugagacggagucuugcucugucgcccaggcuggagugcccggcuuuucuugucucagucucuugaggagcugggacuacagguauaccucaccaugccuggcaauuuuuugcuuguuuguuuguuugagagggguucucacuauguugcccaggcuggucucaaauuccuggccuaaugcaauucuccugccuuggccucaaauuacugagauuacaggcaugagccacugagccuggucaaggaauauauuuugacuuuuacaaauagcagaggggcgaguuuucaguuaguuuuacuucuguaguuuauagaugugaaauguccucuuuugaaauaaucacugauuuacuaaaacaguuacuugcuauuagaauaaaauuuccauauauuguuucauauuuaagggauagauuacuuuuucuuuaagaaguaaaucauauuggcuaauaaauugaacuuauuagaagguugugcuacucugcauuauugucauuuugcuugagaaaaauuuugucaaagaaaaucaggcugggccaagugcgguagcucauaccuguaaucccagcacuuugggagguggaggcaggcagaucucuugagcccaggaguuugagaccagcuugggcaacauggugacaccccaucucuacaaaaaauacagaaauuagccaagcauauugccacacacccguagucccagcuacucaggaggcugaggugggaggauggcuugagccuggaaggcagagguuauagugaaccgagguugcuccacuguacuccagccugggugauagagccacacccagaccuugucucacccaaaaaaaaaaaaaaaaaaaaaaaaucaggccgguugugguaccucauguccauauaaucccagcauuuugggaggcugagguaggaggcuugccugaggccaggaguucaagaccaaccuugucagcaugguaagauucugucucuauagaaaaauaaaaaauuagccagguguggugaugcacaccuguauguccagcuacucaggaggcuaagaugggaggaucacuugagcccaggaguucaaggcugcagugagccaugauccugccauugcacuccagccugggcaacagagcaagacucuuaccucuuaaaaaaaaaaaaucauuuuugucauuuaaaauuaaaauaguuaauacuugauguaauuuucauuuuuacauugguuaagugugccuguuuuacccacaaaaccccuguucuugaacguuaaaacauucauaaggaaaggauuuuauccuguggucuuuauuuuucuauuuuuacuucucuuuuccaaaacuauuuuguuuauuggauaucugguauugcuuuaggcacauauuauauuugaacaccuaaaaaaaauuagcaguugcuuuuagauacuauguuuauuuuccuagugaauaugauuuuugaaaaguuucacacaccauaugguuuuagaauaacuuauuuuacauuaaagcauggcaucacuacugaaacuggaacagaauuuuuaucgcauauacuguuucaggauaagaaaauauaaucuuacuagaaaacaaugaaguuuugcuuuuuuauaguauuuaagcugaccuucagaucaucuuuugauucuugcauugcuauuaaaaugaguuuccaugaaucaugaaauucuguagugucguauucuccagucguaggggauccuucauuaaaacuuuguguaucagccaggugcggugguucaugcccauaaucccagcacuuugggaggccgaggugguugggucacgagaucaggaguucgagaccagccuggccaagauggugaaaccccaucucuacuaaaaaugugaaaauuagccuggugcgguggugggcgccuguaaucccagcuacucgagaggcugaggcaggagaaucucuugaacccgggaggcagagguugcagugagcugagaucgugccacugcacucuagcuugggaaaacagugcaagacuccucaaaaaaaaaaaaaaaaaaacaaauuuguauaucaaaacuuuaauugauguguguuuauguuggaacguaaauugcagauuuccuauaaaguaagcuuauuagggugguaacuguaacuuuguccuucauagauguuuuuauaggguucuuaauguuagaagugaauuguaugucucauauuuguacaguguccauaaccaauguauagaaugcaauuaaucagugaaguagacauaaauuagcaguugggagggugugaaauaagagcaaaaacccagaugaucuaacaugaaauuaaaucaauuucugcauaguaagugaggacauaugauauuuuaaacuucucacaguuauaagcagaaauaugaaauaguaucuucuugagaauguuucaagauauuuucuguaaucuggugaauaaagcuuaggcuucacuuucuguuuucccuucuuagagcaaugauggagaagagcgauuagcuguuguucgacuucuagcuaaauuguuuggcuccaaagauucugauuuggcaacacagaaucguccucuuuggcaauguuuucuuggacgguaagagaacauauaauucugauguuuauauuuuagaaaauagucaguagggugcaguccacuugauuaaaacuauacauaucaaaacuuucauuaauagauguugguuucauugucaucuguguuuccauccuucuuauggaauaaauuguaugaaaaauuuuuuaugaagaaagcuuaguauuuuaucuguguaacucuuuuuaacuucuuuguguuaaaauaaugucauggccagccgugguggcucaugccuguaaucccagcacuuugggaggcugaggugggcggaucacuugaggucaggaguucaggagaccagccugaccaacauggugucucuacuaaaaauacaaaaauuaaccagggguggugaccggcaccuggaaccgcaacuacgcaagaggcugaggcgggagaauccuugaacccgggaggcagaguuuguacugaguugaguucaagccacugcauuccagccggagugacagagugagacucugucuaaaaaaaaaaaaaaagaaagucauuagaauaaauaaacagcauugcaguauauucuaagucuuaagaucuuuaaaucaugaaacugaauacauacugauccaaauuuaagaaccugugccauuugucagccuaccaacuuuuucauuuacuagugcuugucguuugggucuguaacuuaucugaacacauuguaugguguguuuuaacuaauuugguauaauuguaugauuuuuaaguggaaaauaugauugccauuaacucagauaguuuuuaauguuucuucucaagagcuuagaaugacuaaauucuauuuggcuugauaguaguguugacaaauuuaugaaauucauuaaauuucuccuugcauuccauuuaccuguuuugcuuuaaaagcugauuggaaaguagauauuuacuauuaauauucuggagauguucgagauucuccguuguuuuaguucaacugauucaguaguuggugccagaauuuuucuugauguaaauucaccauaauaguucucauacuaauccuagguucugagaaaucgcugacaaggccuacugcuaucuuagcaguuacuugcccagaacacgccauuuugaaggucuuauaggaauaaaugcuaaauaguugaauaacuaaaugugacuccaugagaauuuugaauggugggaaugaagcaacugcacuuucaaaguuaugggggaggaauucccuaucccaggauggacaucaaauauuuuuuguaaaucauuuaagcaaaaacgcaaggcuucauuuuucacuuugguuacuuuuaaaaaugaaaucacccaauauaaguuucugacacucauuauuuuacacucacugcuaacuguaguggugucucugauucauagaaacaagucacagucugcaguauuauuuuccauaauuauagcguuaaguguuuugauacuuuguaauuacuugaucauuaauaauguauaauuuuucucugccagccagagaauuacaaauccuaaaugcaguauuuuauuaacacaugaaaauuuuaucuggguaagaaagugggaggccauagacauuaagacguuuauuaaacaauuuuuguuuacuugguuuuuuuaugagaucauuucaaaaauaaaaauacuuccagcuauuucagaucacauuauuuaucauuaaucaguauauuuuaaaaguugccuaauaaucuguuuuaaauuugaggguuccuuaccuuauccuuaacaugugcauuuuuuuuuuuuuuuuuuuuaauugagacggagucucacucugucgcccaggcuggagugcaguggcgcgaucucugcucacugcaagcuucgccucccggguucaugccauucuccugccucagccucccaaacagcugggacuacaggcgcccgccagugcgcccggcuaauuuuuuguauuuuuaguagagacaggguuucaccguguuagccaggauggucuugaucucccgaccucgugauuugcccgccucggccucccaaagugcugagauugcaggugugagccaccgcgcccggccaacaugugcauuuuugagucuacauauuguguuguauguuaauugaauucuuaacguauacuagaccuuuaaaagagcacuguaauacaaguuggugcuggccaaaagaaacuuaaguggugagacagugcaacacaaauuuuuuuuuuuuuuuugagacggagucuuacuucaucgcccaggcuggagugcagugacgugaucucugcucacugcaaccucugccuggcggguucaagcaauucuccugccucggccuccugaguagcugguauuacaggcacccaccaccaugccugagcuaguaacacauuuucugcacucaucuuugaacuucuggauuugccccuuauauaugguuugcucucuaccucaaguuucccaguguuugucucauauaaaccuuucgucuuguuuuguuuugagacagggucuguuacccagguuggagugcaguggcacaauuauggcuuacugcagccucgaccuccugggcucaagcaguccuuccaccucacccucccaaguagcugggacuacaggggaaugccuccacgcccggcugauuuuuguguuuuuuuguagagacagggcugugcuguguuuucaaggcugaucuugaacuccugagugcaagcaauccacccaccucagcuuccugaguaauagcugggacuacagaggcaugcuaccaugccugccuaauuuuuguauauuuuguagagacaggguuuugccauguguucaaggcuggucuuaaacuccuggccacaagcaauccaccugucuccgccucccaaagugcagugauuacaggugucagccaccgugccuggaaucuccuauaaacuuauucuucaaacugauuuuguguguuuugaauauuuuuuacuuuguagcauaauauuaagcucucagauuuuaacuccauaaaguguauaguuuggguugaaggauguguuuguuuauacuguuuuuuguuaguuaguuuuagcaugguaaagaaauucuguuugugaauauguuuuugugaaauuguauccuuucaccuuauaguguacuuuauauucuuccuucagaauaccuuagcucauaacaaauuuucuaaucaguaacuauuguugcguauaaguauuuucauguuagauauaccugauuugagagugauuauuuugccuuacaauuaauguuuagcaaucuuuuucuguguagauuuaaugauauucauguuccugugagauuagaaagugugaaauuugccagucauuguuuaaugaaucacccagauuuagcgaaggaucucacagguaagcuagcugguuuauuacacauauuagcauaaccauacaacuauauuguagauaugacuugugaccuaacuucacuuuccaaguagguuuuaacucugguauggucucguguuuucauuuguugugcacuaagaaaugauuucauguucauguaauaaaauuacauuuaaaaucucuuuauuuguuuguuuguuuauuuuaagagaaaggcuuucacuccugggcucaagugaccucucacuuugagaucccgaguauuacaggcgggugcuacaaugcccagcuuaaaaucuucauauuuuaauccuuugaaauuuuuugaaaaucauaauuuaaggaaguaguguauuucuuaagacauuggauuuggguagaaaucauuaugucuauuuaauuaaauauaguggcauuuaauaauaagugggaacaugauuaucuucugcacuagacuagaauuuuucauucuuuugaaucuagagcauuuaaaucuaccuuuuugguagcagcacauaagugguuuuuaucagcaggcuguuauuuaccaaaaagaacaggggaaacaacauguuuuuguuuagauuuaguuuguauuauaaauuauuuaagaauuuuuugaacagauuauaaaauauucuggauuuuauauuguguaauuugcaaguauauaccugucagcuaaauugccauaagcauuuucacuguuuuucuuuuaagcuuuuuaauuaguaacugaaauucaagcugacauagaucagauacugcauugugaguugacuuuuccaggauaacugaugaaaauacauuauuaaaauguaacuaugggcaugguggcucacgcguguaauccccugcacauugggaggccaaggcagugcaucacuugaggccaggaggucaagacuagccuggccaacauggugaaaccccaucucuacuaaaaauacaaaaauuagccaggcaugguggcagaugccuguaaucuaagcuaaucggaggcugagguacgaaaauugcuugaaccugggcggcggagguugcagugcaccgagauugcucuauuacacuccagccugggugacaggcuguuuuuguuguuguuucaacaacaaaaaauaaaaauuaaaaaaaagauguaacugugaaguauuuuauuuuauuuuauuuuauuuuauuuuauuuuauuuuauuuuauuuuauuuuuugauacagggcgucacucuguuacccaggcuggagugcaguggcuugauauuggcucacugcagccuugaccucugggcucaaguuauccucccuccuuagccucccaaguagcuggcacugcaggggcgggccacuacacuucuggcuaaugaguuuuuuuauuugguaauuuucguagagacgggguuuugccauguugccuaagcugguaugaacucuugagcuugugcgaccugccugccugccucagccucccaaagugcugguauuacaguugugggccaucacaccuggccaacuugggaguuuaaagugcaguuuugugauuacaguagaguacugcugcuguaaaaauaacaugauuuaauuucaugccauauuuuacaaacauugcuuuaguauggacaaaaacuuaacauauuucuguucuugccauucuaaaucaugacaaauuacauagcuaacauuuagccuaaguuuuuuuucucuuauuacagaauauuuaaagguuagaucacaugauccagaagaagcuauucgucaugaugucauuguuacuauaauaacagcugccaagagggaccuggccuuaguaaaugaucagcugcuuggcuuuguaagggaaagaacacuggauaaacggguaaaaucugaggcauuuuauucuucuguaauuuacuguuuaaauugcuaaauacaauuggguaucauuuucuguuacauuuaaugucuuucugugugaaaaucaaauuaauaacaaugauaaagagcuccuaauuuguauguuuccugcauaucuuuuaauuauccuuaugaauaaauacaauggauucuauaccuuuugagaucuuaagcauggguuucuuuucuaucauaccuucauaagagaaccacuaaguuaaucaaaauuuuaccuuuuuauuuacaugaugaguuucaaaagaauagugauugaucgucuauucuuauaguuaacauuuucacauaugacuuucuugaauaacuuagcugggucugccauucauugaacuuuacuuccuaagaaagugacguuuacauauugaugugccaagcuaaggacaauaaugaugguuauauguuuaguuauuuuuccugugauuuucuccauuugaugcaguugaaaaaauggauugccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagcugagcaugguggcgggcaccuguaggcccagcuacucgggaggcugaggcaggagaauggcgugaacccgggaggcggagcuugcagugagccgagauugcaccacugcacuccagccugggugacaaagcgagacucugucucaaaaaaaaaaaaaagaaaagaaaagaaaacauggauuguuaaggaaaaguaguguuaagaauacaacuaaugaauagcgucagguguaaacaagaaacagauguguaaggcaggcugauuaggccuaacauuucuagcauguuucaugauuaccuugcaacaugcuauuauuuuauuugagguguaguugaaaauuacuuucgucugcaaaugaguauuauaauuucaggguagaauaguaauugguuuggguuuuaaaauauagaaagagguauucuuuaaguuuuuacuuuuaaaauugucacaggagccagauguuuaaaaaaaggcagauaccuuuuaaguuguucaacaguguuaguaauuuuaacuuugaagauuuuuuucccuuggcuuuaauuuaaaugaaaugacucucucccuagugguuauuuggcauuccucccuucccccauuuaaaaaguuucacuacuauuacaguuuuuucauaguuucagaaaguugaauaaaugaaucuuccuaacugaaacuguauggugugguaacaguaacaccuacuggauauuuucugacccauauuuugguuuaauaaguuagauguccuugguuauagccucuagaaauuugggaacaggauuucaucuuaagauuuuauugcuuguuuuuuuuuuuuuuuuuuuuuuuuuuauguaagaaaucucaaaaggcuuuugcuaaccuguuacauaggaacaaaguuuuauuccaucuaauaaggggccuaaaaaaugagaaaaugauacaaaaaaauuuauaaagaaguauugacuuaaauacaccaaagauaauauacucccacccaccccucuuuuuuagaggugguguguuacuauguuacccaggcugaacuugaacucuuggauucaagugauccucuugcuucauucuccugaauagcugguacuacaggcucccaccaucacacucagcugcugcugcugcugcuuuuuuuuuuuuaauacacagauuuuuuuuuacuauuauuuuucuuacaucuuaugaugauccucauucuaaguuuuuauggucuccuuuccugucucuucucuuacaacuuuucuuuccuacccuauuaaaccuucccaaccucuaaaagucccaaagaaucuucugccaacuagcuaaaucguuugccuuuuagguuugcaacguaaggaaguucacuuacggugaucacuaagguuuuuuuuuuuuguuugagacagggucucacuuuguugcccuggcuugagugcagugguguaaucucagcucacugcacccuccucuucccaggcucaagcgauccucccaccucagucucccaaguagcugggacuacaggugugcaccacuacacuuggcuaauuuuuguauuuuuuguagagacgggguuucaccauguugcccaagcuggucucgaacuucugggcucaagggaucugugccugcuuccaccuccaccucccaaaguguugagauuacaggcgugagccuguucucucuuuugggaacucuuuaauuugauguugaaauucuuggacugauaguuuaauuuucuuaucuuuuuuuuuuuuuacuucaucuccauuuuuaauuuccaaaagcaccucuuguuaucuaauuugucuuuguuuuucuuuucuuuuuuauuuuuuaaaucaguuuccucagauugaaucauuaauuuuucuaacuuccuuucucccugccuccuuuccuuuuuuucuucccuccuuuccuuuucuucuuccuugcuuucuucccuccuuuucucccugccucucucccuaucuuccuuccuuucuucgucagaggcauugagucuuauuuuaugguguaaaaucuuaucucccugagaauguuuggaagugucuuuuacugccuguauuaucucuguuucugcugaguccuguuuuccuccucuggccuguuuguuuuggucccucucuuuacuguugaaagcguuccucaaaggucugaugauccuugaauaguuggucaguuuuuuguuuuuuguuuuuuuguugagacagagucucacucugucgcccaggcuggagugcaguggcgcaaucuuggcucaccgcaaccuccgccucucaggcucaagugauuucccugccucagccucccaaguagcuggaauuaguggugcgugccaccaugcccggcuaauuuuuguguuuuuaguagagaccggguuucaccauuuugaccaggcuggucucgaacuccugaccucaggugauccaccugccucggccucccaaaguacuaggguuacaggugugagccaccaugcccgcccuuggucagauuuuuaacugacucacugcacagcugauuggaagcucuguuugagugggcagguuuugucagcuugugagcauauuuuuagauucacugguuagucagccagcucaacuccuagauucacuacaauuuuagauuuacuaggauuuuagauucacuggguagucaguuccccaaguccugagcucaagcgaugcaccugccuuggccucccacagugcugggauuacaggcaugagccaccaugccuggcccagaauucuugauagugaacuuuguucuuauccgaaguuaacaucuaaagggauguaacuggcaauuaaaacauuccagauaauagggguuuuguuugcaaggggaauuauaaucacuucuaaaacuuggugaauuuucuuucaauagaaucaaaugaacucucccauaagguuauuaauaguuuucaagggaaauaaaaaaucaguaaccuguaguucuagguacucaggaugcuaaggcaggaggaucacuuuagcccagaaauuugagaccagccuaggcaacguaacgaaaccccauuucuuuaaaaagaaaaaaguagaucauuuagcaauauuugcauuggaaaauuucuaaauaggaacagauucaaaauuguuuguaggcugggcgcgguggcucacgccuguaaucccagcacuuuggggggccgaggcgggcggaucaugaggucaggagaucgagaccauccuggcuaacagggugaaaccccgucucuacuaaaaauaaaaaauuagccgggcgugcgggcgccuguagucccagcuacuugggaggcugaggcaggagaauggugugaaccugggaggcggagcuugcagugagccaagauccugccacugcacuccagccuaggcgacagagugagacuccgucucaaaaaaaaaauaaaauuguuuguaaagccucuuuugaagagaaauagugugccaguuuauaaaggcacacauaagacuguacaaccuaaugaagccaaggcagucuuuggagauuaguacagaguuuuguuaucuugcucaucuaauaaauuuuaugcuuuuuaguggcgaguaagaaaagaagcuaugaugggucuggcucagcuuuauaagaaauacugucuucauggugaagcaggaaaggaagcugcagagaaagucagcuggauaaaggacaaacuucugcauauuuauuaucagaacagcauugacgacaagugaguuuaauauguugguagaaugguugaguguaaaacuacuuuuuacuuaaaaaaugucuauuuaauauuuuaguaauuucuuauuuuuauguauuuacuucauaaauaaaauuaaguuuauucaacuugauuaaucauuuauuucuaaguuuagagauagcuuuuuacauauuuuuauguacuguguuuaaacaagacuguccacgauuauaagguagccuuauaauaugaaauaggcaugaacuuuggaguuagagaccaaauguucacucugcccuuuauuagauguguauucuuacauagguucauuaaggucuugugcgcuucaguuuuauauaaaaaggaaaaauaauagugccuuucccacaggauuaucauguagauuaaauaaaauaaugaauauaaagcauccuagcccaauguguggcaagagagcacuauugaguuaacugcuaguuacuuuccuuuuuacaccacuaccaauagaggaauuacuaaguuguuuucauuuucugaauauuacuuauaauucuauauuggaucguacaaaugauacuuggugugugcagaauaguuuccauuguuuuguuuaauuaaacuaacuucucuggcaucacuggauauguauuucauuuguuaauuaagagaucuuguauauucuuaauccagugauauuaaauaauagaagcaagaagauacaagcaauagguacuagcaagaaggauauuccaauauugguaaggaauuuagaucauggagagaacaauaaucagauguacacaggaaaaacuacauuuucuggaaguaauaugaaggggggucccccuguuuuuaacuaugugacaacauggaaaaugggcugaacuguaaucagaggaaauuaaugaguuucuugagaauuagcucuaccgcggaucauagcuuuauauguugcguuaaugaauuugcuuuuguucuagacugcugaagaagaauaggcggaacagccuagcacccuguguuuaggaauaacauuuaaaccuucuagaacaaauguuucauacugacaaauuauaaagccacagacaguaaccgugucucuaaaguuaaacuguacugaaagcuuuccaagaaggaagucauuauaaacugauaucuuccauuguaugugcacacauagcuauuaucuugauaugguauccuggcauaagaugguuaaaacuuaaaauguuggcuggguguggugccucaugcccgucguaaucccagcacuucaggacgcuaaggcaggcggauugccugagcucaggaguuccagaucagccuuggcaacauagggacaccuugucucuacaaaaaauauaaaaauuagcugggcaugguggcacgcgccuguaguccuagcuacuggagaggcugaggugggagaaucgcuugaaccugcgagacagagguugcauugagccgaguuugcaccacuguacuccagccugggugacagagcaagacccugucuccaaaaaaaaaaaaaaaaauugcuucuuaaaaauggaauaauugugucacuuagguuuuuuuuguuguuguuauuuccuagacuguugguagagaaaaucuuugcucaguaucuugucccccacaaccuggaaacagaagagagaaugaaaugcuuauauuacuuauaugcuaguuuggauccaaaugcuguaaaguaaguuacuuuucaaauaacugcuguauuuucuaaggauuucguaaaauuacuucaucuuaucuaauuaguuguuauugauuggauuguugcugcuucuauaguugaaucaagaaccucagguaaauauuuauagacaaaauguuacgauuuauguucagguuauucuuauauguguaggcuuguuuggcagccaggucaguaguaggaugguuucagguguucaaauaaaugaccacgucaaaauaccuguggcuagugucuaaaacuacuggugcuuuauccuuccagacuaaauauuaagccuaauaacugaauacugauucuuuguugggugaacauauucagaucuucucuguguaagauggccauaugauuaaugguccaacuggauuauuuucagacugaaagggaucacuauugauauuuuuacuuaaauagcauaaucaaacugucccaggccaaccaggauguguggucauuucacuuuaauagauuuuuuuuuuaaaguaaauguuacaauauauacauauauuauguuguacaccaucguauauguaauuuuugucaaaaauacacaaaguaaaugagugaugucauuaagaauucugaucugaagauggaaggaucuuuucagccuagaagcuugaccauccugggcaauguagugagauucugucuuaaaaaagagagagaauuuugaguuaggaauuugacuguuugccauuguggcuucuucaaguguuccugcauuauuagauuaagacugcauuuuuaggccggacguggaggcuaaccccuguaaucccagcauuuugggaggccagggcaggcagauaauuugagguuaggaguucgagaccagccuggccaacauggugaaaccccaucucuacuaaaaauacaaaaauauuaguugggcaugguggugcacgccuguaaucccagcuacuagggaggcugaggccggagaauugcuugaacccaggaggcagauguugcagugagccgagauuaucccauuguacugcagccugggcaacagagugagacuugucucaaaaaaaaaaaaaaaaaaaagaaagaaaagaaaaaaagacugucauuuuggcagaaauucuauuacgauaguguuguaucaugguuacuaaucccuuuccuugcuuaagguuuugauguuuguuuacauuucaaaauaucugacaaagaguguuuagagauuaguaauucucagaggucaucugggcaccuggaaauauggaugggauuucugagagaagaaaaucuguguuccuggagagagaaaaguuuagaauaaacacaauaauguaaauuuggcaucuugaaucugcaucauuuuugauacuucauuuuucaaaauagucuauagugcuucauguauaugccuuagccuuuuuaauaaggccuucaugauuugaucugugucuguggaaugcuccagcuuccuuaugcuccacacacaugccuugugcuccaagcguauacauguuuuucaguuuguuuuaugucccuugcacuuugagauuuucuuuccuuguaccaaaacuuucuagcuaccuguauuuaguacaucuuucaaucccuguauuacuuauuaaucuuucuaaaccucucaaauauuuucucucauaagaaggcuuauauuuaccauuuguacuaaauuguuuuaaauccuaauaaauauauuucccgguauuuaaacuuuuagguagauguagaagaaugguguauauacagcaugcaacaagaaagguuguaaagcugaauaauuuccaguauuguuauguaauguguguuuucauauucauaacuuuacagagcucucaacgaaauguggaagugucagaacaugcuucggagccauguacgcgaacuauuggauuugcacaagcagccuacaguagguucaugauuuguuuaaauucauaguuuauuauagucacuguucagauuuucuguaguucuacguaaugaagcagggaaaaaguaucucaguuguuuuauuuuccaaaugucaguuaaauauaauuucuguaguuguccaagcuaaauuuccauuuaaaauaaauauaacaaacucuuauuuucuagugugagcaaagaaaugguguuuucuaguuuauauaaaguuuucagacacuaagaguuuauaguuaaucaauuuucaaauaauuagaauuaaauuuugagauaaaauuacauuaaacaucauauuucuuuuucacugcaugauucauggucucucaguguagagugaauaucagauaucaauccuauaaauaugccaauggcaaacuaaaaaagaaaugccauuaaauuuuugcaagguuggggaaaaaaacuuuacauuuuuacguguguucacuagaauagguguucuuaaccaggggaccauauaaacagaccccucaaggacacauggaugcuggaacaggggcgggcaaacuuuuuuuuuuuuuuuuuuuuuuuuuuuuaauacacaggaucuuacucuguugcccaggcugucgcauaguggcaugaucacagcucacugcagccucgaugucacugggcugaggugauccucccaccucagccuucugaauagcugggacuacgggugugcuccaccauacccagcuagguuuuguauguuuuuuguagaggugaguuuucaccauguuucccaggcuggucucaaaaucuugggcucaugcagucugccugccuaggccucccaaauugcuaggauuacaggugugagauacugcaccuagccuagcaaacuuugaaaauaaaucaacagauagcaaaaacauauuuugcaaggcauagagucuguggucagauauucaacccugccuuugcaaaauuagucauacacgauaaauaaaugaauggacaugacuauauuccaucgaaacuacuaacaaaaacagguagcucaugggggcauaguuuucuaacuuuugaacuaaauuauucaaauuuaguauaaaugaaaacuaauaaguaauguuuuaugggauacaggaaagggaaguacguuuuagaaaggagguuuuccugaagguauuuaaguaacgggccacaaaguagcuaacagaacucuauugcagaaaaaaaaguuucuucucuauauuuuuaguuaauuuuuuguggcauguaguuucauaguaauucugauaugauaaguuuauauguugauugcuucauugaucuuuuuucaaucuucuggcaauguaacuuuccugugaaaguuauauacuuguggguuuuuaaguaccuuccucccaacaucuccuuuccuucuauuugucuuaauaguugcuacuauguaauucuuuguuguuaguuuagcguauauaugugguaaaaccauuuuccauugagcagacugugaugaacuuuauuuuuuaacgucaugaaaaauguacaguaaugaguauugauuuuuguuagggaaauuuguuaacacauaugacuaguuguucuuuuguuucuguuuuaaauuucagucagaggcuaacuguucugccauguuuggaaaacugaugaccauagcaagugaguauguuuauuuacucacuaaacauguaguaaacguaaaugcagacaaaguauuuacccagugggacuacugauuuaauguuaaguaaaagaaaauaaucuuuaucuuaauuuuguuucuaagaaccagcuaggcugauuuucuuuuaguggcuccgcaauauuuugauggcaccuguuuuuagcuuaguagaauaguuuuuuuuuuuuccuucucuaauauugauucucuuuuaauuuuauagagaauuugccugaccccgggaaagcacaagauuuugugaagaaauuuaaccagguucucggcgaugaugagaaacuucggucucaguuggaguuauuaauuagcccaaccuguucuugcaaacaagcagauauuugugugguuaguaaaucauacuucacacuuuuucucuagcuuuacuuacagaaauauguauuuuauuaaagccuguuuuacauacagugauuuguguaaauguaacaauauugugagcucugaauuacuuuggaguauaucuauugucaaguuaauucucuauuuaccauucacucucagccacauuccaggaaaauaacuaaagaacuaagccagggagauuggucuuaggaauuuuacaagauaaaguacuuugaacuuaguagacauucauugaguaaugauaaguauuuucugaaugcuuguguacaugugcauuuucuucuuucauguauuagaauggaaauaaucgucaauaaauuaguaguaguaacauugccauauaucugguuucauuuacagauaaaguaaauuccuaucuagacuuuugucuucauucuucucuugaacucauuuaaaaccaauauucuuaaagcuaucaggagggaaaacuuaugcauucauuuauucagcuuuuuuuuuuuuuuuccugagauagucuugcuuuugucacccaggcuggaguucaguggcacaaucauaguucacuacagcguuaaaguccugugcucaugugauccuauaccccagccuucugaauagcuagaacuauuggcacacgcauccacacccagcuaaguuuuuaaauuuuuuggaggccaugcacauuggcucacaccuguaaucccagcaccuugggaguccaaggcguguggaucaccugagguugggaguucgagaccagccuagccaacuuggugaaaccccaucucuacuaaaaauacagaaauuugccagguguggugguacaugccuguaaucugagcuacucaagaggcugagacaggagaauugcuugaacucgggagguggagguuguagugagccgagaucaugccacugcacaccagccugagugacagaaugagacugucucaagaaaaggaaaaaauaaaaauuuuugucucuguguugcccaggguggucucaaacuccuucaagugauuaucucaccucacugcaaccuccaccuccuggguucagacgauucuugugccucagccuuccgaguagcugagauuacaggcaugagccaucacaucuggcuaauuuuuuguauuauuaguagagguagguuuucaccauguuggccaggcugaucuugaacuccuuaccucaggugauccacccaccucggccucccaaagugcugggguuacaggcaugagccacacacccaggcaaaagauucuugauguaucuaaaaugguauacugcaugacaacauuuuggccaaagauaagaccacauguauuuugggagucccauaauauuauaacagaacucagggugauggguguagcaaacuaccaugacacauguauaccuguguaacaaaccugcacauugugcacauguaucccauaacuuaaagcauuaaaaaaaaaaaaagauuauaacggaacugaaggauuccuaucaccuagugacaucuuggugauccugaccuggcguaggccuaggcuauuguaugugguuguaucuuaguuuugcacaaaaaaaaguuuuaaaacuuucuuuuuuuuuuuuuaaacaggguuuugcucugucacccagacuggaguucagugauguuaucauggcccacugcauccucagccuccuggguucacgugauccucucccuucaaucuccugaguagcugggacuauaggcacaugccaccaugcccagcuaauuuuuuauuuuuuguagagacaggguuucuccauguuguccaagcuggucuggaacuccugagcugaagaaaccuaccugccucagccccacaaaauauugggauuacaggugugagccaccacaugcagccaaaaaaauuuuuaauaggaagaagcuaguagaauaaggauauaaggaaagaaaccauuuuguguacagcuguacacaaaauguguuuuaagcuaaguguuacuacaaaagagucaaaaagcuaaaaaaaaaaaaaaaaaagaucaguacauuggcucacaccuguaaucucagcacuuugggaggccuaggcaggaggaucacuugaagccaggaauuugagaccaaccugggcaauauaucaaaacccccgccucuacaaaacauuaaagaaaacuagcugcacaugguggcgcacaccuguaguccugacuacuccagaggccaagaugggaggaucacuugagcccaggauuuuaagccuacagugagcuauggucacaccacugcauuccagccugggugacagaacaagauccugucuccaaaaauuuuuuuaaaagcuaaaaaaaaaaaaaaccgggccaggugugguggcucacaccuguaaucccagcacuuugggaggccgagguuggcagaucaugaggucgggagaucgagaccauccuggcuaacacggugagaccccgucucuacuaaaaauacaaaaaaaaaaaaauuagcugagcaugguggcgggcgccuguagucccagcuacucuggaggcugaggcaggagaauggugugaaccugggaggcggagcuuguaaugagcugagaucaugccacugcacuccagccugggcgacagagcgagacucugucucaaaaacaaacaaucaaacaaaaacaaacccuugaaguucaucaaguaaaaauauuacaaaaagcuaaggauaauuuaucauugaagaaagaaaaaguguuuaaauaucgugcugccuaaguguacaguguuuauaaagucuacaguaguguacuguaauguccuguuucuucacauucacucaccacuuacucacugacuuacccagaucaacuugcaguccuguaagcuucauuuaugguaagugcucuauauguagguguacuguuuuuuaucuuuuauauggcauuuuuauuauaugguuuauauuguguuuuuaucuuuuauauuuuuacccuguguuuagauaauguucaaauacacaaauaccacuguguuacaguucccuacaguauuuagcauaguaacaugcuguacaauuuuguagcauagaaguaguacgcuauaccauuuagguuugugugcgugcacucuaauguucacaugaugaaauugccuuaacaacacauuucucuuuuuuuuuuuuuuuuuuuuuuugagacggagucucacugucgcccaagcuggagugcaguggcgcgaucuuggcucacugcguucucuugccucagccucccgaguagcugggacuacaggcuccugccaccucgcccggcuaauuuuuuguauuuuuaguagagacgcgguuucaccauguuagccaggaugaucucgaucuccugaccucgugauccgcccgccucggccucccaaagugcugggauuacaggugugagccaccgugccuggccaacaacacauuucucaaaaucugucuccaccauugagugauggauaauucuuugugugugugggcagggggaggguauguauuucucuguauaagggcccugcacugcccuauuggauuuaaauaaauaauccuucucacaauguuagacauaaacgucaaguacuaugcuugggaccaggcuuauagagacaaauaagagaaauguaauuucaauuacauaugucuaacuuuguucuagaagggauuagaguugaugguuuuaaaauaacuuauaaaggauaaggacuauaauagauguauauguggagaggucuagcugcauagaacauguaucuuuuauucagcauagagaucugaauaccauuacaaauaccaauaauuaggaggacauggggaggaaaaccaauuuagggaagagaagagugggcuugucucucagggcuaugaauguggaugugccaaaugcccagacaaccucaaccuuugcacuucuuuuuuaaauuuuauuuacuuacuuauuuuuuucuuuuuuuuuugagauagggucuugcucugucacccaggcuggaguguaaugacacaaucucagcucaccguaaccucugcaucuagggcucaaaugauccuccugccucagccucccaaguagcugggauuacaggcaugcgccaucaugccugacuaauuuuuguauuuuuaguagagaugagauuucaccauguugcccaggcuggucuugaacucuuggacucaagugauccuacccaccuuggccucccaaaguagugggauuacaggcaugauccaccaugcccaauaagcuuuguacuucugagcugaguaauuugcugaaaacgcuuaaaaguuucauugacuucuuuggcauuuagaauucuaguuccagaguacuguguccugcagagaaucuacuauuauaauuagaucagacaaugaaauagcuugaaaaggcugggcgcgguggcucacuguuguaaucccaacacugugacugcaacagccacacaguauagccaaucagugcucuugauauuaggaaccagugagguagaaaugaauacugcacuugcagugguaagagcaugaguucauuauaccuucuuuccuagcucuuauauuagcauugugugacuugaguauguuauuuaacuauguguucucauacguaaagugggacuuagaauaccucccuuaggcacacaugaaaacaaaccucugcuagaguaccuuuaugaguuuguccuuuccccuaugggcuacugaauauuauuuacauauuuccucuaauauccccauuccuuuucugauguagaagaauaaagaaaaauaaugcaaauguaaaauuuaguuucucucauucuauguagcuugcauuccauccuugagaguuccuucucuguacccuaaugcguauuugucacuaccuccuuauuuucauaucucacuucucaagagguagauauuacuugauacgagaguuaguaggcauagaaaucuaauauuuucuucccucuuuguccaaguuccauuucugaaaaaucuuagcaaacauacuuugagcaaagauuaucaaaagagacguguauuuguguguggggugggggauauaaugaaugagagugagcaguggaauugaaaugugauauauagauuuacuuucccuuuagaauucagguuuuagguuucuacaccuugacccuagagaaggaccacauacuugccauagcuucagcugugcgucauaguuuaugcuccauugccccccuccccaugagagugguccccaaauuuuaauauuuuccaggaagcuuguuuauuugacauuuaaugaaacaguccuugguuugaauaucguuuacuaccaguaugaccuuuaguaaguuacucaguauuuucaagccuccuuauucauuuucuucaccuauaaauauuaucaaccucauagaauuuuuaaaagaauaauguaaaaugaaauuuuauauguggccuaaugcagggccccccugcacugccuacaggguuucaauaaauggucauuuuuauaggucuuacccuuacaaagaguaggcaucuuuaaaauagguuaugauguagcaucaugaaucucuccaucuuuuaaccaaguuucaacaugagugguuuauggacuacacuuuuaaaaacccuccucuaccuaguuaccuggauaugcauuauaucuucagaaguccaaauaucuucuuucuugaucaagcacacacuguuauaauucacugcaugauuaaauaaauuuuauaauacaugguuucucauggagcuugcagaauaagugacagaggcugacaaauauuuccauugaauugugugcuuugguaaaauaaagaagcauuacucauuccaggcagggguggaaauagguccaggaauggcuucuucuagaauaagugacuccuaaguugagucuuaaaggaugaauaggaauuagaccauugugugaagaaugacugcuauauuuucaguuuggcugacuggauaucagaggagaugcuuuagggaagaagauagcgucuuugcaguuguguucagaaguguugggauucaggccugguucuauauauuagcacaauuacaucacuuggaggagguagagaagaaaugaaagagaagacaaaucugagaauggccucugagaauggucaggcuggucucaaaacuccugaccucaaacgauccgucaccucggccucccaaagugcugggauuauaggcaugagccacugcacccggccuaauaccauaaucuuugagcuuaaauggauaguuaacuuuuuuuuguuuuuuguuuuuuguuuugagacagagucugugcagcugugcaaucucagguggucacugcaaccucugccuaccaggcucaagugaucccccccaccucagccuccugaguagcugggaccccaggcaugcaccaucacgccuggcuaauuuuuuguauuuuuugguagaaacaggguuuugccauguuuuccagacuggugucaaacucuugagcucaggcaauccaccugccuuggccucccaaagugcuuugauuacaggcaugagccacugcuccuggcugagaguuacuuuuauuauugggguuaucuaucagccuuccauaacuguaugucuaacuuauaaauaaaauucuaaggguguacagaguucucauuuauccuccaccuauguucuuccagaacugaaaaauuuugcaaguauauauauauauauguacgaauauguguuucuguuucuuuugagauggaguugcucuuguuccccaggcuggagugcaauggcacgaucucagcucaccgcagccuccgccucccagguucaagcaauucuccugccucagccucccgaguagcugggauuacaggcaugcgccaccaagcccggcugauuuuguauuuuuaauagagaugggguuucuccauguuggucaggcuggucucgaacuccugaccucaggugauccgcccgccucagccucccaaagugcugggauuacaggcgugagccaccugcgcccggccugaauauguauuuuuuaagaaacaaauuaacuggccaggcacaguggcucaugccuauaaucccagcauuuugggaggccgaggcggguuggaucaccugaguucgggaguucgagaccagccuggccaacaugacgaaaccccaugucuacuaaaaauauaaaauuagccgggcaugguggcgugcauguuuaaacccagcugcuauggaggcugaggcaggagaguuguuugaaccugggaagcggagguugcagugagccaagauugcaccauugcauuccagccugagugacugacagagcgagacuccagcucaaaaaaaaaaauaacugaaacaaaacacaauguucugucaaauuaugaaauaauuaaaaccaauaaagcauacccauaaaaguacaaauuguuuuuauucuaaauuagaguauuaaaaagguugccauaguccaggugugugguggcucacgccuguaaucccagcacuuugggaggucgaggcagguggaucacuugaggucaggaguucaagaccagccuggccaacauggugaagccccgucucuacaaaaauaacaaaaauuagcugggcauggaggcacgugccuguaaucccagcuacucuggagccugaggcaggagaaucauuugaacccaggagguggagguugcagugagccgagaucgugccacugcacuguagccuggugacagaguuagacucgucucaaaaaaaaaaaaguugcuauaucaaccaauaauuucaucaaagaauugugaggcaaggcuguguucacucagaaaccacaucauccacuucuuuucucugcuguccagauuuuucagucauugcucgggguguaaaaauuuuagucagggucuagagcagacaauucuuaaccacuuaugcugguuuugaauauuucaguuccuuagucauuuuucuuuucaaaaauaugaaagcaaaucacguuuuugguaaaacuccuuucuuucuauagagagaaauagcccggaaacuugcaaauccuaagcaaccaacaaauccuuuucuagagauggucaaauuucuguuggaaagaaucgcaccugugcacauugauucagaagccauaagguaagccaagaaguauauucgcucaaaaauaaauaauaaucugcaacgacaauguuguuaauuuaaauucugggcuccuaaagauaccugaaaaccucuguaugucucuuuuuaaucacaggguuguacaucauucaaguugaagggaaagccuucucauuuuaugaucuuuggcuuuauauaaugcuuucuguuuuuaaagaguucuuauguuuauuuuuagcuuaugcguucucauuaaagaaaacuuagaacaaagagaaagacagaaaaaggaauauuuuagaucuguguggcuguugaccaaccucugaguuuucuuaagcauuuuaauggcccuguaauauucuguaguacauauuauaccacuguucauuugaugugugagaacagaaugguauguuggaaagaggagaggauuaucuuuaggcaaauuugguuucaaaacauaagucuacuuuguggcuuuggauugucuuugaauuuucauuuauuuucaacuuuaauaugggcauaaaaucuuguuggaugauuauguuaauuugagguaauauauaaaagguaagcagccuggcaucauagacauuaguuaagagcuauugauuuuuuauuacguauucucaugauuucagacuuuucaaacgucugguaaugcuuuucucuugcaccaaucauuuuuccaguagauaagcuauauaucuuuccauauucaguuacuaugcagcacuuguugguucuuuuuccaaacagccuagaauucagagaucaguuccaguacccaagcuucgcuguuuauuucaccuuaggugaaucacugauguggcuguauugaaaugcugauuauauucauuugcuagggcuuucauaacaaaauaccccagugccuggccugaacaaaagaaauuuauuuucucacaguucuggagguguaagccugagauccaagguaucagcaauuuuuaauuuuuuuccugaagccucucaucuucauaaacagauggcuuccuucucacuguguccucuuguggucuuuucucugugcacgcagcaugucuauguccuaaucucuugcaggaacaauagucauauuggauuaggccccacccauucaaucuuauuuuaccuugauuaucucuuuaaaggcccuaucucuaaauacagucacauucugagauacuggggauuagaauucauaugaauuugggagaaacacaugucagcccauaacauaauaaauguacauauauucaggcuaugucugauaauuuaauacauuuauacaauuugugaagaucaaaucaguguauuggugauauacaucaccuuaaauauucaucuuuaugcuagaaacauucaaauucucuuuagcuauuaaacuguagucacucuaccgaucucuaaaacacuagucguucuauaucuauuaauuaaccucucuucauuccgccuuucucacccuucccagcuucuuguaacuaccagucuacugugucaucaugagguucacauuuuuagcucucaaauaugacugcgaauaugcaauauuuguuuuuuuuuuguuguucuuggcuuguuuuauuuaacauaaugagcuccauuugcauacauguugcuacaaauggcaggauuucauucuuuuuuuauggcugaauaauuuuucauuguacauauauaccacauuuucuuucuucguugaugugcacuuagguucauuccauauuuggcuauugugaauagugacacaauaaacauaggacugcagauaucucuucaauauauuaauuuccuuuuuaaaaaauauauacccaguaguggaauugcuagaucauaugguagauccaguuuuaguuuuuugaggaaccuccauacaguuuuccuuaguggcuaugcuaauuuacauuuccaacaacaguguaugaggguucacuuuuuucuacauccucgccggcauccguuauucccugucuuguugauaaaaagcccuuuuuuuuuuuuuuuuuuuuuuuugccggagucuugcucugucaccagcuggagugcaguggcgccaucuuggcucacugcaaucuucaccucccagguucacgcaguucugcgucagccucccgaguagcuaggacuacaggugcaugccaccaugcccagcuaauuuuuguuuuuuaguagagaccggguuucaccauguuggccaggauggucucaaucucuugaccucgugaucugcccgccucagccucccaaagugcugggauuacaggcgugagccacugcaccuggccuguuuucccacuuuuaaauuggauuuuuuuguaugguuuugauuuuuuguuugucugguguuuuuuuguuuuguuuuguuuuguuuuguuauuuugcuauugaguuguuugaacuccuuacauguucugguuauuaauccguugacacagggauaauuugcaaauauuuucucauucuguggguugucucuucgcuuuuuuuauugcucccuuagcugugcagaaccauuuuagcuuaauguaauccuauuuuucuauuuuugcuuuaguugccuguacuuuugggauguuaacacaaacaaacuuggcucagaucacugucuuuaagcauuauccuagcauuuucugcuaguaguuucauccacuaggucuuaauccauuuugauuugauuuuuuuagagggugagggauaggggucuaucacugaugaacauagauacaaaaauccucaaaaauacuagcaaccugcuuucaauaacacauuaaaaauauucaucacaauaaaguggaauucaucccagggaugcagagaugguucauaaaucauauaucgauaaacaugauucaucauauuaauagaaccaagaauaaaaaccguauagucauuuuaauagguucugaaaaaacauucaauaaaauucaacauuacuuuaugauaaauacccucaacaaaauagguauagagggaacauaccucaaaauaauaaaggccauaugugacacacccacacugaacauugugcugaaugggguaaauugaaaggcuuucaucuaauaccuggaauaagauauggaagccacuucuaccaccuuuauucaacaaauuacuggaaguccuggcuagagcaauuagucaaaagaaaagaaggccauccaaauuuagcaagaaggaagucaaauuagccuuguucgcagaugacauuaucacagaaaaagcuaaagacuccaccgaaaaacuguuuugaacagauaaaugaauucaguauaguugcaggauacaaaaucaacauacaaaacucaguagcaucuacguaugccgacagcaaacaauccgaaaaaucaagaaagcaaucuuauuuauaauagcuacaaagaauauuaaauaccuaauaaucaacuuaagcaaauaagugaaagaucuauuacaagaaauacuuuaaaacgcugauggaggaaauuaacggaaacacacaaaaaauggaaagauauuccaugcucgugaaauggaaaaauuaaaaaaaaauuuuuuuuuuuuugagaugguguuucacucuuguugcccaggcuggagugcaauggcgcgaucuuggcucaccacagccuccaccuccuguguucgagcaauucuccugccucagccucccaaguagccaugauuacaguuaugcgccacugcaccugccuaauuuuguauuuuuaguagagaugggguuucuccauguuggucgggcuggucucaaacucccaaccucaggugauccgcccacuucggccucccaaagugcuggaauuacaggugugagccaccccgcccggccaaaaucaauauuguuaaaaugacaguacuacucaaaguaauuuacaaauuaaaugcaauaucuaucaaaauacaaaugacauucuucacagaaauagaaaaaacaauccuaacauuuacauggaaccacaaaagacucaaauagccaaagcaauaugaggaaagagaacaaaagcuggagccaucaaacuaccugacuuuauacuacaaaacuacaguaaccaaaucaacaugauacuggcauaaaaacuagacacaucuaaaggaacagaauugagaacccagauacauauuggugcuuuuuuggcccgcucauuucugacagaggugucaagaacauacaaggagggaagggauagucucuacaauaaauugugguaggaaaacugauuagcagaagaaugaaacuagaccgcuaucucucaucucucaacauacaaaaaaaucaaaauuggcuuuuuuuucuuucucuuuuuuugagacaaggucuugcucugucacccaggcuggaguacaguggcaugaucauaguucacugcagccuugaccuccugggcucaggugaugcuccucccucagccuccagaguagaugggaccauaggcacaugccaccacaacuggcuaauuuugugaggguguuuuuuuuuguuuguuuuuuguuugcuuuguuuugguuuugguagagacaggguuucaccaugccguccaggcuggucucgaacucuuggaccuaagcgauccacccacuucggccuccaaaaguguugggauuacaggcgugagccacuauacgcagcccuuuuuuauuaagauuuucuuuucuuuuucucuuuacuuuuuuggauacacgaucucacucugucgcccaggcugaaaugcacgauccuggcucacuguuguguaggcucaaacgaucucagaccucagccuccugaguagguggaacuauaggugugcgucaccaugcucagcuaauuuuuuuaaaaguucuuuaguagagaagcaguuuugccguguugcccaggcuggucucgagcuccugggcacaagugaucugcccaccuuggccuccaaaaugcugguauuucaggcaugagccaccaugccgaaguuuuuuuucucuucucuucucuucuccuuucuuuugucuuuuucuuuuccuuucuuuuuuuuuuuuuuuuuuuaagaaggaaucuugcucugucaccugggcuggagugugcagugucacgaucucagcucacugccaccucugccucccggguucggccucccgaguagcuguaucuacaggugugcgccaccaugcuagguuaauuuuuuguauuuuuaguagagcaggguuucaccaucuuggccaggcuggucucgagcuccugugcucaagcaaucugcccaccucggccucccaaauuucugggauuucaggcaugagccacugcaccuggccuagaauuuugaaagaaaggauugggguuaauauaaaaucauucuaaauauaaucaauuuccccccuauacauauguccauacaccuugacauaugugugcuacaguuaguuaauggucuauaggaaguagaugaaaaugaaguagucauuguaaugauggcuggaacccaggugaaaguaaaauuuuaaaaaggaaaagguugaggacugaaucgugagggaaauuagcaauuaagaggcuggcagaagauaacggacuuaaauuuucuuuuuaaguuuugagcagacauagucaaaagcagaaaauugggaaagaguguuaucacagaaaccaaagaggggcuaaggaggggucagaugauauccagaaguugauuaaauacuaagaaucaucgaauggauuaggaaaugggaaaaaaucacaaugaacagagcaguuucugugcgguagcaaggacaaagccagaaugccauggauucagaaaggcauaggacaguccuuuccaacauguacaucgugguacacagagaaggugaucaguauuacuuaggcagagaagacuacugagucuguuuuuuacuggcccagcucaauagaaagccacuagguaccacuuggcuacacugaggcuugagcauguuaaagggauacauagccuugucacccuucuaaacccugcuuaggagauaaauugacagcaccaguggggacaaucaguguagacagcgccaaucuuggauaaaaagcaaaggaggccaggcaugguggcucaugcguguaaucccagcacuuugggaggccgaggcgggcagaucacgaggucaggaguuugagacuagccugaccaacauggugaaaccccgucccuacuaaaaaugcaaaaauuagccugacgugguggcacgcaacuguaaucccagcuacucaggaggcugaggcuggagaaucacuugaaccuaggaggcggagguugcagugacccaagaucacauuauugcacuccagccugggugacagagcgagacucaaaaaaaaaaaagcaaaggagaaggcuggguguggugacucacgccagaaaucccagcacuuugggaggcggagguggguggaucacuugaguccaggaguuagaaaccagccuaggcaguauggcaaaacccuaucucuacaaaaauacagaaauuagcaggauaccauggcaugcgccuguggucccagcuaugugggaggcugagguggaagaaugagcccaggaagcagagauugcagugagcugagaucacggcacuucacucucuccugggcaacagaaugagacugugucucaaaaaaagacaaaaacaaaaaaacugggcuaaagucagaguuugagccucaaaagaaaaguaacagaaaaauaagaugauggaaacggaguaagcuugaagaagaaucuucugcuguuguuuuugacuaaauaauuuugaauauuuaaauaccuugaaaaggugcuagcugaaggcugggugugguggcucacgccuguaaucccaacacuuugggaggccgaagugggcggaucaccugcggucaggaguucaagaccagccuggccaacauggugaaaccccauaucuacuaaaaguacaaaaauuagccaggugugguggugcgugccuguaaucccagcuacucgggaggcugaggcaugagaaucacuugaaccugggaggcggaaguugcagugagcugaggucgcaccauugcacuccagccugggcaaaaagugagacuccaucuucuucuuuuuuuaaaaaaaaagaugcuaguugaaaagaagacagauugcagauaagggaaggggaauauagguaugagggagcagcauuccuaaggaagcagagcaagaagaaggacaucuuaaccuaugacaugacaaaauaauacacacaaauuagaggagguuagaagauuagguauggaaaauuagaagaguuuucacucaaggcguccauuacuacucuuccuucuguuaaagaugaaguugccaaugggaguauuuagacuucguuuagaauggugaagauuuguaacagugguuguauagcauagacuucccaagcaguuuugaagaggcacuugagaucgucuuuuucaucaugauagcccugugaaauauauauuauuuauuuaauuuauaaaagaggaaaaauacuuuauaagaggaaggacugugaaccugguuugaagacuuugcucuuucgcuuauagcuccuugacgcauacuggugauuaccaacauuacaaugauagcagagauuaugucucucauuucauacuguauuucucagguagaccauaagacuuggcacaugacagguaguuaauaaauacucaugaaauaaucgugugcauggaaccuaucacauguauuuacauauuuauaaauuuuuuugaaacacacuuguaauuuuguuaaauucaagcaauguugacuaggauuucuuaauaaaaagcucaauuuggaauuauuuucucaaauugaaugaaucuuuaaaauacaaagucagagcuagaauuuccagaaaacauauaggauaggcaaagauuucuuagagggaacauaauagccacagacugggaggaaauacuugaaaagcauguauuugguaaaggauuauauccaggcuauauaaggaacuacucaauaagacagaugacucaguuuuaaaaugggcauauuugaacagguacuaguuaagacgguaaauaagcacaagaaaggacaguuaguauuaauacucauuugggaaaugcaaauucagauuuuuacauuuuuauuuuauuuuguuuuauuuauuuauucuuuuugagacagagucuggcucugucacccagacuggguaauuuauaaaggaaagagguuuuaaugaacuugcaguuccacgugguuggggaggccucacaaucacaguggaagaugaagcaagagcaaagugacaucuuacauggugacaggcaagagaguaugugcaggggaacuccccuuuauaaaaccaucagaucuccugagauuuauucaguaccacaagaacaauauggaggaaacugcccccauguucaguuaucuaccuggccccgcccuuggcauguggggcuuauuacaguucaaagugagauuugaguggggacacagccaaacccuaugaaauuguaugauuucauuaauaugaaauguucagaauaggcaaguguuuaggggagaaaauagauuaguaaaugccuagggcuggagggaguaauggugaaugaguuccugcuaacagguaagggguuugacuuaggauagugaugggauguucuacaguuaggugguacaaccuugugaauauaguaaacaccauugaguuguacauuuuaauucagggaauugugugguauauuauacuuuaaguuaauguuuauacacauauacagcaauuuguuuuuuuaauguuaucagauuaacugaagauaaugaauuuuaaaauaauucuugugauguaagagggaaaggaaaguaagugcuaaacuuaguuuaaacuucaacaucuguaaguuaauacagccauuauggagaacaguauggaggguccucaaaaaaaaaaaacuaaaaaauacaacuaccauaugauccagcaaucccacuacuagguauacauccaaaagaaauaaguuuaucagggauauccguauacucauuauuauugcagcauuauugacaauagccaagauuugguaucacccuguguccaaggaaugaauggguaaagaaaauaugguacauaaauaaauggaauacuauucggccauaaaaaaaagaaugaaaugcugucauuugcagcaauaugaauggcauuggaggacauuauguuaagugaaaugagccaggaacaggaaguuaaauaccagauguucucacugguagguggaagcuaaaaaaaaaaaguagaucucucagaagcaaagaacagaacagaggaaacaagaagcuggaaaagguagugggaagggaggauuagggagaaauacaaaauuacaaaaaaggauacaaaaucacagcuagauggguggaugaauucuaguguuccauagcacaguaggaugacuauaguuaacaauaacauaguuucaaauagcuaggacaauauugaauguucccaacacaaagaaaugauaaguguuuaagauaauggauguguuaauuauccugaucugaucaccaugcauuauaugucuggaaacaucacuguguaccccaugaauauuuauaauuuuuguuaauuuuuuauaagugaaaagaauuucaacaucugcauccuaugcauauuugguacuuaaauuuuuuuuaaugaauacuuugacauaacaccaaaggaaaaaaaaauuagccaaaaucuuguuuugaacauuuguaauaauaauugaauguucucauaauaggguaauaucuucuucaguuuacugaucucaaaaccagaagucacauuuguuuuuacuuaaaauaguaccauguugcuacaucaucugauuuuuauugaccagauaauauucuauuuccuggugguagguauuuugaaaaacuaauuccuuaauuuuugacaauuaaauuguuccuaauuaaugaaucuuuauaaauacagcaugaugcuuccaaugacuugcuucuuugcuguaaguuuauagaaauaaaguuacugauucaguaaauuaucagugauuaauucauuuguccauguguauguuuauuauuuguauuuuuuugagucaguugucauugcucacuuagcaacuacuauauuauuauuuuucuuaaaacugaaaaugaucucuguauauauggaaaugaauauuaaauuacuuaugugaauauauuaccagagugcugugucauuuaauuuuaguuuuguuauuuuuuagaagaguuacucuuauacauuaaguuuuuuagggggauaaacuaaguagaaguuuaguuaucaaguagaggacaagguugaacuuuuuucccccacagaaacuccuuugaauuuaauauuuuaagguucuauauauguucugucacagugugauuaggauauaguuacuacuacagugguuacugauuuauauuuucuucuuuuuauagugcacuagugaaauugaugaauaagucaauagaggggacagcagaugaugaagaggaggguguaaguccagauacagcuauccguucaggacuugaacuucuuaagguauuuuugaaacaguuuuguugccauguauuuccguggggucauaauuugccuucccuucaggauaugcaagagucaggcuuauuucacaggaaacuauuugaaagauuuaaaacuuguguuggaaauuagaugauguaaaaguaauguuuuuacaacauaauauaauaauguaauuauuuuacauuauaaauuaauauuuguuucacuguuuaucauuuccaugccuucuaugcuugguagugauuacuguacaaucuauucuuaacuuaguaauagcaagaugugacuuuagacuuuguggacaggguaugugacuaaaucuagaggagggaauaucaucauuaaagggaguauuucuugguauauuugugggauucuugggagacuggcaugacuagaaaaaaggggugcuuuggggaaugaugggagacaagguugguuccagauugucgagugccacuggguaagaaagguagugucacgggcuuuuaaccuggcuuacaaccagcugcagcccuugauagagcuuucauuggauugaguaaaagaagggaagaaauugaaggcaaagagacaugauaccacugugacauacaggagaagagacaaaccagugcaauggauguuagauagaaaaagaaugaugggaucauauuccaagggucuuaaauaucauuucauucagcugggcucggcagcucaugccuguaaccccagcacuuugggaggccgaggcgggcagaucacaaggucaagagaucgagaccauccuggccaacauggggaaaccccgucucuacuaaaaauacaaaaauuagguagacgugguggcacacgccuguagucacagcuacuucggaggcugaggcaggagaaucacuggaacccaggagguggagguugcagugagcugagaucacaccacugcacuccagcuuggcgucagagugagacugucgaaaaagaaaagaaaaaaaaaucauuucauuaauagaauugauaugaugccucaugaauaagauuuuaauuguuuuuaguaauugaguuguauuuuuaaguuguuuuaaaagugaaaccaccuuuaagguaacauuuuuuaauagauugcuuuuuuuuguuuguuuguuugagauggagucuugcucuguugcccaggcuggagugcaguggcaugaucucggcucacugcaagcuccgccucccagguucacgccauucuccugccucagccucccaaguagccgggacuacaggcucccgccaccaugccuggcuaauuuuuuuuguauuuuuaguagagaugggguuucaccauguuagccaggauggucucgaucuccugaccuugugaucagcccgcuucggccucccaaagugcugggauuacagacgugagccaccgcgcccggccaguagauugcuuuuuauuacauuuuucuaauuuaauucuccaauuuucuguaaauaauuaaaaccacguaaguaaauauuaucacuccaaaccuugccaagugagacagugucuacacuuaaugaccauuaaauaagugcuuauugaaaaauuaaugaagaccaucugcucauuccccuuucucccugcuucucuauuuuccuaaucuugauacuacacuaacugaauuguuucuacuuuauggaagguuaacucuuuagacauguaucuaacuugcuaaaaguuauuuaaggacaggcucgugcugguguuauaauaagggaauaauuauauauuguaaucauaauuaaaaguucacaauaguggcuucuuuguugauaauuauguugagugauagauuucacuucagauauuuuuuuggcuggguacaaugguuuacgccuguaaucccagccaagacaggaagaucucuugagcacagggguuggagaccagccugggcaacauagcuagaccucaucucuacaaaaaaaacaaaaaauuuagccgggcaugguggugcaccuguagucucagcucaggagacugaggugggagguugagaccccagugagcugugacauuccacuguacucuagccuaggugacagagugaaauccugucucaaaaaaagaaaaaaaaaaauucucauagauuaucuuuuugccagucaaagaaagcucugaguuugcauuuuguuuacguuacacaaagauugagucauuacguauggagguuuuaucucaaguaagcauuccuucaccuaaauacaauauauuuauaaacugauaauaguuauuaauauuguaaaucacauuccauaaaaaaggagccauguguuuuguguucuaaguagcagaguagacuaagaggugaagaagaaaauaggacaaaggcugucuguuaguugugucaaggaauaacuggaagcuaccacaccauacaguauuucugauuagccauaacuaacugcaaggacggcuaggagauguaucucuauucuguguagcuagcauauuuaccccagaauuuaauuuuuuuuuucuuuugcgggaaguaauucuuuuuuaauggauuaaaaccauugucuguacuucuaaagcuguaucuguuuuuucagguucugucuuuuacacauccuaccucguuccacucugcagagacauaugaguccuuguuacagugccuaagaauggaggaugacaagguagcagaagcugcuauucaaauuuuuagaaauacaggucacaaaauagaaacagaccuuccccagauacgaucgugaguacauuuuuucucccgugguaaauacaaaaguuucuaaguaugggaaccauaaaaucauuguuuuccuucuguguaggaagauaggagggaagaaagacaacuuugauuuagaagcuacuuuucuguguccuccucugcuuugucuuucccuugcuucacaccccucucccaccauuagaaugcaggcagcagaauaaacugaaacuacauguuuguuuauaacaaaaguauuuuaagauauuaagaaucaaaaguuaucacagaauuuaguguuuuauuauauuuaugacuaaugucuuucuaauccauguauauucaucuuuuuuucuauaaauggguuauaaauucaauaacugucacuuugcuauccuaccaaaaaauggggcaaauaguucacuuuggcaucuuaaaaagguuaaggugaaacuugugcugagauguuauauuuagacuuaaaauaugcagaagacaucuuuugaaggaaacaauacauugcaaauggcaguugaaucauauguucaggguauuggcaauuaguucagaguauauucaacuacauaccauuuuccucacaugauaaucauagaacaagcagucuccugaaguuuuuauuaaauuugugagcuaauaguuuaacuugugaaauaauucaguguccauuguacauucucuucauucuccgcauuguucuggcuaauaauaaaaaguuaccacaauuagucccugcccucaaggaguuuauagacuagaaauaauaaauuuuauacauuauuagaaaaagaucacugacacaauaggauaguuuuugaugaguuuuucaagggaggaaauccuauacauuuuuucaaggcaaagaaacuauucuuagaggaauucuaccccaaaggacacaguugaaaaugagcauagguggaagaguuaacuuuggaugugaggaauaaaauaccuuauucauaagaccaauggagaagaaaggagauaaucacuggaaagcagaaaagcacaaugcuaaagaccucaauaacaacucugauggcaucacuagauuauacugcucuagaaaaaacaagaagaaagguuaaaguugacuuucuguauuauuuuauuuggcuaauaauaauaauacauuuaacaacaguuugauugaaacuaucuuccuuugucauucaccaguguuauaagaaaucucagucugguaaauggaauggugaaagacuaaacagauaggagagaggaaagacaucuuccauuuagaagcauagucaauacucagucaaggaagucuguuuggucauggacaucccuaucucauaauuccaaaguccauagaggcaaacuucaggcauauuuauacaugucaaaucagauucauaccaacuagcauauguucccauuuuugguuaaagugcauggccuggagccugcaguauagguuucauauguagccuuccauuaucauaagagggcauugucacccuugcauuugaugccacuaacuuuauaaaauaggcucuucucuaauaacauuaaauauaugacaaauaucuuuccuuaaauguuuguuucguuuuaucaauuuuauucugauuauaaaaauacuuacguucauuguagcaaacugaaacuagaaaaaauauaacgaaauagucaccauuaacauuugauauauauacuuucuaugaauguucaucuacuagauguguuugucuauuuuuuauaaguucauauaugcacacuauuuucuucauucuaccuaaugcuuuuucaugucaucaacauuuaauuuuugaagaaugcuuuauguuuuucugucauccuaaaagaagacuguuuuaguuuacucuucauugucaguguagagguuaaguauguggauuuugaaagaaaugcuaauuuucaaaucccaacucccaguuuccuagcuucgucaucuuaggaggcuuaaauaacaucuuugugcuuuaauuuucucaucuguguaaugacuaugauagucuucuuuggguggaugugaacauuaguugaauuaauccaugcggaaauaccuagaauggugccuggcacauaauaguuagauauuuuuauugccauucuacugauauauauguagcuguaucuuugcauacuuucuuucacuaguauuauuucagcuguuuaauacaacuuggccuuuugcuacucucuuucuguagcuacuuugaaauaacugaaggggauuauaaaagggaauugaaaaauuagcaauauugcuacuuagaagguaaaugcaaaaauaugucaugggguaagcuuuagauuaugaauuaaggguugcuuguuauuuugcauauuugugagguaacuuuaaaauaaaaauugucuccugaaguaggcuuuuucuugaggcauuguauuucuugguuuauacuugggggcagagauggagcuuuuuuacaacuuucuuuagaucagauaauuuuuaagagagccuucucuacuagcauccauccauauaggggaaguggaagucaaccaaaggaauacuuguugguuuauggguuuaagaaaaaaaaacaacuauauuauuuuuugcaggaccuuaauucccauuuuacaucaaaaagcaaagagggguacuccacaccaagcaaaacaggcugugcacuguauacacgccauauucacaaauaaagaaguccagcuugcacagauuuuugagguauaucuaauauauagguuguguuuauauuggucuuuauuuuuuaagcucuauaguuugaugaagauggaagcuagauuuuuuaaagcuguuuauaugaaguccuaccuuagacuauaaauuccuugugagcaaggauucugucuauuuuaugugguacugcauucccagccuguagaucagauuauauguucaaacaccucauauugaaggguuuugugguuuuuguuuuuuaguuuguuuuugagauaaaguuucacuuucucaccagugcuggaguacagugaugcaaucucugcucacugcagccccgaauuccuagguucaagcaguccuucugccucagccucccaaguagcugagaguacaggcaccaccaccaugccuagcuaauuuuuggauuuuuuuauagagaugggguuuugccauguugcccaggcuggucucaaacuccuggacugaagcgauccacccacuucagucuuucaaagugcuaggauuacacacaugagccaccacaccuagccuuauguguuuauguuagaacauuuuacuuaauuuuagccuuauugguucaguggugcauuuauccucggaaaguauuaguagauaauuuugaacaauccaguuuaaaguaccuaagaacccuaccugaaaauuaauccuguuucccuuuuuuuuacauauaaugacuggccucauuuuacuauuagaaauguauuccuauuaucauaaauuggagauagugugaccaaaacccagugaacucuuacuuuguaugauuuaaggucauuuaaaaugcuuccacaggguaagaaaaccacugguauagcaaauccauuguuguagauuagucaaaaauaaugcugauuugaugaagcaaaaauguuuuucuuuaaacuucuuuuuguuggauuuuauuuuuucuuuuaucuuuuuucuacauucuuucaaucuugcuaaauuuuaguaggugaauuaagaaccaggugucuuaacaugguugaaguuaguuaugaucguauuagagaagauugguuugggcaugguaaauucaggaggacucaggaaaauguacuguuucaguagagugucuagauauuuaucaaacaaauugguaauuuugucuguuuuauuuuuauagccacucaguaggagucugaaugcugaugugccagaacaacuuauaacuccauuaguuucauugggccacauuucuauguuagcaccagaucaguuugcuuccccaaugaaaucuguaguagcaaauuuuauugugaaagaucugcuaaugaaugacaggguaaguuucucauuuaauuaaauugagaaucaugagauuaaggcuguuuacaucuucaucacagaaacacuucuguuucuguguaauucucuuuuucuuuuaaauuauucuauauugguucuacuuauuuuuuauuuauuuaaauucgaaacuacuuccuuauuucaugguagcuauuacuacuagaauuucacacuuaagaaacaaaaauuagaacacgggauuggugaaucaugaaaguuacauauaaguaaaagcuauuuuccugacccucaaaagacaguuuaucauuuucuggaauguuagaauuggguuauuuuuguuuuuuguuuugaagacaagagucucgcucugugccucaggcuggaaugcaguggcacgaucucggcucacugcaaccuuggccuccucucauuccucagccucccaaguagcugggauuacaggugccugucaccacgccuggcuaauuuuuguguuuuuaguagagacgggguuucgcuauguuggccaggcuuauauugaacuccugaccucaggugauccguccgccuuggccucuccaagugcugggauuacaggugugagccaccaugccgggcuaaaauuuguuuuaucaaacauuguuagaaauguaaguggauuagccggguguggugacggcagcuguaauccuagcuacucaggaggcugaggcaggagaaucacuugaacccagaaggcagagguugcagugagccaugauugcacaguugcacuccagccuggacaacaagagcgaaacucugucucaaaaaaaaaaaaaaaaaaaaaguaaguggacuugaauuugacuaauuuuuaagauaauacacuguacuuuuggcacuagauuuauugaugucugugugcucugauuuauuaccucuggguuggaauguauagauugaaaagacuccccaaaugauuucggaaacacaccuugauuaagagucacuacuggcagggcuugguggcucacgccuguaauccuagcacuuugaggggccgagguggguggaucaccugaggucaggaguucaagaccagccuagccaacauggugaaacccugucucuacuaaaaauacaaaaaaauuagccgggcuugguggcgagugccuguaaucccagcuauucgggaggcugaggcaggagaaucgcuugaacccgggaggcagagguugcagugagccaagauugcaccauugcacuccagccuaggcgacaagagcaagacugucucaaaaaaauaaauaaauaaauaaaagaaucacugcuuuaccaaauggaucuaaauuaaaucuguuguuauugaauaaagacacagauaugcuggaucauuguggaugacuuucauuuaaguguuaguuugccacaaauccagcuuauccaaaguuccuaacucucacauguuucgguaaucuugaggccucaguaucaggaacuuaaagacaccugcuagugccccuucuguauuuguaccaccuuccacuuuugaacgcagcagacaagaagagaagaacguggccuaagucucauuuucuacccuuacauauccuugcuguuauuuuuacuuucgauagaugugguuuucaacaaaugugaaauuuaagauaccucuuaaaugaugauuguugauagauuguguuuucagacggucuuuuuuuauggugauaaacuauacauaguaucaaauuugcuauuuuuaaguguuaaaauucacuaacauaauagccacauuguuaccuaaucaucaccaccccauccaucuccagaauuuuuuaucaccccauacagaaacucuguacccauuaagcaacaacucuccauugcccucuguucuaccuucugacucuaugacuaccuauucuagguaucucuuauaugauauuuguccuuuugugucuguuguauuucacuuagcauguucucagggcucuuccauguuguaguauguaucagaauguuguuccuuuuguggcuaagcaguguucuuuuauauguauauuuuuguuuguauauaucccacauuuuuuuguugauugguggacacuuggguugcuucuacguguuggcuguugugaauaaugcugauauaaacauuuauguuccuguucucccauuucuuggguauauaucuaggaauaacauuguuggguuacaugucauuuuccuuuuuaaaaaagcaacagccauacuaguggauaagaagugauaucucauugugguuuugauuugcauuuuccugaugaaugaugaugucaaggauauuuuuugugugcuuauugacuaccuguauaucuucuuuggagagcuguguauuaaauuccuucccccaccccacucuuauuuuauuuuauuuuauuuuauuuuauuuugagacauggucucacucugucacccaggcuggggugcacuagcgcaaccuuggcucaucacaaccuccgcuucccaggcucaagcaauaucuccugccucagccuccugaguagcugggacuaucagcacacgccaccaugccuggcuaauuuuuguauuuuuuuauacagacaggguuucgccauguugcccaugcugccuucacccacuuuuaguuggguugcuucuuguugaguuuuaagaguuauuuacauuuucuguauauuaaaccuuugucagcuauuuaccagauccaagaucaugaagauuucuuccuaugucaucuuuucagaguuuuaugguuuuagcuauuaaauugagauauuugauuaauucugaguuaauucuuauauguauuaacaaucuaguuucuuuuuuuguuuguguguuugcuucuuguggauauccaggaguuuuuuuguuuugcuuuuguguuuuugagauggagucucacucuguagcccagccuggagugagguggcgcaaugucagcucacugcaaccucugccuccuagguucaagcaguucuccagccucagccucccgaguagcugagacuacaggcaugcaccaccaugcccaacuaauuuuuuuguguuuuuagaagaggcaggguuuugccauguuagccaggcuggucucaaacuccugaccucaagugauccaccugccucauccccccauagugcugggauuacaggcuugacccucugcacccggcugaauauccaguuuuucuagcaccauuuguugaagagacuguucuuucacuaaagauggucuuggcauccuuugucaaaaaugaauuaccauauaugcaaggguuuucugaguucucuauuccauuagucuauaugucuauccuugccaguaccagccacacugucuugauuacuguagguuuuauaguaaguuucaaaauugggaaguaugagucuucuaacuuuguccuuuuccaagcucugguuggugauguucccguagguuucucagaggcuguguugaucaacaugaaaaacuuaaucagcaaaaacauaaauuuuuuuuuucaugcuaauagcuaaauuuauucaauugucuauagucaacaggugaaaagaauggaaaacuguggucuccagaugaagagguuuccccugaaguacuagcaaagguaaauuuguuuaggccuugauaaucuucauguuuaaaaaagggacauuuuguaguuaucuuccucaccuuuaaaaaauuuaauaaacagagaugggaucuugcuguguugcucaguuuggucuugaacuccugggcucagcugauccucccacuucagccucccaaagugcugggauuaugagcuuaagccaucgugccuagcugggagccuuuuuuaauuaaaccuaauaguuaauaagcauuuguuaaggagguacuuuauuuuaaaauccauugcaaaaaaugguuuauugaagacauugugguugucauuguuuauuacaugucagugucuucugccugcuaaagcaaucuuaaugaggcuguuuuauagagagacuguuuauagaaugacggugcucagaggcaucuuaaauccagccucaucaccacuaucuacaagcauaugaauauuaacuuggcaaagauagguaauugucaagcugggcacuguggcagauuugggauuuaaaauaagauuguaucaucuucuuugauaaucuguuucacuuuguguugcuucaucaucaucauauauucuaucaauucauuuuuccugguugucaauaaauauaauaaauaauacuuugauuuguuuuucacaccuauuaucccagcacuuugggaggcagagcaggaggaucgcuugagcccaagaguucaagaccaaccugggcagcauagugagccaugucucuacaaaauauuaaaaauaauuuaguugggcuaggcaugguggcucacgccuauaaucccagcacuuugggaggcugaggcaggcagaucacuuggggucaggaguucaagaccagucuggacaacauggugaaaccccuugucuacuaaaaauacaaaaacuagcuaggcaugguguugcacaucuguaaucccagcuacuucggaggcugaggcaggacagucacuugaaccugggagguagagguugcagugagccaaggucccgccaccgcccuccagcuugggcaacagagugaaacucggucucaaauaauaauaaugauaauuuggccgggugugguggugcauaccuauaguuccaccuacucagaaagcugaggcaggaggaucgcuugagcccaggaggucaaggcuacagugaguugugaucaugccaguacacuccagccugggugacagagcagauagagaugauuguuacuaaauuugugacauuuaauagauguaaagcucaguugaaaaguggcagauuugggauuuaaaauaagauuguaucaucuucuuugauaaucuuucacuuuguguugcuuuguagucaucauauauucuaucaguucauuuuuccagguugucaauaaauauaauaaauaauacuuugauuuuuuggcuagcuuuuucacauauauugguaacaaucuuuugacuagacauuucuaaguaauuaugacuaccaauaauuacacaaaaucccauuuuuuuggucacaauguuaaaugagacugaaucagacuugaugguuucuucaaaguaguuuuucaauaccacaaaacugaaacucucaaguuauuuucagucaccacaaucaguacaguugugggguguguguguguguguguguguguguguguguguguguguguuuugguuuuuuuaugaaacagaguuuugcucugucacccaggcuggagugcaguggcacaaucucagcucacugcaaccucugccucccggguucaagcaauucucaugccucagccuccugaguagcugggacuacaggcgugugccaccaugccugacuaauuuuuuuuuuuuuuuuuuuuuaguagagacgggguuuuuuaguauagacacgguuucaccauguuggcuaggcuggucucaaacgccugaccucaagugauccaccugccuuggccucccaaagugcugggauuacaggcgugagucaccacccccggccuguauaguuuaaauuguuguuuuuaaaguauauguuuucaaauaguuucaaaaucuugcacaaacaucuaaguaugagaagccuaaauucuggaaccagacuuuuaagcaaguuaucuaugauaauaaugugucucaauugccuuaucuguuggaaaaaaaaaaaucuuccucauaagaauuuuuugggagauuaaauaaguuaauacauuuacagaucuaagaaaagugccuggcacugguuaagcacagaguaaauauuaguucguauuguugcuguuauuaucccauagacuuauuuaauaaaaugucugcugauggagaugaguaaucucauuaaucuaauuaaauuaauuuucccuuuaauuggaauuuuaaguugcuuucuuuuuuuagcauguuaauauuuuauagguacaggcaauuaaacuucugguaagguggcuguuggguaugaaaaacaaccagucuaaaucugccaauucaacccuucgguuauuaucagcgauguugguuagugagggugaccugacagagcaaaagaggaucaggugagauuuuucuuucuuuccaguuuucuuagugcugaaauuuugguggaauuuacauaggaauuauuuaccuaaugaauacugaaugguguaauuacaccaugaucuucagggucagaucuuauguacucauuuaggguuugucugucugucaguauuguuauuuuaauagugccaauauauuuuucuucauuccuaaagaagaggaacuuuuuccaguaaauacauaaucauaaucacuauauuguacuauuacaguuagcaucaacauuugguucaauuaaacaaguauuuguuaaacuucuacuucauaaaacacugugaaaagcauugcagcaaaaauaaguaggaaaagucccugccuucaaagagcaucccuguauuaaagcgauuaaauaaguggagugacuugagucccaugaaaguaauaaaaauuuaaguggcagccaggcgcgguggccuaugccuguaaucccagcauuuugggaggccgagacgggcagaucacgaggucaggaguucaagaccagccuggccaauauggugaaaccccgucucuacuaaaacaaaaaacaaaaauuagccaggcaugguggcacaugccuguaaucccagcuacucaggaggcugaggcaggagaaucgcuugaaaccagaaggcagagguugcagugagcugagaucgugccaccgcacuccagccugggcaacagagcgagagccugucucaaaauaaauaaauaaauaaaaauaaaaauugcaauggcaacucaagggagaguugaagccuucuuguuguucuacagauuuggguguguacacuuguaugugcacacagagauuguuuacauuguuacacauuuucacuuuuaaucucuaaaauugccaucucauuuuaagaugaaaauagaagcucaguuuuucaugauccugguuucugucaaauucuugauuuaguaggggccaagauuaccaacauagauaacuaaaguauucuacauaugaugcauuccuuuuuaaaaauuuguuuuagaggacagagguuuaaucauucuuuaugaggcugagugcaguggcuuacgccuguaaucccagcacuuugguaggccaagucaggcagaucaauugaggucauguugaaacccugucucuacuaaaaauauagaaauuuagccagguguggugguacgugccuauaaucccagcuacuggggaggcuaaggcaugaaaaucacuugaacccaggagguggagguugcagugugccaagaucacgccauuguacuccagcuuuggcuaguuaugugguacugcuaugcuauuaauuuuuuuaaaaauuauugugauuaggaaugggaucucacuauguugcccaggcuagcugggcucaagcaauccuccugccucagccuccugaguagugggacuauaggugugcaccacuacgcucuauuuuuaucauagaauaagccaaaggcagccuuuuauaacacuguuuagagcugaguuagggauaaugaaagcuuuaaauuggggguaauuauguacaguacauggcaaaggcauaauaaugagcucuuacaagucagugauaccuaggcaggacccccaguggagaugaaguuuagcuauuaucaguuuacuuuuaaaaguuuaacaucacuaaaugcagucaauacaauuuaaacuuaaucaauaccucuuuucauuacaaaucagaaagaaaaaaaaacguuauaagcaaucauuccucaguaugaucauggaaauggguuccuucauuacuccuaugaguauaaauuagcaggacucuuuggcauuuugcaucuagauccucaaaaauguuauccuugacucuuuauuuuuacacucauaauucaugaguauaaaagaaucauaugaaagcuuauacacaagcauguuccuccagcauuauuuuccaucacaaaaaauaggggaaugguuaaccauagaaugaacacccauuggacagauccuaacuggauaucauauaauauaguauuaccuuuuguaagccucaauuuccucaucuuauggagugaaaauuaauugagauaaagccuauaaaguguuuuucacaccugccuggcacggaguaagcacucacauaauagcuauuaacuuugauuccugaaugaaugccauagaaaccauuugaggcucccucauuguuaccagugcucauuuuaacaauccuguuguccaagagugccagguuuucuucucucuaugcuuagcaacagucccaguggguuccggcuagcuuucugcauuucguaaaguggucacaauaaauacaaaagccaugcuauguuccacauagaagucgaaguagaaagacucccaugccaucccauucauuaccacauuuuaccacguaaguaauaaaaauccacagugucggggugggagugccaaggcuucauagguuccauuugaaaacuuuacucugcaaaaggagaucagccccaggaacuaguaccuaagacagacacuggccucuuauauuucauauccuuuagguauuugucugauacuucuucacucuuaacugcagcccugccauuucagcaggcauuaaacuagauuccuguuacauguuuauaugcaggaaauagauuuuaaaugaugauaggugauuuuuuuuuuaauucuuugugguuuuuuuaaucaaguuuuuuuguuuuuuguuuuuuguuuuuuguuuuuuuugagacagagucuuacucuguugccaggguagagugcaguggugcgaccuuggcucacugcaaccuccaccucucagguucaagcaguucuccugccugagucucccaaguagcugggacuacaagugcgugccaccacacccagcuaauuuuuuguauuuuuaguagaaacaggguuucaccauguuggccaggauggucucaaucucuugaccucgugauccguccaccucggccucccaaugugcugggauuacaggugugagccaccaugccuggccacuuuaaucaaguuuucuacaaucaauauguauuucucuuaaaaugagggauacagcuccugauguaaagaguuuuuccuagccuugcaauuacuaugguugcaagaauaagcagaguuuuuggguuguggugaaguaucuaagcuagaguuugacuagaaaugaaggcagguaaauuuguaaucagaaagucacaaugauuugauuugauugugaaagucacaauccccuguguuaaguucauggacucaaaguagcuuucccauauuuguacgucauuuuaaacauaaauuaugcucuaaggaccuuacauucaaaaagggacgaaagcauuuuuaugaaugauagugguuauaggaaauguuuauuucuuuuuuguuuguuuauaguaaaucugauaugucucgcuugcgauuagcugcugguagugccauaaugaagcuugcucaggaaccuuguuaccaugaaauuauuaccccagaacaguuucagcucugugcacuuguuauuaauguaaguaacaaucuuauuuuugucaauuacuuaucuucaaaguugaauacauuacuuuucuauggauacaaauccauuuauaaugugaauauaugcacaaaagucacuacuauuauuaccuguuuaacugucuuccaauuauuacauuauuuauucucccauauaauuaucuucuuuuuaauugaagacacuaaaaauacuuaaacugcuguuuuuuauuuaauaaaugguugccaauuuaaguuuuucugugcugcuguaggaugaguguuaccaaguaaggcagauauuugcucagaagcugcauaaggcacuugugaaguuacugcucccauuggaguauauggcgaucuuugccuugugugccaaagauccugugaaggagagaagagcacacgcacgacaauguuuacugaaaaauaucaguauacgcagggaauacauuaagcagaauccuauggcuacugguaaguaacucagaguucuccgugugcaaauauauuuugucaauguauccauuuuuagguuuuuuuuuucuugucauguguuucuauuauaguuuauaauaaaacugggaguuuuauagaaugcugucauuguaguuaugauguacuuaaaaacugaacuccugaguccuauuuaugcugcauuaacucuggcaaacugcauuuuuccuaugggaucaggaguguaguuuaauuugaacauauugcucggaugucagacuaaauaauuuuuuccuagcuuugccagggaccuguuguuuaauggguuuaauaucugauaccuuugacuucaguaucuuucaaaagugaaauacaacugcauaccagguaccagaaaaagaaauugaaaagugaaguguaaaguauuuuaguauccagguaucauguugugccuaauuuagaaauaacugagggaaaaaaugaaaacuuaagugguuagaacucaguccacuaaggcauuuuauaaagguuguuuuuaauaauguuuuuacuucagagaaauuauuaucacuguugccugaauauguaguuccauacaugauucaccugcuagcccaugauccagauuuuacaagaucacaagauguugaucagcuucgugauaucaaagaguaagucuuguuguuuuucaagaacucuaaaaauuauguuuaguuuucaaaaaaugguaaauuuuuuguuuauuauuuuuauuuauuauuuacauuagaauuagaaucuccuuaugguuuuauucauuuauuauaaauuuccaguuucgucuuucaaaaauuuucccaucuaccagguuuugguuguucauuuucuguuuguuugcagcuaguuaagcuaucuaagucuuugaaauagguuaguuugguuaucuuaguuauuauauuugauuuuuacuauuuauauugagaggguuugaauaugggaagaguacugaaguaugugaaauaauuggaguuggaacugaaaacaguggagcauauuuuuuauucuuuguucucucuagcaugcaacacuuucaaauaucuuuuaaaaaauuuugauacauaauaauuguauacauuuaugagguacacguaauauuuugguacaugcauacaauguguaaugagaaaaucagaguaauuaagauauccauuuccucuucaucccaggcaauuggagcugcaaugagcuaugauuaagccacugcaugccagccugggugauagaacgagacccugucucugaaaaauaauaguaacaauaaaauuuuuaaaauacaaauaaauuauuguuaacuauagucacccuaccaugguaucaaaugucagaacuuauuccuuguaucuaaguguauuuuuguacccauuaaccagucucucucucuuuauuuuuuuccgagauggagucuugcucuuuugcccaggcuggagugcaguggcacgaucuuggcucacugcaacaucugccucccuaguucaagugauucucccaucucagccucccgaguagcugggacuacaggugccugccaccacuccuggcuaaaucuuuuuuuguauuuuuguuagagauggaguuuuaccauguuggccaggcugcucuccugaccuugugaucccccugccucagccuccccaagugcugggauuacagacgugagccaccgcacuuggcaaccagucucucuuuauucccccuucccuucuacacuugacaggcucugauaaccacccuucuacugucugccuguauaagaucuucauuuuuauucuauuuuuuuuuuuuuuaaugagacaaguucuuacucuaucccccgggcugaagugcaguggugugaucagggcucauuguaccuugaccuccugggcuaaagcaaucuccuaccucaucuuccugaguagcugggacuacaugugccaccaugcccagcuaauuuuuguauuuuuuguagagauggggucucacuguguugcccaggcuggucucaaacucguggacucaagcgacccuccugccucagcuuccugaagugcuaggauuacaggcgugagccacugugccuggccuucacucuuucagugcccacauaugagugagaccaugcgauauuugucucugggcuuggcuuauuucacugagcauaaugacuucaaguucuguucauuuugcugaaaaugacagaauuucauucuuuuuuauggaugaguaauuuuucauuguauguguguauauccuccauuuuccuaauuaauuuaucuguugagggacacuuagguugauuccauaucuuggcuguuguaaauagugcuacaguaaacauggaaaugcauccaucucuuagaucuacuaauuuccuuucuuuuuuuccuuuuuuuccuuuuuuuuuuugagacaagugucuuacucuguugcccuggcuggagugcaguggaaugaucucaacucacuguaaccuuugccuccccacuuaaagcuauucucaugccucagccucccaaggaguuagcacuacagacguguaccaccacaaccagcuaauuuuuguauuuuuaguagagaccaguuuucaccauguugcccaggcuggucucccaacuacuggccucaagugauccacccgccugggccuuccgaagugcugggauugcaggcaugagccacugugcccggccaagauguacugaauuccuuuauuuuggauauauauccagcagugagauugcuggauuauauggcagaucuguuuuuguuuuuuugagaaaccuuuuuuuuucucucucuuuauagagaugcgaucuuguuauguugcccaggcuagucuugaacuccugggcucaagcaauccucccaccuuggucucccaaauuucugggauuacaggcaugagccaccacacccagccugaggaaccaucauacuguuuuccauaguagcuucaacaugguguccccacugauuggagcagugaguagucaccagaguuuaagcacagucagugcccugcucuuuguccccaguucaucccaggugguucugcccaucuagcacucccagugguucccaugggacaggacuggagugggcuucccagacuuguggagagcucggaguuccacaucuaguuccucucaucucagaaaccacgagucuagggaaauugugugcgagugguguucugacaguuuaggagaccaggguggugcacucugaaauugaacuguuucucuuaccagugguggcaucacuuaguucuucucccccuacuucaggugcauuaaagaugguauucuugucuuaaauguuuucuagauguucuacuaucuugcugaaaucauuuccacuuuuguguaucuuuaaacauaauguuuaaauuaccauguaauuugaaguuccaacuaauguuuuucaugguggguguggugggucucaccuguaaucccagcuacuuggaaggcugagguggaaggauugcccgagcccaggaguggaaggcugcagugagcucugauccaguuacugcauucuagccugggugacaggaaacccagucugguuuuuuuuguuuguuuguuuuuuuaaguuuuucaaaauguaguuacauaacuuuauggaaauuaguaaguuauugugucagaaacaauuuuuuuguuaauugugguaaauauauauagcaaaauuugcaguuuuuuaccacuuuuaaucauacauuuaaguggagaaauguccagugacuuugcccuuuuauuaauuggguugucuuuuuguuauugaguuguaagaguucuuuauauauuuggguauuuaucucuuaucagguauaugauuuacauucuugauaguaaguagccuuugaugcacaaaaguuuucacuuuaaugaagcccaguguauuuuuucuuuuguugccuauacaguacuuuuguuauaauuaaggaaccaaauccaaguucauaaaaauuuuuuacuguguuuucagccgggcacaguggaucaccugagguuaggaguucaggaccagccugaccaacauggugaaacccugucccuacuaacaauauaaaaaauuagccacgcguuguggagggcgccuguaaucccagcuacucgggaggcugaggcaggagaauugcuugaaccugggagguggagguugcaaugagccgaggucacaccauugcacuccagccugggcaauaagagugaaacugcaucuuaaaaaaaagaaaauuuuacugcauuuucuuccaugacuuauaguuuuuagcucuuuaguuaagaucuuugauccauuguaaauuaauuguugcaugugguauaagguaaacauucagauucauucuuuuguuugugaauauccaguuuuuccaguaccauuuuugaagagacuguucuuuccccagagauugguuuuggcacccuugucaaaaaucaacugaccauauaugcaagggcuuacuucugggcucucaauccuauuuaauuugucuguaugucuggccuuaugccauguaacucugucauuacuguaacuuuauaauaaguuucagaauugagaagucugauuucuguucuuuuucaagauuguuuuggcuuuugauauuuccugugaauuuuagguugcauuuaucuauauuucuaaaaaauuccauuguacuuuugauaggaaugggacugaaucuguauauugccuugggugauauuguuaucuuaccaguauuaagucuucuaaucuauuagcacaggaugucuuugcauuuauuuagaccuuuaauuuuuuauuuuauuuauguauucauuuauuuauuuuuccagcacuguucuguaguuuucuggguauaggucuucgucuuccuugguuaaauuuauuucuaaacauuuuauucuuggccaggcaugguggcucacaccuguaaucucagcaacuuugggaggccggggcgggagaauugcuugggcccaggaauuugagaccagccuggcagcauagugagacucugucucuauuuuuaaaaauuaaaaagaaaaaagaaaauggguuauuggugucuccaguucuuauuaaggcacucacuauuucucccuucaguucuguccauuuuuugcuucauagauugggggacuuucuuguuuguuuuguauauauuuauuacagucacauuuucuugcuggauugaccuuuuaucacuacagucuuuguggucucuucuuaccuuuuugaguuuaaaucuauuuuaucuaauaauaaaauagccacuuaucucucuuaugguuacuguuacaugaaauaucuuuacauccuuuuacauuaaaaguaauuacugaaaaggaaggaguuaguuuugcaaaauagcuguauauuuucugcaugucuuauuuguuuuuuguugaauuccuccaauuuugccucuuugucuuguauuuaguuggcuuuuuuguggugaaccuucugacuucucuuuuguaaaaguuuuuagcuauuucuuuccuuuuuuuuuuuuuuuuugagauggagucucacucugucgcccaggcuggaaugcaguggcgcgaucucggcucacugcaagcuccgccucccggguucacgccauucuucugccucagccuccugaguagcugggacuacaggcaccugccaccaugcccagcuaauuuuuuguauuuucaguagagacgggguuucaccguguuagccaggauggucucgaucuccugaccucgugauccaccugccuuggcuucccaaagugcugagauuacaggcaugagccacugcacccggccauuuuuaguauuucauuagguuuuagaucacagcugacaucucaaacuucuaacaaccuaguuugaauaguagcaaauuuguuucaauagcauauggacacauugcucuucuacaucuguauuuucccucccuuuauuuuuuauuaucacgaaucacaucuuuauaggcuguauucccauuuacuuagauuuagauuuacaguuacuguuuuaugcauuuuccuuuuauuuauuuauuuaguuauguauuuauuugagacagagucucacucuguugcccaggcuggagugcgguggcgugaucuuggcucacugcaaccucugccucccagguucaagcaauucuccugccucagccucccgaguagcugagauuacaggugcccgccaccacgccuggcuaauuuuuguauuuuuaguagagacaagguuucaccauguuggccaggcuggucuugaacuccugaccucaggugauccacccaccuugaccucccaaagugcugggauuacaggcaugagccacugcacccagccgcauuuuccuuuuaaaucauguaugaaagaagugaguuaugagccaaaguacaguaauacugucuuuuaaauguaccuguaugguuacuuucaccagauuuacuuauuucuucuuauggcuuuaaauuacuauguaguguucuuucauuucagccugauggacucacuuuagcauuucucauaagacaggucuacugaugacaaacucccuuugcucuuguuuauuuggaaaauguuuugauuuugucuuuauucuuggacaaagacaaaucuuauauaggauauaagauucuugguugacgaguuguugggguuuuuuuguuuuuuguuuuuuuagaacuuggagaugucaucccacugccucuuggccauuaugauuucugaugagaaaucagcuguuauucuuauugaggauccuuuaacaugagucacuuccuucuuggcugcuuucaagagaccuuuauccuuuaucucuuuaucaaauguucaaccauuugacccugaugugucucaguguggguuucagauuucauccugcuuggagaucacugaguuucuuggauguauaaauucacaucuuucauaaaauuugcaaguuuuugaccauuauuucaucaaauauuuuuucugcuacuuucugucuuuccguuuggaaauuccaugaugucuaauguuaguauuucugauuguuucuugcagguucauuagauuguuuuucuucauucucuuuucuuucuguucagacugaguauuuucaauugccuugucuacagguuuacugaaucuuuuuucugccugcuguagucggccauugaauccuccuagagugaauuuuuaauuucagcuguuauaauuuucuguccuggaauuccuacuugguuccuuuuaauuauuucugucucuuuaucaguauucucuacuuguucauacauaugauuaucuuuauuucuuuuaucucauugagcauauuuaagacaguugauuuaaugucuuugacuaguaacucuaaaaucugggccuccucaggguuaauuccuaauucuuucuucuucccugugaauuagucauauuugccugauucuuuaugugauuuguaguuuuucguuaggaauuggacauuuuaaguacuauaaugugauaacucuaaaaaucugguucuuccucucuuucuagauugcuuuugguucuuguagggcgcaguccaccauucugacuuuuccaaacuacuuucacaaagucuguauuccuuguuuuguguagaccuugaaguuauaguucuguuaucuuuauggucagccugugacccugacauagauucccuucacuguugagguucauccccucuuccuccaucagaccagguguuuaccccugguugcugggucccaugagguuccagaguucugcacaggugauuaugauuguuuuuuuccagcuuaauaguuguuuuguuguugcaauugauaucugaaauuucuuacucugccauuuuucugacaucaguaauaauguauuugaauuugaaaaaucguacuuaaauauagccuuuaauguuuaauaauuaccuuucuccuuuauugauauucaguaagaaaaaauugaaaaugaauucauuaagaagaaaacaauuauucguaauuauacccccuaaaagcccuucauugcuguuaacaauuuggucuguaucuuucaacacuuuuucuucuucauauguucauauuuccuuaacaaauauuuauagaguacuuucaaugugccagguacgcuaaguucuuggguugugagguuauguaauaugaauaucauauauauucccuuaagguuuacaaucuaauggaagaugaagaaagauaaagaggugguuacaauaugauaugugauauaugcucugcuauugugggaguaccuagaauaggcacauaacucacacuugcagggagucagaaguuaaaaagaggaggaagaaaaaaauaaucuguagagcagaacuucuaauaguguagacuucagacauaccacuacuggaaagaacagagaaucagaaaacgaccuggaggaagaauauuggaggucaaaggaacagcaguuuggaaaaaugaucaggaaccagcuaacauucauuggcuuuuuauuauauguuacguguacuggaaauguuaccucauuuauucuucaaaacaaugggauaauuacuguuguucccauuuuauuuuuguuuuuguuuauguuuugagauggagucucguucugucgcccaaguuggagugcaguggugugaucuuggcucauugcaaccuccgccucccagguucaagugauucuccugccuuagcaucccgaguagcugggacuacaggcaugcaccacgaugcccagcuaauuuuuguauuuuuuuuaagagauggaguuucgccauguuggccaggcuggucucaaacuccuggccucaggugauccaccugcuuugaccucccaaagugcugggauuacaggcgugagccaccgcacgcauccuguuguucccauuuuacaaaugaagauaccagcaaggguaaagucacacagcuaauacguguccuuugaauuuaagaacaaacuguguuuauuugcuuacugguuggaaaaauuguuuaaaauguguuuagcaacaaagcacucacugauaaccuuggcaggggcagcuguaguaaagcaaugcaggugaaagccaaauugccaaaagauaaggaauacauaucguuuagacaaaucuuuuuuaaaaauuggcuaugaauuggggaggaagaaggcaauagaaaguauuuaaggagccaggggaaaaagugugguuguagguaaaagaaacgaugguaauaaauugaggugaggucuucaaaaagaagaauuuaugggguggugggaucuuaaagauagauaaagggaaggccaggaaauaaaaauaauuuuccaggacugcuguuaaguaguugaggaagucucaucuuaaugacuuagguuucuaaaugauauaggagcagagucuacugguaggugagggugacagaauuagauaugaguagaguaaagauuggaaacagcugcugugaagaaguggcuaaaaauccuggugacacauaggauagcuggguagcauaaaguaccaagcuaaaaauuuuaaauuuauaauuauaucaagcuucucagcuacaugguuuuucuguagcauuaaacaauucuaaauauagcugucaagaagccaaagauuuggauuguucuugaguuuuucaaagcaaguguaccagaaggaaaauuguuaagaguugauacuguuuucaaaaaagugauuaaaauguugagaggccaagacaagaggauuauuugaguccaggauuucaggaccagccugaacaacauagcaggaucuuaucucuacaaauaauuuuuuugaauuggcuugguguuguaacaugugccuguagucccagcuacucagucccugcagucccagcuacucagucccugcugaggcaggagcguugcuugagcccaggagguaggcugcagugaauuuauaauuucacaggcgaacaauuucuaaagauuaacaaagucuaggaaugucugaggcagugaaaugucuuaggcaaagauaaaauuuaccaggauuagaacagccaaggaauuaggaaaucguguugaacagauugcccagaaaauuggcaggacuuaaagauggagucaaggaaaaaugucauccagaaacuaaaucaacgcaaggaacauagggaagcugauagauaacauugacaaggagaggaugguagaagcagccaaauggcacaagcuuccuaggaguaauuuuacauaaaccuggaagaauaacuggaauuagcuuuggggaugauagaagcugaacucacucucugacccuaaguaugcaucaucuaauagaaugagcaguuauaacuuuuaggggaaugcaaggcaagcauucuugggguggggguaugguuucaguuacggcaaaaaggugaagugagcauucauugaagauucuuuuuggagggaaaguauauucuagagaguucagugaaaagauacgagauggagaggaauuagcucccuuggauaaggcaagaagaagcagaggaucaugggaaucuguguacuucguaggauggguaaacauuaaugauuacauuucuugggcaguauugaggaugcagaagugagacauggccccagggauuucaacauauucuaauuucaaaaaaugcuguuuuaauaucuauuauauauuguuuuauaauacauauauguauuguuuuguauccuguuuuaaauguaacauuauauugaacaacuuccaaguacuaaaauuuauugagucaauugguucauguuagauagcacauuagucucagcauaucugcauaaaauuaagguggaauuggcauucuuaucacaagacaaucauacuuuuuuccaguuacuucaaggaauaaauucucuauuauguugauguacauucaaguauuuuauguauauacuaauguuuaaaaccuuauugcaagauuuuuuuguuacaacuuuuuaaagaaacccugcauaggaaugcuuccucaccuuauccccuaaaacugagaguaauccugacccuauacuucuguggaaagggaucaaacaaaucuucaaguuaauagaaacucaacagaauucugacccaagaauuaaggaaaugauuucaguguuuauauaaacaaauagaauccucaaaccuauagaaccgauguguucaguguugucaccuuuguuuaguauauaguugcucagauaauguuuauuauauuuauuuuguguauuuuuguuaaaaguauaaaagcagaccugguucuaauccuagcuccaucuuuuuaucucugugacccuaaacagguuacuuaaugccucaaaaaaaauauuuagauagccaggagugguagcuuacgccugcaguccuggcacuuugugaggccaaggcagguagauugcuugagccugggaguucaagaccagucggcaaccuggcgaaaccccagcucuauaaaaaucagccagacaugguggcacaugccuguagccccagcuacucaggaagcugagguaggaggauagugugagcccaggacaccaugguugcuggggcugugaucacgccacugcacuccagccugagaggcaagcaagacucugucucaaaagacagaccaaaaaaaaaaaaaauagguucuauauauaauggugacgauuuuucuuauucuuuauagagucaugaggauuauaugaagguaaagugcuuagccuaaugccuaguagauaguaagcacucauuaaauauuugcuaauuuuuauuauauuuguuguuauucauuauucuguuccuuucuuugaucaggauucuagcagcuauccaguaucuaaguagaguugacaacucuuugccuaaguuaauaaauauuauugaaacaaccaacuaucauuuaagccauuaagcuaaaaaacuaaugcaugcuacaguagucucuuaaaacaauuauguggaauguaggaaaagaagcuuuuacagaguaucaucaaauaguuucuccccuguugaugcaggaaugcaguagucaugucacugccugaaaauacugggaucuuuguaaaaacaggccccauuuccagauuugucuauuuaaguuauccaaacaauucuaauguucagccugauuugggguucacuuuuacuuagaaauucaaauguucccuucagacacaauguguuaaaugaauauacagugacaaguguggaauagcaaaagugguuugagauugugacuccuuaauuggguggcuggguaccacacacaucagccucauaauacaugcaacuuagacuuguuucucggcagaacugcauaccaauuguagaacuucugcauagcuuacaaauaaucaaaaucccaagacugcuguguguugauuugcucauuauugcuggguguuaaguuauaucagauuauguaaacuuaccuauagggugaaucuguguuuucuuuugagagggugucacuuuuuugcccaggcuggagugcaguggugugauuauggcucacugcaaccacaagcgauccucccaccucagccccacaaguagcugggacuacaggagcccacuaccaugcccagcuaauuuuuguauuuuuuuuguagagauggggucucacgaggcuagucucgaauuucuuuuuuuuuuuuuuuugagagagagucucgcucugucacccagguuggagugcaguggugcagucucagcucacuguaagcucugccuccuggguucacgccauucuccugccucagccucccgaguagccgggacuacaggugccugccaccaacacccagcuaauuuuuguauuuuuaguagagacgggguuucaccauguuagccaggauggucucgaucuccugaccucuugaucugcccaccucggccucccaaagugcuaggauuacaggcaugagccaccgcgcccagccucgaauuucuggguucaggcaaucuacccaccuuagccacccaaagugcugagguuauaggcacgagccaccauauccagcuagggugaaucuuuauaugccuuaugaaacugucagacuuucucauauuaagcuauguuuucauuuuuuauauguuauuuuaugcuuuaauuuuccauuugaauagaauauuauuaggauaauaacauauauuagucauuaagguugaucauuuuauuuuauuuuauucagacaacagaaauucccagcuaacauauuuauugcuuuaagcuaaagcaucuaucuacgucuagucucuuuaauauguuuacauuuaggugccuaugguucaugcuugaaguuuuaaugacaaagaaugaaaacaauagccaugccuuuaugaagaagauggcagagaacaucaaguuaaccagagaugcccagucuccagaugaauccaagacaaaugaaguaagaugaguguuaggccaguggguguuaagauguaauagaaaaauauauugucccacuugguuuuuuuuuuuuuuuuuuggccauacguaguaauuuaaauuuuagaauguuuacaaaaguaaauguguagucaguuuuuauugcacuucauuacaagugaauuuuauuucaggaaucuuuaguacucugaaaagacauuauaaccuuagagcaagaggauaagaauaaaauguacaacuaugguauauuacgaacuuacaguaagaguuacagacaaaugcuuauucuuuuugugugcuuucuuuggguugguucauuuguuuguuauuuuccaugcauauuggcauccauguuaaauucauauagagggauuuuuauuuaucagaaggcugcauaaacagugcugaacagaaauauggaauguucaaggaauaaauaacaaccacaguauccuucuuuuaacucuaaauuauacauuuaguggaauugguaauuaugauuauuuugcaauacuaaaaguuauauaugauucguuuuccucccuagaaacuguauacaguaugugauguggcucucuguguuauaaauaguaaaagugcuuugugcaaugcagauucaccaaaggacccaguccucccaaugaaauuuuuuacacaaccugaaaagguaauuuucuuccucucauuuuuccuaccacacuaaacugauuucaaugucaauuaccaucaaccauuguggcaaauauugaauugucuugaccacagaguaaagaaaaaaucuggguuuaucaaagagugggaaauugucuuacacagcccugaacauuauucugacuugaacagaagacuacacauacuguugaucuuauguuuauucuaggaauuucuaguauuaaaguuuucagauuuuuaaaauuauuuuaaucucauuuuauugaaacauggguaguauuuuugcagauaagaaaaauuuuaaaucuuuggcacaguguaaggagggacagguucucuccucuaagccuccauuucuucaucuuuauaaugcagauguuaauaauacauauggacaauugcuaauaucuagguuuauaugaagaguuuaucacauaaaaccauucaauaaaugguguuauuaauuaauauacagugcaucuauucugcuuucagcaaacuguuucccauguaaguaaauuuuucagguaacgcaggcucuguaaguuuuuccagcuaauuuggauuuuuaaaagcuuuuguuuauuuccugcuguuaggugguauuuuaaacuuguuucacuuucuccuauaaauguauauauaugccucaguaaugauccccuuagagcagugguucccaaccuuuuugacaccugggaccaguuucguggaagacaauuuuuccacagagaaauugagguggagagaugguuucaggaugaaacuauuucaccucaggucaucaggcauuaguuagauucucauaaggagcacacagccuagaucccucgcaggcauaguucgccauaggguuugugcuucugugagaaucucaugcugccgcugauccgacaggaggcagagcucaggugguaaugcuugcucgccagccacucacugccugcuguguaucccaguuccuaacaggccgcagacccaugacccauaacccauaccagucugcaguucguggguuggagaccccuagcuuagagaauucuccaaaugcacauuccaagaaauaaauggagcuuccuacuuugaaugccguacuuuacuaaaaguuugcuaaaauguaaucugauuuuuauuacugauuuaguauugaacacauaacugugccuugcuuuugauagaaauaaugagaauuugcaaaaguaugcucucuaauugaauccacugaucuguauaaaaaaaauuuuuuuuuuuugagucuccgucacccacgcuggagugcaguggcuugaucuuggcucacugcagccuccaacucccuggcucaaucaguucuccuaccucagccucucaaguagcugugacuacaggcaugugucaccaugccuggcuaauuuuuuaacuuuuuuguagacaggugguuucaucauguuggccaggccucaaacuccugggcucaagugaucaacccaccuccagcaucccaaagugcugggauugcaugagccaccaugcccagccuauaagauauucuuaagugagcuguugaauuaaaauuaauccuguugcugacccaggaccaucaugaauagaauaguaccaaauagaaucuauguaacaguggugauaccaucaucaagaauuaaauuccuacuugucacuacaccuuaucuggacucauagauaacaauuuuuuuuuucuuuuguuaccuucaguguuacagaguuuuagucuucuuaauaauaacaacuuagguuuuucuguuuucaguaugcaacguuccuuauuuauguaacauguugcuuuuaauguguuauaaauucauaaacccuagaacacuagguuugugaaguuagucaaccuagugaagcuauacuauaucuuuaugaaugaagugaaugaacuuugguacacagguuucuuaauguuuauuuuagcugcauagaagacuuugugcaaaagaaaugauacagcuuugccuagcacacaugacaaaacugugauuuccucacaggcacacuuuguucuuuccuacuucugugaagguaaauuuaauacaauaaaaaauauuuuuuaauaggauuauuuaaaacuuaauuauauuuccugaguuuaguagcuaguuuugcuucacugacacaacauugugguuuguuugccauuuucagauauuaagcaggaaaaggcaucaagagaucaaguuugaacuccuaauuuuuauauagauauaacucucaaagugcuaucauuuuccacauuugguuuaaaucguguauuguuaauaucacagcugucaaagaacauaauucacuuaauuguauuuugacaguuggucuacuuauguuuuuugagauggaguuucacucuugucacccaggcuggagugcaauggcacgaucucggcuuaccgcagccucugccucccgaguucaagcgauucuccugccauaaccuccugaguagcuggcauuacaggcgcaugccacccggccuagcuaauuuuguauuuuuguagagacaggguuucaccauguuggccaggcggguucgaacuucugaccucaggugauccacccacuuuggccucccaaagugcugggaugaggcucacaggcaugagucaccacacccggcccgaauuuaugaugugguggaauucagugaauaaauuuaaugaauaaacugcauugaaccguaugaaaacaugugugugcuuuauuuauggugugauuuaggaaauuuaucuuugacauuugccuaagucugcgugccaucaguuuaauuuaaagcuagacuuaugguauggcuuugauuguuuugauuguuugauaaauugguauauguguuagcacaaguguauuuauuauugcaaggcacaauaccuaaaaagccuuauugagauaauuaaaauacucauguuccuuugauugguguuucuuuuuucuuuuucuuuuuuuuuuuuaauaggacuucuguaacgauaagaguuauauuucagaagagacaagaguacuucuguuaacaggaaagguauuauuuacuuaauaauuuugagaucuuuguuucauguguaucuugcuucugcuauuccuagaaauaccuuuaaaugaccacuagauuguauaguuccugauucuuagggaucacauuauggauuuaaagcaucuaaagcagccaugcuuuuagaauuuuucugccagcaaccacuccucugaaaugccacuguguguucucaucaguaauguuaagcacaguuuauuuacaauucacaaagaagacuuuccugggaaaugguauaaccaacuuagguauauaagauaaaagaaauaauuuuauacuacuaaugaauuagacaauucauguucuauguaaguaauauggugacaccuaaaacagcaaaaggaaauuuaguuuuuuguaaauaguuccuaaacuauuacuauauauauauccaauaguuuauuuauaggagcauuuauuauguauguauuuugcuauauuuuaggggaacuuuguauuuugauugaauaauaaaggauacauuaauauuaccuaguuauuauuaaguagagauaugcuuaugacuuuugauuguauuaaggcaaccaaacacaauuuuacagaaugaucuuuuuuuuucuugagacagucucauuuugucacccaggcuggaguacaauguugcgaucucagcucacugcaaccuucaccuccuggguucaggcaauucucaugccucagucuaucgaguagaugggacuaccggcuuauaccaccacaccuggcuaauuuuuguauuuuugguagagguuggguuucacucuuuuggccagaguggucuugaacucauggccucaagugauccaccucccaaagugcugggauuugcagucaggagccaguaugccuggcccagaaugaacauuucugguaaauuuaacuaauuagcacuuaacaauaucucuuacuugugucuaaauuuacauguauacaugguaagguauaaacguguguguuuuugggggguuuuuuguuuuuguuuuuagccaaagccugcuggaguacuaggugcaguaaauaagccuuuaucagcaacgggaaggaaacccuauguuagaagcacuggcacugagacuggaagcaauauuaauguaaauucagagcugaacccuucaaccggaaaucgaucaaggcaacuuuucucuccaauuauuuuguuacuagcacucacuacuugguuuaucuuuuauuccuaaagugcugucucauaaaauggucuucugucauuagcgguguucugguacaaaauaauauugaugaauuuuaguauuuucuuuucuggguuuuuuuuuguuuuuuuuuuuuuuuugagacaaagucucgcucuuguccccgcccaggcuagagugcaauggcgcaaucuugguucacugcaaccucugccucccggguucaagcaauucuccugccucagccucccgaguagcuggaauuacaggcgccugccaccacgccccgcuaauuuuuguauuuuuaguagagacgguguuucaccauguuggccaggcuggucucgaacuccugaccugaggugauccgccugccucagccucccaaaguguugggauuacaggcguaagccaccgcacccagccaguauuuucuuuuuuuucuuaauuuuauguaauuuuuuuuuaagagacagggucucacuuuguugcuuaggcuggagggcaguggcaggaucauagcucaccgcagccucagacuccugggcucuagggaucuucucgcuucagcaucccaaguagcugggacuacaggcaugcaccaccaacccccagccaauuuucuuuuguacuuuucauaaagauggaguuucgucaucuuccccaggucgggcucgaucuccugggcucaagugauccacccccuucagccucccaaagugcugggauuacaggcgcaaaccacugcaccugggcacauuuuaguauuuucaaugaggaaaucaagaauguacugcacacuuugaaacuauuaauauauagcauucuaaguguauagaaaaauuaacagaaaauaauauaagaguuaauaauacaaccaauuuauaucaaaauacuuauuuuuaauauuuuugagacagagugucucuguccgucacucaggcuggagugcagugaugggaugucagcucacggcaaccuccaccuccugguuucaagugauucucacaccucagcuuccugagcuuacaggcacacgccaccacucccagcuaauuucuguauuuuuaguagagacagggugucaccaugauugccaggcuagucucugcccaccuuggacucccaaagugcugggauuacagucaugaaccaucacgccuggcccaaaauguuuauuuuuuauacguaagaaaauucaacccuuaggaaaacuaugaaaacauuaacuuuuaaauaaauugaaaugcuuuuuaauuuuuaacucaaauuaguauaggagggcuggguguagugccuuauggcugugaucccagcgcuuuaguaggccaaggcaggauuaucacuugagcccagaaguucaagucuaaagugagcuaugaugucucugcuacacuccagccugggugacaaagcaagacccugucucuuaauaaaaagaaaaggccaugugugauggcucacaccuguaaucccagcacuuugggaggccgaggaaggauaaucacuggagcccaggaguucgaaaccaaucugggcaucaugggggcauacacuuguagucccagcuacuugggagcucaggaggcggaggcaggaagaucacuugagcccaggaguucuaggcuauaucagcuaugauuacauauuucauuucagccuaagacccugucucuuaaaauauauauauauauauauauauauauauaaaaauaggauaaguuuacauuguucuaacauuuucuaauuauaaaaauauuccauguuuauuuuaacauguuaaguauucaguauauuagcuacugcauaagaauuucuaccugcaauuuuuuucauaaacauacuuauuuugauauauaauaauuguacauauuuaugggguguuugugauauuuugguauaugcauagcauguauagugaucaaaucaggguaauuaggauauccgucacaucaaaccuuuaucauuucugacccuacucuuaggaacacuuaauauugugguuuuuauagauauuauucuuacacaugaaaucuuaagaauaaacucaaccaaugauguuuuaaaccacuuuuagcaaaaaugaagcccaagauaugaaaucaguuaacaugguuuaaagaauaguggggccucaaauaccuaccaaauagccucuucugacagcccccuuuuuaguagaacacuauggaaaugacaacuauacuauggucuguaguuuuauuuuuguuuuaggauuuucuauucccaaaagauaaagcuuacagugguuguguuauuuugucucuugacaauuaacccuuuugucaaguagucuuaggcagucauuucugucuuaauguuauuaaggcaaaauggaaauugauaccacuuuaucaaagcuaaauggaaaaugauauuuuuaaagcaauagucuauaacuacagaguauccgaaucuugcuauuguugcuucaauugucaagguuucgaaaccagccuaagccuuucuuuauugguacggugagagagugaacuuucucuucauggaaauaugaagucuugguuuauuuguuuuaaacagggaacagaguucagaggcagcagaaacuggaguuagugaaaaugaagagaacccugugaggauuauuucagucacaccuguaaagaauauugacccaguaaagaauaagguaaauuuuaaaauuuaacaaguggauuuuuuccauggagauuauuacaguuuuuccguagggauaagaaaucuacagccaacacuucaaugcacaugcuacauuuuaaacuuguguguauuaccacacaccuucuccccgcuucccgcaccccggcuauacuucccaaaaaugauucugcuuaccuccacccacuuuauaagaauuuauguggucuggcugggcacaguggcuuacaccuguaaucaucucuacuaaaaauaaaaaaauuaccggggcguggugguuggcaccaaaaucccagcuacucaggaggcugaggcaggagaauugcuugaacccaggagguggagguugcagugagcugagauaacgccauuguacucaagccugggugacagaggcagacucugccuccaaaaaaaaaaaaaaaauuuguguggucaccuacccguagugguauccuuuuccuauacuacccauuucaacucuuuuaaagaauaggaauugaggccuggugcguuggcucaugccuguaaucccagcacuuugggaggcugaagcggguggaucaugaggugaguaguuugagaccagccuggccaacauggcgaaaccccgucucuauaaaaguacaaaaauuaacuggacgugguggcaggcgccuguaaucucagcuacucaggaggcugaggcaggagaauugcuugaacccaggaggcggagguugcagugagcuaagaucgugccauugcacuccagccugaacgacagagcgagacucugucucaaaaaaggaauugagaguuuuugaaauauuucaaaaguuuguugauucccaccagagaucagcccuuugcuuuguuucuacuguguuuuuaaaaguucaucuuggcugggugcaguaacuuacaccuguaaucgugcacuuugggaggcaaagauggguggaucacuuguggucaggaguuggagaccagccuggccaacauggugaaaccccgucucuacuaaaaauacaaaauauuagccaggcaugguggcgcacaccuguaaucccagcuacucaagaggucgagacaggagaaucacuugaacccucgaggugaagguugcagugagccaacaucaugccauugcauuccagccugggcgacaagagugagacuugguggaucaccugaagugaaacccugucucugcuaacaaagugcaaaaauuacuugccuggagucccagcuaugcgggaggcgacccggcgcaguggcucacaccuguaauuccaacacguugggaggccgaggcaggcaaaucgccugaggucaggaguuccagaccagccuggccaacguggugaaaacucgucucuacuaaaaauacaaaaauuagcugggcgugguggugugcaccuguaaucccagcugcuugggaggcugaggcaggagaacugcuugaaccgcggagguggagguugcagugagccaagaucacgccacugugcuacaggcuggucuugaacaccugaccucaggugauccacccuccucagccucccaaagugcugagauuacaggcgugagccgugcuugacgacuuuguugaucuuuaaacgauaccgcccaauuuuguuuuguuuuguuuugaaacaggaucucaccaugcccaacccaauuucuuaauuuuuuggcaggagaggaguggugcauaaucgauaggagcaucacacauaucugacuuuugccucuuggcucugccacucacuggcuaaguguugacuugagcaggucgcuugacuucucuggucuucuuucaguuguuuuuuuuuuguucuguuuuguuuuguuuucuuuuguuuuuugagacggagucucugucgccugggcuggagugcaguggcacaaucucagcucacugcaaccucugccuccuggguucaagcgauucuccugccucagccuccugaguagcugggauuacaggcacgcaccaccaugcccagcuaauuuuuguauuuuuaguagagacgggguuucaccauguuggccaggcuggucuugaacuccugaccucgugauucgcccaccuuggccucccaaagugcuggaauuacggcucaacuauuaaaugaaauugguaauuuaucucaguaagaauggcuugaagauauuauuuccuccccugccccccccccccagaaucauauucuugaagugcuuaucuuuuuauugcucaccauauacuuauuguagucaucaaauauuuuagauauuacccuuggguacauuaaauauacuaggauuaugcaguuacaccacaguagcuuaacuuuuccuauccaaacucucauuuucugaacucagcuacaugaggauacuuuuugagauggagucuuucucuguugcccaggcuaaagugcaguggcgcgaucucggcuuacugcaaccuccgccuccuggguucaaaccauucuccugccucagccuccugaguagcuggauuauaggcaccugccaccaugccuagcugauuuuuguauuuuuaguagagaugugguuucaccaucuugaccaggcuggucuugaacuccugaccucgugauccacccgccuuggccucccaaagugcugggauuacagccgugagccaccaugcccgcccgacguuacauuuuuagaucaaucucuugcuaucuaaacucuuucugcuugguguuugaaacacagcaugucaguggauucagguaacaaguuaccucuuauuaucaaaacucuuagaauccagauaccaauagauuagaauauugugggauccuuguguaaaauuaagcagucuugacuuaaacaaacuuacauagaaaaaugcauauugccauagacauugaguuacauugagaguuagauuuuauuuuucaaguacuauuugugcuuuauauuuuuauuauugcaauuuuuuuccccccaagacagaguuuugcucuuguugcccaggcuggaguacaauggugcaauuucggcuauucuccugccucagccuccugaguagcugggauuacaggcaugggccaccaugccuggcuaauuuuguauuuuuaguagagacaggguuucuccauguuggucaggcuggucuugaacucccaaccucaggugauccacccgucucggccucccaaaguagugagauuacaggcgugaggcaccgugccgggcuugcaauuacuauuuugagauaagaucucccucugucacccaggcuggaguccaguggcauaaucucugcuuacuguagccucaaccucccaggcuuaagcaauccucccaccucagccucccaaguagcugggacuacaggcacaagccaccaugcccggcuaauuuuuuaaauuauuuguagagaugggaucucacuauguugccggggauuguuuggaacuccugggcucaagcgauccucccgcuuuagccuccuaaagugcugcgauuacaggcgugagccacuguucccagccuuugcuuuuuaaugagcauuuauugagcacauuauauaugcuauacaccaugguagguaccaggcacagucacucuccucaaggagcuuacuuuccuaaugugauguaagcaguuaacuggaagcccucaaauccagacuccuuuaaaauacuuucaaaacacucuuuucuaauagagaucauuaauauuuaaggaauuuguguuuauagaauuguuuugugcuuuuuuaggaaauuaauucugaucaggcuacccagggcaacaucagcagugaccgaggaaagaaaagaacaguaacagcagcuggugcagagaauauccaacaaaaaacagaugagaaaguagaugaaucgggaccucccgccccuuccaaacccaggagaggacgucgacccaagucugaaucucagggcaaugcuaccaaaaaugaugaucuaaauaaaccuauuaacaagggaaggaagagagcugcagugggucaggagagcccuggggguuuggaagcagguaaugccaaagcacccaaacugcaagauuuagccaaaaaggcagcaccagcagaaagacaaauugacuuacaaagguaauguacgccauucuuccucaagugggaauuuagacauuuuguuuuauucguaguauauucuuagugccagucaccccaaacaccuaagcauuugagagagaaaccugcaucugguuuuccuggguccguuuauaauagcaucuguuauuaucucauaacuuccaguuuuaaggcacaaauuugaagaaaaaucuuuuuucuuuguguaauuuuuauuuaggauaugguauuuugauauuucuauuuuuauuaacaagacaaauauuucuuuugcuuagugccuuucaagugguugcagagguuuacauaaaauaagggcuaccuuuuggauacaaggucccagaaauggagaaaacagucacgaaaugucaauagguaauaggucccacucuuuaauucuucguguuauaguuaauucuaacacaggucaacaacuuacaucuuccccacccugcccagaaaaacaacuuaccaaacuguucaucuuugaucauucuugugcugagauuucagacuuuuccuguuggaaaucuagaagguggcuccuuucaccuuggccuuagaacuuaacucauccuccuuuuuuccuuacauaccuaacucauuuaccccugaauuagacuguaggcauuugaguuucuucuagggaagagucccagauuugaucagcucaggauacccccacuauccugcuucaguauuuuuauaaaacucaaugucaggccaugcucaguggcucaugccuguaaucccaacacuuugggaggccuagguggguggaucaccugaggucaggaguucaagaccagccugaccaacauggugaaaccccaucucuacuaaaaaaaaaaaaaaaaaaaaaaggaaaugcaaaaaguuagccaggugugguggugcaugccuguaaucccagcuacucaggaggcugaggcaggagaaugacuugaacccaggaggcagagguugcagugagccaagauugcgacacugcacuccagccugggugacagaaggagacugugucucaaaaaaaaaaaaaaaaguuacugaagcauguguguaaaaacauuuaaaauauuaucauuuaugagcugggcccagugacucucgccuguaaucccaacacuuugggaggccacggcggguagaucacgugaggucaggaguuugagaccaacguggccaacauggugaaaccccaucucuacuaaaaauacaaaaaaaaaaaaaaaaaaaauagaaaaaaaucccggguguggucgugggcaugggcaccuguaaucccagcuacucaggaggcugagacagaagaaucacuugagcccaggaggcagagguugcagugagcagagauugcgccauugcacuccagccugggcgacaaagcgagacuccaucucaaaaaaaacaaaaaaauuagcauuuacggaauucugaaauuuugggcuauuaaauuucuacaucaucuaagugcccucuuggcaaucuuucacauccucucauggcaucugauccagaaggcucaaaccugaucugaguacuaguguguuccuccuacucacuucuguuucuauuaacuaauaaguguaguaaugaaagccaguauuagggacaaauuuuacaugacuuucuucucaaaccuggaccuuuauugaaccucugccucccuuuuucauuaguaugaaaguauguaucuuaaaggguugcucuacgaauuaaauggaucaguaaauauaaagaaagcgccuagcaaagugccuaguacaaaauaaacgcccaacuguuauuguuacuauuguuuuaaauucuaguuuccuuaccccuuaacauacauuuucaguuauacaaaaguugaacguuucccuggagauugccaaaauucucugaacgguuucaagagaucuguccuauucuucaccuacacacaaaaaaguacuaaucaucacacacaggcuaccuaagccaccugaccuuaccucccauuagcugucccuguaccaucuaacuaaaauguacagauacauacuuguggccaggcacgguggcucacgccuguaaucacagcacuuugggaggccaaggcaggcggaucaccugaggucaggaguuucagacuagucuggccaacauggagaaaccccauuucuacuaaaaaugcaaaaauuagcugggcuugguggugcacaccuguagugccagcuacucgcgagacugaggcaggagaauugcuugaacccgggaggcggggguugcagugagccgagauccggccacuacacuccagccugggaaacagagcgauacucugucucaaaaaaacagaaagacaaaaaaacggauacaugcuggaacccugaaaacuuuuucaguagcauuuagaccuucucucauauacagcauuguaaaauccauugcuuugcuuuuagcugcacuaugugccccaauaucaucaaauggcauuuggccuucucuuuacagacugaaaaggcacauuacagaucuuaaauaugcuaguaguagaucaaugggcaguguguuauucagaauacaguauucugugaugguuuucuaaucucagugacaguaggugguuaaauuaaauguuuauggccaggugcgguggcucacaccuauaaucccagcacuuugggaggccaagccaaggugggcagaucuuuuaaggucaggaguucaagaucagccugaccaauauggugaaagccugucuccacugaaaauacaaaaaauuagcugggugugguggcgcaccccuguaaucucagcuacccgggagguagaguuugcagugagcagagauugugccacugcacuccagucuggacgacagagugagacuccaucucaaaaauaaaaauauaaauuaaauacaaaauuagucgggcaugauguugugugccuguacucagggagcugaggugggaggauugcuugagccuggggcugagguuagcgggaauaggcuuuaguguuuaauggggauggaguuucaaucggggaacgugagaaaguucuagagauggauggugguaaugguuguacacaauauaaauaauuggccacuucagaaaggucauggaaaacuggaguuaagagauaaaaauagaaacuuucucaacauaagcuccaucaacuucaagacacuuuuuguaagcaaugauagaagccauuuaguccauccccaaagaacugaggguccugugaguuuaaccauuucaaacagucuuuuuuucauuagugaccaaagaaaaauuggcacucuuuaaaaauuuuuuuaagauuaagaagcaaaaagaagucagaaggagccaaaucaguacuguaagcuggaugccuaaugauuucccaugggaacucuugcagaauugcccuugucugaugagaggaaugagcgagaacauugucaugguggaggaggacucucuggugaagcuuucccaggcauuuuucugcuaaagcuuugacuuuguccaaacacucauaauaagcagauauuaucauuuguuggcuuuccagaaacucaacaagcaaaaugccuugagcaucccaaaaaacuauugccaugaccuuuacucuugaccagucugcuuuuccuuucacuggaccacuuggccacuuugaccucuuaguacccuuuuuuuuuuuuuuuugagacaauaucuggcucucuugcccaggcuagagugcaaugaugcggucuugccucacugcaggcucaaccucccugguagcugggacuacaggcacgcgccacugugcccagcuaaauugcuuugauugugcuuugucuucgggauuguacugguaaagccauguuucaguuccuauugcaguucuucgaauaagugcuucaggaucuugaucguacuugucuagacuuucuauccaaagcucugcucuugucuacagcugaucugggugcaaaggguuuuaacagccauugaguggaaagcuugcucaacuuuaauuuuucagucagaauuuuguaagcugaaccaguugaaaugaccacaguguuggcuauuguuucugcucuugucaguccucuugaaucggcagaaacaagaugaauuuuuuuccccguaaauugauguggagggcaugauguucaacaucaucucaacccuuccugaaacaauuuauccagcuggucaucaugguucaugccuauaauccuaccacuuugggaggcugaggcuggcagaugacuggagccuaggaguuuaagaccagccugggcgauauggcaaaaccccauaucuacaaaaaaaauagaaaaauuagccaggugucugguaugugcccauagucuuggcuacuucagaggcugaggugaggggaucaccugagccugggaggucgaggcuacagugagucaugaucaugccacuccucacugcacccuagccugggugaccgaggagacccugucacacacacacaaaauaccaauuuuaagcuacugauuucuuuggggcauugucucauaaacuuuuccuaaagcaucagugauuucgccauucuuccacccaagcuucaccagacauuugaugcuuuucuugcuucaauuuuagcagaauccuauugcucugauagggacucucuucaaacuuuuuucuuuuuuuuuuuuuuuuuuuuuuuuugagacggaguuucacucuuguggcccaggcuggagugcaacgacacgaucucagcucacugcaaccucugccuccuagguucaagcaauucuccugccucagccucccuaguaucugggauuacaggcgcccgccaccacacccagcuaauuuuauauauauauuuauuuauuuauuuauuauuuuuuucuuuuuuuuaguagagaugggguuucacuauguuggccagacuggucuugaacuccugaccucaggugauccacccaccuuggccucccaaagugcugggauuacaggcgugagccaccacgcccagccucuucaaacuuuuuugagagaccagucucacucugucacucaggcuggagugcaguggcaccaucauggcucacuuuguucuaugagagcacugaggcucaagcaauccucuugccucagccucccaaguagcugggaccauaggugugcaccaccauggcuggcuaauuucuuuuuaaauuuuuugggucuugcuguauugcccaggcuggucucaaacuccuggaaucaagcaaucuuccugcccccaagcaaucuuccugccccagcccucaaacuucucaaauauuuucagugccucaaacuagauccugaucagacauaacaaguuaguaugaguuuauuuuggugcaaaaaaaaaauuuugagccaggaacgguggcucaugccuauaaucucagcacuuugggaggcggguggaucacgaggucaggagaucgagaccauccuggcuaacacggugaaaucccgucucuacuaaauauacaaaaaauuagccaggcgugguggcaggcaucuguacucccagcuacucgggaggcugaggcaggagaauggcaugaacccagggggcggagcuugcagugagcagagaucacaccacugcacuccagccugggcgacagagugagacuccaacucaaaaaaaaaaauaauugaaauccaugcauaauuauuucguaacauucauuuuccacaaacuuuuugaagaccccuuauauucuuguuuuuggguuuuuguuuuguuuuguuuuugaaauggagucuugcucugucacccaggcuggaguacaauggugagaucucggcucacugcacccucugccucccggguucauucaagggauucuugugccucauccuccggagcagcugggacugcagaugugcgccaccacacccggcuaauuuuuguauuuguaguagagacggguuucaccguguugggcagccagaccccuaauauucuuuuuuuuuuuuuuuuuuuuuuuuuuuuugagacgaguuucgcucuuguugccuaggcuggagugcaauggugugaucucggcucaccgcaaccuccgccuuccaguccaagcaauucuccugccucagccucccuaguagcugggauuacaggcaugcgccaccaagccuggcuaauuuuguauuuuuaguagagacaggguuucuccacguuggucaggcuggucuugaacucccgaccucaggugauccgcccaccuuggccucccaaagugcugggauugcaggcgugagccaucgcacccaucccuuuauauucuuaaugccauuaaacuuuauacuuaaaaaugguuaaaaugauaaauuguauuugauauauauuuuaucauaauuuuaaauuuugcugcauuaaaaaacagcuaaugguaauauagugcuuauuauaagucaagcucaauaauaagcucuuuauuuguuaacccauugaauccuuaaaacaacucuauggccaggcacgguggcucacgccuguaaucccagcacuuuaggaugccaaggugggcagaucacgaggucaggaguucaagaccagccuggccaauauggugaaacuccaucuauaauaaaaauacaaaauuuagccgggcaugguggcgcacgcgccucuagucccagcuacucaguaggcugaggcagaagaauugccaggaggcaauugaacuugggaggcggagguugcagugaaccaagaucacaccaugcacuccagccuggaugacagaacaagacuccaucucaaaaaacaaaaacaacucuauguggcuaaguacugcauucuccccaguacuaucauuuccucccaaaaguggaggaaacccagguauaaagggcuauguagcuuuugaucccuuacauaaaugggauuauaggcgugagccauugcgcccggcagaacuguaaguaaaagcacuaguuuauuugaaauaaucacggguuaaauuagaccaauucuacucaucuuuuucaccucuuuugguaguacaugcaaacaaaauccuugcauuuuaggauuagagaggaaaaccgagagauagaucagauguuuuugaaaguggcauacuuuaauugaaucuaacacccaaugccaagaacaagacuggggugaaaauuaguucaaaugggcugggcaugguggcucacgccuuuaaucccagcacuuugggaagccuaggugggcagaucacuugaggucaggaguuugagaccagccuggccaacauggugaaacccuaucucuacuaaaaauacaaaauuagcugggcgugguggcacacaccuguaaucucagcuacucaggaggcugaggcaggagaauugcuuaaaccugggagguuggagguugcagugagccaagaucuugccagugcacuccauccugggcaacagagugauacucugucucaaaaaaaugaaaauuaacaaaaauuaguucaaauguuauuugguacuauagcaagacccugucucuacaaaaaauuuaaaaagaaauuagcccggcauggugguauucaccuguggucccagcuacuugggaugcuguggcaggaggauugcuugagccucaguguucauagcuccagugggccaugauagugccacuguacuccagccugagugauaggugccuggcaucuguauuaguagugacaguaggaaguguuuuaugagcagauaucugaccugccaacauccauuauuaagcaaguaucacacuauaugagcauaaagaaaugaagaccugaacggaccuugcucaggucacuuggcuagugcuacacagggcauggcuuaagaucccagcauaucacuuauugucugucugccucaugauacugcucauggcgguagcuuggaaauuucuuuuuuuuuuuuuuuuuuuuuuuuuuuuuuuuuugaguuggagucucagucugucgcccaggcuggaguacaguggcucgaucucagcucuuugcaagcuccaccuccugggcucacgccauucuccugccucagccuucugaguagcugggaccacaggcacccaccaccacgcccggcuaauuuuuuguauuuuuaguggagacaggguuucaccguguuagccaggauggucuugaucuccugaccuugugauccgcccgccucggccuccaaaagugccgggauuacaggcgugagccaccgcgccuggccggaaauuuuuuuuuuuuuuuguggagaugaagucucacucugucacccaggcuggaguguaguggcgcagucuuggcucacugcgaccuccaccuccuggauuaaagcaauuuuucugcuucagccucccgaguagcuagaacuacaggugugugccaccacaccagcuaauuuuuguguuuuuguagagaugagguuucaccauauuggucaggcugguccugaucuccugaccucgugauccacccaccucggccucccaaagugcugggauuacaggugugagccaccaugcccggccucagcugauguuuugacugcccuucaguugaauggucaaaauccugaaagugccaacuauuuuuauuucauguggaacugcagcuuccaccuugcuacaagauucuaaacauagcucucauuaacugcuaguauucccugugagugauuugacauuccaccugcauuuuccugagaccuggugaggaucauccuguuaagguuuuauaucauuacaguuucaaccaacuaacugguaagagaagacauagaggugccaaaccugagagcaaucaaacacaccgcugagcuacagggugauagaaucagcucuccuuaggggccuugcauuguggagucugaucgggauugcugcacuaaguucagcccuggguuuuauuugauaaagaaggccuggcacccuugugcuucucuguggcccugcauucuaacuccaggugcccaauuuaucagucuuuuauuuuuccuugcaugauucuccacaccuuucacuugcuuuauuuuucacuuccuagaugaucauuuucggcucuguucacaacucugcaguaauaucucaaaagagcuuaccucuuaaccucaccccagucaucuauaggugcucuuuugucgaucugaguacagaaucccaccccagagugguacuuuacacuugcaccaccuccagaaagcuugugcaguuguauuacuugguauuuacuaucauauuuuauuaucauuaauuagugaaaaccauuuuugaggcccuaguauaugccaacuacaguuuacacuuuagguuuguuaacuucauuucaucuucagcucuuuuagguagauuucugaugugugaggcuucuagagccauuuuaauaccacagccauaacuucuaauauguggcaagugcuaacccucgcagaauuccucuuacuagguuuuuacucaaaacauuaggucaguaaugauuauuuuuagcuugauuccuaccuauaggguuuauuuacugguucaaggauacuuuauuccaccaaaacagagagaggaagauaugcaaaauucuccuggccucaguuuuagcugggagcugaugcuaaagguuuuaacuuguaaagguaacguuagaauuuuuagaucggauuuuugugguaaauguauucccucagcuauuugcauguauguggguuucaguaaguauuccuguuuauguuuugggcugcauuuagacuuguuauuccuuuugcaaaaauuccuugaguucacccaauaaaaccaguaaaaaucagccauuugcaguguggucaggaaacagucaacaguauuagcuggacauuaguguugggucucugaguuucggaugaaggaaugaucauuucaguaguuuaguucacuuguuuuuccucuuuguguuaaggcuaucauucagagggcaaacaguucccgguguugugaauugaaaauauguucugaauagauuugcugauuguugaguauguuuugcuuacacuuaaggccaaauucuuccuugaagaugagcuugucaauaaacaucaauggaaaaauaaccccaaauuugugacuucuggggaauuugaauuuaaagagaauaucuguaggauaacagacuguggguuucuagucguuggauuaacauguuuuguuuagcaugcuuagugugggaguguucaaggaucuuagaauuuguuuuucuuaaagcaaagaauugacugaguuuuugugcucauuuguauaaugagaagguuuccucccaucauguggguucguaucucaaaauuaaccccuaaguauauauccucaaauguguauccucauguguuaaacagcuauauauuaguucaauaugaauuuuuuuuaguaacaagugaauuuuucucaaaauaacaugaaauuuuucagaagccaagugcuugcagugauggcaguucaucuugguacauagaaucaaguccaggagcucuuccagugaccugggucuuucagaagucugugagagcagcccaagaaauacagaggacucagggcuaggaaagggaagcuuccugaagguguagcaggcagcuuguaaauaauucuuuggccggguccagugguucaugccuguaaucucagcacuuuggaggccaaagcaggcugaucacuaggucaggaguucaagaccagccuggccaacauagugaaaccccaucucuacuaaaaauacaaaaauuagcugcgcgugggggcgcaaccuauagucccagcuacucaagaggccgaggcaggagaaucgcuugaaccugggagguggagguuguggugagccgagaucaugccaagcacuccagccugggcaacagagcaagacucugccucaaaaaaaaaaaaauucuuuaauagcauauuguuaaaauugcuucaaauaguauaacaaauuaauagucucuguaugaauuguaauaaucacuuagcucuuuuagcauuguuaccuuuauaaaauauguauguaguaaaggaguuugggaauauaucuuucuuucucuuuuagguguaaaauuguggaaaaggagacagucuuacuacugaucaggcugauuaaaaauguagaaugggccgggcguggugguucaugccuguaaucccagcacuuugggaggccgaggcaggcagaccacgaggucuagaguucaagaccauccugaccaacauggugaaacaccgucucuacuaaaaauacaaaaaaugagcugggcaugguggcacgcaccuguagucccagcuacucaggaggcugagacaggaguaucgcuugaacccgggagguggagcuugcagugagcccagaucacaccacugcacuccagccuggcaacagagcgagacuccaucucaaauaaauaaauaaauaaauaaauaaauaaaaauguggaaugaauuaggcaaguugggcugcuaaugccuugccacugaauugaacagccacagacaaaccagaaugcacuucucagggcaaaagaacaaauauugaugaagucaaucccaacaugcucauuccuuuucccuaaucucaucuauuagaugaguuccuccuucucccaaagaggaguaggugagaggaggugagaaagaggccaugucccacucuccugugcuuccagggaucagaauuucccucccuauuagggaaaugcguuuaaaaaaaaaaaaaaaacacgccaguuugguugggauguuuuuaguaugcuaaaacguuuauguuuacccagcucaugagucagaaguuauuuugcugcuuauaaauucauuuugccauaguaugauaaauagcuuuuaauguuguaagcaaauagggcauuggauagcagcacuaagucauugaaaacaaaaacuucuuuauugguguuugguuuuuauauaguuuagggaaaggcucuuuaaaccaaguuucaggugaaaaaaugaaaaaacuuuuuaaggauuuuagauaacaugccaagcacagugacucaugccuguaaucccaguagugaaucugagaagcgcaggcuucccagaucgcuugagcucaggaguugaagaccagccugggcaacauaaugagaucccgucuguacaaauaauuuaaaaauuagccagccaugguggugugcgccuauaguucuagcuauuugggaggcucaggcuggacgcugagccuggaggaccacuugaacccaggaguuggggcugagugagccaugaucgugccacuguacuucagccugagugacagagugagauccugaugcuuaaguuuaaaaaaaaaaaaaaagauuuuagauaacaacuauggaaaugaaaucauuuucguuugguuuauaucuucuccacaucuuuucuaacuuugcguucuauucuuaacccuaagguaaaaaugcauuugcaaagggagaaaaugaaggccaaacagaagcaggcuccagcuucugcaaaaacuuggauucacaaaugucccugaacagaaaaugaagcucacuucagaacacacacucucugccuugaaaacuaaagagacuauuacuuccuuuucacaugaccacaaguccucugauggaaauguacagcagaaacucuugagagagaggcuaaaagcaacucuguucucccccuuccccuagacuuuucuuacgaaaagucaauaauuaagcaaauugcuuaacacuugguuccaguuccugccuaucuggaguuuaaaugcguaauacaccauuaauuuccacgcugcaguuuuuauuuuaaagaaaguaacaagaugucuuuacacugacacugaaaauucauccauuuuagagccaggaauucccauguuacacaggaaaaaauagaagucuacugaauuaauuuuuuaaaagaaaagagaucagauuaaauauuucuuuguuuuuccuuuuggaaacuuuuauguauaauucuuucugccugccuacuuuucugcaaaaaugagauguacagauuucgguucccugcuaugaaaagugaugugguagcaauuuuauaaauguugcuuucugauuuuuaucagagugagaaaauuaaaauuauugauuugcaaguaguaaacaguucauauuuugauuuccccucauuuuaguuuaauauaauuugcaauaaauguacauauuguuguuuguuucauaaagcauaucacuuuaaaaugguuuuuacuccugugauuauguuggaauauuuggaauuuuaaaggaguaaagacuguccagcauuugguuuuauaauguuugucaccagauuuuuauuaauguaaaaaaaaucaauuuuuaaaaaauaguuggacuuuggcagcuuuuaaggaaaguuggagguguuuuaggauugcuaucaauuuucagcauugugcuauuuggaaauaaguguuuugcuuuugucugauggucugggcucauuuuuauguuuauuuuagaaaacuguugcaucaauauauuauguuucuuggcauuguucagcauagguaaugugugcacuuuauguguacacauaaucauauuuaaguuuuuugcauaaaauaaaugcuucuagaugucauggcagucuuuuuaaucuuuuuaucauaugcuuucuugugaauuuuuucauguuaaagagcuaaagucauaacaugauuacagucaacucuccauuaucuauauaaaauagugacuaagccucagguuuuuaauuuugugauaacaaaauaacgaaggcauguaagaccugauucuggaggaacaugaaauuugucuuuucucauguccagaguucuauccugcccccacuguccacuguagggucauccgcaaagcccuagcagaaugugcucacuccauuuccuuacacguuucuagcaugggucagaggaaacaacauuuguguuauaacuucgucuugauaggcuguaguguacaugggauguaaaacaaacaaguguaucaaagguggaugauucuguuagagugaaguuugagaguaaaugucacuuacguuucucauagauaaucaagaguuggcuguguauugacugaaagauggguaauuauuuuaaauaugcauuuacacacauuuagguaucagaagaugcuuagggaacaauggauaccaaugauagaaaaugauaccuuuacaggggcagaaaaauccccacucuuccuuauugccucuucagaacccuuuagaaaguauaaaauauugccuccaacaugcugaaaaagaguaucuaugcauaaguaucagagaagucccucaagcaaucaguagguguguucuauuuagagagaguuuaaaguucucuuagcaucagacaacuugauuccuaagguuuccagugugucaccaacaaaaagugcauugauagggaccuuugucucuuccucccuuugauuaauugcccggcaucacaguuuacuagauuaccaaguguuacaucauauuaaauaaaauguagcagaaccaucugcaucaauauauuccuguuuagauuuuugcaggagagaaguuaaaaggauuugcuccuuguaugauguaaguggcccaccccaauuuuguaacaugaugcaagugucuggcacuaagggaagcaagaguaggguuguggaaagaccaagcugauggggagggacuuguuuacgggaauuuuuuuaguuuuccuuuucaaaggaaaacauuaaaaucccuuaggaauuugguauucacaucucagagaacuacaacacaaaagugcagacuuauauuugagaauuaauguuaacccuuugugucuaguuugaagcuucuuguauuugucuaaaacaacaagccagaauuuuguaucuccuuugauaaaaaguguguauaauguaaaguaguuuugcauauucuugugcugcacaugggcugaauuuuuaaauuuuuuuuaaaaacuugaagcagaaccuuguaauuuguguaaaugacaaguguaaaauccuaccauaaaaugcuaaaaauaugcacuguuucaaauaaaaccaagaaaugcagcauua

SEQ ID NO: 191476 - RNA, 25688 nt, Homo sapiens
acggaaaugaaaggagcacuuccggguucggcaauaaccuggagccggcggcguagguuggcucuuuagggcuucaccccgaagcuccaccuucgcucccgucuuucuggaaacaccgcuuugaucucggcggugcgggacagguaccucccggcugcugcgggugcccuggauccagucggcugcaccaggcgagcgagacccuucccugguggaggcucagaguuccggcagggugcauccggccuguguguggcgcgaggcagggaagccgguacccggguccuggccccagcgcugacguuuucucuccccuuucuucucucuucgcgguugcggcgucgcagacgcuagugugagcccccauggcagauacgaccccgaacggcccccaaggggcgggcgcugugguaagugcgagggcaggguagucuggcuugauuugcaagaguuaggaagaagcaggaagcguugcgagucccgaggcguuccagaagcucagugcauucaggaaugggauuaaugaguugggguggggaaguuggagcggggagaggggagguccugagcgaagauauggagggaacuacaaguuuguuucugaagcgacaauaggcugaccuggagcugguggcccccaccuguaugccauggaaauugggccuucuuuccucuucucccaccucggucuuuuguuuaccguaggccccaagguuaaagaugccgcaugagauugugccaugacacacaugauccaugacacacaccacguggagcacacgagugccggcaaagaacguuucugccuaguuuauacaaucguauauagaaauuaugcaaagggaggagagcgguggucuuuuucuucuucacuuuguucuuuaugaagagaaauaucauuaugcuuuuguaauuuuuuuaagaugcugaucuggagcuaacaaguuauuugugcccggagcauugcuguccucuacuuuuuaauccauaaguaguuaaguauuauucugugugaccacaaugcaguuaccacauuugggaaauauuaccuaauauaaaauccaugugcaaauuuccauaauuguccuuuaaagcugcuuucucuucaucugggauucugucaaaaagcaugcaucgaugggcuggcgcaguggcucacuccuguaagcccagaacuuugggaguccaaggcgggaggaucgcuugaguucaggaguuagagaccagccuuggaaacauagcgagaccucaucucuacuagaaaucaaagaaauuaggcggggcgugguggcucacgccuguaaucucagcacuuugggaggccaaggcggguggaucgcuugcgcccgagaaguugaagcugccgugagccaagaucgcgccacugcacuccagccugggugauagagcaaaaccuucucucaaaacaaacaaacaaacaaacaaacauaaauuagccggucguggaggugcgcuccuauagucccagcauagucccagcuacucaggaggcugagguggguugugcuuuugcgcuccagccuggggugacagagcgagacccuaucucagaaagcaugcauucaauuuacuggccauaucuuguuuacugccuuuuaaucuagaacaguucugcccucuccuccccuuuuuugucuuuuaagauacugauaguuuucaagaguccagacauguuuugcagcauauauagguacaucuaauauguauaucuauauuauauaucaggaagcauuuuacauugauuuaucccaucauugcagaauuuguuugauuauuugauuaaggugguguccaccaguuucuccauuguaaagauaccuuuuuuccuuucuaauuaaaaaguguucuuuggcaugauacugugacacugugugaauauugcuccucaacaauuuuucacccaaagaucuagugauuuuuuuuuuuuuuugccugaugguuggacaguuuacucuuaaaaaauguauaccaauagacuuucuuaaacuuuuaaaauuguauaauauacauaaguguguacaaaaugaaacgcauagcucaaugauuuauugcagaauaaacaaccugaacaaauagauuuuaaggagaauguucuaaaacuaacuuucaagcuguggugcccagucauaauauuuguugagaaacugagcacaguaagcuggauucauccuucacuugauuacugcuaaucauuucaguuuauuggagucacaguacgguaagucuggauuuaaugauaaaucaaaguuguauuucauauuucugaaauuaccuacauguggguuaaaaagacauaaaauaaaacagccuggaauuuuacaauguacuuggauuuuucccucaaauuuuuuauauuuuuuuuucaaaagauaaugaaauuaaauuacauagagcaguguuuuuagacuucagguagacccauuagugaguugagaagucaguuuaguguaaacaccagcuauuuuuaaaaaauuaaauagaaaaugucaaaauccauuauauacaguaggguaaauauuugugaaacuuuuguuuauauauccauguauauggaucucaauguuaaaauuacgaagauccuagacaaaaaauguaaaagccacuuuugaauauaagauacauuuuaaugagaaaacacauuuuaagauucugcuuuagugguaauagacauaaguauuggggggaaagcagcaaaggaaagauagaaugggaaaaaaaugggggaagaaaaugguauaggaaaguuuaaucuaggaccaccgaaacuaggguaagacuugugggggaacauggaggugauaaagagagugguguaaucagagaggcagguggccauuuaauaccugucagccacauuuugagcaccuagaguaugccaggcccuugugcauguaggcagauuacaaggcgaaugaguuuaguuguuacuacuaucaugguuuuauauuucuucuucaaaagguuucuuuaaucccaacuggcuuuaugugauguuuuacucagcucugagaccuaccuauucggauuugagauuuuuugcuaagaauaggcauauggaucucuugagagcaauuaguuuuuguuuaauguucuuuuaaaauagaugaagccaauauugcaaguguuaaaggaacacagacaauuguaguugaauuucuguuaagauuauuuuuucuaauuaauuagucuuugcauuuuuuuaaaaugucagcugauauuuuucuauuuauuucuguuuaaguacuucuugugcuuuccacaugaaaacuauaagguguuuggacuucucauuaagcauauacaugaaacauguaauugccuuagaguuuucaccuaaugaucuaaaaaaacaaauggaggaagauuaaaauauuuugaguagacauaaaaaccacacagucuugaugcuuaaaaacaugauuugcaggcauagcuuacaguauuuuucuuuuuaaauuuagcaauucaugaugaccaauaaacuggacacggcaauguggcuuucucgcuuguucacaguuuacugcucugcucuguuuguucugccucuucuuggguauguauuauacauauugcugccuuugauauucaauuguugagucaguuuauauggagugccuuuuagguguaagacuuauuaaccuguaaaggguuuagggacaaauaaaauacaaguuccagccuucagguacuaacaaccuaauaacauuaucagaggaauauuuuauaucuugugcuuugugaaacuaacacauugaaaauccaaggaaaaauugaugugugggaaugagauaaguucauguuuuuuucauuuuuacuuauuacuugacaggaagguccugcuuuauaaaauucaauuuuauaaauugauuauaagaaauucaguugggcauauauaugaagugaagcuauuaaaacgguagaauaaguucauguaauuuuuuucuauugacaagugauuuagguguugugcaauuaugaugcaauucacaaaggaggaagagacacugcaguuguuuaugucucaugauaaccucuccucugguaauuugcagguugcaugaagcagcaagcuuuuaccaacgugcuuugcuggcaaaugcucuuaccagugcucugaggcugcaucaaagauuaccacacuuccaguuaagcagagcauuccuggcccaggcuuuguuagaggacagcugccacuaccuguuguauucacucaucuuuguaaauuccuauccaguuacaaguauccuuuucuaccuuguuaacaaugaaauugccaacuaagcauauaggagaucucuucugauuauuucagcaaugaaggcauuccaugaagccuggguuuguucucggcacuucauuugaaugaagauauguuuaguguaagaauuucugacuuuaaaaugugaaaucuaaacuuugaagagcugauuuaggaauuuuaaacuaucuuuguucuugccucuuguaagcuucccuauuagaauggauauuuucaaauuccccuucgaagcacaaccuuacgcagaacuuacuuuaauauuuacauuuuuuucauuuaauucacguuuuuggcaaaguguccagaugucuugcuuuaaaaaagagagguccucagcucuuuccaucuuaaccccagugaacuagauacaaauggaauuuaaccaagaaacaacuuauuuaagcagguaaugagauaaucaauacaaagaaauuaauauuugcuguguauagaguagaaaauaaggacacacauggauaauccgugaagcuaaugagaaauaauucauuuggaauuuguauguuuucacauuucaaagguguguugugggaugauacuggguaguccauaaaggaggggaaaaauggggaagagguucuauagugaacacuagguuaaacuuucuuuuuuuuuuuuuuuuuuuuuuuugagacagagucuugcucuguugcccaggccaccugccucugccucccaaagugcugggauuauaggcgugagccaucacgcccagccaggucaaacauuuuuaaauaggguucuuuacuauaguggcuuugguauucuaacguguguugugaaacuaagagaguuaguaggguuuuuuaaacuuaaauuugugguuguuuuuuuuccuguagauuaucucugcaaaucauuuugugcauugagaagugcuggucuaagagcuuuugaauauuuaugauacaucuguauguuauguaaagcacaauaaaauauuccucugagacugaauauuaccuauuuagauaccuaugcucaugaaguaucaaauuuuuaaauagauuuuuauaagucuuaaggaaaagaaauaggaggaaaccgaaauuuccugagcaccuauuuugccaguauaagaacuugaauuuaggccaggcgcgguggcucacgugcgguggcacuuugggaggcugaggugggcggaucaugaggucaggagauugagaccauccuggcuaauauggcgaaaccccaucucuacuaaaaauacaaaaaauuagcugggcaugguggcaugugccuguagucccagcugcucgggaggcugaggcaggagaaucguuugaacccuggaguggagguugcagugaacugagauugugccacugcacucuagccugggcgacagagcgagacuccuucucaaaaaaaaaaaaaaaaaaaaaaagaacuugacauuuaaucuuuguagcacucugaaaaaaauuguugugguauauuuuuaauaaagaugcugauuugcugauugucaguauucacuucccacacauuggcuaguaaguaguaaugcugaaaaagucuuucuaacuuaaaagcucuaccuuaucuacaguuagugggugaguaauacuuaaguauacauuaaaaauauuucuuucuguauguggguaaaccugguaauuucauuuaaauauucaguauauggagauucccuuuaaauuacucacuucacugagauaauguggguaguuugaaauguaaggauaaaauuuuuccuguuucaaugcaugagucuguaaugucccaucauaauuuguauugguuuauuuuuagguaaaacucauuaaaugauuacuauacuacaacuguaaaugauaaucacauuuguuuggcauauuauuggcuugaccagccucuguugauugaagugcuuugcagucaccaauguuaaaauucuagccuuucugagcuauaacgggaaguuauguagagauuuuuggucaugccuuuuaguagcuuaaaauuucuuuggagggagaaauagaaaugacagaaaauguguuucaauguaggguaaacugaauacgucaauaacuuugggaacagugccucacacagaucaggcacucaguaaguuuuguugagugaauccugaggucuugccaaaugagacucaugacuggugaagaaaaccuuucugccuuuuuauacaguugguuauuugguagccccucuuuccugggaauguugaagauuaaggauuucauauuccuuaaauucuuacaaagggaauguaguaaacagugggaauaacauaaacuaguaauuggcagcaaaugcuaaucugauuauuaaagugauaugguaauaaauaaaagcgggcccaaaguaauauuacagauuugcguucugauccuucuucuuauaaaagugauauuuuguccuugcuugauuaauaacagauagggcauuucaccucuuaucuuuucuaaauacauuguauuaauaguuuaagaguaauguugaagacuaagauuaugaaucucuuaccaaggauuugugaacuauagaauguuagacauaaaagacucauuggcaguuucuagcuuugaucucugcauacucauuugccagagcaugaaacuugaccuaggaaaauuagguuagugacagagucaggaguggaacucagguaucuugacucccaauucagggcucuauuuucacuaccugacacugccccuuuuauugaauucagucuggauaugugucaaaguuuaaauugaauucuuuaaggaucgacagaguuuuauagugacuuuuggagaggguuguagcuuccaucaguuucaaaguagucuaugauucauuaaaaaauuuaaaacuuuuuauauacauauaugaucucuacuuaggaaauggacauuuuucuuaauucuuguuagaggugggaaugaguuggucaggauauuaauuuggagaacuauauuagggaguuaggguucuucuaauacuuggauauagguuggugucuugcuugucaauuggaaacugggacccuugaauuccuaaaugaguuaugguuauaaugaauuugauacucagauuauguuacagcaaucacuauuuccugucauauuaggccuucaguuaguauagaaaaauacaaugguucauuucuuaggaacugguaauauuuuuaggacaaguauuuuugccauuugugauugacuaacagucuauaucauuuuguggaacuacuugacaauuuuuuuuuuuuaaucaaccuggcagaaauugggguggagaauggggucuuuugaacaauuuccauuuuucaaaaaguugaaugaaaaauguauguuuauccauggcauaaagccaaacaguuggacucaaaaggauucuuuccuuaugucuguaauuaagcugaugagaguuucaauugacuauauacaaagcaaaauacauacugccuuguuaauuuuuacaaauugagagcauaacugugacaacuuguuagguauaguaucucaaaauaauggaguccuuguaggaaagaaguaauaaaagaucuuuagucuuugggacuaaaaauuugggaauuacucuuuaaacuguuaccuuagacucuuuccucagcguuugagauugugaaagcacuguaaaacuacuguguuugaaggcuaaguuagagugaccaagaaagccguuguaggguuagaagcuauacuuacaacccuuugggguggccuagauuucaguuuaauuuagcaaguguuuacauuguuacccaguagaaaugaaggaaaaaccuuuuuuucacuauuaauuuuugucaugaaaagaacugugaauuggccgggcgcagugacucacaccuguaaucccagcacuuugggaggccgaggugggcauaucaccugugguaaggaguucgagaccagccuggccaacauggugaaaacccaucucuacuaaaaauacaaaaauuagcugggcgugguggcaggcgccuauaaucccagcuacucgggaggcugaggcaggagaaucacuugaacccaggagguggagguugcagugagccaagauuacgccauugcacuccagccugggggagaagagugagacuuugucucaaaaaaaaaaaagaacugugaauuuuagaaaaugaaauaguuuacuuucuucuuuauagugaacaaaauuugauuuggcuuaaaguguaucaguaaaacaagccauuccacugaacucauuuuagcagauguuucacaucuguauauuuggacauaauacauagucuguuuugcagaauacuugaugacuuuuaaauguuuuccuuaauuguuuucuuuagugaguaucuucccagucuuguuauucucuuugcuucaugcugccacauauacgaaaaagguccuugacguaaguaaaacugcucuuugucugacuucugaauuacagaucauugacaugaauuugaguucuaagacauuuugguauuugucacaaaaagucccucuauaccuuacaaacuuguuaugaauuauuuagugauuugaaaguuuuaaguuuaaaaguguuuauuguugaaguuucacaaacuagaacauuuuauagauaaaggauugcacuuaaaaucaccccccagucuccaggggaauuuuucaaguuugaaauagaucaguuuuuuugaaaccugugucucuaaaguuuguugaguugucagaucucuuguucugucaguguuuaauucuggcauaccugauaaguugaguguacugaaugaaucucuuguacacuaauuuucagaacugcugcuuuccugaaauucuuucuuauugcuagguuggagcauuaaaccuaacuuggcaccaggccauuuacagcauauacugaaauuugaauuaaaauauccaggcacauuuaccaagcacauuuacagaaauuugaauuaaaauagccagauuuaugcuuuguauuggccuuuuucuuuaucccuauaauucuuuggucacagcaguaauuacacugcuguauaauucuaacauuagcuaagaaaggagucacagauauuuuaacuguauuacuggauagucagauuuuguugugguuagagagaaauaaccacuauuuuuuguuaaauaaucauucuugagaaaaagcagcuaagaaugaaaaguacuuuuacuaaaguuguuuuuuauauuaagucuaaaaauguaaaaaagcaggaaaauauacuauauuuguccuuaaauaguuugugaacuucguaccaucauuuccaaaguaguauauuugguuguauugccuguuggauaggcuguuuaccuacagaaagaaaauauuguuaucagaaaugcuucacuuauuucuaauguugguuuucuuuuguuuuaggcaaggggcucaaauaguuuaccucugcugagaucugucuuggacaaauuaagugcuaaucaacaaaauauucugaaauucauugcuugcaaugaaauauuccugaugccugcgacaguuuuuaugcuuuuuagguaaggaaaaauuauauuuguuuugggaggcugaugacugaacguaauaaagauaguaacucaaguuuuauucuguuuaaaucuguugaagguagguauugacauguagagcuaaaugaaucuuagcaguugccuaaucuaaccuuugucauuuauaguagagaacuugaaauauaguagaccuaggaauuugucuuauuccuugugauuuaucauuugacauuuuaaaaauuacuuucauaguuaccaccuuugaaagaaucuuaugaaaucuaaucuaguccagucugucacuauugagaugauguuucuuacacuagagaaaaacuuuuaaaauuauguucuuauauuaauagugccuacuaucaccuuauuuuguuuguaucuuaauuauagaaguaauacaugaauaaagaaagccauccuuuuaaaaguaugaacauuaaaauaguauugaccucugcauugaaauuuuugcauuacauuuuaaaacaauacaccuugcuacccagaugauugcuuuaucaauuuuuaguuuuacaaguaaugagacauuacagauaaaagcuaaaauagcauuugacuauaugaauucuugcugcaauuuuguccucuucccaaagguguaaggaguuuaauaugugucuauguauguaguccuuuaaaaauacuuauacaaauuuguagaacauauauauuauggauguggaguuuuguuuguuaauuuguuuaguucuuauuuuacaucaaagauguuauucuggcugggcacaguggcucaugccuguaaucccagcauuuugggaggccaaagugggcagaucacuugaggucaggaguucaagaccagccugaccaacauagugaaacccugucucuguuaaaaauacaaaaauuagccaggcaugguggugcacaccuguaaucccagcuacucgggaggcugagacaggagaauuguuugaaucugggagguggaaguugcagugagcccauaucacgucacugcacugcagccugggcaacagagugagacucugucucaccaaaaaaaaaaaaaaaaaagaaaaggaaaaaaaaaaguguuauucuguaccuuuuucccacuuguauguuuucauaaccuaauugauuuggcauauccaguucuguuuuuuuuuuuuuuuuagccguauaacauuccaacuuaucuccugaucauggaauauguuuccaaauuuucaguuuuccaaauauugaugcaguaaauauuuuuuaccugcuuauacuuaaugccaguguuuucuuuaacauagauaccagaauugauuuugcuaguacaagcuaggugccuuuuguguuuaauggaccaugcuaaauuguucuuuaaaaugucuguauuaccuguuuuucauaauuuuguuaguuuguaacaaauguccuuauugaucauauaguuauauuuuauaauuuuaaauguaccuugccuugauuaacuaguaaaguuuucauguacuugacaguuacuucuuucuauagcagucucuucaaacuaagaacagaguuuuauagauuuccuuauaaauauauaucuguuucauucuuuuaaguagugcuuucuucugagaacuccaggacuggcugguguugcuuaaguuguauggucccaacuagauuugaugcaguuguauuuguaaauuaacucuaaaaccuugacccuaaaauuuaauaaaagcauccucuuauccuagaagcugaaagcauauaaaagaaaaggguaauguaaucugggacagcagaaaaagggacaacaucaacauucuaauauuuuuuccaucauuuauagguuuuucuuuccaccucuuucuuuugugauccugaucuacacuuagaaacuuuaauuauuaauuaguaagaggaacuuuuugcucccuuuuguuauucauuuuucucggguuuuugugucacuuaauccugcuuuugggucaggaucacagguucugugauuuguuucauguaacuagaugaaaguuaaaaugguagauaccaggccgagcacgguggcucacagccuguaaacccagcacuuugggaagccaaagcuggcagagcaugaggucaagagaucgagaccauccuggccaauguggugaaaccccgucucuacuaaaaauacaaaaauuagcugggccugguggugugugccuguagucccagcuacucgggaggcugaggcaggagaaucgcuugaacccuggaggcagagguugcagugagccgagaucgugccacugcgcuccagccuggcgacagaccaagacucccucucaaaaaaaaaaaaaaagauagauaccgagacuaguuuuuuuguauggguauaauugaugucuauauccugaaaccuccagauucuguuuaguaagcaaaauaauuucuuaugcuccucuuaaaucagauuaaaauaauuuuaaugaaauucugagaugccaugcaaacuuagacaaaaacuucacuuuggaacuauagugaauuuuuuguuaggagcaccagguuuugacugcguugguacauuaauucaauugugcuccuuaaauguuuaauuuaaacauuuauuuguacaaacuuaccaucuuaauuuuuaagauuacuguaaaaaagaugagaauuuaccagaaauguuuaaauagagaaauaauuuuguuugaaaaauuaaaaucagcuuauaaagugguacuuaauuccuauuaggaaaagcuguuaaugccuuaaguagguaguuugaauaugaccuaaacaauaaaauuaagaacagucuuacauuacugcuauucuuaauaugcuacccuuucugguauacacacagucuaauauuaggaggcuuuaucaaguuacauuugugccaguaaugcuucaagcucuguauuuaaaaauugaugcauugucugaguuuaucuuacacaugcguugcacaugugugcaaagacagguaaaaggaucauuguggcuuuucuucuaauugacuggagccacccaaauauucauuaguacggaguuuguuacauaauaguccaagcauuagaugguauauuugaagcuguaaaaaagauugcgguaauuuauguguugugauaugggauaaucaccaagauauaauaaguuaaacuuaguuguguaggguguucuccauuuauauuuagugggguguauguguguaaggacauagacguuucugucucaguuuuuugggaaugauaaaccaucucuguccuagaguuguuaaacagauuuagugaauuauaaagugagcacuaucaauguuagucauuauauacacuuguauauauacauuucuggaaggacauauucgagauugugguauaaguuugaggaaggggcuaacuuggaugaugggaaacuuguuuuuuaagugaauauuuucuauuuauauuuucuauguugugucucuuacauuuucacuuuaaaaagauaaaaauuugucaaauuauuagggaaaauggauguugcauuuguuuagugguaaguucguaaucguguaaauuuuuuuuaaugaaaaugauacaauuuagaagaaaaggcuaaaaaaccuaauaaaacacauuuggcaucuuaauauauuucuuccaauuuaaaaaaauacaauuguaauaauauguguaguuuuauauucugcuuuuuucagaguugcuauguaauuuucauaaccaagauucuagguaguugcauauuaaauccauuaaauaaccauaauauaaguuguucaauucuacuuccuuacaguucacauuagguuguugccacauuuuguuuguaguuauuucagugaaugucuuaauucagauaguuuuucuuagggaagaauuccagaccugguauuucauaaacauauauauaauucuugggauauuguaauuguguuuuuuaaccaagaacaauaauuaguauaggcuguuuagauuuacugaugagccaguguaauuuuuuugguggaggggaguguuuguuucuuuuuauauauauaaaauaagucacuuuucauuugcauauuuuaugaagcuuuacaacuugauuucaucaauuaguaauuacggaauuauuuaacauuuucugauuuauuuaguauuuuaaaaaauuucaaaaguaauacagauaagaauacauuuauaaaaaaauuaaacaacauuuuacucuuuaccaaucauguacauucuuuuauauccuuuuuuaaggauaacuuggauuuagacaugauagauuucacuaugaccauuugaugaaugaagauacacauauucuccaguugaauugcuuuuaaguuuugagaguauacacaugaauugaaauguauauuuaucacgcuuguauuuguuuauuucaguggucaaggaaguuugcuccaaccuuuuauauacuauagauuucuuacccuucgauauucgucucgaagaaacccauauugucgguaagcugaugauuauuuuaggcauguuuuauuuguugagaguauugugaauauauaguauucgcaauucuuaagaguuacuuagcuaauguguuagacuuuagaagcaagcaguguuuuuguaaauuuaaguucuaggccuuagaauguacugggguuggugaggaagugguuguauuuguucuuagaaacugagacugcaguuaucuacgccaccucuaaagcacugcuaaaacuuagcaaauuuuaaaauguauaagacauagauuccacucucaacuuuccuaguugaagaaacaaaacacgugucaauuagauaaacaaugguuaggauacagaauucacaagccaauagauaaugaaugccauauguuugcuuuauuauaucaguacugcaguccacagaagggagagaucauugggccagaagauagaugagcccaggaagguuucacaaaauugagauugugggaggaguaaagcuuuugaauagggaaaagcauuuuagguggggcaagagagacgagaagcacaagccauauuugaggaacuuuauguagagcuguuuugacucuaauggagauucugaauggcuaauugcuggagcuaagauuagaaagguauauuggagcuauauuauaaaacuucuugaguuuuaggguaagaaguuuggaauuuaucuuuuaggugaaugggaaugaugguuuugacaucgucagaauauucuucugauacccuugugccagaagaguuugaagcagaaaaauggggaagcagagaaauuuuagggaauuacuguaguuuucaggaauggaggcuuaaauuaauauacacuaaauuaugcauucugaucucaagcauuggaguaaaacuaaaaugauacucaaauacuaauauuaagauaaucuauuuuuaaguuuaaaauaauguagaauucagcuagaaauccaaugagugcauuacagcaaucuguauauuuucauaaguacaguaaaaagaacuugaauuugaaugcuggcccaucauuaacuaguugugugacuaggcagguuauuuauuuggauuucuucauugguagaggaaauaacuccuucugggggugaagcgaaguaauauuuuaaaaguacuuagacuguuauguucuuacuaguucauuuucauuauucuaugaucugauuuucuguucagagcguuuuuaugcucuauuagacaaugucuuuuuuauaauacuuucuaaaauagaacuuauuuuagacauucguucuuagugagucucuaguagcaaauuaacauucauuuuuacuugauuucuugaguuuuagccuuuuuucuuucuggucccuauauucauuucagacauuaucuuauauucucuugcccugacaucuguuauuuuaaucagcauauuuguuuuucugugcuucuuugugccuccuucuccauucccauuuucuucacauacccuuaaaucauauuaguacaucuagaauucaguuuucaguggacugaaaaggaaaggauagcagugaaucaagauaacacaaauaugugcugguaaacaucuucaaagcugucuuauaagcacccauuuuaaccaaaccaguggaaagguaauggaaaauauuucagcuuguaaauauugauaaacaggcuauaaaacuacauuuucaguacuacacuuuuuuuaauuaaagguuuugagaccaucucuauucacaauuuguaccauuuucaccuacgauauuuauucucaaguuggugguuucaguuguuuuuggaucucuagugcagauugucuauagcugugcuguccaguacagcacagcaaccacauuugaccuuuaaauaaaauucauaaaacuuagaacuugguuccuuuugagcacaguucagguggguacucaaaagccauguguugcugauggcaacugugggucagcacacauaugcaaaaauuuugucauuacucaaaguucuguugucagugcuauuaaggaacucucugacugguccuucagcacagauaugcaaaaauuuuaucauuguucaaaguucuguuguccgugcuguuaaggaacucugacuuggucugugccagcgaugcagccaguaauaaaagaacuaugugacuuuagugaaagcgauugacuucauuaguccucaugucuucuagcuuuauucauuugacugauugguuaaaacagugauuguauguugaugaacuuauguggaauuaaaauaucuucuuucagagguacucacugcugaauaaauuagacagcuauguaagucagugugaugaugaaggugcucugaaagcauagagaacagacagagacaaauaagaauucacugaggaggugggaacauaagccaagucuuuuaaagaaugagccugaguucugacacaugggugccugaaaagugcuuagcauacuugagcucaggaaguauauagagaauugauaaauaucuguguccacaaagguagaugguagaaaggacuagaucaugaaaggguuuggauuuuauuuugagguaaggagagccuuugaagauuguaacauagagaggcugggaacccccaugaugaaaucugauuuagaaauauuccagaaaauggauugcaagcucagcaagagaagaaaaauaucaauuuggagacuauuagaguagucuagagccugaauuaauccagugguaaaaggaaaaggggacaaauaugaaagguauuaggagauaggauauuagggcuugagagaaaagaguaaauuaaagacccacagguuucuggcuuggaagccuaagaguuguaauggugcucucacgaagacaggagauacaggaagggcagguuuuggaaaauuaugcauuacuccaaauauuauuauuccugucuuucugugcaagcauauuaaauacuuguuuagaaaaguagauuuguugcuuuuuuucuaaccauagaaguaaaacaggacacaaaaagguagaauaguaguugcaucuuuauacaggaugagucagcacauaaggugaaaauugugaaugguuaaaauuacccuugaugauccuucauaucacuuauaaaugucaguacaguauacaugauuuuguguauacuagccuguauaauauaugugauaucuacaguauguaauaauacuuuguaggcagugagcacaguuaagacauaggcaaagcccacaugguuuugggcacaaacaugcaacauaaguugaugauaggagcgagggcagggaguggcaggagauggggcagaaaauuagauugagacuagauuguggaggguauugggugugacaccgaguacuugggcuuuagucggaaggcauaaaagagucauaguucaguguauugauccaacugggaaguaacauuuauugagcaucuuccauauugcauuuaaauuucaccacaacucagaauuauuuuacagaagaggaaaucucugagggacaauauguacauuuaaggaaauagugggugaauaaauauaacuguccauguuauauauuuuaaaauauauaaaaaacacuguccauguaguauauuuuuucuuguucuguuuuaaaaaacuaguugaaauugccuaaguuaaaugugaaaaugaugugacucuaaaauauauauauauaauuuuuaaaauuuaaucugagguuuuagagauagccauuuauuaaauaccuuuguuaaaugaguguuuccacccauaaaagauguagguguuguuugagaauuucauuguauuuuguguuuucucuacaaugcauucuaguuauucuuuuacuucaaauucuaauggcuaugguagauuccuucaugaguauuuguuuagcauuagaggcauacuucagaaauguugugggagugguuccagacuaccacaauaaagugaauaucacaaagcugucagaugaauuuuuugguuuuccagugcauacagaaguuauguuuacacucuacuguagucugcuaagugcgcaauagcauuaccaucagcaguaaggcuguucugcuuucuuaucauucauccguucacagaaaugggcuuuuaauuuucuucaggaacuuuuccuuugcauucacagcuuggcuauuuggcacaagaggucuagcuuuuggccugucuuagcuuuagccaugcuuuuuucacuaagcuuaaucauuucuaguuuucaucuaaaguaacagacaugggaggccuccuuucaccugagcacuuagaggccauuacaggguuauuaauuggccuaauuucaguauugugucucaaagaauagguaggucugaggagagggaaagagaccaaucaggaauggccuucaugaacugcuucaucuuauauuugugcaguuuguggugccccaaaacaguuacaauaguaacaccaaagagaucaccguaacagaacagaucacagaucaccauaauagauuaauaaugaaaacauuugaaauaguggaagaauuggcaaagugugacgcagagacaugaagugagcacaugcuguuggaaaguggcacugauagucuugcuguaugcgguguugcaacaaaccuucaauuuguaaaaaaugaaauaucuauggaguacaauaaaaugagguaagccuguguauugcuuuuuccuuguguuucucaaagaaaacuauuuugucuugcaggaccuuauuuaaugaacugaggauuguuguugaacacauaauaaugaaaccugcuugcccacuguuugugagaagacuuugucuccagagcauugccuuuauaagcagauuggcaccaacaguuccauaguuuaacaucuaguuaagcuacaaauauaguauaagcauuauuagcagcugguacuucugcuagggguuguaaauuccagguguuacacugaccucaauccaauuuacauaauuuacauaaaugcaucucgguggaaaaauaaucauuuucuuggcauguuaaaucaagcuuaaaaaguuuugagaaaauuuuacugcgcuguguugcuaaugguuaaagaagucuguaucuagugauaaauauaccaguuuuuuuaaaaagaugcuguugugccuauaucaugaaguacauuaauuucucauguaaaaaaaauagcucuaaaauuuguuucaaccuaauugguaaccugaguuuauaucuggcaugaauucauuauggugauacacauaugugaauucaguacauuuugagacaguauucuaccauucaguaauuuugguuaaugauuuuaacacuucucaguguauuuaauuucaaauuguuuuuuuaauugguuuuaugcugcuuuguuaggacagauguguuuugaauguaccauuauaagaagaauucuauguaucuuaaacuaugaucuucuaaaauuuuauuuccguaaguacuucuguggccuugaguauuuuuuaaaaggcucaacuguaagccucuuagccaguuggauaaauauuuggggucaccuagccauugaaagcagaaagcaguagugacacagcuuucccuucaaagagccauugagaaacauuucucaaacaggaaauccuucuuuuacuaauguggacauauagauuauucguauuauaguuuguagaacuaccuaguucagaaucuugacugccaguuuucuugguuucuuaggcuugaauuuucauagacaauugcaacaguuuagaugccuuuugaaaggaauguaaugaagauucagcaucugacuauaugugugucuauccugaaauaauaauggagaguauacuguagauuacauguuuacccaucaaaucugacuuaaaagguuaaauggaagguuuuauagguaagguaauugauugggaaugggguagggggaggaguugugggggaauaaugugcauuucagucucaacgcauagauaaauuuaggggaauuggauguauuauucaacuuugauuuggguuguaaaauguguuaaauccuguucauugaacucccaucaacucuuauaaaauucaugcugaucuucauuaccguugcaugauuggaaauguuuaaaacauuguacaguuuuaguauagagaaauguaaugguuuuugugaccaguuucugucugcauguaauuuggauuucucaaauacauucauuaguaauuuaucaguaacauuaguuuuauuuuuguucaucuccuuaucuauaaaaaggggauauucuuaggauaaauacaugaaaaauuauacuugauagcuuaacuauaaucagcuauuuuuguauuuuuguaauauuuguccacuaagcuggagaagcagccucauacaguugauuuuguguauguggcuagucuuauugucacuauguaaguaauccaaugguuuuagaaacuaaacuuucuagagcaauaaaaugacuauaauguuaaguaaacauaauguugauuucuaauuauguuuuaaaaaaugaagucuugaauuauaucaagaaauuuuggcagcugaagucauguuuauuuugaagcuguuaguuuuuuccuauaauuuaaaaagaucuuuuagauuuauagaagagucagaaauguacaagagaguuuuuuuguuguuguuuuuguuuuuugagacagagucugucucugucgccaaggcuggagugcaguggcgcaauccuggcucacuguagccucugccuccuggguucaagugcuucuccugccucagccucccgaguagcugggacuacaggugcacgccaccacgccuguagucccagcuguauuguaaaaauacaaaauuuuaguauuuuuaguagagacaggguuucaccauguuggccaggauggucucgaucuccugaccucgugaucugccugccucggccucccaaagugccgggauuacaggugugagccaccgcgcccugccaagaagaguucuuuugcauacccuuuacucagguccucucauguuaacguuuuacauaacuguagaacauuuaucuaaaguaagauauuagcccagaacaauacuacuaacugaaguauaaaacuuauuugaauuucaacaguuuuuuuuucauuucuuauuuuccuuuugugugcucuguuuauaccaugauccaugauuuuuuuaaaaucaugauugucuuuuaaagaucugugugucucuguuuugaguuuuuccuguuuauuuugaaaaguacuguuggucaagauaauuggucaauaauccauguugguuuuaacaaaaagcauuuuaacauuaaaaauauuacaguauaaaauaacacucugugcuuuaaauugagguuuuaugucauuuuagcagaauuauaauauuucugauauacucauguuugacaaguugaaacagauuuguuucuuaaaggaagguuuaauauacaaaaaaagguaaucuuaaacuuacgaaaaaguaaauuuuacaauuugagcauuacuagauguuuaguuugcaugaacucauaguuagaaauucugcaauaggaauaucuacaaccggcugauuuggaauuugaaauuauaguguuacauguauaccuaucaaauuaaaauuaaggaaauacaauagcaauauauagaaugaauguaguaacagaaauuaacucuuuacugcaucauugaacuuauuguuaguuacagguuuaaaagaaguucauuuaacauccagugugucuaauucuucuggaagugguguaguaccauuguucuucuggcauuuuuaaauauuaaaccuuuuuggauagauggaagccuuauacaaaaucuacuuuauuuuagcaaggauucucuguccuuuuguauaguugguaccuuacuaauuuaaacucuaauaucaaucuaaagagaaauuuauuaugcaauuuguauuuagguuuuuuuuuuuuuuuuuggaaugaaguucagagguagauccuccuggaagaaagaaagcaagcgaacuuuuuaaagaaaauuagacuugaauauuuaagaaugucccuuacagagaaaaggccaacuauaauacuaagcuaaaaguuaugaaaaauuaauagguucuuuuauagagcuaagaaugaugaaaccaucaauacuuccuucuuccuaaaaauccagaucaaaacuucagguuagguuucuaaguuuaggacaugaauauuauuuuuuucuggaaaagaagaugaguauauguguaauaagacaaguagaacugagagauuuaguuuuuuuuuuuuuuaaguuuuaguucagaauaacauuaauuuugagagauugagguaaagaaccuuaacuaaugcuaaggaguuuauuuugauuaacauagguuauucugaccaccaccucuuccuuccuuaaucuccuuagaaucugacagucucaaagcugucacacaaauuagacuaauuuugacacuuugaaaugaaaacuucaaggaagaaguagccacggacaguuauguuuauaaucaguagguggcacucuuuccucagguagccccccauuuucacaugauguguuugaagguuaaaugccaccaaaagugcugagucagcuauaaaacuaagucccugaauuccauggcccuuuuaaauauguaaucauucaagauugaaaaaaaaaauuaagcauuuuuuguuuguuugcuuguuuguuuuugagacggaguuucacucuuguuggccaggcuggagugcaauggcgccaucucagcucacugcaaccucugccucccggauucaagcaauucuccuucagcccuccaaguagcugggguuacaggugcccgccaccaugcccagcuaguuuuuguauuuuuaguagagaugagguuucaccauguuggccaggcuggucuugaacuccugaccucgugauccccccaccucggccuuccaaagugcuggauuacaggcgugagccacugugccuggcuugcauuuuuaaaauacugaauuauucaaaagaaguacccugucaauaugugcuuucuaggaaaacaguaaaauaggccacaauuuggagugacaccauucagaucaaggucuauccaguuuuuucuuuucaugcuaagugccuacaucaccgaaacacacuaauauaaaauuauccuuucuccuucauuuucagauguguaaaaaaugguacuuaaaguguuuucaugaucauuuuguagguagacuagauauagcccguugaaccucuuuuaaaauuuagacuuuugauaguaauauaaaagcauauugaaauuuguagauauuauaugaggaauggcaccuagauuugaaaauuaugcuuggcuuguagagacaacuaguuucucucgcucuuuuuuuuuuuuuuuuuuuuuuuuuugagacagauucucacucaguugcccaggcuggagugcaguggugcagucuuggcucacugcaaccucugccuccuggguuaaagcgauucucaugccucagccucccuaguagcugagacuacaggcgugcaccaccacgcccagcuaauuuuuguauuuuuaguagagacaggauuucaccauguucaccauguuggucaggcuggucuugaacuccuggccucaagugaucugcccgccucgaccucccagagugcugggauuauaggugugagccacuaagccuggcugagacaacuaguuucccuuaacucauuggaauucucuaggauuaggagaauuccacagagccuauaugauauuauagcucaacauuuaguauaccaaaggcauacccguguaaaucuaggaguuauuuccagagauuguuuuaaggagcagucuuauauucaggguagaaaguuaugauuggaucugcuguuaaggagaacaaaggagcuucuaaagguuugggagguuuacugguaguaacuauucuaggaaauauuuauguuuuaaggugauguucacauggguucuuuagaaggaacauagucaagugugauggauuaacucuauauagucuuucuccucuugugcguguaggaaaucugaccugcagugucaguugaugugacaagagauaaagaaagcacaguauuuuaaaaucuaaagcagauuccuuucuuagaaaacaauaggaaaaaauuauagauggaugucuuugcugaaaucuaacaauuagcucauauuccaugagaaagaguggccuaagaauuauuucauguuaccuagccuucugaagcuacucacuugaugugccuagcacuuugaaacuaaccuuuucuuucuuuguucaugacaguuuaauuccaaauauuuacuauuuucucuuguaacuguuagaacaguuccuuuugacauuaauuuuugccuacauauauauuuuuaaguugagaccaaaucggugaaguguugagcaaguaacauuuaugauguguguauauuggaacaaauguaaaaggguuacaaagauuagaaacagagucauaaaaaauggcuugauuuauaaaggcauuacuuuuggugcuuuauauaauggcauauauugaacuaaaaauuuguauauacaguaugucagcauuucuuaguaacuucucuugaauccauuuuuaauaucuaauauuguacagguuggggaguuacauucuucaggccaauacuauccagacuauauaaauuuauaaaauaaauugaaaaauucauuccccuguauucaagaccaaagcacauaaaugcuaauguagggcucagaggggaaauacaguucuccugcauauuugagaaaaugugaaguccuuucaagaaaaucuaauaaacauaauaaucauagccugcugacacuaaggaaaaaggaccucauucacucuuucuuuuaugcagugauuuacuggucccuacugauuuccaaauuggaucacgauaguaaauuauccaugcugguaccugugaaaguaagcccugggauccauauuuguuuuguguucugcuuaaaucagcaagaaugauaaauuugauggugugaaauuggaaguaucaagggcuuucuuuggugauugagggaaauaaugucucuacuuguaauuuauugugacccuuuuucacuguauaugcuuuguaugucuaauauuuauuucaaugcaaauucaauuguuccuucaucuguauuguuauaucuaagauuuuauugauguuaaaaucuaauuguggaauaaaaaucucucuggaauuuagcagauacaaaaauguuaucuugcaaaagaacuaagaacauuuguaguuagaaaucagcuuuccuuugagcuuaauugccuuuuuguuagaauaaggugaauuugaacacacuccucuuauccucagcccaucacaaauaauagagaugccaugauuuugaggucugaugugaaacugguaaaaaugugaucuaagguguaacuggaaaaaaaaaggaaagaaaaauuacauugaugccucagcuguu

SEQ ID NO: 191477 - RNA, 30253 nt, Homo sapiens
gagucggggcugggccgcgccgaggcagcuggcugacuccaguuuagccgccgccggagaggacgggcgccgagccggggcugcggacuucggccugccccucaccucacucccgcugcuugcaccucccggauggugcugacugcucccuaagcggcggcggcggcgagucgugaggacgcgccgcggaggcuguucggggucgaggcuucccgucgccggcacuuccucuugcggcgcccgugcgcggccggcccggcaggcgggauggcggccgcggcuccagggaacggccgcgcaucggcgccccggcugcuucugcucuuucugguuccgcugcugugggccccggcugcgguccgggccggcccagaugaagaccuuagccaccggaacaaagaaccgccggcgccggcccagcagcugcagccgcagccuguggcugugcagggccccgagccggcccgggucgaggugagcgggccgggauggggcgagcgaggcugcagggccggcugcgccgaguaccaggcuccaggccuuugaaagcgccgcacuccgccggccucggcugggggaggggagcccggccccugcucccgggguggagggcggucggcugcgcuguuuuccggugaggccuggucuugcccgcuccuuuagggaaagggagagggagaguccaagaggagcccgcuauaaacguugaucuccggagggccaagaugcugcuccgggaugggcguuuuauugaucagaugugucuuagaguagcuagaaagacucaucccuaccaaaaaguuuuuaacagaaggcugcuaggaggcuuuuuguauucccugaggaucaucacaucggccauuucauuguugaaauagcuuaugccaaacugcuuacccaaauucaacuuggcacugccugugcuuuuugccaaauauggauuaugaaccaugacucucacuuuuuaaaaaugugcuuuggcuagcaggaaguagccuuuaggaacgcagaggaauuagucuccggcaguacagcgugcugcagcgaugugggaugccaaaacuacauuuauaaguaaaacagaauccuguauuuuguccuucccugaauagauacuagaaaucaacuuuuuaaucuguuaauagaauuaguccuuagucacuuggcagcguuuuaacauuucucccuucucccagucgugggcuuugucgucauuuccaguaucugcucccugaaucccggccaguguggcacucaaacccccacucccacccaggccacauccagcccaucuccacguaacuaaucuucccgaacauugaauucugccaucuugucagaagucgucggugaguugccuccacuaauuucaguccagccuuuuuaggagagugauguucagguuucuucugaucuggcuccagcucaccuccaggcuuuuuagccaccgcuuucuugcucauaugcuaaagggauaugcucaucugcaaaaaagaaugugcuucaagagcccuuugggacaggcuuugugcucucuugccaguuccucccuaacacaagaccuuuucaaagaaaaaaaaaaaaagaccuggaguuugaagccacggaucaacucuucccaccuuggagaaccagcagauaccuacucucugugaagacuucccuaaaauuucuugguuaagggugauuuaucugacccuuuccuuuccuuuccuuuccucuccuuucuccuuuuuccuuuccucuccuuucuccuuuuuccuuuccauuccuuucauuucuccuuuccuuuccuuuuuccuuuccuuucucccuuccuuuccuuuuuccuuuuucuuuguugagacagggucucgcucugucgcccaggcuggagugcaguggccccgucuuggcucacugcaaccucuaauugauccucccaccucagccuccugaguggcugggacugcaugcgugugcugacacgcccggcuaauuuuuguuuauuuuuuuuuuuuuugagagaggaggucucacuauguugccgagucuagucucaaacuccugggcucaagcgcuucuccggccuuggccucccaagugcuggugagcucucacaccggugcauuguuuucguguuucauguuuucguuacauguuacuuucuuaggcuuuuccaauuuucuguuguuuuucuguguaagaccguaggauagaacuuucugagagacugaucuugguuucacuaagcaagaacauuuguaagaaucagugcugucccagauguaguaaucgcuauugagaaauaaugaaguuccccuuacuggaaguacucaggaagaaguugaauaacuaacugccuaugaggagauucugauaugggagggaaucugggagauaaaguuacugggaagugaagauucugggagccgauuuaauccucacaacagcacguuaaacagguagaggagguuuguaaggaauagugguuuaauaucacagagcuagaagcuaguuucagcagaaccagaauuagaaucuggacuucugugccuuacuaaguuuuauuagcauucauugugucuuacucuuuugacuuauuuaauucacuaauggauuuuaaugguuuauuggauuguaugcuggugcaguucuuugaucuugagccuagcuuucucuuucuccuuuuuugggaacuuuauuguguauguuguggcauguuuacacacacaucuugcugccuuggguucuugcaaguugugugcguguuuuaucugccccuacuagcuuuuaggugucuugagagcaugacucuggcuuacucaucugucuauuccagaagaccuugucuguucuuggcauuuauuaacuaauuuucuaagacuggguugaaguaguugcaugucaaguuuauaucagcuguuaaauaccuuucuggaaaaacuggcuguaaaauaaacucaaccaggaaaaaaaaaaaaaaacaacaacccgauuuuuaauagugucuauccaaccuuuuuuuuuuaaguugcaagggauccaccagauggaauuaagagaacuaagcuuuuaucaucugcuggauauaaugugauuuuguaaccauuauuggauugguguugguuuagacaguuuauuuucagcugacuauauaguuaauuccgggacucuuauaaaguuuuuuuuaaaaagagaaaaagagaagaucaaaagcacuggaacucaacgaguaaauaacccaugguaacagagagauauaaugcagugaugucagagguguacaagaagugugaaucauuuaacaugugaagccagggucuuuaguccacuuggggagagcaaagaggugagugggcuucuccaucuuuuuccuucugccugcccugcuacccccagccauaugcuuaggagugggguucccauuuacacugcccugcuugucgcuccuggcucagcugacccugcuugacauguccacuucaguaauugaacugaaacgcugauugaugaacuuaauucuuaguguucaucuuuuagcccugucauuuaccccaguaucacauuuauuuuaaaacaauaacuauuuuggauuaaguuaauugugugagugagagauuaugaauauguaacuuugcagguauuuuguugaaguuuuagucauauuggaauuuuuaagauagaaaugaugguagguguagagcuacuaauauccuuuuuaagaagcuaggaaaaaucuagccaugcagaaugccacagugguagaaacaguguccaguaaacauauuaaauggucuuaaggauucuugucuuuuaaaguuuuauuuaauuuuuuuuauagagacaaggucuucuuauagcucauaacucauugcagccuccagcuccuggacucaggccauccuccugccucagccuucugaguagcugggaagggauccuugucuuuaaaacuagggguauggagggaaggguggguauaauauaauaugauuuuuccguuuaauauuuucauauauucuuggugauucauuuuaguuaggcauuuauuuauuauuguuuauucuaauuuuguauuauaauagaauauaauugucuucuuuucuuccuuuuuuuuuuuuuuagagacagggucucacuauguugcucagccugcccucaaacuccugggcucaagggaucuuccccucuuggccugccaaaguggugggauuacaggcaugagccaucaugccuggccuugucuuguuuuuauuuuauauauauaauauauauaaaaaauaauauauaaauauauaauuuauauuuauauuauauauuaauauauuaauguaauuaauauuauauuauauuaauauauaauauauaauauaauauuauauauuauauauaauauuauauauaauauuaauacuguauuauauauaauauaauauuaauuauauuauauuaauauaauuaauuauauuaauauaauaauaauaaauaauauuaauauaauuaauauauuuauauuaaaauauaaaaauauaauauauauaauauauauauauuuuuuugucucacucugucgcccaggcuggagugcaguggcgugaucuuggcucacugcaaggucugccuuccaggcucacgccauucuccugccucagccuccagcauagcugggacuacaggcgcccgccaccaugcccgccuaauuuuuuguauuuuuaguagagacgagguuuuaccguguuagccaggaggucuccaucuccugaccuggugauccgccugccucggccucccaaagugcugggauuacaggagugagccaccacgccuggccuuaauuauauuuuuauguaacuuuuugauacuacucaaguauuuuuuccucuacgguacucacuaugcugaaagauuuuucuuucacauguuuucuaaacuauguaauauaagugucauuggcuauuuuuguccaccugauggagguaagaaaugaucaaaguacaguuuaacagcaguauuagcaagaguugagccuugcugaauauguaaguuucaacggauuugcuuugcaacuacaugcaguagauguuuuaagaggguagguaggauauuuaaauuuaaccuuuuugugccacugugugagagugggcuucugaaaauggaggggggaagcaucucuccuugguuaguaggcauucaaguggaagauauguuauaaaaaccuaguuguaucuuauaggaugcuaaaagcaaggugacugaacuucuaacagggcauucuacauugaguaugugcuuuucucuauaauuaggcuaaaaaaagguugguaaguaauaugaacuuaaaaucaagauuaacccccaauuuacaaacccaugauaaaaaguguuguugauuacuuggauccuaucuuuucugcaguuuauguuucuagugacuuacucaauaguuuuuucuuacucuuucccuggacagaauauguaauauaagaaacauaaguccuuugaguugagggagaucagauagauuuaauaaaagucauuuagacuuuauugcauauucuggaaguccaaagaagaaugacucugguugcauagcacuucuaauaaagccacaaaaucauuaccugacucagugccuguucuuguuaucauauuuuuacuuuauguuuugguauuucauuuauuuauuacguuucagcugugagaguaccuucuacaaaacauuuuaaacuuuuuucuauuuucauuaaguugcagucccacuccacccaguccagccuccuaauucuagccuuuauacagcuaagauugaggcaaucaguuauaaggacgccugcucauaauuaccuucucagaagguaauuauauuaauacugaauuuauuuagugguaugcugucaucaaaaaaauucauuaaaaauaaaaucaaugaaggccgggcgcaguggcucacgcuuguaaucccuccacuuugggaggccgagguggguggaucaccugaggucaagaguucuagaccagccuggccaacaugaugaaaccccaucucuacugaaaauacaaaaaauuagcugggcgugguggcacacaccuguaaucccagcuacucaggaggcugaggcaggagaaucgcuugagcccgggagguggagguugcagugaaccaagaucgugccacugcccuccagccugggcaacaagagcaaaacucugucuccaaaaaaaaaaaagaaacuaaacacauuuaauaaauuucaagugcauaaauacauuacaaaacaacauucauaaaaauaaacauucauuaaaacaaaaaauaauuuuauuacaaaauauuacauauaaauucuaauauaaauuaacaaguaacaauaaaguauuuaaaaauagugaaaccauucacaaaaauacguaaugaaaauuaaaauacuuuaauguuaucuuucgaaaucagguuuaucuguggugucauuguuuaagugcgugcguguguguguguguguauauauauauauauauauauauauauauauuuuuuuuuuuuuuuuuuuuuuuuuuuuuuuuuugagacagagucucacugucacccaggcuggagugcaguggugagaucuugguucacuucaaccucugucuccgggguucaugcaauucucaugccucagccuccagaguggcugagacuacaggugcaugccaccacgcccagcugauuuuuguauuuuuaguagagaugggguuuugccacguuggccaggcuggucucaagcucccaaccucgagugauccaccuaccacgccucccaaguugcuaggauuacaggcaugagccaccaugcccggccuaagugcauauauauuuuugggcacauuuuuacaacuuuuaaaaaaagcuuuuuuuuuuuuuugagacggagucuugcucugucgcccaggcuggagugcaguggcgugaucucggcucacugcaagcucugccucccggguucacgccauucuccugcgucagccucccaaguagcugggacuacaggugcccgccacacgcccagcuaauuuuuuguauuuuuaguagagaugggguuucaccauguuagccaggauggucucaaucuccugaccucgugauccgcccgccugggccucccaaagugcugggauuacaggcaugagccaccacacccggccccuaaaaaaagcuuuuuugacuuaguagugcccaggagacaguucuaagcaaauuguaagcauuuucuucugacuccuuugucuucagauaaucucaccucuuguuugauaacuuauugagcaacuuuguuucuguuuuuuugcagggacaucaguuuuuuucuugguagcaagcuguagauuuuguuucaaggaaagcaucuucaucuucucuaguuucaucauguauagauggagauuccgaugcagguaucuguaucaauuucaauacagucacauuuguguuuauuugaacucuagaacuagaaaaggaauuacuuuuuucuuugauuuucuuuuucuuccuucucuugaggaucaugaaaguauaaaagaauacuuucuaaaugagggugccuuuuucuuuuucuuuuuuuuuuuuuuacaauuuuuacauuuggaauuaaaauuuuaacuagaaaagaguuuuuauuaagcaaguuuuuuuaaaaaaaucuuaaguuguuaauccugcucucaagauguaaguaagguguguuucagacauuauuaaaauacugaaauagugguauuuguaccaaaacacuaguaucucauuacuuaccaugauauauaacacuguauaacugaauaguggaauaccaaaauugaaauugcacacugcaucuaauccuguaugcauccaaguauauucuucugugccuguacugucugccuuuuucauguuuuggacaaaacugucauccuuuguguaccuccucucuguguccacguuccuauucuccucccucagugccuuuauucucucccuucccauugcuuccuuuguaucugcuuacacauguucauauguuucucuuauuuuggaaaagaaagaaaaaggucauucauuuaaucuuaacuugacuauuaguuucguuuucuuuccuuccuuccuuccuuccuucuuucuuuccuuuuuuuuuuuuuuuuugacagugucuugcucuguugcccagccuggagugcagugggcacaaucuuggcacacugcaaccucagccuuccgaguggcuaggacuacaggugugcgccaccacgccuggcuauuuuuuuuuuuuguacuuuuaguagagaugggguuucaucauguuugccaggcagcucuugaauuccugaccucagaucuguccaccucggccucccaaagugcugggaugacaggcgugagccaccaugcccagccauauuaguuucuucaguuuuauaaaccaaacuucuaacuaggggauuugcugcuuuuucacuuuacuuuaguauguuguuaucuggcuucaguccuugccuuuuccuugaaauucuuuuuuuaauuuuaaagauagggucuugcucugucgcccuggcuggaguucaguggcacaaucauagcuuacugcagccuggaacuagugggcucaagugauccucccaccucagccucccaaguagcugggacuacaggugcaugccaccacaccuggcuaauuuuauuuauuuuauuuuuuuuuuuuguggagaugaggucucacuauguugcccaggcuggccucgaacucuuggccucaagcaguccuccugcaucggccucccaaagugcugggauuauaggcaugagccaccacaaauuccauuuuuugaaagaaucuuguaaguuagcaaauugcuaaauccagggaucuuuuucaguucucauuugacacuguuaauucucuacuguuuaagaauccaucucagguguaugaacuuggcagaauaaugaagcccguuugaccucaguuuuccuguauuaaaacuuaaaacagcuccuaaguuuuuuugaguaucaaaugcaacaaugugucugaaaauaucucgcaucuaguuaguagcgcaccccaaccugacggucugugaugcuuuaguugcugccuggcucgaaauaucuaagauaguuuuuuuuccuauuuuuuuuccucccuccaccuucuuugaauaaagacauucucuaaggcgcauucuuugaacuuuaucucuuugccuuaucuguuggaaaucucaucuacuugcagagcuuuagcugauaaauuugggcugccagcaaccagauagaguacguccucacuuaauguuauuaauagauucuuggaaauggucacuuuaagugaaaugacaucaaugaugucauuuuaauucaguguuguuucauuauaacauugaugagaaaagaaaguugguuuucuuuuacaucauuucacuuaaaguugcaguuuccaagagccuauugaggacacgaaggcugucaaccuugaggcuacauaccuugaggcuguccuaggcuaaacucuggugauccauuucugauaaccucuuucaaaccuucauuugaaaugcuuuuuaucaccccaaguggaauguauaugaaaccaaaccccuuguuuuuauuccccuuuccgacauaccuuuuaagaguacuaaauacauaauagcguuuuaagaguacuaauauuucugccaaccagaaaaccucaccaccaucuuugauuccccccaucccgccuaccuuuuuuuaaaggucuagugauuuuucuuuccauugugugcagaauuuuuuccuucucuuauuugucuuaacacggguuucaugcagcugaccuccugauugauccaguggcugauacuccccacucugcccugauaauuggucacagugccuugaugguguuuauguguuacacaaaaauauguaaugacuucccucuugccucugagcuuguccacaaacauaaagaauuucaggcccaguuuaucuuucucaucuugccccaaccauucuucugaugguuuacuucuuguucucagaacaugccuauauucuuucacauugucaguacagaaaagagguauaugcagaaaaggagugauguauuuucaaguuagccacuccaugagugacuaguacugaaucccacugaaaucccacugaaacuucccaggaggcuuaugaaaugaaucuuagaaccagcuuccauauugguagcccuacagcuauuaacuucccauacuuccagguagugaaugaguaaauacagagcagugcuuuuugguuggaccugccugaagucagucacagcuuacaagaaauugauccuccauagcuggcauaagauguugggucaggaaguuuuugaaaugguacauagcaugugucuauaauggugugaaaguuaaaaauuccagaagauacagaagaauguagaaugagaaguuacgucucuuuuccuuuuuuguauucuagaaaaaguuugccaaccccuguucuagucauucugguuccuuuccuggaaacauucaucauuaaccuguuucuugagacgugguguguauuuaugauacuuacaccauccacauguacacauacuuaguauauacuuuuucucaacuucaaaauaucuuaaugauuuucuauauuaguguauagaacauucuuauuauucuuuuagcucuauaauauuccguuauguggaucuaccauuuauuuaacuaguuuucuaucaauggacauuuaguuguuuuuuucuuucucuuuguuuugagacagggucucacucuguugcccaggcuggagugcagugaugucaucucugcucacugcaacuuguaccuccugggcucaagcgauccucucaccucacagccucccaaauagcuggaaacuacaggugugugccaccacacccagcuacuuuuguauuuuuuguagagacagggucucacuuuguugcccaggcuggucuugaacuccugggcucaagggcuccacccaucucccaaagugcugggauuacaggcaugagccacugagcccagccgacauuuaguuauuuugucucuuuauuacaaaugauagcauuacauuuauacauauuuguaauccgaaaaggucaauuccuugaguguuucugucuugaacuuuuuucuguaauaggccucccauacucauugcccacaguuugcauucaguuuuauuguagugggucaggaucauuaagagcuggaguugcugggauaggccuuucucaagagguucuacuugaguuggaccuugaggaaucuggaugaagagggggauaacgaaaaggaggugggaagggaaaaaggacuguguggcugaaggcuugugguuagcaaaagccugucaugcuuucgagcugcacugcccagcacuguaaccaugagccaugaguauguguggcugugagcacuugauauguggcuaauccagaguugaggugugcggugaguaaauaccuaccagggucugaagauuuaauaugaaaaaaagaauguuaaaauaucucaguaguuuuaaaaauauugcuuauaauuuaaauaguagcauuuuggauauauuggguuaaguaaaauguuauuaaaauuuuuaccugguuuuacuuuuaaauauauggcuaccagaaaauguaaaauuguauuauguggccuaccuuuguggcugcaugauuuuuuguuagacucugcucuggcucauccuucaggauggagaagcagguucauuuggggaaccugguaugugcuucagugagaacuguuggauaguuaccagaaucaaguauuugguaugaaaagaccauuacguuucuuaaaacagugaaguaacaugaaauuaguuucaggaagauucaacuguucauauuuuguggcacuacaaaaacuaauugagcacuuacuguguacugagcacuguccuaaagggcuuuauucauuuaauccucacagcaacccuuugagacauagguagcccuuauguuacagaugaacuugagucacagggggguguaccuauuggcccaaggucacgccguaacugauaaugccuuggcuaugaacuggcagucugauuccagagccuauacacuuaaccacuacacugugucccugugaaggugaauuagacaaagaagaugauccuugcacauagcagugaaggaaugguaauggaucacuuuuuaauccuguuaauauuuuaauuaaaaaagaucuucuaucuucacgguaccccgauacuuuucguuuuaaguucuugucaccaugauugguuguaugauuuuggccacccaggaccagcuuaguauguaacaagcuuuauguuuauuuuucuuguguuuuguguguaggaagguuuuaagaauauguagcaucgcuuaaugauggggauguguucugagaaacucauuaucaggcaauuucauugugcagacguccuagaguguacucaacacaaaccuagauguauaaccugcuauacaccuaggcuaaaugguauagccuauggcuuuuaggcuacaaaucuguacagcguguuacuauauuaaauacuguaggcaguuguaacauuuuauauauauaaaaaaacauagaaaagguaaaguaaaaaauuugguacuguaaucuuaugggacuacugcugcauauucggcccaucauugaucaaauugucaucauguggugcaugucuguacucuuaaagcaaauuuuauuuuaucccuacauuuuacagaggaacagagauuaaauaauguggcugaaguuucauggcugggaauuauaaaaccaugagacuguguagcuuugaucacuauuguguuugauuuaaaaaguaaacauuuuguguuugagcuuagagcuaagugaucauaaaugguguauauuuauuccuaaaauuuuucugggauuucagauccugaaauuuuauacaaaccuuuaaaaagcauuuucaggaggaaaaugugucagagccaaguugaaauuugaaaugcccuuuuuuuuuuuuuuaauauaaggauucuuaauauuggaagagaaaggaaguuguuguuuugagaagggggcuugcuccaucacccaggcuggagugcaauggugccauuacagcucacugcaggaagcucguuuuuaaaggaccgucaacguagguggaaccaaaauaauggagagaaagcaagaagcccuuaaaaugauacuugcuuaauuaauuaaacucaauucauugagagccagcugucaaggcaacaaauacuuuccauuuuguuaaauuucuccaguauuuagcucagaggucuagucuuaaugguaaugccuaaauuuuucugaucuuuacuguggaauuuuauaaucuuuauguuauguguuaaggaaugacaugcacacuaagaauuuaugauuuuauucuuaccugugacuagggccuuuguaauaaaucuguuuuuacgcuguccaaaauuacuauguucuuggguuucuuuuucuuuaucucuuggguuucuagagauucauaagcuuaaaaaauuaaaaauaaguuauuaggauuggaagagaccuuuggaagugguuuaucuagcccagggcgucucagucugggaacuguugacauuuuggauauauaauucuugguuguggaagggcuguccugugcauuguaggauguuuagcagcguuucuggccucuacccacuagaugccaguaguuccccuuugauuguaacuaaaaauguccgcaagcauugucagauguccccugggagacaaaaucgcccugguugagaaccgcuugucuagcccauuuccugggaguggugguucccuucucuggaacucagacguugagaagagaaggguauuuaccaccuccucuagcagucuguuccaacuuugggugcgucuuuggagacagaaaucucuccucucuguuaagcuaaaaccugccaucucuaacuuuuuaguucugccucuuaggaccguauggauuggauagauucacuuaaaaacuuucccaauuauuggaacaugauaccccguccuuccuggucccucacgggauuguuuuagagccaagucagcaaacuucuuguaguugccauguauuugcaggcuaccaaucucugaugcauaaucuuccuuuccuucccucccuccuccuugccucccaccagccuucccuccuuuucucuuucuucuuauuucuuguaacuucuuaaaaauguaaaaaaccuuuuuuugcucuuauaggcuggguuuugguucaguaacuugccaucccugguuuuagagucugacaucugcuaaucuucagagggcagugcagugcuuuagaacuguauauagaacuuuggggaaggucugagcagcauagaauaacguuggacuugucauuaacuccuucaugcgaagagcuuacugcuuuuuugaagcuuugucacauuuacagcguaaugacagccaagacacugguuugucuuuuucauuaggccacuuuaccuucuuuuuuuuugagacagaguuucacucauugcccauugugcaaugggcgcagucucagcucacugcaaccuccgccucccagguugaagcaauucucccgucucagccucccaaguaacugggauuauaggcuuccgccaccaugccacuuuaccuucuaagauauuuuuagacuucagcguaggacgaucuguguuaacagcuguauuaaacuugucuuagcuggaaccaacucucuauacccugcugagguuugugggucuuacucuguccuucagaguguuaaugaaauuuuucuuagcuucccgucguucaaauguuuuuuaaacauaccugggucuuucaugcaaguuacuaauacaaauuugaaugagauguagcuaagaacuaaaucugaaaucacaaaugccuaacaaauaagguaauuuuggccaagcgugguggcucacgccuguaaucucagcacuuugggaggcugagguggguggaucacuugaggucaggaguuugagaccagccuggccaacaugaugagaaacccugucuugacuaaaaauacaaaaauuagcugggcuugguggugcauaccuauaaucccagcuacuugugaggcugaggcaggagaaucgcuugaaccugggagguggagguugcagugagccaagaucacaccacugcacuccagccugagugacagagugagauuuugucucaaaaaaaaaaaaaaaaagggaauuuuaaugcauggauauagcaggucuguacucuguucuuaaaauuguuuuggagaauuauauguaaaucugcauuauacauguuuaguauccucaaucuaaaauccacagugcuccaaaaucugaaacuugagcacugacauacaugaaaugcucaauggaacauuuuggauuucuggauuagggguacucagcuaugauauaaauauuccaaaaucuaaaaaaauccaaaauuccaacuacuucuggucccauacauuucagguaagggauacucaaauuguagcaaccaucgucagagguuaccgucguuacugauggcuuucagagugauuagacaguaaauaaguguaaugaccaugacaagaaaauuuucaaaaaaacuaaaucuuauuuacgugcaaaauaaaauaauuuugaauaaugauuuuaagaaguaacugauuuuuuuuuuccagaaaauauuuacaccagcagcuccaguucauaccaauaaagaagauccugcuacccaaacuaauuugggauuuauccaugcauuugucgcugccauaucaguuauuauuguaucugaauugggugauaagacauuuuuuauagcagccaucauggcaaugcgcuauaaccgccugaccgugcuggcuggugcaaugcuugccuugggacuaaugacaugcuugucaggugagugugcuuuucccucucaugaguucgcugaauuaaagggaaagcguguugugugacauggagucacugagucauuaaccuagucuuaugggaauuuggcuuacaccuuauuuguggucuuccaaccuuuuccuuguguauccuuuccuuguguauccucuaaaauaauuuuguacccccucucgcauaguugucugaaauuuuucaucuucaauuuaaggaauugcaaagaucuaauuucuguuauauuguguaaaguaagacaguuagggcugggcacagucacucacgccuguaaucccagcacuuugggaggccgaaguggacagaucacgaggucaggaguuccgagaucagccugaccaauguggugaaaccgcaucucuacugaaaauacaaaaauuagcugggcaugguaaugugcaccuguaaucccagcaacucaggaggcugaggcaggagaaucgcuugaacccaggaggcagagguugcagugagcugagaucgcgccacuacacuccagccugggugauagagugagacuccaucucaaaaaaaaaaaaaaaaaaaaaaaagggagacuguuaggguguuuuuaaaaucuacccagugacucuaaauaccauuaguaauuugauacccacuaucaccaucauuccuuuaaaacaaaugugaauauacuuuuuuaacaguuggaaauuuacauuuuuuucuuccuauaauuuauauuuucauuuacuucccuuaauuuuacucuaaugauuauaaauuuuugcuucaaaauuuauuacaaagcugguccaagugcaaugguguauacaacuaaucgaugacaaaccaguuacagauuucuuucuuccuuguccacccccacugcuucacuuuaugagccuaaagaaauauauauauggaucaccccaucauaucuaccugcaauaaaaauaugcauuuaauaucauugaauuuucaaagauauuguaaauuucuccuaguaaaucucuuaaguguuaacucuaugaauugaguuguuauaguuauuaguacucaaagaaaauauauuauaaauuuaaauaaucauuuuaaaaaauuggaaauacaucucuuaaugagaugauagggcuauuuuuuauuuauuuauuuauuuauuuuuuuuuagagacugagucuugcucuaucacucaggcuggagugcaguggcaugaucauagcucacugagaccuggaacuccugggcucaagugauccuuccaccucagccuccugaguagcugggaccauaggcucaugccaccaugcccagcuaaauuuuuuguuuuuuguagagacagggucugguuguguugcccaggcugaucuugaacuccugggcucaagcuaucuuuccaccuuagccucccaguguacugauauuauagguaugugugccugcccauccuuuuaccuuguauuuauuuuuuaaauuuuuauuuauuuaucuuuuuauuuauuuugagacagacucuugcucugucacccaggccggagugcaguggcaugaucccgacucacuuaaaccuccaucucccaggcucaggcgauuuuccugccucagccucccaaguagcugagacuacaggcacaugccaucacgccuggauacuuauuguauguuuugguagagauagaguuuuaccauguuggccaggcuggucucaaacuccugaccucaaaugaucgcccgccuuggccucccaaagugcugcgauuacaggcgugagcuaccacgccuggccccuggcccaucauuuuacaauuuuuaaacauuuuauagaaauaauuuuaaguuuacaaagcagcaaaaauaaaauaguaugaagaacacuuauauaacuuuugccuagauucaccuguuguuaacauuuuaucccauuuguuuuagcauuuguacucuuaucuaaauaaaauuguaaauguguauauauacacguuguuuacauaccugucuauaguguguacauauacauacauuauuuauaagcuauauaaugcacacauauaaucacaacauuuaauauauauuauguauugauacaguacuugaaucugucauccauauuuuaauuuuggaugaccuaauguccuuucuuguuuuuugaaaggacauaggcugggcgcgguggcucacgccugugaucccagcacuuugggaggcugaggcaggcggaucacgaggucaggagaucgaggccauccuggcuaacacggugaaaccccgucucuacuaaaaaaauccaaaaaacuagccaggcuugguggcgggcaucuguaguccuagcuacuugggagacugaggcaggagaauggcgucaacccgggaggcagagcuuguagugagccgagauugugccacugcacuccagccugggcgacagagugagacuccgucucaaaaaaaaaaaaaaggacaugaaauuuuuaaauauuucacuuguguuaucaguuuuauguaauuuaaguggguuuaacagucuuuauauuauuuugccucaacuguuaaaucauauguguuuauuucuacaucuucucuuuuauagcuuuauuuaguuuuauagauuuaaccacuuuuuuuuuauacuuuauguucugggauacaugugcagaacgugcagguuuguuacacagguauacaugugccauggugauuuguugcacucaucaacccgucaucuagguuuuaagcccugcaugcacuagguauugguccuaaugcucucccuccccuugccccugaccccucaauaauguccuuuauaucaguguuuuucccuucggucuaggucagauauugcauuuaguuauuuauuaucuuuuuagucuuuuaaucugaaauauauccauagccuuuuuuuaaaauguuuucugacaucaaccuuuuugggagaauuacaguguaucccuccucccuccaccccaggaaugggcuguuccccauuuuuuguuugucugauguuuccugaugguuagauugagguaggcauuccugacuagaaaacugcauaggugauacuuugucucuccaagaaugucucaucuggaagcacaugguguccauuuauuccucauuggugacauuaauuuuggugacccagucaauauuucuuuucuguguugucuucccuugcaacuacuaucuaaucuguagggauauacuuaaagacaguacaaauacccucuuccucaucaaaauuucuccaaagauuuugcaucaauugaugauucuugcauaauuagaucuuucauugaugcuugcaaaaugaugcuuuuaauucuaauacuucuugcauauucaccagugagccuugguauucuacugccagcaagagcucuccuuccuuucccauuuguuugucuuuuuacuagcaguacaaacuuauggauuccuuuuuucaaugguuuauaauuaauuauuuaacuauuuugcugcuuaaauuauccgauguuaggccagugagagccucuccaaacuguguccugugucuuuguggcaugcucccauuugauuuugcuccucacuuucuaguacaacaagauauuacagguucaucaugcaccugcucugcccaguccuggaacuggccauuucucggcggagcuuugaggagcuuuuuaggggagaaugguauuagaacccaagaucuaggugcaagguuacugagcuccuuguuacugagaugucuuugccucuugucuuuuucaguggacagagcuagaaaauauaugcuuguauccuguguguacacauacauauauacaaauauacauccauacauauauacacacacaauaauuuaaauacagaugugcacacaaacauagguuugcugcauuucuaaccaugauuuuaagaucuuuucaguuuuguaauguagggaauuauuuacauacagguuauacauuuacaggcagauuuguaaguguugcacccguuuuauaaaaagagcuggugaauuaaagaguaauuguauuuuucuuucuuucuuuuuuuuuuucugagaugggaucucacucuguugcccaagcugggaugcaguggcaugaucgcagcucacugcagcuuugaccuccugggcucaagugauccuccuaucucagccccucaaguaggcugggaccaaggcgugugucaccccgucaggcuaauuuuuguauuuuuuuuguagagacaggauuucgccauguugaccaguggucucaagcuccugggcucaaguaauccgcccgacucggucucccaaagugcugggauuacaggcaugagccaccgugccuggccagaguaauuguauuuauuauauguauggucguguccucuguuccuuacauaguuguuuuuguuuguuuaugagacagggugucacuauguuucccaggcugguuuugaacuucuaggcucaagcaauccuuccaccguggccucccagagugcugggauuaugccacuuugcccagccaaauuuuuaaguuuuaauuacugaaugaguauuacugauauacuuguguuucaccauuaggauuugaguucuugauauaguuccaagcaucauuuuuuauauaacuuacacagaugucuuuccuuaucagugggaaagaguggaacugaauguuugagccuguuguaacauuauuuuaauauaauaagaaauuuuuagauuuuuuucauaaaacguacuuauuuuaaauaguuacaagggagcagaguuuaaaucuugcuaugugagacuuuugucaugauucuucacuagaaguuugugauuuaaagauuugugaugaagaaauuccacuaugcaaguggcauggcuucccaguuauaaaaucucagcucuugagagggccucagagcuaacuucuaccccagguacugugccuugcacaacauaaggcaagccagccucugacugaacaugccuggaaaggaguucaauaucuuacuuaacaucucucaggaagaugugccaucuucaacuggaccauuggcuucugaguaagcuguguuaggccugggcuagaccuaaugguuuauuauugguggagagaaagaucuggaaauacuugagguuauuacauacuagauuagcuucuaaugugaaccauuuuucuuuuaacagugauaaauuauuauuuccgaaguuaacuguucccuuggucgugauacacacucgauuaacaaacauacuguuguauuuuuuccaguuuuguuuggcuaugccaccacagucauccccagggucuauacauacuauguuucaacuguauuauuugccauuuuuggcauuagaaugcuucgggaaggcuuaaagaugagcccugaugagggucaagaggaacuggaagaaguucaagcugaauuaaagaagaaagaugaagaaguaagccauggcacuguugaucuggaccaaaaaggcacucaacuaggaauaaacacucuacagagguuucucaguggccccaucugugugauaugcggggcuacacaaaaauagcuucuuuugcuuuguucuguucuuauaccugucugugaucugacuugggguuggugugaauguaguagagaaaggaagcugacagaugaauacugaacacagguaaucaguuuccuuaauuagguugauuauaagcuccugaaaagcaggaacuguauuuuauaauuuuaccuguuucucccguggugucuaggauaguaagugagcagagcaguaaauacuguuugguuuguucagcugaggagaaacggaagaauugagacuauagcauuuguugcugugugagaccagugguucagaggggagguuugggggucacauaaauguaguuuuuuuggagcauauuucauagaauuuaaacacuuagaaaagucaagugauuugugugcuauuuugauuugcuuccugugcuuacuuucauuuguuuauuauuuauuuuaguuucaacgaaccaaacuuuuaaauggaccgggagauguugaaacggguacaagcauaacaguaccucagaaaaagugguugcauuuuauuucacccauuuuuguucaagcucuuacauuaacauucuuagcagaauggggugaucgcucucaacuaacuacaauuguauuggcagcuagagaggugagugauauuugagaggagacuguuuaaaaugaaacguaauuauuauuacuuuguuccagaaaacacuggacacacugaagugggccacagcauuccuucauaugcaagacuguuuuacaucugauaauucagcugcucucuaaaauuggccuucucccaguuccugcuaccugcaggugaaauucuuguaaccaagcucaguugggcucuuuuuacucauccuuuucccuuugguuuugccaaaaugaugccgugguacuugucaucuuagcuugguuuucuuaucauagaacuuucuuuuuuauaguuguugagaauauaaaucaguauaauauuauugaaggccauuuugguguuuaauaccuaaagccuuaaaaauguguagcuagccgggcuuggugguaugcaccuguagucccagcuacucaggaggguugaggugggaggauugcuugagccugggagguugaggcuccagugagcuguguucgcgccacugcacuccagccuuggugacagggagacccagucugaaaaaaaaaaaaaaguguauagcuuuucguucauguguuacacuaaagaaauugacuguugcacagacuacuuauaauuauuguaacuuaguaaaaauuuagaaacagccuaauaauccagcagaaaauugguucagcuguuuacaaaucucuguguagcucuuagaauauucacucuucaacaucauuucagugacauggaaaaauuuuaaaaggagguuuacuuuuaaaauauaaaaagaaggccgggugccgucccucacgccuguaaucccagcacuuuaggaggccaaggugggcggaucaccugaggucaggaguuugagaccagccugaccagcauggagaaaccccuacuacuaaaaauacaaaaauuagccgggcaagguggcucaugccuguaaucuuagcuacucaggagacugaggcaggagaauugauugaaccggggaggcagagguugcagugagccuagauugcaccacugcacuccagccugggcagcagagugagaugcuaucucaaaaaauuaaauaaauaauauauaaaaagaacaaaaaagacuuaaggaaauaaaaacauuauuuuuauuucagugcuuaucuaucguugcguacugcuauuauggguaauuuauuuauuuacuuuuugguagggguggggucucaccauguuguccagccaguuuugaaccccuggccugaaacuuccugccucagccucgcaaauaauccuucugggauuauaggcgagagucacugcucuggccuaggugacuuguuuguuucuguguaggaacuuuuuguucaaaaagucuuagcccaagaauccuaaguucuggagugggaagcuagagaccucagcucaucuuguagcuuuuacucuucagaugaagaaccugacccccagagagaucgggugacuugugugagggaguaagcuggcuggcuguggccuucuucacaguuguucaaugccacuuauuuaaaacaugcccauugguuuuuuauuuuuuaauuuuucuuuugaugggaauagcaagguuuuauaugaggcgccugucauuguucacacagauuuauuaagauuucauguggagacgguuguggaauggaauacugcugccacuuuucaaccucuuuuucaucuuaacugauacuauuucuuaucuguguuuauaucagauucucuuuuuauaagaguaaaauuguuucuaauuccuuggaacuaucauaaaagaacaaguucuuuaauuauaggcugugguuuaaaauacaagacaguugaaggccaggacuaagauagaugggaaaggcuauuuugucagggaagccucaaaaaugcuguauuuuggggaaaaaaaauggaacucugauuuucauuugauucucauaaaacaaacuuucuuuaaaaauaucacuuuaauuagcugggcgugguagcgggugccuguaauccuagcugcuagagaggcugaggcaggagaaucacuugaaaccgggaggcagagguugcagugagccgagauggugccacugcucuccagccuaggugacagagugagacacuaucuuaagaaaaaaaaauauauauauauauacauauauauuuauuuauuuauuuauuuuauuuauuuauuuaauggcuguacccuauauucuucuugauuucuagccuuuuauuggcucucagauugccagaguugggacucaauaguaaguaaccauuuuguugaggugguagugauucuaccagggugaguuaucaugacagcagaaucacugcguuuuucucucuacucuguggcauagacucuaugccauagagugacgugugaaaggcuugaggcucccuaccuacgagacacccugguccauucuagcaguauggcacgugcugacuggguuuugagucucuugcuguaaaaucacauuacugcacuucccugcauuuucucauccaaaaauggggauuaccugcuuuguggaucgguuugcagaugaaauaacacacgcaggguaucuagcauggucccccacauggcacauucaguguuagccacacuuccauacuaacugcccugcggggauauuuaaugagcucuuaaauggcagaaauguugugucuuuuccuguucccuuaguauuccuauuuuuguugguaauuuuucuuaugaaccaugcaguugucuaguucaggccauuuuaguaugcaguuuuaucuuugcuuccaacaugauuuaauguucccaaauuggauuucacauaauccuaguguccuuugagacuugaauugguucuaggccaaaaaagggugagggggaaggaagaaauucagagucaaauuuggcaaauaauauaucccugucguuuuguuuuuucuuuuuaagacuugggccaggugugguggcucacgcguuuaaucccagcacuuugggaggcugaggcaggcaaaucaccugaggucaggagcucgagaccagccuggccaacauggugaaaaauacaaaaauuauccaggcaugguggcccacgccuguagucccagcuacucgggaggcugagacaggagaaucucuugaacccgggugagccgagaucgcgccacugcacuccacucuggucgacagagcuagauuccaucucaaaaaaaaaaaaaaaaaaaaaagacgacucaguauacaaauaaagacuggaaaguccuauauuaaaggaacuaguuaaauacuaguuuauuuuacuuaaucuagugaauuuuuaaauauuuucuuucuuucuuuuuuuuuuuuuuuuuuuuugagacagggucuggcucugucaaccaggcuggagugcaguggcacaaucucagcucaccucaaccuccaccuccugggcucaagccauccucccaccucagccuucugagucugggacuacagguucccaccaccaugccuggcuaauuuuguauuuuuuguagagacaggguuuugccauguugcagaggcuggucucgaacuccugaguucaugcaaucugaccaccuuggccucccaaagugcugagauuacgcccggccuaaauauuacuuucaaauagaaccaucuucauggguagcaguuuauaauacacaaguagaauuugggaaauguagucccagucuuccauucuucacaguggaugcuucagccaguuuccugucucugcacacacacugcccgacagcgggcuuucccuucuccuucagagcaguagcaguucccuuucuucauucccacccaucacaguggcagcccccucugcccuccuguauucugaaucccacccuuauaauaugcuuagauuuugccuuucucccagccguuuugugagcauuguucguguguaccaauuuuuucucauccuuuaaaaagaaaaaaaaaaagccccuuuucucaauuguacaucgcaaauccaacucuugcccuccugcagugucagaggacuuggcugugaugggaauaagccuuggcucuguucuccuugcauacuuagcccaugggaacccaguuucuggccucaccaggaauguuguugugcuuugagcucccuguggccuugcaugaugccuccguugguccuuacaggaggugauuggcuggccaccucacuugcuuucuccuguggacccuucuuucucuguccuuccuugaaugcugccuuugucccucaugauuaugcuaucaacauucuucucuuucugcuuucucuguaacagguuuauugacucuuuuuuuugagagucuugcucugucacccaggcuggaguacaguggcacaaucuuggcuugcugcaaccucugcuuccuggguccaagcgauucuucugccucagccucccgaguagcuaggauuagagacaugugccaccaagucuggcuaguuuuuguauuuuuaguaaagaugggguuucaccauguuguccagguuggucucaaacucccaaccucaggugaucugccugccucggccucccaaaguggugagauuacaugugugaaccauccacccacccugauucaacugacucuuaacuuuaaaaaucacauuggucuuaccauacauaguucaucaauugugggagagaaacuugggugucaugcuuuauuuauuuauuuuuuuuuugagauggagucucacucugucacccaggguggagugcaguggcacgaucucagcucacugcaaccucagccuccuggauucaagccaauucuccugccucagccugcccaguaguugggacuacaggugccugccaccacacccggcuaauuuuuuguauuuuuaguagagacagcauuucaccauguuucagucuccugaccucgugauccacccuccucggccucccaaagugcuggcauuacaggcgugagccacugcacccagccuauuuuucuuuuuuuaauaagagauggagucuugcuuugucacccaggauggaauuuguagcauaguagugugaucauaacucacuguagcuucaaacucaggcucaagugauccucucaccucagccuccugaauagcuggaacuacaugcaugaaccacugcaccauuauuuuauuuuuaagagacgggaucucgcuguacugcucaggcuagccuugaacuccuggccucaagugauccuucugccuuagccuccugaguggcuggcuccacucugcuuggcucugauauuuuuccauaaagccuaucauucauuuaucauggagguauguuaauuuugccuucuuaauuucucucaaauucaccugcucuuugccuacagucaucugccccgaucuggggcaacgcaguuucuucccagggcuguugccauagcaucgcaguggaucacccuuccuucagucuuguuccccucugguucuuucucuccacuagacuuuaaaaaauuuuugagauagggucuugcucuguugcccaggauggagaacaaucauagcucacugcagccacgaccuccugggcucaaaugauccucccaccucagccucccgaguagcugggaccacuugugcuugcuaggaugccuggcuaauuuuuaauuuuuuuguagagacaaggucucacuguguugccuaggcuagucucaaacugccaggcucaagcaauccucuugcuucagccucccaaaguguugggauuacaggcaugagccacugcaccuggccuagcggauuucugaagcauuaaucuguucuguuacuuuccagcuaaaaaccaacaagugucugaggacacaguuuaaacuccaagaugauaggguccucccucaccuggacucccaccuacccucaugaccuccuuuugugaaaugcugaagggcucugcagcugguugucugguacugcuggccuuugcuuucuauuuagcauguuccuucucccacaaaacaaaaucacauucucacuaugcccuguucauucuucaggacuaucuucugggaaacuuuuacuacauaccccucucccccuaaucugagugucugcuuugcucagguaacauguguucacuggauaaauccuugauuccuggcacugaggcaggguuucuguucccaggaagcagaggcauacuauucugugaaggauugacugaguuucuccuaauaccaagcaguaucugagggaacagaugucuagcuuaaaauccucccuagcacuugucauagcagugcuacguauugccugugaaggaaguuuaauaacugcugaaagguucgauuagcuuuauuucaucaggauuuguuugacuuuacaaauugauuuggguuauuucaacuuuuaggucuagucuuaaguauaacugguacauauuccuucaagcagccauuacaccucucauaaauuuauuauacaccugcauuuuuauaacuauuaugcuuuuuaauuguuggccaccauuuuuagugcuucugaauuguuaugguucucaagcagcaguugucaccuugguuuugaauuaaugcugugacgcuugcuuccaggaccccuaugguguagccguggguggaacuguggggcacugccugugcacgggauuggcaguaauuggaggaagaaugauagcacagaaaaucucugucagaacugguaagucuugaaaauuacaaaucagauaacauuuuagaaucacugagagauuaaaggguguuagcuuugauuauuuaaauuucugcugcugaaguauacuugguuuuucuaauuaccuaccaucucuuauagagguauuaauccugguauugcaaauacggacuuuuuucaccuguguagaaguuagcaaaauacaaagucauuuuuaucgaauucauaguagcuucuuguuaacauauuaucuuaguaaaacaauugucauuuggaaguaugagaaguuuuuggcucuaaaaaugugucuuacaagacuggaaucauguggagaccauauguacugauucugcugaauauguccugugaagccacaguuaggucuagagauggaagaaucgucucuuugcuagucagaagaccugaacauuuucuuuuauaacuggauuuuaagaugaguuauaguucuacuguugcuugccagcacugucuggauuuaauacaauccugucauuucucaaaacagugcuggagaaaaccugauucuuaguguucacagucaagcauguuaaguauuguuccuuguuauguaaaagggguugaagugauucuaauuuguuuucaagguuaguuuaauagauuggaagaauaauuggccgccucaucggcucccuuuucauuuuguacaguaucaagguauaggaauuuuacuguauuugacuuuuuuucucucucuuccagugacaaucauaggaggcaucguuuuuuuggcguuugcauuuucugcacuauuuauaagcccugauucugguuuuuaacaagcuguuuguucaucuauauuuaguuuaaaauagguaguauuaucuuucuguacauaguguacauuacaacuaaaagugauggaaaaauacuguauuuuguagcacugauuuugugaguuugacccauuauuaugucugagauauaaucauugauucuauuuguaacaaggaguuuuaaaagaaaccugacuucuaaguguggguuuuucuucucuccaacauaauuauguuaauaugguccucauuuuucuuuuggugcagaaccguugugcaguggggucuaccaugcaauuuucuuucagcacugaccccuuuuuaaggaauacaaauuuucuccuucaucacuuagguguuuuaagauguuuaccuuaaaguuuuucuuggggaaagaaugaauuaauuucuauuucuuaaaacauuucccugagccaguaaacaguaguuuaaucauuggucuuuucaaaacuagguguuuaaaaaaagagacauauaugauauugcuguuauaucaauaacauggcacaacaagaacugucugccaggucauucuuccucuuuuuuuuuuaauuggguaggacacccaauauaaaaacagucaauauuugacaauguggaauuaccaaauuaaaagagaauacuaugaauguauucauauuuuuucuauauugaauaaacaauguaacauagauaacaauauaaauaaaagugguaugaccagug

SEQ ID NO: 191478 - RNA, 30253 nt, Homo sapiens
cacuggucauaccacuuuuauuuauauuguuaucuauguuacauuguuuauucaauauagaaaaaauaugaauacauucauaguauucucuuuuaauuugguaauuccacauugucaaauauugacuguuuuuauauuggguguccuacccaauuaaaaaaaaaagaggaagaaugaccuggcagacaguucuuguugugccauguuauugauauaacagcaauaucauauaugucucuuuuuuuaaacaccuaguuuugaaaagaccaaugauuaaacuacuguuuacuggcucagggaaauguuuuaagaaauagaaauuaauucauucuuuccccaagaaaaacuuuaagguaaacaucuuaaaacaccuaagugaugaaggagaaaauuuguauuccuuaaaaaggggucagugcugaaagaaaauugcaugguagaccccacugcacaacgguucugcaccaaaagaaaaaugaggaccauauuaacauaauuauguuggagagaagaaaaacccacacuuagaagucagguuucuuuuaaaacuccuuguuacaaauagaaucaaugauuauaucucagacauaauaaugggucaaacucacaaaaucagugcuacaaaauacaguauuuuuccaucacuuuuaguuguaauguacacuauguacagaaagauaauacuaccuauuuuaaacuaaauauagaugaacaaacagcuuguuaaaaaccagaaucagggcuuauaaauagugcagaaaaugcaaacgccaaaaaaacgaugccuccuaugauugucacuggaagagagagaaaaaaagucaaauacaguaaaauuccuauaccuugauacuguacaaaaugaaaagggagccgaugaggcggccaauuauucuuccaaucuauuaaacuaaccuugaaaacaaauuagaaucacuucaaccccuuuuacauaacaaggaacaauacuuaacaugcuugacugugaacacuaagaaucagguuuucuccagcacuguuuugagaaaugacaggauuguauuaaauccagacagugcuggcaagcaacaguagaacuauaacucaucuuaaaauccaguuauaaaagaaaauguucaggucuucugacuagcaaagagacgauucuuccaucucuagaccuaacuguggcuucacaggacauauucagcagaaucaguacauauggucuccacaugauuccagucuuguaagacacauuuuuagagccaaaaacuucucauacuuccaaaugacaauuguuuuacuaagauaauauguuaacaagaagcuacuaugaauucgauaaaaaugacuuuguauuuugcuaacuucuacacaggugaaaaaaguccguauuugcaauaccaggauuaauaccucuauaagagaugguagguaauuagaaaaaccaaguauacuucagcagcagaaauuuaaauaaucaaagcuaacacccuuuaaucucucagugauucuaaaauguuaucugauuuguaauuuucaagacuuaccaguucugacagagauuuucugugcuaucauucuuccuccaauuacugccaaucccgugcacaggcagugccccacaguuccacccacggcuacaccauagggguccuggaagcaagcgucacagcauuaauucaaaaccaaggugacaacugcugcuugagaaccauaacaauucagaagcacuaaaaaugguggccaacaauuaaaaagcauaauaguuauaaaaaugcagguguauaauaaauuuaugagagguguaauggcugcuugaaggaauauguaccaguuauacuuaagacuagaccuaaaaguugaaauaacccaaaucaauuuguaaagucaaacaaauccugaugaaauaaagcuaaucgaaccuuucagcaguuauuaaacuuccuucacaggcaauacguagcacugcuaugacaagugcuagggaggauuuuaagcuagacaucuguucccucagauacugcuugguauuaggagaaacucagucaauccuucacagaauaguaugccucugcuuccugggaacagaaacccugccucagugccaggaaucaaggauuuauccagugaacacauguuaccugagcaaagcagacacucagauuagggggagagggguauguaguaaaaguuucccagaagauaguccugaagaaugaacagggcauagugagaaugugauuuuguuuugugggagaaggaacaugcuaaauagaaagcaaaggccagcaguaccagacaaccagcugcagagcccuucagcauuucacaaaaggaggucaugaggguaggugggaguccaggugagggaggacccuaucaucuuggaguuuaaacuguguccucagacacuuguugguuuuuagcuggaaaguaacagaacagauuaaugcuucagaaauccgcuaggccaggugcaguggcucaugccuguaaucccaacacuuugggaggcugaagcaagaggauugcuugagccuggcaguuugagacuagccuaggcaacacagugagaccuugucucuacaaaaaaauuaaaaauuagccaggcauccuagcaagcacaaguggucccagcuacucgggaggcugaggugggaggaucauuugagcccaggaggucguggcugcagugagcuaugauuguucuccauccugggcaacagagcaagacccuaucucaaaaauuuuuuaaagucuaguggagagaaagaaccagaggggaacaagacugaaggaagggugauccacugcgaugcuauggcaacagcccugggaagaaacugcguugccccagaucggggcagaugacuguaggcaaagagcaggugaauuugagagaaauuaagaaggcaaaauuaacauaccuccaugauaaaugaaugauaggcuuuauggaaaaauaucagagccaagcagaguggagccagccacucaggaggcuaaggcagaaggaucacuugaggccaggaguucaaggcuagccugagcaguacagcgagaucccgucucuuaaaaauaaaauaauggugcagugguucaugcauguaguuccagcuauucaggaggcugaggugagaggaucacuugagccugaguuugaagcuacagugaguuaugaucacacuacuaugcuacaaauuccauccugggugacaaagcaagacuccaucucuuauuaaaaaaagaaaaauaggcugggugcaguggcucacgccuguaaugccagcacuuugggaggccgaggaggguggaucacgaggucaggagacugaaacauggugaaaugcugucucuacuaaaaauacaaaaaauuagccgggugugguggcaggcaccuguagucccaacuacugggcaggcugaggcaggagaauuggcuugaauccaggaggcugagguugcagugagcugagaucgugccacugcacuccacccugggugacagagugagacuccaucucaaaaaaaaaauaaauaaauaaagcaugacacccaaguuucucucccacaauugaugaacuauguaugguaagaccaaugugauuuuuaaaguuaagagucaguugaaucaggguggguggaugguucacacauguaaucucaccacuuugggaggccgaggcaggcagaucaccugagguugggaguuugagaccaaccuggacaacauggugaaaccccaucuuuacuaaaaauacaaaaacuagccagacuugguggcacaugucucuaauccuagcuacucgggaggcugaggcagaagaaucgcuuggacccaggaagcagagguugcagcaagccaagauugugccacuguacuccagccugggugacagagcaagacucucaaaaaaaagagucaauaaaccuguuacagagaaagcagaaagagaagaauguugauagcauaaucaugagggacaaaggcagcauucaaggaaggacagagaaagaaggguccacaggagaaagcaagugagguggccagccaaucaccuccuguaaggaccaacggaggcaucaugcaaggccacagggagcucaaagcacaacaacauuccuggugaggccagaaacuggguucccaugggcuaaguaugcaaggagaacagagccaaggcuuauucccaucacagccaaguccucugacacugcaggagggcaagaguuggauuugcgauguacaauugagaaaaggggcuuuuuuuuuuucuuuuuaaaggaugagaaaaaauugguacacacgaacaaugcucacaaaacggcugggagaaaggcaaaaucuaagcauauuauaagggugggauucagaauacaggagggcagagggggcugccacugugaugggugggaaugaagaaagggaacugcuacugcucugaaggagaagggaaagcccgcugucgggcagugugugugcagagacaggaaacuggcugaagcauccacugugaagaauggaagacugggacuacauuucccaaauucuacuuguguauuauaaacugcuacccaugaagaugguucuauuugaaaguaauauuuaggccgggcguaaucucagcacuuugggaggccaagguggucagauugcaugaacucaggaguucgagaccagccucugcaacauggcaaaacccugucucuacaaaaaauacaaaauuagccaggcaugguggugggaaccuguagucccagacucagaaggcugaggugggaggauggcuugagcccaggagguggagguugaggugagcugagauugugccacugcacuccagccugguugacagagccagacccugucucaaaaaaaaaaaaaaaaaaaaagaaagaaagaaaauauuuaaaaauucacuagauuaaguaaaauaaacuaguauuuaacuaguuccuuuaauauaggacuuuccagucuuuauuuguauacugagucgucuuuuuuuuuuuuuuuuuuuuuugagauggaaucuagcucugucgaccagaguggagugcaguggcgcgaucucggcucacccggguucaagagauucuccugucucagccucccgaguagcugggacuacaggcgugggccaccaugccuggauaauuuuuguauuuuucaccauguuggccaggcuggucucgagcuccugaccucaggugauuugccugccucagccucccaaagugcugggauuaaacgcgugagccaccacaccuggcccaagucuuaaaaagaaaaaacaaaacgacagggauauauuauuugccaaauuugacucugaauuucuuccuucccccucacccuuuuuuggccuagaaccaauucaagucucaaaggacacuaggauuaugugaaauccaauuugggaacauuaaaucauguuggaagcaaagauaaaacugcauacuaaaauggccugaacuagacaacugcaugguucauaagaaaaauuaccaacaaaaauaggaauacuaagggaacaggaaaagacacaacauuucugccauuuaagagcucauuaaauauccccgcagggcaguuaguauggaaguguggcuaacacugaaugugccaugugggggaccaugcuagauacccugcguguguuauuucaucugcaaaccgauccacaaagcagguaauccccauuuuuggaugagaaaaugcagggaagugcaguaaugugauuuuacagcaagagacucaaaacccagucagcacgugccauacugcuagaauggaccagggugucucguagguagggagccucaagccuuucacacgucacucuauggcauagagucuaugccacagaguagagagaaaaacgcagugauucugcugucaugauaacucacccugguagaaucacuaccaccucaacaaaaugguuacuuacuauugagucccaacucuggcaaucugagagccaauaaaaggcuagaaaucaagaagaauauaggguacagccauuaaauaaauaaauaaaauaaauaaauaaauaaauauauauguauauauauauauauuuuuuuuucuuaagauagugucucacucugucaccuaggcuggagagcaguggcaccaucucggcucacugcaaccucugccucccgguuucaagugauucuccugccucagccucucuagcagcuaggauuacaggcacccgcuaccacgcccagcuaauuaaagugauauuuuuaaagaaaguuuguuuuaugagaaucaaaugaaaaucagaguuccauuuuuuuuccccaaaauacagcauuuuugaggcuucccugacaaaauagccuuucccaucuaucuuaguccuggccuucaacugucuuguauuuuaaaccacagccuauaauuaaagaacuuguucuuuuaugauaguuccaaggaauuagaaacaauuuuacucuuauaaaaagagaaucugauauaaacacagauaagaaauaguaucaguuaagaugaaaaagagguugaaaaguggcagcaguauuccauuccacaaccgucuccacaugaaaucuuaauaaaucugugugaacaaugacaggcgccucauauaaaaccuugcuauucccaucaaaagaaaaauuaaaaaauaaaaaaccaaugggcauguuuuaaauaaguggcauugaacaacugugaagaaggccacagccagccagcuuacucccucacacaagucacccgaucucucugggggucagguucuucaucugaagaguaaaagcuacaagaugagcugaggucucuagcuucccacuccagaacuuaggauucuugggcuaagacuuuuugaacaaaaaguuccuacacagaaacaaacaagucaccuaggccagagcagugacucucgccuauaaucccagaaggauuauuugcgaggcugaggcaggaaguuucaggccagggguucaaaacuggcuggacaacauggugagaccccaccccuaccaaaaaguaaauaaauaaauuacccauaauagcaguacgcaacgauagauaagcacugaaauaaaaauaauguuuuuauuuccuuaagucuuuuuuguucuuuuuauauauuauuuauuuaauuuuuugagauagcaucucacucugcugcccaggcuggagugcaguggugcaaucuaggcucacugcaaccucugccuccccgguucaaucaauucuccugccucagucuccugaguagcuaagauuacaggcaugagccaccuugcccggcuaauuuuuguauuuuuaguaguagggguuucuccaugcuggucaggcuggucucaaacuccugaccucaggugauccgcccaccuuggccuccuaaagugcugggauuacaggcgugagggacggcacccggccuucuuuuuauauuuuaaaaguaaaccuccuuuuaaaauuuuuccaugucacugaaaugauguugaagagugaauauucuaagagcuacacagagauuuguaaacagcugaaccaauuuucugcuggauuauuaggcuguuucuaaauuuuuacuaaguuacaauaauuauaaguagucugugcaacagucaauuucuuuaguguaacacaugaacgaaaagcuauacacuuuuuuuuuuuuuucagacugggucucccugucaccaaggcuggagugcaguggcgcgaacacagcucacuggagccucaaccucccaggcucaagcaauccucccaccucaacccuccugaguagcugggacuacaggugcauaccaccaagcccggcuagcuacacauuuuuaaggcuuuagguauuaaacaccaaaauggccuucaauaauauuauacugauuuauauucucaacaacuauaaaaaagaaaguucuaugauaagaaaaccaagcuaagaugacaaguaccacggcaucauuuuggcaaaaccaaagggaaaaggaugaguaaaaagagcccaacugagcuugguuacaagaauuucaccugcagguagcaggaacugggagaaggccaauuuuagagagcagcugaauuaucagauguaaaacagucuugcauaugaaggaaugcuguggcccacuucaguguguccaguguuuucuggaacaaaguaauaauaauuacguuucauuuuaaacagucuccucucaaauaucacucaccucucuagcugccaauacaauuguaguuaguugagagcgaucaccccauucugcuaagaauguuaauguaagagcuugaacaaaaaugggugaaauaaaaugcaaccacuuuuucugagguacuguuaugcuuguacccguuucaacaucucccgguccauuuaaaaguuugguucguugaaacuaaaauaaauaauaaacaaaugaaaguaagcacaggaagcaaaucaaaauagcacacaaaucacuugacuuuucuaaguguuuaaauucuaugaaauaugcuccaaaaaaacuacauuuaugugacccccaaaccuccccucugaaccacuggucucacacagcaacaaaugcuauagucucaauucuuccguuucuccucagcugaacaaaccaaacaguauuuacugcucugcucacuuacuauccuagacaccacgggagaaacagguaaaauuauaaaauacaguuccugcuuuucaggagcuuauaaucaaccuaauuaaggaaacugauuaccuguguucaguauucaucugucagcuuccuuucucuacuacauucacaccaaccccaagucagaucacagacagguauaagaacagaacaaagcaaaagaagcuauuuuuguguagccccgcauaucacacagauggggccacugagaaaccucuguagaguguuuauuccuaguugagugccuuuuugguccagaucaacagugccauggcuuacuucuucaucuuucuucuuuaauucagcuugaacuucuuccaguuccucuugacccucaucagggcucaucuuuaagccuucccgaagcauucuaaugccaaaaauggcaaauaauacaguugaaacauaguauguauagacccuggggaugacugugguggcauagccaaacaaaacuggaaaaaauacaacaguauguuuguuaaucgaguguguaucacgaccaagggaacaguuaacuucggaaauaauaauuuaucacuguuaaaagaaaaaugguucacauuagaagcuaaucuaguauguaauaaccucaaguauuuccagaucuuucucuccaccaauaauaaaccauuaggucuagcccaggccuaacacagcuuacucagaagccaaugguccaguugaagauggcacaucuuccugagagauguuaaguaagauauugaacuccuuuccaggcauguucagucagaggcuggcuugccuuauguugugcaaggcacaguaccugggguagaaguuagcucugaggcccucucaagagcugagauuuuauaacugggaagccaugccacuugcauaguggaauuucuucaucacaaaucuuuaaaucacaaacuucuagugaagaaucaugacaaaagucucacauagcaagauuuaaacucugcucccuuguaacuauuuaaaauaaguacguuuuaugaaaaaaaucuaaaaauuucuuauuauauuaaaauaauguuacaacaggcucaaacauucaguuccacucuuucccacugauaaggaaagacaucuguguaaguuauauaaaaaaugaugcuuggaacuauaucaagaacucaaauccuaauggugaaacacaaguauaucaguaauacucauucaguaauuaaaacuuaaaaauuuggcugggcaaaguggcauaaucccagcacucugggaggccacgguggaaggauugcuugagccuagaaguucaaaaccagccugggaaacauagugacacccugucucauaaacaaacaaaaacaacuauguaaggaacagaggacacgaccauacauauaauaaauacaauuacucuggccaggcacgguggcucaugccuguaaucccagcacuuugggagaccgagucgggcggauuacuugagcccaggagcuugagaccacuggucaacauggcgaaauccugucucuacaaaaaaaauacaaaaauuagccugacggggugacacacgccuuggucccagccuacuugaggggcugagauaggaggaucacuugagcccaggaggucaaagcugcagugagcugcgaucaugccacugcaucccagcuugggcaacagagugagaucccaucucagaaaaaaaaaaagaaagaaagaaaaauacaauuacucuuuaauucaccagcucuuuuuauaaaacgggugcaacacuuacaaaucugccuguaaauguauaaccuguauguaaauaauucccuacauuacaaaacugaaaagaucuuaaaaucaugguuagaaaugcagcaaaccuauguuugugugcacaucuguauuuaaauuauuguguguguauauauguauggauguauauuuguauauauguauguguacacacaggauacaagcauauauuuucuagcucuguccacugaaaaagacaagaggcaaagacaucucaguaacaaggagcucaguaaccuugcaccuagaucuuggguucuaauaccauucuccccuaaaaagcuccucaaagcuccgccgagaaauggccaguuccaggacugggcagagcaggugcaugaugaaccuguaauaucuuguuguacuagaaagugaggagcaaaaucaaaugggagcaugccacaaagacacaggacacaguuuggagaggcucucacuggccuaacaucggauaauuuaagcagcaaaauaguuaaauaauuaauuauaaaccauugaaaaaaggaauccauaaguuuguacugcuaguaaaaagacaaacaaaugggaaaggaaggagagcucuugcuggcaguagaauaccaaggcucacuggugaauaugcaagaaguauuagaauuaaaagcaucauuuugcaagcaucaaugaaagaucuaauuaugcaagaaucaucaauugaugcaaaaucuuuggagaaauuuugaugaggaagaggguauuuguacugucuuuaaguauaucccuacagauuagauaguaguugcaagggaagacaacacagaaaagaaauauugacugggucaccaaaauuaaugucaccaaugaggaauaaauggacaccaugugcuuccagaugagacauucuuggagagacaaaguaucaccuaugcaguuuucuagucaggaaugccuaccucaaucuaaccaucaggaaacaucagacaaacaaaaaauggggaacagcccauuccugggguggagggaggagggauacacuguaauucucccaaaaagguugaugucagaaaacauuuuaaaaaaaggcuauggauauauuucagauuaaaagacuaaaaagauaauaaauaacuaaaugcaauaucugaccuagaccgaagggaaaaacacugauauaaaggacauuauugaggggucaggggcaaggggagggagagcauuaggaccaauaccuagugcaugcagggcuuaaaaccuagaugacggguugaugagugcaacaaaucaccauggcacauguauaccuguguaacaaaccugcacguucugcacauguaucccagaacauaaaguauaaaaaaaaagugguuaaaucuauaaaacuaaauaaagcuauaaaagagaagauguagaaauaaacacauaugauuuaacaguugaggcaaaauaauauaaagacuguuaaacccacuuaaauuacauaaaacugauaacacaagugaaauauuuaaaaauuucauguccuuuuuuuuuuuuuugagacggagucucacucugucgcccaggcuggagugcaguggcacaaucucggcucacuacaagcucugccucccggguugacgccauucuccugccucagucucccaaguagcuaggacuacagaugcccgccaccaagccuggcuaguuuuuuggauuuuuuuaguagagacgggguuucaccguguuagccaggauggccucgaucuccugaccucgugauccgccugccucagccucccaaagugcugggaucacaggcgugagccaccgcgcccagccuauguccuuucaaaaaacaagaaaggacauuaggucauccaaaauuaaaauauggaugacagauucaaguacuguaucaauacauaauauauauuaaauguugugauuauaugugugcauuauauagcuuauaaauaauguauguauauguacacacuauagacagguauguaaacaacguguauauauacacauuuacaauuuuauuuagauaagaguacaaaugcuaaaacaaaugggauaaaauguuaacaacaggugaaucuaggcaaaaguuauauaaguguucuucauacuauuuuauuuuugcugcuuuguaaacuuaaaauuauuucuauaaaauguuuaaaaauuguaaaaugaugggccaggggccaggcgugguagcucacgccuguaaucgcagcacuuugggaggccaaggcgggcgaucauuugaggucaggaguuugagaccagccuggccaacaugguaaaacucuaucucuaccaaaacauacaauaaguauccaggcgugauggcaugugccuguagucucagcuacuugggaggcugaggcaggaaaaucgccugagccugggagauggagguuuaagugagucgggaucaugccacugcacuccggccugggugacagagcaagagucugucucaaaauaaauaaaaagauaaauaaauaaaaauuuaaaaaauaaauacaagguaaaaggaugggcaggcacacauaccuauaauaucaguacacugggaggcuaagguggaaagauagcuugagcccaggaguucaagaucagccugggcaacacaaccagacccugucucuacaaaaaacaaaaaauuuagcugggcaugguggcaugagccuauggucccagcuacucaggaggcugagguggaaggaucacuugagcccaggaguuccaggucucagugagcuaugaucaugccacugcacuccagccugagugauagagcaagacucagucucuaaaaaaaaauaaauaaauaaauaaauaaaaaauagcccuaucaucucauuaagagauguauuuccaauuuuuuaaaaugauuauuuaaauuuauaauauauuuucuuugaguacuaauaacuauaacaacucaauucauagaguuaacacuuaagagauuuacuaggagaaauuuacaauaucuuugaaaauucaaugauauuaaaugcauauuuuuauugcagguagauaugauggggugauccauauauauauuucuuuaggcucauaaagugaagcaguggggguggacaaggaagaaagaaaucuguaacugguuugucaucgauuaguuguauacaccauugcacuuggaccagcuuuguaauaaauuuugaagcaaaaauuuauaaucauuagaguaaaauuaagggaaguaaaugaaaauauaaauuauaggaagaaaaaaauguaaauuuccaacuguuaaaaaaguauauucacauuuguuuuaaaggaaugauggugauaguggguaucaaauuacuaaugguauuuagagucacuggguagauuuuaaaaacacccuaacagucucccuuuuuuuuuuuuuuuuuuuuuuuugagauggagucucacucuaucacccaggcuggaguguaguggcgcgaucucagcucacugcaaccucugccuccuggguucaagcgauucuccugccucagccuccugaguugcugggauuacaggugcacauuaccaugcccagcuaauuuuuguauuuucaguagagaugcgguuucaccacauuggucaggcugaucucggaacuccugaccucgugaucuguccacuucggccucccaaagugcugggauuacaggcgugagugacugugcccagcccuaacugucuuacuuuacacaauauaacagaaauuagaucuuugcaauuccuuaaauugaagaugaaaaauuucagacaacuaugcgagaggggguacaaaauuauuuuagaggauacacaaggaaaggauacacaaggaaaagguuggaagaccacaaauaagguguaagccaaauucccauaagacuagguuaaugacucagugacuccaugucacacaacacgcuuucccuuuaauucagcgaacucaugagagggaaaagcacacucaccugacaagcaugucauuagucccaaggcaagcauugcaccagccagcacggucaggcgguuauagcgcauugccaugauggcugcuauaaaaaaugucuuaucacccaauucagauacaauaauaacugauauggcagcgacaaaugcauggauaaaucccaaauuaguuuggguagcaggaucuucuuuauugguaugaacuggagcugcugguguaaauauuuucuggaaaaaaaaaaucaguuacuucuuaaaaucauuauucaaaauuauuuuauuuugcacguaaauaagauuuaguuuuuuugaaaauuuucuugucauggucauuacacuuauuuacugucuaaucacucugaaagccaucaguaacgacgguaaccucugacgaugguugcuacaauuugaguaucccuuaccugaaauguaugggaccagaaguaguuggaauuuuggauuuuuuuagauuuuggaauauuuauaucauagcugaguaccccuaauccagaaauccaaaauguuccauugagcauuucauguaugucagugcucaaguuucagauuuuggagcacuguggauuuuagauugaggauacuaaacauguauaaugcagauuuacauauaauucuccaaaacaauuuuaagaacagaguacagaccugcuauauccaugcauuaaaauucccuuuuuuuuuuuuuuuuugagacaaaaucucacucugucacucaggcuggagugcaguggugugaucuuggcucacugcaaccuccaccucccagguucaagcgauucuccugccucagccucacaaguagcugggauuauagguaugcaccaccaagcccagcuaauuuuuguauuuuuagucaagacaggguuucucaucauguuggccaggcuggucucaaacuccugaccucaagugauccacccaccucagccucccaaagugcugagauuacaggcgugagccaccacgcuuggccaaaauuaccuuauuuguuaggcauuugugauuucagauuuaguucuuagcuacaucucauucaaauuuguauuaguaacuugcaugaaagacccagguauguuuaaaaaacauuugaacgacgggaagcuaagaaaaauuucauuaacacucugaaggacagaguaagacccacaaaccucagcaggguauagagaguugguuccagcuaagacaaguuuaauacagcuguuaacacagaucguccuacgcugaagucuaaaaauaucuuagaagguaaaguggcaugguggcggaagccuauaaucccaguuacuugggaggcugagacgggagaauugcuucaaccugggaggcggagguugcagugagcugagacugcgcccauugcacaaugggcaaugagugaaacucugucucaaaaaaaaagaagguaaaguggccuaaugaaaaagacaaaccagugucuuggcugucauuacgcuguaaaugugacaaagcuucaaaaaagcaguaagcucuucgcaugaaggaguuaaugacaaguccaacguuauucuaugcugcucagaccuuccccaaaguucuauauacaguucuaaagcacugcacugcccucugaagauuagcagaugucagacucuaaaaccagggauggcaaguuacugaaccaaaacccagccuauaagagcaaaaaaagguuuuuuacauuuuuaagaaguuacaagaaauaagaagaaagagaaaaggagggaaggcuggugggaggcaaggaggagggagggaaggaaaggaagauuaugcaucagagauugguagccugcaaauacauggcaacuacaagaaguuugcugacuuggcucuaaaacaaucccgugagggaccaggaaggacgggguaucauguuccaauaauugggaaaguuuuuaagugaaucuauccaauccauacgguccuaagaggcagaacuaaaaaguuagagauggcagguuuuagcuuaacagagaggagagauuucugucuccaaagacgcacccaaaguuggaacagacugcuagaggaggugguaaauacccuucucuucucaacgucugaguuccagagaagggaaccaccacucccaggaaaugggcuagacaagcgguucucaaccagggcgauuuugucucccaggggacaucugacaaugcuugcggacauuuuuaguuacaaucaaaggggaacuacuggcaucuaguggguagaggccagaaacgcugcuaaacauccuacaaugcacaggacagcccuuccacaaccaagaauuauauauccaaaaugucaacaguucccagacugagacgcccugggcuagauaaaccacuuccaaaggucucuuccaauccuaauaacuuauuuuuaauuuuuuaagcuuaugaaucucuagaaacccaagagauaaagaaaaagaaacccaagaacauaguaauuuuggacagcguaaaaacagauuuauuacaaaggcccuagucacagguaagaauaaaaucauaaauucuuagugugcaugucauuccuuaacacauaacauaaagauuauaaaauuccacaguaaagaucagaaaaauuuaggcauuaccauuaagacuagaccucugagcuaaauacuggagaaauuuaacaaaauggaaaguauuuguugccuugacagcuggcucucaaugaauugaguuuaauuaauuaagcaaguaucauuuuaagggcuucuugcuuucucuccauuauuuugguuccaccuacguugacgguccuuuaaaaacgagcuuccugcagugagcuguaauggcaccauugcacuccagccugggugauggagcaagcccccuucucaaaacaacaacuuccuuucucuuccaauauuaagaauccuuauauuaaaaaaaaaaaaaagggcauuucaaauuucaacuuggcucugacacauuuuccuccugaaaaugcuuuuuaaagguuuguauaaaauuucaggaucugaaaucccagaaaaauuuuaggaauaaauauacaccauuuaugaucacuuagcucuaagcucaaacacaaaauguuuacuuuuuaaaucaaacacaauagugaucaaagcuacacagucucaugguuuuauaauucccagccaugaaacuucagccacauuauuuaaucucuguuccucuguaaaauguagggauaaaauaaaauuugcuuuaagaguacagacaugcaccacaugaugacaauuugaucaaugaugggccgaauaugcagcaguagucccauaagauuacaguaccaaauuuuuuacuuuaccuuuucuauguuuuuuuauauauauaaaauguuacaacugccuacaguauuuaauauaguaacacgcuguacagauuuguagccuaaaagccauaggcuauaccauuuagccuagguguauagcagguuauacaucuagguuuguguugaguacacucuaggacgucugcacaaugaaauugccugauaaugaguuucucagaacacauccccaucauuaagcgaugcuacauauucuuaaaaccuuccuacacacaaaacacaagaaaaauaaacauaaagcuuguuacauacuaagcugguccuggguggccaaaaucauacaaccaaucauggugacaagaacuuaaaacgaaaaguaucgggguaccgugaagauagaagaucuuuuuuaauuaaaauauuaacaggauuaaaaagugauccauuaccauuccuucacugcuaugugcaaggaucaucuucuuugucuaauucaccuucacagggacacaguguagugguuaaguguauaggcucuggaaucagacugccaguucauagccaaggcauuaucaguuacggcgugaccuugggccaauagguacaccccccugugacucaaguucaucuguaacauaagggcuaccuaugucucaaaggguugcugugaggauuaaaugaauaaagcccuuuaggacagugcucaguacacaguaagugcucaauuaguuuuuguagugccacaaaauaugaacaguugaaucuuccugaaacuaauuucauguuacuucacuguuuuaagaaacguaauggucuuuucauaccaaauacuugauucugguaacuauccaacaguucucacugaagcacauaccagguuccccaaaugaaccugcuucuccauccugaaggaugagccagagcagagucuaacaaaaaaucaugcagccacaaagguaggccacauaauacaauuuuacauuuucugguagccauauauuuaaaaguaaaaccagguaaaaauuuuaauaacauuuuacuuaacccaauauauccaaaaugcuacuauuuaaauuauaagcaauauuuuuaaaacuacugagauauuuuaacauucuuuuuuucauauuaaaucuucagacccugguagguauuuacucaccgcacaccucaacucuggauuagccacauaucaagugcucacagccacacauacucauggcucaugguuacagugcugggcagugcagcucgaaagcaugacaggcuuuugcuaaccacaagccuucagccacacaguccuuuuucccuucccaccuccuuuucguuaucccccucuucauccagauuccucaagguccaacucaaguagaaccucuugagaaaggccuaucccagcaacuccagcucuuaaugauccugacccacuacaauaaaacugaaugcaaacugugggcaaugaguaugggaggccuauuacagaaaaaaguucaagacagaaacacucaaggaauugaccuuuucggauuacaaauauguauaaauguaaugcuaucauuuguaauaaagagacaaaauaacuaaaugucggcugggcucaguggcucaugccuguaaucccagcacuuugggagauggguggagcccuugagcccaggaguucaagaccagccugggcaacaaagugagacccugucucuacaaaaaauacaaaaguagcugggugugguggcacacaccuguaguuuccagcuauuugggaggcugugaggugagaggaucgcuugagcccaggagguacaaguugcagugagcagagaugacaucacugcacuccagccugggcaacagagugagacccugucucaaaacaaagagaaagaaaaaaacaacuaaauguccauugauagaaaacuaguuaaauaaaugguagauccacauaacggaauauuauagagcuaaaagaauaauaagaauguucuauacacuaauauagaaaaucauuaagauauuuugaaguugagaaaaaguauauacuaaguauguguacauguggaugguguaaguaucauaaauacacaccacgucucaagaaacagguuaaugaugaauguuuccaggaaaggaaccagaaugacuagaacagggguuggcaaacuuuuucuagaauacaaaaaaggaaaagagacguaacuucucauucuacauucuucuguaucuucuggaauuuuuaacuuucacaccauuauagacacaugcuauguaccauuucaaaaacuuccugacccaacaucuuaugccagcuauggaggaucaauuucuuguaagcugugacugacuucaggcagguccaaccaaaaagcacugcucuguauuuacucauucacuaccuggaaguaugggaaguuaauagcuguagggcuaccaauauggaagcugguucuaagauucauuucauaagccuccugggaaguuucagugggauuucagugggauucaguacuagucacucauggaguggcuaacuugaaaauacaucacuccuuuucugcauauaccucuuuucuguacugacaaugugaaagaauauaggcauguucugagaacaagaaguaaaccaucagaagaaugguuggggcaagaugagaaagauaaacugggccugaaauucuuuauguuuguggacaagcucagaggcaagagggaagucauuacauauuuuuguguaacacauaaacaccaucaaggcacugugaccaauuaucagggcagaguggggaguaucagccacuggaucaaucaggaggucagcugcaugaaacccguguuaagacaaauaagagaaggaaaaaauucugcacacaauggaaagaaaaaucacuagaccuuuaaaaaaagguaggcgggauggggggaaucaaagaugguggugagguuuucugguuggcagaaauauuaguacucuuaaaacgcuauuauguauuuaguacucuuaaaagguaugucggaaaggggaauaaaaacaagggguuugguuucauauacauuccacuuggggugauaaaaagcauuucaaaugaagguuugaaagagguuaucagaaauggaucaccagaguuuagccuaggacagccucaagguauguagccucaagguugacagccuucguguccucaauaggcucuuggaaacugcaacuuuaagugaaaugauguaaaagaaaaccaacuuucuuuucucaucaauguuauaaugaaacaacacugaauuaaaaugacaucauugaugucauuucacuuaaagugaccauuuccaagaaucuauuaauaacauuaagugaggacguacucuaucugguugcuggcagcccaaauuuaucagcuaaagcucugcaaguagaugagauuuccaacagauaaggcaaagagauaaaguucaaagaaugcgccuuagagaaugucuuuauucaaagaagguggagggaggaaaaaaaauaggaaaaaaaacuaucuuagauauuucgagccaggcagcaacuaaagcaucacagaccgucagguuggggugcgcuacuaacuagaugcgagauauuuucagacacauuguugcauuugauacucaaaaaaacuuaggagcuguuuuaaguuuuaauacaggaaaacugaggucaaacgggcuucauuauucugccaaguucauacaccugagauggauucuuaaacaguagagaauuaacagugucaaaugagaacugaaaaagaucccuggauuuagcaauuugcuaacuuacaagauucuuucaaaaaauggaauuugugguggcucaugccuauaaucccagcacuuugggaggccgaugcaggaggacugcuugaggccaagaguucgaggccagccugggcaacauagugagaccucaucuccacaaaaaaaaaaaauaaaauaaauaaaauuagccaggugugguggcaugcaccuguagucccagcuacuugggaggcugaggugggaggaucacuugagcccacuaguuccaggcugcaguaagcuaugauugugccacugaacuccagccagggcgacagagcaagacccuaucuuuaaaauuaaaaaaagaauuucaaggaaaaggcaaggacugaagccagauaacaacauacuaaaguaaagugaaaaagcagcaaauccccuaguuagaaguuugguuuauaaaacugaagaaacuaauauggcugggcaugguggcucacgccugucaucccagcacuuugggaggccgagguggacagaucugaggucaggaauucaagagcugccuggcaaacaugaugaaaccccaucucuacuaaaaguacaaaaaaaaaaaauagccaggcgugguggcgcacaccuguaguccuagccacucggaaggcugagguugcagugugccaagauugugcccacugcacuccaggcugggcaacagagcaagacacugucaaaaaaaaaaaaaaaaaggaaagaaagaaggaaggaaggaaggaaggaaagaaaacgaaacuaauagucaaguuaagauuaaaugaaugaccuuuuucuuucuuuuccaaaauaagagaaacauaugaacauguguaagcagauacaaaggaagcaaugggaagggagagaauaaaggcacugagggaggagaauaggaacguggacacagagaggagguacacaaaggaugacaguuuuguccaaaacaugaaaaaggcagacaguacaggcacagaagaauauacuuggaugcauacaggauuagaugcagugugcaauuucaauuuugguauuccacuauucaguuauacaguguuauauaucaugguaaguaaugagauacuaguguuuugguacaaauaccacuauuucaguauuuuaauaaugucugaaacacaccuuacuuacaucuugagagcaggauuaacaacuuaagauuuuuuuaaaaaaacuugcuuaauaaaaacucuuuucuaguuaaaauuuuaauuccaaauguaaaaauuguaaaaaaaaaaaaaagaaaaagaaaaaggcacccucauuuagaaaguauucuuuuauacuuucaugauccucaagagaaggaagaaaaagaaaaucaaagaaaaaaguaauuccuuuucuaguucuagaguucaaauaaacacaaaugugacuguauugaaauugauacagauaccugcaucggaaucuccaucuauacaugaugaaacuagagaagaugaagaugcuuuccuugaaacaaaaucuacagcuugcuaccaagaaaaaaacugaugucccugcaaaaaaacagaaacaaaguugcucaauaaguuaucaaacaagaggugagauuaucugaagacaaaggagucagaagaaaaugcuuacaauuugcuuagaacugucuccugggcacuacuaagucaaaaaagcuuuuuuuaggggccgggugugguggcucaugccuguaaucccagcacuuugggaggcccaggcgggcggaucacgaggucaggagauugagaccauccuggcuaacauggugaaaccccaucucuacuaaaaauacaaaaaauuagcugggcguguggcgggcaccuguagucccagcuacuugggaggcugacgcaggagaauggcgugaacccgggaggcagagcuugcagugagccgagaucacgccacugcacuccagccugggcgacagagcaagacuccgucucaaaaaaaaaaaaaagcuuuuuuuaaaaguuguaaaaaugugcccaaaaauauauaugcacuuaggccgggcaugguggcucaugccuguaauccuagcaacuugggaggcgugguagguggaucacucgagguugggagcuugagaccagccuggccaacguggcaaaaccccaucucuacuaaaaauacaaaaaucagcugggcgugguggcaugcaccuguagucucagccacucuggaggcugaggcaugagaauugcaugaaccccggagacagagguugaagugaaccaagaucucaccacugcacuccagccugggugacagugagacucugucucaaaaaaaaaaaaaaaaaaaaaaaaaaaaaaaaaauauauauauauauauauauauauauauauacacacacacacacacgcacgcacuuaaacaaugacaccacagauaaaccugauuucgaaagauaacauuaaaguauuuuaauuuucauuacguauuuuugugaaugguuucacuauuuuuaaauacuuuauuguuacuuguuaauuuauauuagaauuuauauguaauauuuuguaauaaaauuauuuuuuguuuuaaugaauguuuauuuuuaugaauguuguuuuguaauguauuuaugcacuugaaauuuauuaaauguguuuaguuucuuuuuuuuuuuuggagacagaguuuugcucuuguugcccaggcuggagggcaguggcacgaucuugguucacugcaaccuccaccucccgggcucaagcgauucuccugccucagccuccugaguagcugggauuacaggugugugccaccacgcccagcuaauuuuuuguauuuucaguagagaugggguuucaucauguuggccaggcuggucuagaacucuugaccucaggugauccacccaccucggccucccaaaguggagggauuacaagcgugagccacugcgcccggccuucauugauuuuauuuuuaaugaauuuuuuugaugacagcauaccacuaaauaaauucaguauuaauauaauuaccuucugagaagguaauuaugagcaggcguccuuauaacugauugccucaaucuuagcuguauaaaggcuagaauuaggaggcuggacuggguggagugggacugcaacuuaaugaaaauagaaaaaaguuuaaaauguuuuguagaagguacucucacagcugaaacguaauaaauaaaugaaauaccaaaacauaaaguaaaaauaugauaacaagaacaggcacugagucagguaaugauuuuguggcuuuauuagaagugcuaugcaaccagagucauucuucuuuggacuuccagaauaugcaauaaagucuaaaugacuuuuauuaaaucuaucugaucucccucaacucaaaggacuuauguuucuuauauuacauauucuguccagggaaagaguaagaaaaaacuauugaguaagucacuagaaacauaaacugcagaaaagauaggauccaaguaaucaacaacacuuuuuaucauggguuuguaaauuggggguuaaucuugauuuuaaguucauauuacuuaccaaccuuuuuuuagccuaauuauagagaaaagcacauacucaauguagaaugcccuguuagaaguucagucaccuugcuuuuagcauccuauaagauacaacuagguuuuuauaacauaucuuccacuugaaugccuacuaaccaaggagagaugcuuccccccuccauuuucagaagcccacucucacacaguggcacaaaaagguuaaauuuaaauauccuaccuacccucuuaaaacaucuacugcauguaguugcaaagcaaauccguugaaacuuacauauucagcaaggcucaacucuugcuaauacugcuguuaaacuguacuuugaucauuucuuaccuccaucagguggacaaaaauagccaaugacacuuauauuacauaguuuagaaaacaugugaaagaaaaaucuuucagcauagugaguaccguagaggaaaaaauacuugaguaguaucaaaaaguuacauaaaaauauaauuaaggccaggcgugguggcucacuccuguaaucccagcacuuugggaggccgaggcaggcggaucaccaggucaggagauggagaccuccuggcuaacacgguaaaaccucgucucuacuaaaaauacaaaaaauuaggcgggcaugguggcgggcgccuguagucccagcuaugcuggaggcugaggcaggagaauggcgugagccuggaaggcagaccuugcagugagccaagaucacgccacugcacuccagccugggcgacagagugagacaaaaaaauauauauauauuauauauauuauauuuuuauauuuuaauauaaauauauuaauuauauuaauauuauuuauuauuauuauauuaauauaauuaauuauauuaauauaauauaauuaauauuauauuauauauaauacaguauuaauauuauauauaauauuauauauaauauauaauauuauauuauauauuauauauuaauauaauauaauauuaauuacauuaauauauuaauauauaauauaaauauaaauuauauauuuauauauuauuuuuuauauauauuauauauauaaaauaaaaacaagacaaggccaggcaugauggcucaugccuguaaucccaccacuuuggcaggccaagaggggaagaucccuugagcccaggaguuugagggcaggcugagcaacauagugagacccugucucuaaaaaaaaaaaaaaggaagaaaagaagacaauuauauucuauuauaauacaaaauuagaauaaacaauaauaaauaaaugccuaacuaaaaugaaucaccaagaauauaugaaaauauuaaacggaaaaaucauauuauauuauacccacccuucccuccauaccccuaguuuuaaagacaaggaucccuucccagcuacucagaaggcugaggcaggaggauggccugaguccaggagcuggaggcugcaaugaguuaugagcuauaagaagaccuugucucuauaaaaaaaauuaaauaaaacuuuaaaagacaagaauccuuaagaccauuuaauauguuuacuggacacuguuucuaccacuguggcauucugcauggcuagauuuuuccuagcuucuuaaaaaggauauuaguagcucuacaccuaccaucauuucuaucuuaaaaauuccaauaugacuaaaacuucaacaaaauaccugcaaaguuacauauucauaaucucucacucacacaauuaacuuaauccaaaauaguuauuguuuuaaaauaaaugugauacugggguaaaugacagggcuaaaagaugaacacuaagaauuaaguucaucaaucagcguuucaguucaauuacugaaguggacaugucaagcagggucagcugagccaggagcgacaagcagggcaguguaaaugggaaccccacuccuaagcauauggcuggggguagcagggcaggcagaaggaaaaagauggagaagcccacucaccucuuugcucuccccaaguggacuaaagacccuggcuucacauguuaaaugauucacacuucuuguacaccucugacaucacugcauuauaucucucuguuaccauggguuauuuacucguugaguuccagugcuuuugaucuucucuuuuucucuuuuuaaaaaaaacuuuauaagagucccggaauuaacuauauagucagcugaaaauaaacugucuaaaccaacaccaauccaauaaugguuacaaaaucacauuauauccagcagaugauaaaagcuuaguucucuuaauuccaucugguggaucccuugcaacuuaaaaaaaaaagguuggauagacacuauuaaaaaucggguuguuguuuuuuuuuuuuuuuccugguugaguuuauuuuacagccaguuuuuccagaaagguauuuaacagcugauauaaacuugacaugcaacuacuucaacccagucuuagaaaauuaguuaauaaaugccaagaacagacaaggucuucuggaauagacagaugaguaagccagagucaugcucucaagacaccuaaaagcuaguaggggcagauaaaacacgcacacaacuugcaagaacccaaggcagcaagauguguguguaaacaugccacaacauacacaauaaaguucccaaaaaaggagaaagagaaagcuaggcucaagaucaaagaacugcaccagcauacaauccaauaaaccauuaaaauccauuagugaauuaaauaagucaaaagaguaagacacaaugaaugcuaauaaaacuuaguaaggcacagaaguccagauucuaauucugguucugcugaaacuagcuucuagcucugugauauuaaaccacuauuccuuacaaaccuccucuaccuguuuaacgugcuguugugaggauuaaaucggcucccagaaucuucacuucccaguaacuuuaucucccagauucccucccauaucagaaucuccucauaggcaguuaguuauucaacuucuuccugaguacuuccaguaaggggaacuucauuauuucucaauagcgauuacuacaucugggacagcacugauucuuacaaauguucuugcuuagugaaaccaagaucagucucucagaaaguucuauccuacggucuuacacagaaaaacaacagaaaauuggaaaagccuaagaaaguaacauguaacgaaaacaugaaacacgaaaacaaugcaccggugugagagcucaccagcacuugggaggccaaggccggagaagcgcuugagcccaggaguuugagacuagacucggcaacauagugagaccuccucucucaaaaaaaaaaaaaauaaacaaaaauuagccgggcgugucagcacacgcaugcagucccagccacucaggaggcugaggugggaggaucaauuagagguugcagugagccaagacggggccacugcacuccagccugggcgacagagcgagacccugucucaacaaagaaaaaggaaaaaggaaaggaagggagaaaggaaaggaaaaaggaaaggaaaggagaaaugaaaggaauggaaaggaaaaaggagaaaggagaggaaaggaaaaaggagaaaggagaggaaaggaaaggaaaggaaagggucagauaaaucacccuuaaccaagaaauuuuagggaagucuucacagagaguagguaucugcugguucuccaaggugggaagaguugauccguggcuucaaacuccaggucuuuuuuuuuuuuucuuugaaaaggucuuguguuagggaggaacuggcaagagagcacaaagccugucccaaagggcucuugaagcacauucuuuuuugcagaugagcauaucccuuuagcauaugagcaagaaagcgguggcuaaaaagccuggaggugagcuggagccagaucagaagaaaccugaacaucacucuccuaaaaaggcuggacugaaauuaguggaggcaacucaccgacgacuucugacaagauggcagaauucaauguucgggaagauuaguuacguggagaugggcuggauguggccugggugggaguggggguuugagugccacacuggccgggauucagggagcagauacuggaaaugacgacaaagcccacgacugggagaagggagaaauguuaaaacgcugccaagugacuaaggacuaauucuauuaacagauuaaaaaguugauuucuaguaucuauucagggaaggacaaaauacaggauucuguuuuacuuauaaauguaguuuuggcaucccacaucgcugcagcacgcuguacugccggagacuaauuccucugcguuccuaaaggcuacuuccugcuagccaaagcacauuuuuaaaaagugagagucaugguucauaauccauauuuggcaaaaagcacaggcagugccaaguugaauuuggguaagcaguuuggcauaagcuauuucaacaaugaaauggccgaugugaugauccucagggaauacaaaaagccuccuagcagccuucuguuaaaaacuuuuugguagggaugagucuuucuagcuacucuaagacacaucugaucaauaaaacgcccaucccggagcagcaucuuggcccuccggagaucaacguuuauagcgggcuccucuuggacucucccucucccuuucccuaaaggagcgggcaagaccaggccucaccggaaaacagcgcagccgaccgcccuccaccccgggagcaggggccgggcuccccucccccagccgaggccggcggagugcggcgcuuucaaaggccuggagccugguacucggcgcagccggcccugcagccucgcucgccccaucccggcccgcucaccucgacccgggccggcucggggcccugcacagccacaggcugcggcugcagcugcugggccggcgccggcgguucuuuguuccgguggcuaaggucuucaucugggccggcccggaccgcagccggggcccacagcagcggaaccagaaagagcagaagcagccggggcgccgaugcgcggccguucccuggagccgcggccgccaucccgccugccgggccggccgcgcacgggcgccgcaagaggaagugccggcgacgggaagccucgaccccgaacagccuccgcggcgcguccucacgacucgccgccgccgccgcuuagggagcagucagcaccauccgggaggugcaagcagcgggagugaggugaggggcaggccgaaguccgcagccccggcucggcgcccguccucuccggcggcggcuaaacuggagucagccagcugccucggcgcggcccagccccgacuc

SEQ ID NO: 191479 - RNA, 49182 nt, Homo sapiens
gggauagcuuuacggcuucugggagcugcugcuucgcugugagaaguauccgcgacgagcuauccgggaaagggccgaaugcgaucaaaccuaauccgcgagacuugcuaagugagucgcggcagggcgcgguguccggcgggggucugugugaaggaggcgaagugccgcuaggccugagccugcuuccacauacauuugcucagcuucaggaccacugccugaccucggauuugauacaucggggucuggcgugcugguguggugcagacuaacccugaccuguguguacacuccugcgucacuagccuccgccccuccauucaaauggaaauaagugugcuccgcgcucagcuacccccuagagugguuucgaagagcaaugaagaaauguuuaggaagcuguaaauugcauuguuacucguugcauaccguaaauuuagaagccggggaauugggaaaauaaaguuucuagauuauuuauccauuuuuaaaacagccaguggccuagagagaggccccauagcaauugaauuugcugacacucuuaagaucuuuguugacuaaauagcagcuucuacaguuguagcaaguaaauuuauuccuuuuacauguaaaaucugcuuaccagaguuugcuuuuuuuuuuccuuuuuuuuuuuuuuuuuuuuuuugagacggagucucgcucugucgcccaggccggacugcggacugcaguggcgcaaucucggcucacugcaagcuccgcuucccggguugacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuuuuuuuccuuuuuaaggucucaaacauuugggcauuaauaaguuuaguauucucuacugcagagaauguuauuugugauucaaugaaugaaaaugaaaaccugagacaagaagaauggauuuuaccuuaaaugucuguagcaaccauugggaaaauggaaagaaacaucuuaauuaucguauagauguguagguacccuucugcgcuaccuguauguugcgaaaugaacucauuccucauaauuuaagcgccugcugcagaaagccucccuuauauuuacauaaugaucauuguaugucugaggaaagcuuaaaauuguaucuugugcauuaaaaagagcuaauauuuauagaaaugccuacuaaaaauaaauaauguaaguacuaaaguugccuuauauguuuaaacuguauauuuagaaaucacagcauuuucaaacuuaugggucuuggcaguuauugguucauuuuacucucuuuaggauuucuuuuuccuaauugauguuaauuaguugauauaaaugaaaauuuugagucaggaaaucaauucaaauaggugugaauaaauuaaaaaaaaaaaaagaaagaaaagaaaacuugacucggccgggcgcgguggcuccgccuguaauccuaacauuuugggaggccaagguagguggaucacuuaggucaggaguucaaaaccaaccuggccaacauggagaaacccugugucuacuuaaaaaaaaauaacaaaaacaaaaauuaguuggacaugguagcgcgcacuuguaaucccagcuacucgggagcuugaggugggagaaucgcuugaaucugggaggcagagguugcagugagccgagaucacgccauugcauuccagccuggggaacagagcgagacugucacaaaaacaaacaaaaacuuuacugaagcaggcuacuugguaagucuuaauugcuuuaaaauauggaaaacagaguucagagagggaaaaaaauaacuuucaccuuuaaggaaacacugugaauuuuuuuuaccguugaucccgaguguuucuuucuugaaauacuguuucgaaucuuuuaauauaaucugcauuaagaaacccagagaacauugcauugauauacugcuuuauugaguuguaauauuauauuuucagucuaagugaacuuauuggcaauuuaaaaauaaacuauacaguaugaagaguuuacuucuugacaauuauacaaguaugacuucuguaaaauauuaauaguauaguaauaaacacuguuuuuauauauaguugucuagaacugaaugaauaggaauaggguuuuuugcuuucuucugucaaagauugauuuugcuuucaucugaguuuagcuccuacuggaauuuaaaagcaaaguuuauuuacauuagucauuuuauuuuaucuuuauuucauuuacuuauuuauuuugagauggggucuugcccugucacccaggcuggagugcaguggugccgucuuggcucacugcaaccucugccuccuggguucaagugauucgccugccucacccuccagaguagcugggauuacagguguaugccaccuugcccggcuaauuuuuguauuuuuaguagagacaggguuucaccauguuggccaggcugaucuugaacuccugaccucaagugauccacccaccucggccucccgaagugcugggauuacaggugugagccaccgcacccggccacauuaguaauuuuaaagucaccauacaagauuuugacuacucuaucuuaacaaaucuguaacaguuacugaaggaaaguaaaaaaaaauuaagugugggguccuuuaaauuugauuuuauugauuaauuuuuuauauauuucauauuuacauugugguccguugagagagaagucuccauuuuuaccugcuucauuuucaucuguguauaccacugcccucccaaauuuuuuugaugcucugacccagcauagguugauguaucaaguuaauuuucaaccucauuguccucaguaaaguuaccauaauuucauaaguucagagauucuucauuuauauaucuuugauauaauuauuuuugugagauauuauuguagagaaguuuuucccugucccuccaccgagcucucuaaaacucccucucccccuaacacuucuguauauacacaggguucugugcuacaaauugauguuuagauaaacuucagugaaaugacucuucaggaauuggugcauaaggcugccuccuguuauauggacagaguagcuguauguuuugaugaaugcaacaaccagcuuccaguuuacuacaccuacaagacugugguuaaugcugcuucugaauuaucaaauuuucugcuguuacacugugacuuucaaggaauucgggaaauuggucucuacugccaaccugggauagacuuacccucuuggauuuuaggguaauauuuuuuagaacuguaaauuugauguuacuccaagcuaauguaaauuuuuaauagaguauauugcaaguuauuguucuguuuacuauuggacuuuucuauauuguuuggucaauuguagagagacuaaagaaguuugcauuuccccaguauuauuuuuauauuauuuaaauuaauuauucugagcuuauuuaggaaagacuagaagcuuucacuaauagaacguauaaguaucuccaaaauguaagggcuucauuaaucuguuaaaggaaaacaauuauaacaauuuauaacacuuuguuguuagauaaaagaaaacaggauuucacagauaacaugacuauguuuuuuguccgcaacugaaauuugaggcacuaagguauucaauaaaucaguaaauuagaguuuuggauaauaguugauauagauugaaauaugaacccauuagaagacacuauuccaacaaauauuugcaaaauguucaaucauuuaaauuguucuagaauguuauccucauauagugauuucuauucuagaacucugcaguaaguauaaacugccaaagaaauaguuuauucauucuauaauaugugucuuaguaaauuaauuauauaaauauaaagcaaaagauguucaaaaauuuacuuuuggccaggcacaguggcucacaccuguaaaucccagcacuuugagaggcugaggcuggaguauuauuuaaggccaggaguucgagaccacccuggugacuucacaagaccccaucucuauaaaacaaauaaaaacaacaacaaaaauuuacuuucacucaauuauugacgaaauuuauugagaauuuacuaugugcaaagaucuaguguccuuaaaguauaccugaaacuacuuaaaaugcuuaacuuuaaaaaaaucuuguauuucucuauauuaagugauaagaauuuaacauaguaaauacucaggauuuucauuaagaaaagauaaaaugacaguguuuauguauuuauuuauuuuugagaugaaguuucacucuuauugcccaggcuggagugcaacggcgugaucucggcucaccgcaaccuccgccucccggguucaagcaauucuccugcuucaaccucccaaguagcugggauugcagacgcccggcugauuuuguauuuuuaguagagacaggguuucuccauguuggucaggcuggucuccaacucccgaccucaggugauucgcucgccucaaccucccaaagugcugggauuacaggcgugagccaccgugcccggcuaaaaugacagcguuuauuaccaacuaugugucagugaaaacauuggaaauuucugaucagcaauaaagugcuccggaaaccauuuuuaugcugcuacaaaaaauaaauaaagugcauagagaaauagaaaugcuuaaacaaauacuaaaucaacagacauucuaugcugacuguguacuuuuuucuuuagaauucuccaagucccggcugcuuauguaccuaucgagccagauucaccaccgucauuaucaacucauuuuaugaaaaaauguaaucuaaaguauauccuuguugaaaaaaaacaaauuaauguaagucuggauguuucaauuguuuuuugccuguauuacauuuauuucaauugaaacauuccuuccuucucccaucuggauuccuaagucugcuaaauguggcaagguuucucagucuuugcacuaugacauuuuuaggguugaguaauuguugugaggaguguuccguauauuauaggauauuuagcaauauauuugaccuccacucgcuagaccucaguagcaccucccagucauaacaaccaaaaaucuccagacauugccaauugucccccagaggggcucuccaccccucacacuccauugugagccacuauucuguaguaugaacagaucuguuagccuuauaauaauauauuaugcauuguuuugaauuucucuuuccaaaguauuuccuauacugcaaaauuuuauaauacuuggaacuuucauauuuauggcaauuacauuggucagcaacacugaagaauuauaacuaagcuugcauuuugaaaaagagacugguacuuagaggagaucuuuccagaaaaguaaauuuauuguuuuuuuauuuuuaaaugauugccaaccaaagauauaaccaagaaacucuguuuuuggggcaagaauugguguuauaucuucagcaagaugcagcccaugcuucauuguuuauuuauuauuuauaaaauauuguuuuacuaaaggggaagaacauuauaaaaauauauucaauuuagccuguuuuugcccauuuucuauaugagccaguuuguauugggguaacuuaaaugcauucccugcuuucaccccccccaacugugugugugugugugugugugugugugagaagugucaagaacuugagguauaugggggacuuucuagagacucaaaggguuuuuuuuuuuuugagccagagucucacucuguuacccaggcugaagugcaaugggcaguggugcgaucucagcucacugcaaccuccgccucccagguucaagcgguucuugugccucagcugcccaaguagcuggaauuacaggugcaugccaccacacccggcuaauuuuuguauauauauuuuuaaguagagacaagguuucaccauguuggccaggcuggucuugaacuucugaccucaaguguucugccugccccgaccucccaaagugcugggauuacaggcaugagccaccacaccuggucugguuaauaaauauuuuuaaaauaauuacuuauuaguguguagccgaaauuuccucuacuccucaaauugguuauugcauuguucauaaguaagcaaaacugaaauggggaugugauguuuauuuuucuuagcaaucuuagugaaaauuuuauaaaagguagcugaguaucaguauuaauugucaaugucaagguauucuuuaugaccaguaggaguuggacauagcaaaacccaaaaaggaguugggcgcagcaaaaccuugcuuccuaucccaugauuuugaugaugguguaaguguucuuccuucauuuaacacaggaacgaucaguaaguauuuuuaagcaucuacuguauguaugcccagcauccacuaaagcaguaguucucaacuggggacaauuggcaaugucuagacauauuuuuuauuguaaugauggaaguggggugcuacuggcaucugguggguagaggccagcgauacugcuaaaaauccuacaguguauaagacagcacuccacuaagaauuuucugguccaaaauaucaguaguguugaaguugagaaaccuugcacuacggacaggaugauugggagggcauuagcauauaagccuuccagcuuuuuauaauguaguuggagagaaaaguuaauacuucugaaccuauaacaucuacauagugugauaauuguccuaagugaaguaaacauaaccuaguagauauaguagaauuuuaauggggagggaugguuuugagcuagaucugaagcguauguaguucuuuaauuuuucaaauauuacaggccacaccacauccccuacccaauacauacacacauuaaacacacaaagaaaacacuguaggcuucuggguugugaccuuuuucucauuauuuauguugauuuauuuaaugugaaaacuuagguuauauuucauuaagcuguuguugucaaccuaaaaagauauauucaaagaaaccuuacuuucaacauguacaaauucaguuuagcaucucuucauccaaacucacuucuggauuaauucuucuccauccaccaaaucaccugggccagaaacccaacaauuuucuuagacucacucuauauccagaaagucaccaugucuuauuuauucuuugcucauagacccuuucuaaccacuccucuuguaacagaauaguaguucaggaccauauaguauauccgaauuacugcaaaagacucauuaaaugguucucacuuagcagaaucucauuuauuauucuguccuugauagagucuaaucuaugcuauugccaccuucaauuggauccugucacuuacagguuaagaucuaaacuccuuagugcugaguguacacgguuauuaaggauuugcaucucaucuccuaucaacaacgcaccucaccuuuucccucucccccaccccguucuuuaccuuaauuggaaggcuuaauguucacauaccagcuuucccaggucagauccucaauguuggcuguuugccugaagugcccauuuuuauuauuuggagaauagcuacuuauaacaaauauuacccaugaagcaaucucugaccuucuaggcagaguucggcauucucuguucccauuaacauuucaagccugcuuuauuaucauacgcauugcauuauaauugcuuguauaugucugguguuuuugaaaauaaguuaguaaggacagcacuuugcucuuggagauuuauuuaucuuuuuacccccggguauacagcaaguacuuccccccacuccccaaaaacgucauguugaaugaguaaaugaauacaguuggcccucuguauccagagguuuccuauccgaggauucauccaacugcagacugaaaauauuuggggcccacgccuauaaucccagcacuuuaggagacugaggcaggagaucauuugaggccaggaguuugagaccagauuggguaacauagugagacaucgucucugcuaaaaauaaaaagcuagcuggguguuuuggugcacaccuguaguuccagcuacucaagaggcugaggugggaagaucgcuugagcccagcuguucgagguugcagucaguuaagauuacacugcuguggucaggcgugguggcucaugccuguaaucccagcacuuugggaggcugaagcuggcggaucaugaggucaagagaucaagaccauccuggcuaacacggugaaaccccgucucugcuaaaaaaaauacaaaaacauuagccgggcgugguggcaggugccuguagucccagcuacucgggaggcugaggcaggagaauggugugaaccugggaggcggaauuugcagugagcugagauugcgccacugcacuccagccuggaugacagagugagacuccgucucaaaaaaaaaaaauaaauaaaaaaauaaagauuauaccacugcacuccagccugggcaacagagugagacccugucucaagaaaaaaaaaaagaaaauauucagaaaaaaaaaaaaacccagugcaacaguaaaaacuaauacagauuuaaaaauauagcaacuauuuacauagcauuaauuagcauaguuuuguauuaguuauaaguaaucuagagaucauuuaaaguauaugggaggaugugcaugguuuauaugcaaauacagcaccauuuuauauaagggacuugagcaucuucagauuuugguaucugagaugauccuagaaccaauucccccaaggauacugagggaugacuguauuucauauuacuucuauauaaagaagaauaucuuuuaacauacuaauacuguaaacuuugucccccauuucacacagaaauuuaaaucuuuucaugaaacauuauugaacuaugauacauuuacaguggaacauaaugaccuagugcucuucagacuucacuggaaaaauacugaggugaacuugaugcuaaaugauggaaaagagaaauaugaaaaagaaaaaauaaaaagcauaaguucugagcaugucaaugaagaaaaagcagaagaacacauggaucugaggcuaaagcauugcuuagccuauguucuacauacaucagggacuacagggauaccgaagauugucagagugccucauaaguguauaguaccaaauauccagcauuuucgguaaguucuagucuuugacucuuucucagaaucuauauuuuaggccaggugugguggcuuaugccuguaaucccagcacuuugggaggcugaggcggguggaucacuugaggucaggaguucaagaucagccuggccaacauggugaaagcugucucuacugaaaaaauacaaaaaucagccaggcguguuggugggugccuguaauaccagguacuggagaggcugaggcaggagaauugcuugaacccaggagguggagguugcagugagcugagacuaugccacugcacuccagccugagugacagagugagacugucucaaaaacaaaacaaaacaaaaaaccuuguauuuuaaagggaaaaaaauaauuuuaaaacguuugguuuuauaacucuuguuccuaaauuaauaguccuaagaaguaaauugagucuuuuuuguuucagcuguaucugaacuuuaguucucugcagacuaggcccuucaccuguuucauccaagccuagggccagacacggaacaaacaaaugauaugauuagaagcuuugcaucuuaauuauuaauaaaaagggagaaaggauuuuccuagcagagguacuagcagaguuauaugagaaugaaggaguuuguccuacuagaaugucagagcagggcugaggaaacagugaaagaucaggagccugguaugcccuguugaaggcugaacuuaauccaguagaugauggggaaccauuaaaagauucucauuuuguuaaguucacucuuguaguaguauuguggaguuugacuugcugauguggucaagagauuagaaaucuccaaaguugacauucuuaauuugccaagaaagagaggaagaagugaaccuuagggguguaguccuagaaaaucaaaggaggaaacagaaauagaaaccucaugaaacauguacguaauuuuaugucauuuuaaguuuuauguaauuuuaaaugcuuaaguaauauucaaaaguaaaauggaaugaaugaaaagggaagaaaaaagaaucaagugaaguuaauuuuauuuuauuuuauuuauuuauuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucacuguuuuagccgggauggucucgaucuccugaccucgugauccgcccgccucggccucccaaagugcugggauuacaggcgugagccaccgugcccggcaaaguuaauuuuaacaauauauuuuauuuaauuuaguauacuccaaaacauuacuucaauauguaaucaauauaaaaauuacuaguaagauauuuugcauuuuuuaugcuaaucaucuucaaaaucuggcauauauuuuauacuuacacaucucaacguggacuagccauauucuuagugcucaguggaccuaugguauuggauggcacaugcaggccuggaaagaagaaaugguuaaaugcugguagagaaagaugucuguuguaaucgacaauauagucuuuagugacuucuuaauccccaagauuggagauagauuacauuaggcuggagauaagagaauaggagauaacgaaauagagguaacaaaagucaaauguuauuuucuagaaacugguuuuaauggaaaagaaggaauucugggauggacacagguguuuugucuuuaagaugggagagguuggcugggugcaguggcucaugccuguaaucccacacuuuaggaggcuaaggcaggaggaucgcuugagcccaggaguucaaaaccagccuggguaacauagugggacucugucuuuaagaaacauuaaaaauaauuagcugggccugguggucugugccuauaauccuagcaacucgggagguugaagcggaaggauugauuuagcccaggaggucaaggcugcagugauccguuauugcaccacugcauuccagccugggugacagagcgagacucaaucuuaaaaaaaaaaaaaaaaaaaaaagaugagcgguuuagaggcugaggguggggaauugguagaagggguugguuuaaauaaugaauuaguaguaggaguauuaacaaaggaguaagauacauuuagaugggaggaagauacauuuagaugggagggaauggcauuauuuaaaauacugaguggaauaccucuuuuuuugauagccucaaaaagauuaggauaguaaaguaaauacauuucuugguguuagaggaagccaguagguuuuaacuuuuguaugaagcagaaggccaagucauaccuaagagugugggaggugagguggggauggggauguagggaacuugaagaaaaugaagcagauaaggaaucugggggagguggagagacagccgacuaagaggcacuggcccagcagugguaagaaugguccgugaaaugggagcaaacauuugcuuaaugaggggugaaggguugauuuaugacuaaauuauacaaauuucuugauaccuauuuugugcuucaacuucauucaauugauuugccuguuagaaaucuuuuuuugguuugcuuuuagguucuuaagugaggugguaaauaauuagauucuaaagagaugaaauguuaaaguagucaauuuaaaaauuaaaacaguaauguuaaauuuucuauuuuagacuuagaucacuaagcuagggaguauuaaauuucagacacauauuagaacaaucuuaucucuguugcuggcuccccaaauauuaccagaauaaccuauuaauaagauagugcuagcugggcaugguggcacaagucuguagucuuagcuacuccaguggccaaagcaggaagauugcugagccuaggaguuugaggcugcagugaacugugauugaacuugggcagcugcaagacccugcacuccagcuugggugacagagcgagacucugucuuaaaaaaaaaaaagacaaagcugaguuuucuugcauauguugguaaaaggcagcacuaccuccagagagaaugauagcuccagaaagggaaggacuagguuuccuuuauugaaauuuugaaaucuaauuuagauagaucuuucaaaucaggggauuaauuuaaaggcuuggauaaggauaacaauuuuuuaaacaguuaaaaauuaguugauuuguuugacuuugcauaagguacuuaaccuccaugaacuucaguuuucuccauuuuaaaauggggguggagagcuuuuccucuaccaucugugacgcaguaucuaggggacugagaauuaaacugacaaaagacagauuaagaaaaaaaguuuauuccugugcauauagcaguuuacaaaagaaacggaauugcauuuuauuaaguucauuuaaauguauuuguaaauuuauuuguucauaggaagaacaaauaaauuguuuuggaaagagaaauggguuuucaggaaaauaaacaggagauaagaaaguuugugauaacacuuggguaugcaggugcaguggucuuucugucuucuucauggccuuccugggaguaaaaccacucugaagaagaaguuuauggcagccucauuucccugaaguuucugcuuucagucagauaagggaagcuccaagaagguuucugcauuuguugaaucucaaauguccuuuuuuuuuuuuuuuuuuuuucugagacagagucucacucugucacccaggcuggaaugcagcagugcagucucugcucacugcaacuucugccucccagguucaagcuauucuucugccucagccucccacuauaggugcacgccacuaugccuggcuaauuuuuguaguuuuaguagagacaggguuucaccaucuuggccaggcuggucucaaacuccugaccucaaguaucugcccaccuuggccucccaaagugcugggauuacaagcgugagccaccgcgcccagccucaaaugucuuuaccuuaaaauaaucuucauaccaacuugguuucugaguuagguucucacauaaucauaccugccucauauggugguugggaaaaugaggaacaguauauuagauacccagccuaagcuucacaaguaauauguuuaaauguuuguugcauuccacuuuuuuucuuccuuuaaaaucugucucuucuuuuuuuucaacuuuucuuauauugaaugcaucuuaagcugcuuucgugaaaugaacuacauggaacuacaugaacuguaugcaugcauaaccuugcccauuuuuguucauagaauugaaaacuaaaaauauucucagaauuuaagcuuuguuggaagccuguuagaaaguuugcucuccccugaauaccuaaguaggaagcuagacaauauaugugaagaauacuuccucuaaaacuugaaguuugaggguagccuuuguugggcucagaaaaugauaccccaacguauggcacuuuggcaugcugaguacuuugaacugaaggacauuggaaggacuucagaaguaaagucucuuucugaccuuuuccugcccuucuuucucuugcuucucuuucuccccaaggcaggccauaguaacugaaccccucucccucaaagacagucauaaaaccuagaggccaggcgcgguggcucacaccuguaaucccagcacuuugggaggcugagguggguggaucauuugaggucaggaguucgagaccggccugaucaacaugguugaaacccagucucuacuaaaaacucaaaaaaauuagccagguuugguggugcaugccuguaaucccagcuacucgggaagcugaggcaggagaaucgcucgaacuugggaggcagagguugcagugagccgagaucaugccacugcacuccaccuugugugacagagcaagacuuuucucaaaaaacaaaaacaaaaaaacuagaaauauagaaauauuacucuaaccuuaauauguaagagcuggcuguaaagaaauugcucuuacuuaccuugucugaaaguagaacauaagacucauuccagaaaggguccugcccuauacgugggaggaagaaaugccacacagagaggccaggaauuuaaaaggacaggccuugcuggauuuucccacucaguuuauuacucauucccuuuuuguugaaucacauuucuacacagcuguccacucuauugaaucuaagcauuaaaauggacacuuuucccuugggucuuugggucuucauucugaagccucccauguuucauaaaacuuugauuaaauaaauuugucaugcuuuucuguuguuaaacugucuuuuguuuauaagagugugggcugugagccuuaugauggggaggaaagguaucacagccuuucggccccuacaccuuuaacacacaaugaguuuuuauuuuaccugagacaccauauacauaguuauaauuuuuaaaauguuuauaccauauuugaagcuuuuuugaaauuaagaugcuuuuagauguaguggugucuguguguucaaauuaaaauagugucauaggcuccacaaugacuauccaugcuguauaagagccuaaccacauauauucuuauucugcuuuuuguucagauacugaaagaaaaugcuaaauagaaaggggagucggaagucucuauuaaacaucauugaauaaguaugacagaauaaggauucugccagaggagcagaaccaggaguuagaucagggauugauuauaagaaauugguuuacacaauuguggggccuggcuaagcaagucuaaaguccauagggaucaguuaggaaggggugaucacaagcaggcuggaaucccguggccaugagacugucccaggugaaaucagauugggaagaagggagauuaauugcagacccagcugcuguuugggccucuucaucagagaaggccuaaaacuucuucuaaaggccuuccaaguaaauccagccaacccuggauaaucucccuuuugauuaaguaaaucagcugauuagggacuacaggguuugauugaauaacugcuugaagaaggcgugugugcugcuaagcagcagccucccuucuguucuucagcucucaagagaauaucccuugucuccuucccuaacaggaaacauacuagagaggaaauuccggggacaguaguucaaucaaaccaaguugacacaucaaaagucaucacagaugauaaaauaugucugguaaaacguggauauugcuuuaaauagcuguuaauucuuuuauaaagaagauuuccugaauuuugauagcaccauuuuggcuaauuuaagagagaagaauaaaaucuggccaacauucagaaacuugaucaucauaaacacaugaacacucuuuuaggauaugugcuuacugaauguuugacguuucucauaacugcauucuguuuugccuuaggguacuuuuugacaucacacaagaagauguuuuguuucuggcuucaccucugaccuucgauccuucuguuguggaaauauuucuugcucuaucaaguggugccucucugcuuauuguaccaacuuccgucaaguugcucccaucaaaauuagccagcguucucuuuucccaucauagagugacuguuuugcagguacauuuuaguagcaaugaacguuuuguuuaucauuuuucaauauuuuaaguguuuuagagaauauuuuguauuccuguaguucuuuacaauggauuaauauaaucugguuagauuaucaagggccgucuccucaggaugugacuuuuuuuguuguuuauuugaaaaugaaaaaagauaaaugaauucugccuagaaaauucuuuuauuauguauuuugugcauacuauaauaauuagaggaccuugacuuugacucagauuuguuggauuugagaaggauaggcugccucuucugucuuaaaaucuauguauguuguguuucucaugaaaaacuaguauaagucaauuaaauuauaaucgaguuaggaauauagauuuucuuauuuuuacaucaguguacuuuacauuaaccuacagaaacaaguauuuuugaaauuuggccuuuuaaaauguuauuuaaauguguaucugacuggugauuaggucaugcagguacacaaguauaugacugguacacaagccuugaguuacuacauuguaaguagcuaacaguacuagagaauuagcaauauuauaugcauaucauaauauguagauaucuuaguuaaauguuuaacugcugugagccucagguuuuaucuguaaauggaaauaauacccaucucaaauagaauuaaaugagacaguguagcauaguuccugauugugugugugaguccauucaggcugcuguaacaaaauaccauaaacuggguagcuuauaaacaacagacauuuauuucuuauaguucuggaggugggaaguccaagauuaagucaucaggagauuugaucucucacgaggggcccacucgcugauucauuagacugcggucuuuucauuggguccucacuugauggaaaggguuuuauaagggcacuaaucucauucaugaggucucugccugcaugaccuaaucacuucacaaaggcccuaccuccuaauaccauugccuugagaguuagaauuucuuuucuuuucuuuuguuuuuucuuuucuuuucuuucuuucuuucucucucucucucugucccucucucucucucucuuucuuuugacagagucuugcuguguugcccaggcugcagugaaguggcgugaucuuggcucacucugccuccuggguuccggcgauucuugugccucagucuccugaguagcugggauuacaggcacccgccaccacaccaggcuaauuuuuguauuuuugguagagacaggguuucaccauguuggcuaggccagucucacuccuggccucaagggauccuucugccucagccuccaaaguucugggauuacaggcgugaaccacuguaccuggccugagaguuaggauuucaacauacaaauuugagggggagacacaaacauucagaccauaguguguuauauucguauaccugugugcauaugugcaucuuaauuauuaguuuccauugucuguuuuuuuuuuuuuuuuuuuaauugagacagagucucacucuucucgcccagccuggaguacagugguaugaccucggcucacugcaaugucugucucccgggcucaagagauucuugugccuuggccuccugaguagcugggauuacaggcguguaccaccacgcccagcuaauuuuuguauuuuuaauagagacagcauuuugugaugauggccaggcuggucuugaacuccuggccuccuggucucaaacuccucaaucugcccgccuuggacucccaaaguccugggauuucaggugugagccaccacgcccaccuuccacuuucuauuuugauaaacuaaaauuaucagauuuuuauccaggguaacgagaauugagaggauauuaaacuucugcuauaaaaacaaaauuugauacuuugaacuucuuuaaggcaauguguuuuucauccuaauucauguauauauaugaaccgaguguagcaguguggcuuguugggugugaggggauauaaauucucaucuguuagagagucauuccaugaauucuguggaucuagauaagauuuuacuauaacuguuuuauuuaccuguaaaauucaaagagcauauuucucacggaauguuugcaaaguuccuugauagauuugauucauaguuacuaaaagggaaggagacuuuccuucuaugucaggucaaugaauucuaccucuuuaaaucucauccccuuguuugauguuuuagcacaaucucagauaaauuuacuuuagcaguuguuuuuaaccuuuuugggaucaaauuuuucugagaaacugauagaaacuuacucuuuuccaagaacaugacaaauauugcauauaguuucauggugauuuuauuuaucucacaauaguuauugggaaugucaucagcagaucacauuugacuugguuugaguaaggaggagagguauagaagcugacaggcuguccuuuccuuugugugaggcacgugccuuuucuuauucugaauuuuagcuguguugucaggguucaucuuuucuuuuucuuuuuuuuuugggagggaguuuauauuuacauuuguuuuuuuuuuuaauuuaaguuuuaggguacauguguacaacgugcagguuuguuacauauguauacaugugccauccauguuggugugcugcacccaucaacucaucauuuagcauuagguaucucuccuaaugcuaucccuccccccuccccccaccccacaaaaguccccagugugugguguuccccuuccuguguccauguguucucacuguucaauucccacccaugagugagaacaugcgguguuugguuuuuuguccuugcaauaguuugcugagaaugaugguuuccagcuucauccaugucccuacaaaggacaugaacucaucauuuuuuauggcugcauaguauuccaugguguauaugugccacauuuucuuaauccagucuaucauuguuggacauuuggguugcuuccaagucuuugcuauugugaauagugccgcaauaaacauaugugcgcaugugucuuuauagcagcaugauuuauaauccuuuggguauauacccaguaaugggauggcugggucaaauggaauuucuaguucuagaucccugaggaaucgccacacugacuuccacaaugguuaaacuaguuuacagucccaccaacaguguaaaaguguuccuauuucuccacauccucuccagcaccuguuguuuccugacuuuuuaaugaucgccauucuaacuagugagagaugguaucucauugugguuuugauuugcauuucucugauggccagugaugaugagcauuuuuucauguguuuuuuggcugcauaaaugucuucuuuugagaagugucuguucauauccuucgcccacuuguugaugggguuuuuuguuuuuuucuuguaaauuuguuugaguucauuguagauucuggauauuagcccuuugucagaugaguagguugcagaaaucuucucccauucuguagguugccuguucacucugaugguaguuucuuuugcugugcagaagcucuuuaguuuaaugagaucccauuugucaauuuuggcuuuuguugucauugcuuuugguguuuuagacaugaaguccuugcccaugccuaugugcugaaugguauugccuagguuuucuucuaggguuuuuaugguuuuaggucuaacauguaagucuuuaauccaucuugaauuaauuuuuguauaagguguaaggaagggauccaguuucagcuuucuacauauggcuagccagucuucccagcaccauuuauuaaauagggaauccuuuccccauugcuuguuuuucucagguuugucaaagaucagauaguuguagauauguggcauuauuucugagggcucuguucuguuccauugaucuauaucucuguuuugguaccaguaccaugcuguuuugguuacuguagccuugucauauaguuugaagucagguagcaugaugccuccagcuuuguucuuuuggcuuaggauugacuuggcaaugcaggcucuuuuuugguuccauaugaacuuuaaaguaguuuuuuccaauucugugaagaaagucauugguagcuugauggggauggcauugaaucuauaaauuaccuugggcaguauggccauugucacgauauugauucuuccuacccaugagcauggaauguucuuccauuuguuuguauccucuuuuauuucauugagcagugguuuguaguucuccuugaagaguuccuucacgucccuuguaaguuggauucuuagguauuuuauucucuuugaagcaauugugaaugggaguucacucaugauuuggcuguuugucuguuauugguguauaagaaugcuugugauuuuuguacauugauuuuguauccugagacuuugcugaaguugcuuaucagcuuaaggagauuuugggcugagacgaugggguuuucuggauauacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuuguccauucaguaugauauuggcuguggguuugucauagauagcucuuauuauuuugagauacgucccaucaauaccuaauuuauugagaguuuuuagcaugaaggguuguugaauuuugucaaaggccuuuucugcaucuauugagauaaucaugugguuuuugucuuugguucuguuuauaugcuggauuauguuuauugauuugcauauauugaaccaggcuugcauccuagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugccaggcuuugcuaucaggaugaugcuggccucauaaaaugaauuagggaggauucccucuuuuucuguugauuggaauaguuugagaaggaaugguaccagcuccuccuuguaccucugguagaauucggcugugaaucaaccugguccuggacuuuuuuugguucguaggcuauuaauuauugccucaauuucagagccuguuauuggucuauacagagauucaacuucuuccugguuuagucuugggaggguguauguguugaggaacuuauccauuucuuccagauuuucuaguuuauuugcauagagguguuuauaguauucugugaugguaguuuguauuucugugggaucgguggugauauccccuuugucauuuuuuauugcaucuauuugauucuucucucuuuucuucuuuauuagucuugcuagcagucuaucaauuuuguugaucuuuucaaaaaaccagcuccuggauucauugauuuuuugaagggauuuuugugucucuauuuccuucaguucugcucugaucuuaguuauuucuugccuucugcuagcuuuugaauguguuugcucuugcuucucuaguucuuuuaauuaagauguuagguugucaauuuuagaucuuuccugcuuucucuugugggcauuuagugcuauaaauuucccucuacacacugcuuugaaugcgucccagagauucugguauguugugucuuuguucucguugguuucaaagaacaucuugauuucugccuucauuucauuauguacccaguagucauucaggagcagguuguucaguuuccauguaguugagcgguuuugagugaguuucuuaauccugaguucuaguuugauugcacuguggucugagagacaguuuguuauaauuucuguucuuuuacauuugcugaggagugcuuuacuuccaacuauuuggucaguuuuggaauaggugugguguggugcugagaagaauguauauucuguugauuugggguagagaguucuguagaugucuguuagguccgcuuggugcagagcugaguucaauuccuggauauccuuguuaacuuucugucucggugaucugucuaauguuggcaguggggugugaaagucucccauuauuauugugugggagucuaagucucuuuguaggucucuaaggacuugcuuuaugaaucugggugcuccuguauugggugcauauauauuuaggauaguuagcucuucuuguugaauugaucccuuuagcauuauguaauggccuucuuugucucuuuugaucuuuguugguuuaaagucuauuuuauccgagacuaggauugcaaccccugccuuuuuuuguuuuccauuugcuugguagaucuuccuccauccuuuuauuuugagccuaugugugucucugcacgugagaugaguuuccugaauacagcacacugaugggucuugacucuuuauccaauuugccagucugugucuuuuaacuggagcauuuagcccauuuacauuucagguuaauauuguuaugugugaauuugauccugucauuaugauguuagcugguuauuuugcucauuaguugaugcaguuucuuccuaggcuugauggucuuuacaauuuggcaugauuuugcaguggcugguacugguuguuccuuuccauguuuagugauuccuucaagagcucuuuuagggcaggccugguggugacaaaaucucucagcauuugcuuaucuguaaaguauuuuauuucuccuucacuuaugaagcuuaguuuggcuggauaugaaauucuggguugaaaauucuuuucuuuaagaauguugaauauuggcucccacucucuucuggcuuguagaguuucugccgagugaucagcuguuagucugaugggcuucccuuuguggguaacccgaccuuucucucuggcugcccuuaacauuuuuuccuuaauuucaacuucggugaaucugacaauuuugugucuuggaguugcucuucuugaagaguaucuuugugguguucucuguauuuccugaaugugaauguuggccugccuuacuagauuggggaaguucuccuugauaauauccugcagaguguuuuccaacuugguuccauucucccugucacuuucagguacaccaaucagacguagauuuggucuugucacauagucgcauauuucuuggaggcuuuguucauuucuuuuuauucuuuucucucuaaacuucccuucucacuucauuucauucauuucgucuuccaucacugauacccuuucuuccaguugaucccauuggcuacugaggcuugugcauucaucauguaguucucgugccaugguuuucagcucagauccuuuaaggacuucucugcauugguuauucuaguuagccauuugucuaauuuuuuuucaagguuuuuaacuucuuugccauugguucgaacuuccuccuuuagcucagaguaguuugaucuucuggagccuucuucucucaacuugucaaagucauucucuguccagcuuuguuccauugcuggugaggagcugcguuccuuuggaggaggagaggagcucugauuuuuagaguuucccguuuuucugcucuguuuuuuucccaucuuugugguuuuaucuaccuuuggucuuugaugauggugacguacagauggguuucugguguggauguccuuucuguuuguuaguuuuccuuccaacagucaggacccccagcugcaggucuguuagaguuugcuggagguccacuccagacccuguuugccuggguaucagcagcgguggcugcagaacagcggauauuggugaacugcaaaugcugcugccugaucguucuucuggaaguuuugucucagaggaguacccagccgugugaagugucaguccgccccuacugggggugccucccaguuaggcuacccgggguucagggacccacuugaggaggcagucugcccguucucauaucugaagcugcaugcugggagaaccacuacucucuucaaagcugucagacagggacauuuaaguuugcagagguugcuguugccuuuuguuugucugugcccugcccccagagguggagccuacagaggcaggcaggccuccuugagcugugcugggcuccacccaguuugagcuuccuggcugcuuuguuuaccuacucaagccucggcgauggugggcgccccucccccagccucgcugccgccuugcgguuugaucucagacugcugugcuagcaaugagccaggcuccgugggcauaggacccuccgagccagguguaggauauaaucuccuggugugccguuuguuaagcccauuggaaaagcgcaguauuagugugggagugacccgauuuuccaggugccgucugucaccccuuucuuugacuaggaaagggaauucccugaccccuuggcgcuucccaggugaggcgaugccuugcccugcuuuggcuuacacacggugcacugcacccacuguccggcacuccccagugagaugaaccugguaccucaguuggaaaugcagaaaucacccgucuucugcgucgcucacgcugggagcuguagacuggagcugcuccuauucggccaucuuggcuccacccccaggguucaucuuuucucuccuaaguccaguuucuuucaaaugauauauaagucaucaaggauuuuugcuuugauauaauauacacuuuuuuauuuacuaaagcgcuccuuauauagauuuuauuuacaaauaaaaaccuuacccagaccuaauuggacaugaagcagggcucuuaaaugcugucaaggccaggcacgguggcucacgccuguaaucccagcacuuugagaggccaaaguggguggaucaccugaggucaggaguucaagaccagccuggcuaacauggcaaaaccccgucucuacuaaaaauacaaaaauuagccaggcaugguggugcacaccuguaaucccagcuacucaggaggcugaggcaggggaaucucuugaauccaggagguggagguugcagugagccaagauuacaccacuguacuccagccuggacaacagagugagacuuagucuaaaacaaacaaacaaacaaagaaaaaaaaagcugucaaaacacauacuacuaaagcuuuggaaauugaaaagaauagaauaucuugaguuacuguggggggaaaaaggccuccaaagugaaauggacuaagcuuuggaggaaauuaaagaccucuuuuauuuguuucaggaauaaggaguuucuugggaaauaaaggauugauuuuugguuuaucacaaaccuaaaauauauuuggacauuuuuuauuuacauacucuugguaacaaaguuauauuauuuaaacuugaugcccuuuaaaacuuuuuuguuuugagacagggucuugcuuuguuacccaggcuggagcacaguggcgcccucacagcucacugcagccuugacuucuggggcucaagugauccucccaccucagccuccugaguagcugggaccacaggugcaugccaucaugccuggcuaauuuuuaaaaucuuuuguagagacagggucucccuguguugcccaggcuggucuugaacuccugggcucaagcaauucaucccaccucagccuccugaagugcuaggauuacaggcaugagccaccaugcauggucuaaaaguaaaacauuuuagaguaaaauauuagguugauaccuaggaaugugucagcauaauaauguuuuccauuuuuccugaguuuuuccuuaaaaaacucggaagaaauuuuaacauucccuauuuuuucuauuaucuacuaagucucauuuuuguaugucuagaaugauuuacuagcaaaggaugcugacuuguauucugccccucaauuuagcauuucaguuuaugaguaucugaaaaguauuucaauuuuuuuauuuuucauuuuuuauuuuuuugagauggaaucuuacucugucacgcaggcuggagugcaguggugugaucucagcucaccgcaaccuccaccuccuggguucaagugauucucaugccucagccucccaaguagcugggaauacaggugugugccaccacacccugcuaauuuuuguauuuuuaguagagacagaguuucacccuggcuaggcuggucucgaacuccugaccuuaagugaucugcccgccuuggcuuuccaaaguguugggauuacaggcgugagucaccacacucggccuccauuuuuuuuauuuugcugaguauucauagauguguguuuauuuauugaguucaaaguugauauuauacuuaacaccagaaguuaggccacaacauugaaauucggcuuagugaaaaugaagagccaggaccauuuuagccccuauuuugacaagagauuuucauuaugauaaacuucuuggcauaacagguaagagcaugguuuaggaugccuuauaguguugccaucauaauuuauuacuaaaaaccagaaucuuaacugggacauaaguaccuaugaggguguagagucauucuacuauguaaauguuuugacaagccaugaucuuaaaucauuuuucugaauuaaaauucagguugucuguuacaacuccguauggauuuuauugagagaaacaauuuaaaaaucuuuauucccaugugacuuuuggcucuggccaagugaagagauuaacagauuaucuuccccaaaaaagcaacuauaaagcuggacaaaauggaaaaaaaaacaaucauuucaacauuuggaaaucaaccaaagacauauagcaaucuuagaaauguuuauguuuuuuaaaacugcugaauuuuguguaaaaauaguggaacuucguggcauucugguaugggucugcuccuaucauccccaccccaauucagucaacacacagauucugucuguuugaaggggcucacuuaauuuguaauagucaguaaugcccaugaccagcugcagcaucuguggaaaugaugaucuugaaguaggccaguagggagcccuacagcucccuagccugagaggucaacagcucuucuagccugagauugcagugguggugggauaagcauauuccuggcugagguugcacucaugugaaucagagaccaaaggacugaugcaacuccugacugaaccugaggcuguguucaugcacauaagagacagaaaagggcccauagaaaauaaaagauggaucaggcuugaaaaugaccugaacuuugaaugagcuccccuauccacauacagauuugggacaguaaguaccuacugggauguagagucauucuacuuuauaaauauuuuauaagcugugaccuuaaaucauuuuucugaauuaaacuucaaguugucuguccaaccauucacuugacagacuuuccacauuuggacaguccacacuuggacagucugucuagugaucauugauugaucacuugcuuucuacacaugggaugacucauaagaacucagacuuaaaaaggagaacaucggccgggcacgguggcucacaccuguaauccuagcacuuugggaggccgaggcggguggaucaugaggucaggaguucaagacuagccuggccaagauggugaaacccugucucuacuaaaaauacaaaaauuagcugggcacgguggugcaugccuguaaucccagcuacugaggaggcugaggcaggagaaucgcuugaaccugggggguggcgauugcagugagccaagauugugccacugcacuccaggcugggagacagagugagacucugucucaaaaaaaaagaacauaaggccgggcacggugaggugacucacgccuauacucccagcacucuggggggccgaggugggaguaucaucugagguuaggaguucgagacaagccuggccacaccucgucucuacuaaaaaaaugcaaaaaaauuagccacacaugguggcaggugccuguaaucccagcuacucaggaggcugaggcaggagaaucacuugaacucgggaggcgggaggcaggaggcaggaggcggauguuguggugagccgagauugcgccacugcacuucagccugggcaacaagagcgaaacucugucucacaaaaaauaaaaagaagaacauauauuuuuuaauaaacaacuaagcagcaacaucaguggccacauauaugaggggagacagacuucauggauuuaguccaggcagguuacuagcaaagaaaugcacuagcaaaaaaaaaaaccaaaaacaacaacaacaaaaaaaagcaagcaacaauaacaauuuuauaaggauaagauugucaguauaucaauaaguacuuuguuauaucaauaagauguaacaguuauacauguauauccaccuaaaacuugcuuccaaauacaugaaacaaaaauggacaaaauugaaaacauaaguagacaacucaaugguuggagauuguaauaccccacuuucaauaauugauugaaaaacuagacagaaaucagcuaguaucgaagacuugaacaacauuaucaaccaaaugccauauauggaacacuccauccaaugauugcagaauucuuuuuaagcacauuggcacauuucauaggauaagucauaugcuaagccacaaaacaagucucaguaaauuuaaaggugaccaugugggauuuaucccaggaaugcauguuugguuuaacauccaaaaaucuauugaugauguauacuacguaaagaauaaugaacaaaaagcacauaccuaucuuaauggaugcagagaaaggauuuggcaaaaucuaacacccauuuaugauuuuuuaaaaagcuccuaacaagcuaggaauagaagggaacuuucccaauaugaagaagggcaccuacaauagaacuacagguaauaugacgccauacuugauaaaagacugaaugcuuugacccuaagauugggaacaaggcaagcaaguuugccuuugccacuucaacauucuggugguucuugccaguacaauaagguaagaaggaaaaaaacuaaagauacuuacauuggacaggaggaaguacaacucuuuauaugcaguugaugugauccuguauauagaaaauauuguagagggguggggcuggugaggaggacuacuagaaauaauaaaguuuagucagguuggaggauagaagaucaauauacaaaaaucaauuguauuucuauauauauauuuguacauauauauguauauguauuaaagaaaaaucuaaaaaugaaauuaagauaauauuuacacuagcaucaaaaaacaauaaaauaggaauaaagcuaaagagcaagauuuguacacugaaaacuauaaagcauuguugauagaaauuagagaccuaaauaacauuuugucuuuauagauuagaaguuuuaauauuguugagauugcauuucuccccaaauugaucuguaaauuaaacacacuucccagcaaaauccaguaggcuuuuuuguuagaaaugaauaaguugauccuaaauguuauauggaacagugaaacccaguccugauccauacuauagaauaccacuuagcaauaaaaaggaaugaaacuguugauacacuuagcagcauagaugaauuguaucuauuauguugagugaaagaaggcaggccaaaacaggcuacuuauuuuaugauuccauuuauauaaauggaauauauaauuucuauucauaauuauauauaauuauauauauaauuuauauuaauggaauuauacaagauuauucugaucuguagcgacagaaaauagaucagugguugucuggauaagggguccaguuggagaggagacuaacagugguacacagguaguuuugggagugauaaauauugcugucaucugaauguuugugucucuccagaauucauauguugaaaucuaauccccaaucuguugguauuaagauguggggccuucaggagaucacuaugucaugagggugggaaccucaugaaugagauuagugcucuuauaaaagaagccugagguugcuuuuugguuccuucuaccaugcgagaacacagcaagaagguaccaucuaugaaguagaguacucaccagacacuaagucugcccauaccuugaucuuggacuuccccaucuccagaaccgucagcacuacauuucuuaccuagucuacaguauuuugguuauaguaagccaaaucaacuaagacaguuauguucauuauuuugauuguggugaugguuuuacuaguauauacauaaaacauauuaaauuguauacuuaaaauaguuuauuauaugucaguuauaucucaauaaagcuuuuguuauaaaucuuuauucauuauuguuuuacuuaggcacauuuuuaaaggaaaauuucuauuauuuuaauuauuuuuauuuacagaaaacucagcaguguacauuuaacccaguuuaguggcagguucuuuagcguuugccuuuucgagcuuggcgaugcgagccacagacuugggagccaggacauugccgccccagugacgguggaucucaucguaucugucauuguaauugguccuaauagcuuccacuagcuuagccaaaacgccuuugucuuccaaguuaaccugugugaaggcgacagugguacaggucuuccuguggacuagacaucccagucuucccuuccccuugauaaugcaauaagggacccccauuuuaugacacagggcaggcaagaagacaaccaacucgaugggagccacgugugcagucaccaccagcugagcuuucuuuguucuccaccaagguguugaugguguuaacuccugcucgaaggacagguggucucuuacuggggacauccccuuugccagcagcuuucuucucagcccaggucaacagccucugcuucuucucuugcuuugucucuggucuguacuugugggccagcuuaagcagcugaguagcuguuuggcgguccagggccugggugaacugguuaaucgcaggaggcacuuucagccgcuuauugagggauggcucucugccgcugcaaccugauagagcagggcuauuucacaaagcuggugaggucucuuuugggcuggaugucuugcucagugccaaaauucuuaggccuuuucucaaacaggggauucaccacuuucuuguccuccugcuucuucacaacagcaggggccagagccaccuucuuucccuuggccuuuccuuuuggcaucuuggacggcgggaggagagagcuacuuaggcacauuuuuaaacccuuuuguauacuuuuuauacagaguaagaaaggaaagguaaauugauuuuauagauuuuguccuuuuuauccuaaaccuuuuuguguaaucaguaugaugaaauauaaguaauauuuuugcuugaguuuuuuucuaaagcauaagugauacccacauuaggaagauaauguugggccaggcaugguggcucaugccuguaauccuagagcuuugggaggccaaagugggaggauugcuugagcccaggaguccaagaccagccuaggcaacacaggccccauuuguacaaaaaauuuuaaaaauuagcuagguguggugguacgugccuguagucccaagcuguucaggaggcugaggugggaugaugacuugggccugggagguugaggcugcagugagccauggucaugcuauugcacugcagccugaucaacagagugagacccugucucaaaaaacaaacaaacaaaaccaaaaaaaaaaaaaaaaaaaaaacaagaagauaauguugcaccaguaguuuuccaaaugggauuucccauuugauaaacacagccuucauuuccaugugggcuccaaauguuaacuuugaaauaauaacuacagugcuuaccuuuuuaaagaagugaaggaaaauaaauaaauuauuuuuaauguaucuacaggcaacaccaacauugcuuagaagauuuggaucucagcuuaucaagucaacuguuuugucagccacuacuucucuucgaguauuagcccuugguggugaagcguuuccaucauugacaguucucagaagcuggagaggagaaggcaauaaaacacaaauauuuaauguuuaugguaucacagagguaucaaguugggcgaccauuuauaggauuccagagaagacucuuaacucuacucucaaguaaggguuuucauuguacuauauagagaagagagacuguauauuucuaggaucuuaacacugacaguguuuuugauaggugcugggguaauaauuuuagaaacacgauuguaucugauauuuuaaguugggaauccagaaccuuccuuacuauagcuggugccaagauacugcugcaacuuuuuguacuaaauaguaaugaauaacauauaugguuaccuuuccaccuaaccuuuuccucuugucagucuuugaauuagagcguaacaaacuuuuuuuucuuuauuugguacaguaugauuuaaauauauuggaaaauauucuauucaaaugaaaaauuuuaaaucugcucuguaucuuauuuucauagaugugaauugccuguacaacugggauuuccacuucuuggaacaguaguugaagucagagauacuaauggcuucacaauucaggaaggcaguggccaaguauuuuuagguuguuuuauauuuguugauugggaauuuuuuuuucaagaaaaaugaucugauguguuaauuuuauuccuuucgucuuuuucuuuugucuaucucaugcuuuucagugauaauuuuuauucucauucauauagucaugaaauaccaaauguuacaauaauuauuucagauaauaaugucuaacacauuaauaaaaguaauuuagagacuguaacuuggaccuucauauuuauauuuauagccaaaauuauauuuaaucaguagucuaagaauuuuuuuaauuccauaaauuuuaagaaauaaauuucauuuuaucucugcuuauuuacugaacuuauugugucugauuuuaucagauaacauuuuaaaaugagcccaucuuuuaauauuuaaauuuugaaguuuagucacugaacuuuuggagauguugauuuuaugguuuuuaauauauuucccuuggauuuuuaugacauugguguuuauaucuugggaagguggcagaaacagaguguguuuucuugaugaugaagugacaguaccacuuggcacaaugcgagcuacaggagacuuugugacugugaaagauggagagauuuuuuuuuugggacgaaaagacagucagaucaaacgucauggcaaacgucuuaacauugaacuugugcaacagguagaacuauuuaaauauugaauaucuauuaauauauguaaguaguagaagcagccaccaccaauuuucugugcuggggucucuauuauuuacaccugacauuuuuguguuagugaugaauuacaauaaaggguaugaauaauucagggugccccuuauccccagcaugaagagaugguuauucuuuaaauaagugacaaauuagauuuugauauuugugaaauuuaacuggcuuauuuugcuuuaggaucuauuauuuugaaaaauauuaugaacccuaugugcaaguaauaguaacaguagcaaagcaauuuuuuaaaaaucuccaguauauuccaaaauuuaauucagcuguuuugauuucagacauuaaaaaaauaagcuuuuaggaagcuuguuuguaaauauccucauuggcaaauuaggauaaucucucuuauagguugcugaagagcuucagcaaguggagucuugugcaguuacaugguauaaucaggaaaaauuaauucucuucauggugucuaaagaugcuucaguaaaagaauacaucuuuaaagaacugcagaaauaucuuccaagucaugcagucccggaugagcuuguauugaucgacucucuaccauuuacaucccacgguaaaguaauuuaaagcagauauguuucagugccaaauaauacuaauuguauucauaacuagcuuaaugauaacauaaaucuuuauuuuuauaaaugguacuagcauuuauugugauagacccucuuuugacugcuuugucuaauuaauucauuuuaucuucagaaaauccuguggauaggugguauuauuccuauuuacagaugaagaaaauaaggcuuaaagagguuaaguaguuaggugaggcaugguggucagcgccuguaguuucagccacucagggaagcuaaaguggaggaugcuugaggccgagaguuugagggcacagugugcuauguuugugccuguaaauaaccacuauacuccagccuuggcaacaucuaaaaaaaaaaaaagagguuagguaauuuuccaaaaaucauuuugcuaguuagugguuauauuaguauaguagucaugguucuccagaaacagaaccaauauauagauagauaaaauauuuauugucaggaauuugcccaugcaauuauggaagcuaagaagucuaauaucucccuuuggcaagcuggagacucaggaaagucggugcuguauccagucuguguccuaaggccugagaaucaggggagcugaugauauaaaucccuguuugaggacaggaggagaugagauguccuagcuuaagcagugaugcaagaaaaagggugcaggccaggggcggcaacucgcgccuauaaucccagcacuuugggaugccaaggcagguggaucacuugagguugggaguuugagacuggccuggccaaaauggugaaacccugucuuuacuaaaaauacaaaaaaauuagcugauugcaguggugcacgccuguagucccagcuacuuggaaggcugaggugggaggaucgcuugaacccaggaggcagagguugcaguaagccgagguugcgccacugcacuccagccuaggcaacagagugagacuccaucucaaaaaagagaaagaaaaagcaugcaaauucuuccuuucucugccuuuuuucuauuuuggcccucaacaguuuggaugaugcccaaucuacuuuacugaguccuuaauuaguuucaucuacuaaucucauccagaagcacccucacagacccagucagaaaaaugguuaaucugggcacccuguggcccacccacauugacacauacaauuaaccuaucacagugauagaauugauauucugucuaggacuguuuuuuauuuuaauuuuauuuuuauuauuguuuguuuugucugucuaggacuguuugacuucaaaauauauaaucuuaaucaccauauuauauugccuucccaauuucauuuuuauuuaauauauacuucaacaugcaguaauugcucagguaauggaacuauuuccuuaacucuugaaauugagauaaauuggauaaauauuagcuccuuuuuuccuuuuucuuucuuuuuuuuuuuuuuuuggagauagggucucacuucuucacccaagcuggaaugcaguggugcagucagggcucacuacugcagccucaacuuccuggguucaagugauccucccaucuaagccucccgaguagcuagaacuacaggccaauuuuuuaauuuuucuguagagacagggucuugcuguguugcccaggcuggucuugaacaccuagccucaagcgauccucccaccucagccucccaaaguguugggguuacaggacugagccacuaugccugaccuguuucucaucuauuucucuguauauucuugguaguaucagacaacuuuuuagaauugauuguugacaacaaacucuuuauaugauuucuguguuguacaaagaaaaauguauauggcuaaugaauauauaaaggcuuugagugaaauuuuaaaauguuuuaaaacauuuguuauuucucuuuuauauuaaggcaaaauugauguuucugaguuaaacaagauauauuuaaacuacauaaacuugaagucugagaauaagcucagugggaaagaggaccuuugggaaaaauuacaguauuuguggaagguacaauuuuuaaguuauaaaauuauuauuauaaagaggucguuuuauaucuuuagggacugcuauuauccuaacaaguuggauaaaauuuucugagaauguuauugcuacccagauguuagguaguauaucuucauuuauccaauuuguauuaaaaugaagguuagauucucuacuauaagacuagauuaaguuuccgacaaagaaauuuauugaaagugaaguagucauaaaaggcacaaguagacaaagccuguuuugacauaacuuuucucuaagaggaucgguggaauguaguaacacucuugucagagcugagaaaauagccaaaucuugcuauagcacagugcguugucuguuauacuuagggcuuacaucauuauucuaaaagaacuuucaguaacaauauuuauuucuacuugagagaguuuguuuaaaaauauaucucaguaaguuaauaauuuuucuuaaauaaaauguagauuuuucuuuuuuaaaggguucugaaaagaggauguaauuguguagccuugucuaaaaauagaggguaucuaagauaaaagucucuucuacuucauuuuuagauucuuggaaaguaauuuugcuuuauaugaagcagccaaagacaaauuauucccauauuauagaaauauuggcuauugguaucuugugggcuuuauaauuaauaaaucagauguuuuugucccaauuuuauggguaagaaaacugcucuaaagggaaguauauuuuguacuuuuagagugaauuugugacaaaauugguaguacagugaucuccuuuaacauaaauaaaauaauuuaaaacuuuauuuuuauuauuaaaaguauuuauuuuauauuucuaauuguuauuauuauuauuauuuuugagauggagauucacucuguugcccaggcgggagugcaguggcgcaaucuuggcucacugcaaccuccacccccuggguucaagcgauucucuugccucagccuccgaguagcugagauuacagguggcuaccaccgcacccagcuaauuuucgugguuuuaguggaggugggguuucacuguguuggccaggauggucucgaacuccugaccucaugugaucugcccgccuuggccucccagaguacugggauuacaggcgugagccacuguacccgaccuauauuucuaauuauuaauguagguacucucaucucuauauauuaccuguaaauguugaagucuuuugcuuuuagaccuuuacgucacauauuucucuauucucucaucuguagucuacucugaaucucccagaagaucuuuugaggguuccugaugagucacucuucuuaaauagugguggagauuccuuaaaguccauccggcuccucagugagauugaaaaacuuguugguacaucaguaccugggcuucuggaaauuauucucagcaguuccauuuuagagauuuauaaucacauccuucaaacagugguuccagaugaagaugugacauucaggaagaguugugccacaaaaaggaaacucagcgacauuaaucaagaggaagccaguggaacaucuuuacaucagaaagccaucaugacuuucacuugccacaaugagauuaaugcuuuuguuguacugagcagagggagucaaauuuugucucugaauuccacuagguuuuuaacaaaguuaggacauugcucuucagccuguccuucugacucaguuucacagaccaacauucaaaauuugaaaggcuuaaauucuccaguucuuauugggaagucaaaagauccauccuguguugcaaaaguuucugaagaggggaaaccugcgauagggacucagaaaauggaguuacaugugagguggaggucagacacaggcaaauguguagaugcuucaccgcugguuguaauacccacuuuugauaagucaucuacaacuguguacauugguucccauucucauagaaugaaggcaguugacuuuuacucugggaagguaaaaugggaacagauuuugggagaucgaauugaauccucagcauguguaucuaaguguggaaacuuuauugugguggguaaguuuuugaauuugagguuuguggaguuaaauugaauuaccauacaauaaucuucauaggcccaaguuaaauuuuuuaaaaaucuaaauaugauggguuugguugcuguccaaaaauuauaguuaacccugugcugauuaauauugugggccuuggggucaagagucccuggauuugaaccuaccuguauagcuauuaugaacucugugaccuuuggcaaguuacugaaccucuuagaauuucacuuuccuuguggguaaaaugggaauaauaauaaaauguguugcuguaucacaaauaccccaaaacucaacaaccuagaacaacacaaauuuauugucucauaguuucuaugggucagcaauucaggagcagcuuagcuggcaguucuggcucagggcuuucacguggcuauagccaucugaaagcuugacuuggguuggaaaaucugccaagguagcucauuuacaucacuauuagcagaaagccucaguucuuugcugauucuggcaggaagcuucaauucuugccacauacgccucucucuaggcugcuugacugcccuuacaacauggcagcuaacauuccucagagugauccaggagacagcaaguaaagaggaacagaguaccuuuuaugaccuagcguuccaaguuccauaccaucauuuuuuguuuucuucuguuaauuagaagggcauaacucagccaggcgcgguggcucacagcuguaauaucagcacuuugagaggccaagguggacagaucgcuugugcccaggaguucgagaccagccuggguaacaugcagaaacucugucacuacaaaaaauacaaacauuagcuaggcaugguaguacaugccuguagucccagcuacuuggauggcugagaugggaggaucacuagagcccaguagguugaggcugcugugaguggugauugugccacuguacucuggucugagcaagcagagcaggacucugucucaaaaaaaaaaaaagugcauaacucaguucaggccacauucaaggggaagagaauuaggcuccaccucuugaaaggaaguacaucaaagaauucauguacuuuuuuuuuuuuucuuuuuuuugagauggagucuggcucuguuucccaggcuggagugcaguggcgcgaucuugguucacuacaaccuccaccucccggguucaagugauucuccugccucagcccccugaguagcugguauuacaggcacauaccaccacacccagcuaauuuuuguauuuuuuguagagaugggguuucaccauguuggucaggcugguauugaacuccugaccuugugauccaccugccucggugucccaaagugcugggauuacaggugugagccacugcacccggccuccuggacauauuuuaaaacacuagaaucuuuuaucaagcuuuugggaggauuaaaugagauaacuguuuaugaaucaauuggugcauugcuagggacgugccaccacaccuggcuaauguuuguaauuuuuguagagacagagcuucugcguguuguccaggcuggucucaaacucccgggcucaagcgaucugcccaccucagccucccaaagugcugagauuacaggcgugagccaccaugucuggccuggugagcauuuuuucauaagugcucauuaaggguuagcuacuaacugcugcuuaguuucauuaagguauaggugacuuuuacucuauuaggaauauggggguccuggguauaauaucucccccugacuacaacucucuuuuuacucucccaaguauguuagguuucauuuuauacgcucauggaaucuucaucaaagcuuuucaaacuaaaggcuuaggaauagcuuucccuacuugugcuauccuagcagcaaucuacuugaaucugaaugugauucuucccuucuuccccuuuaaacaacggcauuuugaaaauuauacuacagaacacuuucaguaauacaccugaaugauaagaaacugcugaauuguuucccaaagugauaaaguguuuugcauuuccaccaucaaugugugaaaaguccaguugcaccacauuuuugcuaguacuugguauugucagcuuuaacuuuuuuuuuguuauagccguugaaauaaucaugaguggaauuuuauugugguuuuaauuugccuuucccuagugaccagugauguugagcaucuuuuuuuuuuuuuuuaagacagcgucuugcucugucacccaggcuggagugcaguggcgucaucauggcuuacuacacccucgaacuccugggcucaggugaugcucccaccucagcuucuggaguagcugggacuacagauacaccaccacaccuggcuaauguuuguaauuuuuguagagacagagcuucuguguguuguccacgcuggucucaaacuccugggcucaagcgaucugcccaccucagccucccaaagugcugggauuacagacgugagccaccaugucugacgagcaccuuuucaaaaccucauuugcucucuguguaucuuuugugaagugucuauugaaaucuuuuucccauuuuuaaguuuuuuaaauugaguuuuaagaauuguuuuauguauucugaauauaaaucauuuaucagauauauguuuugcauguuuucucucagucuggggcuuguguuuuauucuuuuagcguagugacauagugucuuuugaagaggaguccuuuauuuugaugaaguccaauuuaauuuuuuuaaugggucaugcuuuuggugucaucuuagcaaucuuugccuaacccaaggucaaaaagauuuucuuuuguauugucuuuuggaauuaaacugaauugacagaaaucuuuacccaggugaguucuggggugcucuacuauguaggacauuucucuuugucaucucugagcuggccacuacucucuugcuacuaaauaauaacugccaggggaaaaaaaagcauaaaaaguacauugggaauugggccucaaaugaguggcagcggccauaggcagagcugucuagagagugggcaucaaugaaauugcccuaaauagcuguccccaaauucuacuucuccugauuuucaugaucuccagggaauuugagugaccuucacuuuguacauuugaaccaucucuacuuccaguuagguuauuuuggcuacaccaaggucaaggacuccugcccugucuucucauccauagcagcaauuugggaaaagcaguuuaguuguuaagagcauaggcucuggagauugacuucuuagauucaaaucuugguuugccacauaugagcuguguaauuuuuccccaguaauuuagucucucugugcuucaauuuuguuaucuauaaaaugugguuauaauaguacuuacuucacuguggggauuaaaugaauuaauagauguaacauacuuagaauaacgccugacacauaguaaaugcucaaugaacauugacuauuaacguuagcacuucuuaaacaccuucuaugcacugggcauuuguucacauuaucugaauuguugcaauaacccuggaaguagaugacuccacauucugcagaugaauaauuuggggcuuagcaacacugggugauuuaaaugcccagugacagucgugaugaaaucugaauccagaugugucaaaaaucucucuccaccacaguguacuuuauuauuuuuucaguagugaagcgcuucuuaaaaauaaguauguaaaaaaauuagugaaguacuuuuaaaagauaagauacaccuacuaaauagauauuuuacauaagugauuacuaauucaguuucugcuuuacauugcuaaaauguaagccagaugagcuuaucauagagccuauguauaagaggaggacugaauauaaauugcaugcuguaggcuaaagaauuauuuuccaguaauauaucuauaucaaaucuuuugugcuuuguuucuugguaggcuguuauaauggauuaguuuauguucugaaaaguaauaguggagaaaaauacuggauguuuacuacugaagaugcugucaaaagcucggcaaccauggauccaaccacaggacucauuuacauuggaucucaugaccagcacgcauaugcuuuagauauuuauguaaggauugaccucaaauuagcugggcaugguggcgcaugccuguaaugguaguuacuccagaggcugaggugggaggauugcgugaaccugggagguggagguugcagugagccaagauugugacaguguauuccacccugggugacagagugagacucuaucucaaaaaaaaaaaaaaaaaaagaaagaaaauucaccucauuagucuaauaccauaagcauagaagcauuaaauuucaauacuuagaagaagagugaguaacugucagguguaguugagccuuggaacagguauuaacuauuucccaagcuuguguggucugggaagaauaaagcauuaauuaagucuuaauaucuuaagaccuuuuuaacuucauuaccaaauuuaccacaaauaagugugcuacucagaguuuuggaauuaaagaauuuaggauuaucaucuugacaguagaaaaaaaugacgaagauaucaauaagauguuuuaagaccugauuacauaaaaauuaaaauguuauguaagaauuaugaaauuaagcugggaaaauuuuugaaauaaauguaaaaaaaguggaaauucauuuauauuuauaaguauuaaugaaaauaaagaucaaauacaaauuaauaagacaaauguagagcagauagaaaaauaaacaagggacauaaauacacaggaccccaaagaagagacggcuaguaaauguauauaaauaguucaugaauuuaauaaucaaaggaaugaaaauuaaaaacucuugagauaaacaaaugguguuagauuagaagacauauucaucauaacauuaaaugcugaugagagugguaagagguuguaacuagugaggccucuaaugaaaacgauuugaccauagguaacaauaucauauccuugauccaauaaaauucguuuuuuagaaauccuggcaaaaauaaucagaaacauagucaaauauaugcauuaagaugccuauuucuaaguuguuuauaauaccuagaaauuccaaaaaacguucaaugauaagguagagagagaaauuauuuauguucauaugggauauuauggauuaaaauuauauuuaaaucauuuuacaaaaucagugagcaaaauaugauaccaaguuauauauucagaaugaucucagcuauauuagaucguguguguguauauacacauauucucagaugugugcgcccagacacacacacccauaccccaaaaagaucaaaugagaaaaugcuaaaauguuaacacugguugucucuggguaguguccuuugucuuuauacuaaucugauucuccacaguaggcauguacuuuauacuaaagauaaaaacuuauauuaacuaaacagacauaauaucaugaaggguagguuauauggauuuguuaaccaucaacaagaacaaauuaauuuguuuucuuauuugcagagaaagaaguguguuuggaagucaaaauguggaggaacugucuuuuccucuccguguuugaaccugauuccacaucauuuguauuuugcuacauugggaggacuuuuacuggcuguaaauccuguaggcauaaaauaauacauauugauuuuauuacuuuucuuuaaauuuguaaaauuuuugcuuugagcuuugaaaguuugaguaguuuucaguuaauuguaguaguccacauacaccaaacuggaauucauuaaaaaugauugacaugagaucuagaaagauaagaaaauuuaaauuccuguauauauauauauauguauuuuuuuguuuguuuguuuguuuuuugacagagucucccucugucacccaggcuggagugcaguggcgcaaucucagcuuacugcaaccucugccucccagguucaaauugacaaaauuuuuuucaucauauuaagaacuuuauguccaucacagggauaacucuuaggugcuaguuuuuucuuugcugcuuuuauugcaagccuuuuuccuaguucucauaaauagcacugauuaauuuuauauauguauaccagcuucauuuaugucugcauaccacuacagcauuuucugcuauuuuaguucuaacccuaggagauguaugaguuuguuuuuuaaaggguaacugauuaguaggaugacauaaaaugcugugaauugcuuuuuccugugacaggcuacugggaacguuauuuggaaacauuccuguggaaaaccacucuucucuuccccacaauguugcucacaguauauuuguauuggcuguguagaugggaauuuacucugcuuuacucacuuuggagaacagguaauagaacuagaaauuuuuuauauauacauuuuuauauauauauaaauguauauauaaaaaauagaacuagaaauuuuauauaucuauaguucuauuuauauuuuuuaaauuuacuuuucuuaaaggcaaagcagauggugacaacugaaguaacauuuuaaacaucauuauucaacucacgguguugagaaguaguucuauuuuaauugugaagccauggauuucuuaauuuuuuaaagaagacauaguagauuuaaaagauuucuacccaaacauuguuacacuucuuuugucaucucccccaauuuuuaaaauauuaccaguuuuuagccuguuuuauuauaacuucuauugagauuaugaaaguuuaaauaaaaccccuggauucuuuuaauugauacagacauuuguaccuauuuaugggguauguaugugauauuuuguuacaaucauagacuguguaaugauuaagucaggguguuugugguguccaucaccuugaguacuuauuauuucuauguguugggaucauuucaugucuucucuuuuagcuguucugaaauauacaacauauuguuguuggcuguagucauccuacucugcuacugaacauuauaacuuauuuuuucuuacuauauguuuuuaccuauuaacuaaccuguuuuuauuuuuuuauuagccaacccaccccaacuucuuuuuuuuuuuuuuuuuuuuuuuugagacagaaucuugcucuguuaccaggcuggaguacauuggugugaucuuggcucacugcaaccuccgccucacggguucaagcaauucuccugcuucagccucccgaguagcugggacuacaggcgcaugcugccaugccuggcuaauuuuuguauuuuuaguagagacgggguuucaccauguugcccaggcuagucucgaacuccugaccucaagugauccaccugccucagccucccaaaguauugagauuacaggcaugagccaccacgcccggcccccaacuucuaauauuccauuuucuuccucccugagaucaacuuuuuuagcucucacauaugagugagaacaugcaauauuugucuuuuugggccuggcuuaauuucacuuaagauaaaaaucuccaauggcugggcaucauggcucacgccuguaaucccagcacuuugggaggccgaggugggaggaucacagagucaggagaucgagaccauccuggccaacauggugaaaccccgucucuacuaaaauacaaaaaaaaaaaaaaaauuagcugggugugguggcacaugccuguagucccagcuacuugggaggcugaggcaggggaaucgcuggaacccgggagguggagguugcagugagccaagauugugccacugcacuccagccuggugacagagcgagacucugucuccaaaaaaaaaaaaaaaaaaaaagauaaaagucuccaguuccauccauguugcugcaaaugacaugauuuccuugguuuuuauggccugauaguauuucacugcaucuauauauacuacauuuucuuuauccacucauccauugguggacacuuaagugcauuccauaucuuugcucuugugaauugugcugcaguaaacaugggagaugggagugcagguugucucuuugauauacugauuuuuugucuuuggguaaauaguaguaggacuguuggauaugauaguucucuucuuaguuuuuugagaaaucuccauacuguuuuccacaaugacuacccuaauuuacauucccaccagcaguguaaguuccuuuuucuccacauccuugccagcauuuguuauguucuuuuaguaauagccauuuuaacuugguaagaugauaucucauugugguuuugauuugcauuucccugaucauuagugauguugaguguuuuuuucauauaccuguuagccauuuguaugucuucuuuugagauaugucuauucaucucccuugcccacuuuuuaauaggauuuguuuacuguuguguuguuugaguuccucauauucuauauauuagucccuuguuggaugaauaguuugcaaguauuuucucccauucaacaggcugucucuucacucuguuguuuccuuugcugugcagaagcuuuuuagcuuaauauagucccacuuaacuauuuuuguuuuuguugccuauacuuuuuaggccuuagcuauaaaagcuuugcuuagaccaguguccugaagugauucccuuauguuuucuucuaguaguuuuaacuaguuuuaggucuuaaauuuaagucuuuaauccaucucgaguuuauuuuuauaugcagugagagagaggggucugguuuauucuucugcauguagagagagcuccaauuuucccagcaccauucauugaagagggguguccauuccccauuguguauuuuugacaucuuucucaaaacuccauuggcuguaacuacguggauuuauuucuagguucuccauucuauuacauugaucuauuuuuauaccaauacagugccauuuuggcuaaauuagccuuauuuugaagucaguuacugugaugccuccagcuuuguucuuuuuacccaauauugcuuuggcuauucugggucuuuuuugguuccauaugaauuuuauuuucuuuaauuuuauuuuuugagauggaaucuuguucuguugcccaggcuggagugcacuggcacaauuuuggcucacugaaaccucugccucccggguucaagccauucuccugccucagccuccugaauagcuaggauuacagguguguaccaccacacccagcuaauuuuuguauuuuuaguagagaugggguuucaccauguuggccaggcuggucucgaacuccugaccucaggugauccaccugccuuggccucccaaaguguugggauuacaggugugagccaccaugccuggccacaacuuauaacuguuuaucauugcccauaaacucuuccuuucagcacaauuaacuuuuuuccuacauuuggaaaagaagauacauaguuuguaagaagauauauugaaaacuggucucaauuuuuuuuuuuuuuuuugaaacaaggucucacuaucgcccaggguggagugcaguagugugaucuuggcucacugcaaccucugccucccagguucaagugguucucccaccucagccuccccaguagcugggacuguaggugugugccaccacaccuggcuaauuuuuguauuuuuaauagagaugggguuucaccauguuggccaagcuggucuugaacuccugacugcaggugaucugccugccuuggccucccaaaaugcugggauuauaggcaugaaacaccacgccuggcccaguuuuuaauaagauacacugaaggcuggaugugguggcucacaccuguaaucucugcacuuugggaggccgaggugggcggaucacgaggucaggagaucgagaccauccuggcuaacauggugaaaccucaucucuacuaaaaauacaaaaaauuaccugggugugguggcacgcgccuagcuacucgggaggcugaggcgggagaagcgcuucaaccuggcaagcagaggaugcagugagcugagaucaugccacugcacuccagccugggcgacagagcaagacuccaucucaaaaaaaaauaauaauaauaaauaaaaauuaaaaaaagauaauauugaaaacucaauguaguuuuaccuuugaacucagugucucugaauaauacuaacucuugaauggaguucaaaauuaauuuuacuuauuaugcacggcagugaaucacauaguaacaacacuccaguauauuuugucuuagauuuuacauuuuaccacugggacagaggucuaguaugauagugcuacuuuucagaaaaagccauuuugucuguguauaguuaccauucaaauagccuauaucucuuagauuugcauuaagaaccucauagagcuuuaagggagaauuggagcaauuagaugaaugaauuauauuuauuuuuauuacuuguuauagguuuggcaguucucuaccaguggaccaaucuuuucauccccguguaccucaccaucagagcaaaaaauauuuuuugguucccaugauugcuuuaucuacuguuguaacaugaaaggucaccugcaguggaaauuugaaacuacuucaagggucuaugcaacaccguuugcuuuccauaacuacaauggcagcaaugaaauguugcuggcagcagcaucuacugaugggaaaguguggaucuuggaaucucagaguggacaauugcaaaguguuuaugaacuuccuggagaagucuucucuucuccugugguccuggaaucaaugcucauuauuggguguagagauaauuauguuuauugucuggauuuauuggguggcaaucaaaaauaaucaaauacaguccuuauuuguauaacaaaugugagauauuugaaaauauuuuaccauuauacaucauguggacuuauuuuauauuaaagaagauuauauuuuggcuaagaa

SEQ ID NO: 191480 - RNA, 25266 nt, Homo sapiens
accaaaguuaaucuucuaaguccuuuuaauuguucuuauaaacuagcauaagauauaaacuuaaguaguacacaugaguuuuauaauuuacuaaucucugacagauagcuaagcauagcacaucagagcauaacacagugugagggaaauaaaguguacaaugacaucuucuauucuggaccuaauaauucaauagagaaagaacuacuuguagucacugugguuacagaagguuucauggacagcgaacauaaagcucuacuagcuaacaaauaggucuuaaugauaaaaacgugggccuucagagaacuaaagguaccaauguguggcaguccaaaauuacgaggaaaaugaguucccuucaugggucacaucagcaauuuuuuuuuuccccuuuugagacagagucuugcucugcugcccagguuggagugcaguggcaugaucuaggcucacugcaaccuccgccucccggguucaagcaauucucaugccucagccucccgaguagcugggauuacaggugccugucaucacggcuggcuacuuuuuguauuuuuaguagagacaggguuucaccauguuggccaggcuggucucaaacuccugaccucaagugaucugcuugcuucagccucccgaagugcugugaucguaggugugagccacugugcccagcuaccucaucaauucuuaaucuauaaaccauggauaggcuucgggagaacccaagaaccaaugaaaucuguugguaaguuuuaugugugcgguuuucuacagagagggucaacagcauguauauuuucaaagaagucuguggugcaaaagagaguuuauuguuagaaguccuugggcaaucaacuuggaaaaggguggauugagaaugggggcugucuagaucaggauaauguugaauuugacccucacuugaggcuuuuguacagaggaugagaagacgguaaauucaaggguuaaucagaaauuaacaccaacaugacuuggugaugagugagaugugaaacgugagaaaaacaucaaugaugaaaucaagcuucugacuugcaacagugaguauaccaagagcuacaggcuuggaagaugaauaaaguugggagcauucuguuuuuucaugagugcccaugggacagacagggagaaauggacaguugaaaguacaagucuagacaggcacaguggcucaugucuguaacccuagcacuuugggaggcugagauaggagaauuacuaggguucaggaguuugagacgaaccugggugacauagugagagcucaucucuacaaaaaauaaaauuagcucggcauggugcugcaagauuauagucccuguuagucgagaggcugaggugggagaacugcuugagcccaggagggaaagcagcagugaacugagaucacgccacugcacuccagccugggcgacagugagacccugucucaaaaaaaaaaaaaaaaaugcaagucuggagaaauauagcugggagucaguaaugccaguuuuagcugagggaguuaagaucauuuaaucaguguuaaggaagaaacucaauaguagugaccaccaauacuuaaggaaaaaggauaaaguaagaggaaugauaaaggcuggcugaaauaucuuggugucuagccuaagaaaggagggguuagaugcucauguuuauuaauauggaucuagagaagcauuuauucacuaauacauuuuauuuguguucucuaauuuaaaauuaccuuuucaucuugcuugauuuuccuucagcuaaauuagaaauuuguaguuuuuccccuaaaaaauucaauggcauucuuucuuauaaauuacauucucugauuuucuugucagccugcuucaaggaaauccauguguucaaaaugcuugcucgcaguuugcuccauaccaaaugguugcuuaacccaaauaucugagcagcaaauugagcugauccuucuggagaaaguacgguugaacagccaagaccuauugguucagcaaggaaaagacagaaaauugagcucaauuaguaaugaaaauacaaccuuacaaaaaauuuuauacucagagcaguccugccacagaaaauaaaaagcuacugcauuauucuaaucuaaaguagaaucuguacaacugucuuuaauaccggagugguaaagugauuacaagaggaaaagcagucaguauuaccugccaugaagagauauuuuauauauaucaucuaucacccuucuuauagaacucacuuacaaagaaacuuaucuuuuugaaacuucuguucacauacacuaucccuuucaaucccuggcgaagaacaacugaagcaaaauaagggucaagguaagaguacaaaaguaccuguucuuagacaaacuugagcuauguuguuuugacaguuuucuagcuaaucuuucuaucugcauuugaacuauuuuaauauuuuugagcaguaaaagucaaauccguagaauaauuuuaggaaaugucaaguuauaaauaaauauuaauaagauccaagacagcagaauaaaaaaguaacauccuaggggccacaugucugcucaggcagagugucuugaggugguacuauuaugucuaguguuugcuagaaucagggguacuauuaugucuaguguuugcuauaguuccaaaagcucgauuuucccgauauucuuggaauucaucaggcucuuugacucccauuauccacaagaacagagucaaauacaaaucacaaggccaauuuacuaauuuguauuaauacguuauuuuauggagcuccaccccuuaauaugugguauuggucaaguuacuucacguuaauuuauucuccucuucugugagaagggaauuuuaacuaguagcuaccugaugugacacuucaaugaguuaauaacauagauaaagugcuuagagcauugccugguacacaguaugugcuccaagaaugucaaccacuauuguuagcacgcuagguagagugcuccacucuaauauuugaaauaaccugugccuccugcccaggacucccuuucugguaaaagaauagcuuaaauugcagaaaaaaaaaaaaaaguuaucuagugagcaugacaucagagaugagaaauaugggcggucuucaggauuuuacacagguuacuguaaaacuacuccucaaaagauuauccccaauucuagugaucauuauguacaagucuuccagauuauuugucacuccugaaacaacacuacuauaaaaacugccaauuuuuugcuuaucaugcuccccuuuuguaagcuccauggguaucuauacaauuccucuggcauaaauuugguuacagcuuuauuuguagccgcugauuuuuagcuugagacauuuguauaaucacaucuuguuaaagauagcuuaggcacaaaauuuaauucucagagccuauaaaaacaguaaaggaaauaggcaugaacacacaaggccagauaacagcaguaacauuuuggcaacugaaaggcaaacacagugguagcuaaguuagcagaccaagaaaacuuaaucaaaauuagcuggcaugguggugcaugccugugauuucagcuacuugggaggcugaggcaggagaaucgcuugaaccugggaggcggagguugcgccauugcauucuagccugggcaacaggagcgaaacuccauuuaaaaaaaaaaaaaaaaaaaaacuuaauucuaaacugaaagcagggaaagaugagaagcaacaugacugacauuacagaacucccccaaagggugacugacuaaauuaguggcaccagauaccuuuggaagggaauagggacuaagaagaagaugacugacucgaagucuaagaagaagcuagguccucaaaucuccuuccccacuccaucuaccugaguaacugccucuuuaaagcacuguagcaauuuuuuucuuuuuaaacauuauuuuuuucugagacacggucucgcucugucauccggagugcaguggugcaaucacggcucacugcugccucaacuucccaggcuccagugaucaucccaccuuggcuucccaaguagcugggaccacaggcgugugccaccaugccuagcuaauuuuuguauuuaugguagagaugggguuucgccagguugccuaggcugagcucaggcaauccaccaaucucugccucccaaaguguugggauuauaggcaugagccaccaagccaggccuuuaauuuuucugaagguaaaacagacuucagucuuggcgucuuugaacuaggggacgccaggcacagacaacuuuuguucucugaguaauucuggucaacacuuaagaaaauaccuagacacuaaugugagggguuguuugaagaacaaucccuaccagauacaccccacagugaagcccaauuuugacacggaccacccacuugaaguuuccaauuguuuuuuauaguauuccacucuuaaaagcgcaaacagccaaggauuaccagacagcugaagaaaguaacuauaugcaacagacuauaaucaucuccagagaacaaaaaagagcuuuuggaaauuuaaaaacauacaaacacaaacaacaacaacaacaaaaacccagaaaacaaaaaccaaaagaaauauaaaaacauuguguaaaaaaaaaaaaaaaaaccccagaggcagugguuccuacccaaucccaacacuuugggaggcugaggugggaagauugcuugaguccaggaguucaggacaagccuggacaacauacggagugcccaucucuacaaaaaguaaaaaaauuaaccaggugugauggugugggccuguagucauagcuacuugggaguuugaggugggcggaucacaugagcccggggaguucaaggguccagugagauaugaucaugccacugugcucccaccugggcaacagagcaagacccugugucaaaacaaacaaaaaacaccuguauccaaaaugaaggccgggcacaguggcugacgcccauaaccucagcacuuugggaggccagggcaggcagaucaccugaggucaagaguucgagaccagccuggccaacauggugaaaccacaucuccacuaaaaauacaaaaauuagccaggcgugguggugcauaccuauaaucccagguacucaggagguugaggcacgagaaccgcuugaaccugggaggcggaggcugcaguaagcugagauugcgccauugcacuccagccugggcaagagagcccgacuccgucucaagaaaaaaaagaaaaacucaauagaaggguuggaauguaaaauuuaggaaauauuccagaaaguauaccaacaagacaaacaaguagaauagaaaucaagggaagcccaaauuuauucaaauucaaaaaugagaagagagaauauggagggguaugaaaauuaaauaauucaaggaaaauggggacuaagaaaucagaauuucagauuaaaagagcucaccgaaaguccauaaugaaaacagacucagcacaucacaucuguguaaaauuuaagaacaaugaaaacagacaaaagauccugaaagauuccagagagaaacaaaauucauaagaaaccuagaaucagacugguggaaaagcaauggaguccucaacuguggaugcuaggagacaguggaguaauaaugcucccaaaauuccaaagcaaaaugauuuucagcauaggauucuauuucuaaacuaucaaguauagggcuucaauauacacauuuuagauacacaagguaucaaaauuuaccuuuuguauucuuuugcccccaaguucaagaauguacuccaacaaaauaaaaauaaaccaaguaaggggaaaacaugggagauccaagccuagagaaaggcaaaaugagucuccaaaauuaugguaaagggggauccuaagacaacagcaguacaggaugccuagagagaagccaguccacuggaccagguuggagggcucaaagacuuaauauacuugacacauaucaagacuggauauauacagauaugagaaaaguuagggauuuuaguaauaaagcaaaucuccuacugaaacaauauugacccucauaaacugcagaauaucagaucauaucuuggacuaugaugaacgaaccacaacacuguuacgugauccaguuccaucagccaaaaggggacuuccuuauguuauuaucuuuuauccccaauuuuuuauuuugagaccgagucucacucuguugcccaguuuggaauccauugguacaaucuugacucaccucugccucccagguucaagcgauucuccuaccucagccucugaguagcugggauuacagaugcucaccaccaugccuagguaauuuuuguauuuuuaguagagaugggguuucaccauauuggccaggcaggucuugaacuccugaccuccagagaucugcccacuucagccucccaaagugcugggaugacaggcaugagccacugcacccagccuuauccccaauauuuaagaauaaaauuguauucucucuacagaaguaacaugaucacauuuacuuuaaaaaaaaaaaucaauaccaugaauucuugggaaaaaaauaucuaaacuugauuuuauuacagaucucaccaucaguuuauagaaaauauagggaauggaagagcauguuuaccaccaccuagaaauguaagaagccaaauccaaaauauagaaaauucuauugaaaaaaugaaagggaaaaagggaggaugaauuguuauauauuuaaaaaaucaagagauuaucaacuaaaugcaauauaaggacugugguggaucugaacaaacagaugagacaauuagaaaacuuggaccccaacuaaaaauuauaccuuaagaaacuaccacuagucuuucuuaggugugaauaugguauugaaacuguguccccaagaguuaaaagauaccaacaacuaacagaaauuccugaguuugcagaaugguagauuaaacaauauggccaacuagagucugcacagaaccagcuuacugaugucacaggcccaauuuccaccacaauucauucuaacucccccaaauuuacacacgugauccaugaaauaacaugaagagauaacugcacaugcccaaggacuuucuagaccuccccuuuccuuccaccaaucaccuacuaaucccagaaucuauccccuaaaccuuuucuaauaaaauugcugccuuaaagccagcacagauuugagcuggacucaugucuccuuguuggucaacuugaaagaggaagccuuucuuucucaaaaaccugguggcuuagauaguacugguuucuaaugcaucagauagugggcuccuuuuguucuauaacaauaucaugauuaugauuuaaaaacuagagccuguauuacuuaaacauauacuuaaguauaaauuacuauaacgucuaagaucugcuuuaaaauaauccagcaggagauggcuguagacacaacaagauguuaauugcugaagcuaggucauggguacaugagauuuuauuaugcuauucugucuacuguugugcaucuguuaaaugcuuguaaugaacaguuuuuaaaaauucaauguaucuuaccacuggguagucgaagagaagaccacacauccugaacuccccagucuggugugaggggaggacagcugauaacuggauaugcaguguucccagacaucacuggucccaaaccauuacuucugccugccacugccacaaauacaguaggaaugccauccccuagggaaaugacaagaguauaauuaugcuaaacauucaaaacagauuuaaagacaggguuuuuuuuuuuuuuugguuuaaggccuauauguuuuaauuacuugagguccuugaauagucuucucugaaaaaacauaaaagauacuauuauuacacauauauucaaaacauaagguuacucugccacuuacuauaagucaaguaauaaaguagcuggaaucgguuugguuguuuuugagaucuacauuauaaaggggauagcagggugucagugagggaauagcucauaggccucuucuauugcuguauaggcuggccaaagugaagaaugacaccaucugaacaggugucuuucuugacuggguggucccucaacuggugcagggagaaccaguuaauauaaacuagggguuuagggacacgucuucaaacaagaguugaaggaaaguuuaauuaauauagugucccccaaauuuuaaggcccuuugauacauuuuuuaacauaaucucuuaagcaauucauucuuugauaaauuuauaaauuauccuccuguuuccuaaagcagagauuuguuaaccuagaauccaaaauuguauguauuugcaauuuucugaaaagaguucuagaauucauuagcuaucaaaggagucugaguucccccaaccucccacucccccaaaauuaguaacuacacuuccauagcaacaaccuguacacgaaauaaucaacauuuuuuuccaguugagaaacauuugguuguaaacccagggcuccauuauuuuagaucacugcuauaccauuauuuuuuauguacuauauucugaaacuguucuuuaauuuccuaucugacugccucccaggaaaggguggcaacuaaagauucccgggagaaccggcuauuuuaaccucccgccuccuguaacugugggggccuauuuucuauuggaguauauuagaagcaaugcuccaggggcuucuuaccagguaaggaugccagagguucucaucauucuagucuuuguuuucuuuucauacuugcauuuuuaauuauuucucccugcuccuuucuuuucuaagcuucuagaauaccuuaagcucuuuggaggugaguauuaagaaagccuagcggccaggcgugguggcucaugccuguaaucccagcacuuugggaggccaaggcaggcggaucaugagaucaggucaagaccauccuggcuaacacagugaaaccccgucucuauuaaaaauacaaaaaauuagccgggcaugguggugggcgccuguagucccagcuacuugggaggcugaggcaggagaauggugugaacccgggagguggagcuugcagugagcugagauggcgccacuguacuccagccugggcgacagagugagacuccaucucaaaaaaaaagaaagccuaguauaucauguguuuuucccuuagaaaacugacaaagcucuuuuuucagcauuauuagucuaaaguguguaauuacuuuuagcaaaaucagaaauaccugaaauguccauauuacuugugguuuaccuucauacucagcuuuaauccucagaguuucaucugguccuuuaugcgcagauguuacucgaaguucacauggaaugccaaaauuuccacaggccuucuugauuuuuucacagugaccaagaucagaaguagagcccaucaacacuacaacccugcacugacuuucugauuucaaaagcaacugaagaaaaaauacguggauaugaaaagaacauaaaaacaaaaaugaauaaaugagcuagaguuuguaguaaaauuauaucugggcccaauauuuucuuucuuaacagaucaaauuuaagacagagacaaacaacaaaaagacaggauuuauuuuuaaaaaucucaauauauaaaggaaaguggucuucaucaagaccuaaagaauucaauuuuuaucagacaaauuauuuaaaauaaacaguaaagauacucaaaaucuuuuaauuuucaggaaauuauaauacaaaauauuucauccuaagaccuuuagugcacuuuguuuaauggaagcuuuaagguaugauuagccaaaucagaagucauguucuaagucuuuguaaguuaauugcuuguaacucaaaauauauauuccuauaagaauaauguucucaaaugugauuaugacccuugcauaaucacaaaccccauucaacucccagaauuauaguaauaccauaaaacuuaaaggaauauuuaaagucacacagaguuccauccaucccaugcuaauggaacucugacuagcagugcaggugaguaggaaauauaagguuucuccuacgggguagggaggagacagauuccagguuuccccaacaggaucugggagguauguauuggccagcuuaacagcacggaguuccaguauccuaguaaggauagcccagcugauacauuuccuaaaaguguuccucacuuucaaagucacugaagagcugggcgugguggcucacgccuguaaucccggcacuuugggaggccgaggcagggggaucacgaggucaggagaucaagaccauccuggcuaacacggugaaaccccgucucuacuaaaaauacaaaaaauuagcugggcgugguggccagcgccuguagucccagcuacucgggaggcugagcuaggagaauggcgugaacccgggaggcggagcuugcagugagcugagauggcgccacugcacuccagccugggcgacagagcaagacuccgucucaaaaaaaacaacaacaaaaaacaaagucacugaaaagaaaagcacuauacucucccauuuuuuuuucuuuugaaacaagauuuucuuagaagaaaaacacauaauacauacaguuuuacuauagaagguuuaccucuacucucucugcaacccacucaaaguuuuucuuuaccauuuggagcccuucaggaguuacuucuuugaggucccgauaagacuagaaaauaagauagaaaguuuagaaaacaaguaucucuugcuaccugaaacuauuugguuucugaguuuuggggagggauuaugaagaguuuguauagcaagggauacuucugaaaaugcaucuuuucacuuccugaauuaaacuaacaaaguuccauaguaaaguauacuuuuauuuucacuuaagguuaaguguuuucuguacuagcaacuacaauuaacugccuugagaauuuuuauauauuaaguauagaaagggucuugcucuaauuuuguuuucuguuauuuuuuauuuuaaauacaugugcagaaugugcagguuuguuacauagguauacaugugccaugguaguuugcugcacccaucaaccugucaucuagguuuuaagccccauaugcauuagguauuucuccuaaugcucucccuccccuugcuccccacccugcaacaggccccgguguguguuguuccccucccuguguccauguguuuucaguguucaacucccacuuaugagugagaacaugugguguuugguuuuccguuccuguguuaguuugcugaggaugauggcuucuagcugaauccauuucccugcaaaggacaugaucucauucuuuuucuuucuuuuuuuuuuuuuggagacagagucucgcucugucaaccagguuggagugcaguggcacaaucucggcucacugcaaccuccaccucccggguucaaacaauucucugccucagccuuccgagaagcugggauuacaggugcccaccaccaugccuggcuaauuuuuuuuuuuuuuuuuuuuugagacaagguuucacuaucuuggccuggucuugaacuccugaccuugucauccaccugccuuggccucccaaagugcugggauuauaggugugagccaccgcgccuggccaaucucauucuuuuuuauggcugcauaguauuccaugguguguguauaucacauuuucuuuauccagucuaacacugaugggcauuuggguugguuccaugucuuugcuauuguaaauagugcugcuccugugcacgugucuuuacaguagaaugauuuauauuccuuuggguauauacccaguaaugggauugcugggucaaaugguauuucugguucuagauccuugaggaaucaccacacugucuuccacaauggcugaacuaauuugcauucccaccaacaguguaaaagcguuccuauuucuucauagccucuccagcaucuguuguuuccugacuuuuuuaaaacagccauucugacuggugugagaugguaucucauugugguuuagguuugcauuucucuaaugaucagugaugaugagcuuuuuuucauguuuguuggcugcauaaaugucuucuuuugagaagugucuguuguuuuauauaggagcagaaauguggccugguaacaugcaggagacuuggaauagagucccagaucugucccugacucuaguaauugugaagauacccauccucuuaagacccuuaguuuucauuuagccaaacaaagauaauacuugcuguuacuguugugacaauguuauuaagauaacagaugagaaauuugcuuuauaaauguaaaguauuauuccuauuauucuucuauuaggauaccagagacauuuaucuuuaaaaauaaacagcaauccacaaaacagguucauaucauuaggaacaauaauuugcuuuuuccccucaucucuccuuucuccucuaucucagcuugaucucaaaaaggauaaaaaaaccugaagcauuaucuaccuguuugucuuucuguuggcuucgaucuccugauggccagagucuccaggaaucauugucaauaacaucagcaagaacaauuucuuuggugguuacaucaacaccaaauucaaucuggaaacagcaugucaacaaaguuuucaaaaacuauuuuaugaaagcaucucucaacuauaaccuuuacuuucaaauccuguuguuuuaucuguacuuguuuuaucuguaccuucauaucaaccaguguacaauucuggggcaaccaggauuucuccaguauuucaaauauagccuguguagcaugacucaugauauccacuucagucuggccuauaagaaguccagcaaagcaaaauuuugcagcaaucagcuguuccucagaccacugugggucauuauuggcaucauccugugaauaaaguauaguaguacaauuaacuucaaucuaaaauuuuuaaacuuuucagaaaaaccaacauccuuuucaccuugagcaugaacuccuuagaaauuuuuagccacagccgggcaugguggcucaugccuguaaucccagcacuuuagggggcugaggugggcggaucacaagaucaggaguucgagaccagccuggccaacacagugaaacccugucuacuaaaauuacaaaaaauuagcugggugugguggugugcaccuguaaucccagcuacuugggaggcugaggcaggagaaucauuuaaacccgggagguggagguugcagugagcugagagagcgccacugcacucuagccuaagcaacagagggagacuccaucucaaaaaaaaaaaaaaaaaagaaaagaaauuuugauccaggugcaguggcucacacuguagucccaguaauuuaggaggcugaagcaggaggaucgcuugagccuaggaguucaagagcagccugggcaacaaaaugagacaucuaaagaaauuuuuuguuuacgauacuccuuaauucaaagcaauuauuacuccucuuuuuuuuccuaguuagcuccugcaagcagaaaaaacuauuacucuuaauuuguuuacucucaauagcacuuuaaaauucaaaguauuuaggugaguaacuuauucuaggucacaaaguauuucaaagaauuuaaccucuauaaaccaauuuaaacagaauuuaaguuugugauuuuuguuuuuccuuaauaacagucaucagacaugacaggaaggccaaagcacauuuuaaucaaucaaaucuuuccaaaaccaccguucucauaaccucccaaccucacuuuuuauuagaauuuauacagcacuauaauuuuuuagggacauuauuugauaauucaagagaccucagacaaagagguaagugaaaaaaaugaaauaauuucauuuuauucucagcagugucccaacuuuacaugacaauaucuuuauaaauucuugaucuauauaaucauaauacacacaaguuacauaacucauugauuaaaaagcaagacugauauugcuucccaagcagaucuaugcuuaacagcauaaaucaagaugguuaaaagcaguaaagccuacaaaauucauaaccacugauucuuacaaccuuuauuuauauauuuucacuuacaagagacauuguuaguauaguuuuccuguauuagaauauaaaaagauuucaacuaaauuuuaaaaaaauuaacuaaauguuacuuuucucuucuuccuguuagucaucuugguucaaagguaagauuuucagaugcuuucuuuuuaaaauuugauuuaucauuguuaauggaaguguacauuauugacauuggcaacuagauaagacaaauuuuggaaugacauuugcaauaucaaaauaucaaaaacuuugcuugaauauuuaaaccuuuagaguuucuaauuauaaauuuauugccguguuacaguaagacauaaaacagaggcauaagauaauuaccuugaaaaacaacuccacuuuagguggguaaaacuuauauccuuccuugacaccaggauuucuuuugagaaaagaaccaguugcuauucuucugcaaacccauucaauuggaaucauuucacacugcggugcaaugaaagcugucuccccacauuuucuggugaaggcaguuuuaauaccuacauauugauaaccaaaguuaaaaaagguauugaaaugauauguaaaaagguagaucugaggcacaauaaaacucuacccuuuacaagcaacaaagaaccucuaucaaaaauaaguguaauuuuucucuuuauuuaauguagaugcggucaguuguugacucaaacaguaagcagcacaugacuauacauacaauguauuguucagccauaaaaaggaacgaaauuccugauacauccaugcuauauaauauggaugaagcuuaaaaacacuaggcuaaaugaaaaacacaaaaugcaaaagaacaaauacuuacgauuugacuuauaugagguaacuagaauaggcaaauucagacagaaaagagaauggaaguuaccaagggcugaggagugggaggaauaguuauuguuuaaugcuacacaguuuguuugggaugaugaaaaaguucuggaaauggauaaugggaugaauguacaacauugugaaugcacauaaugccacugaauuggacacuuaaaaauggucaaacugguaaauuuuauguauuuaucacaauuuucuuuuaaaaaauaucaggagccuauuuuauggcagauauuguuccaaccauuuuaaauacaucuuuuuuguuuaauccucauaacauuugauaagauacuauuaagaucaacaaaacagguaaggacacuaagacacaguaguaaugucagcuaguauuagguauagcaggauuuccaaccuacccugucucuaggagccgcccacuuaaccacuuugcuguauugccucuccuggaaguguuauuacaucacaguacaaaguaaugcuacagcauuaacaugauuuaaaauaucuccuggaaaccuacauggguuugagauaaugcuuauuuucagccugcauuacuauuuccaaucccaaccuaauccucuagucuaacuuuuauuaucaggaaagaauuggggaucuuugcuguuauauguguaucuguacaugaagggagcuucuauuuauggaaauccuccacugugcuaagugucuuauauauguugucucauuuaacugugcauaaaauuuugagguagguuuuuuuguuuuuuugguuuuuuuuugagacaaagugucacacaggcuggagugcaguggcgugaucuuggcucacugcaaccuccgccgccuggguucaagagauucuccugccucagccuccugaguagcugggauuacaggugugcaccaccacgccuggcuaauuuuuguauuuuuaguagagacaggguuucaucauguuggucaggaacuccugaucucgugaucugcccaccuuagucucccaaggugcugggauuacaggugugagccaccgcgccuggccuugaaguagguauuauuauuuauacauuuuacagugaaaaaaacagaggcucaaagaaguaauuucacacacuaggucauguagccauuugguaauggagccuggacuugaaacgcacuguccaaacccuacacuauuuccucugcccucucuuugaaucugacucguaagacucaaaugaaaaaaagaaagaauugugguauguugcaugaacagaaacccuaaggaaaaaaugaaaagaggggaaguaaaacugucauuuuaaccuuuaaaaaaaaauuagaugcaaucuguuguuuaacuuuuaaugaaugaucaggcucauggauagacaggugacuucaaucaauucucaacuuggggugguaacuacauccuugguuucaagagcucuucucucuuagaucuguuaaucauuagucacauauuugcucauuugucuaccaagcuggacacaguaguauccaauuuuauuguuuuuaauauaaagauaacuucgucuuagagagauccccccgccaaucccaaggagaaccaaaagcacauaaugaagcuacaguaaucaucucugcacaaaaaaucccuaaaaguuucuaaaacagacucaguuuagaugacauaaugauggcuucuaauacugcuaaauaugaaagcaaauuccaugacugugcauggugagaaaaaaauucccauuguuuaucuuaguugucuacaaagcucaaaacucucauucagguuacuaaaaaauguuuaugucacugacacacucuggauuacaaugaacauauauuagcuagaauaguaauucuagcuaauacauauguccccguggccaucccucuuuuagauugguccagaugcccaucugugguuuagcaacuguaguaccguucuucauauacuaguauuacacuuaauguaauuauagugaguuucugugaggaaauugggauuucaucaucacuaagaaggccagauuuuaauuuuuaaguaauaaaaccaaauccacaaauuguauaacacaguuauaacacaguuauacuauuuccacggaaaaagauuacuucuuauuuauauaguccuuuacaguuuguuccugagugacaaugagaaaaguagaauccugauuuucugauucucauuccaaugcucuuuccucucuacuuucuaccuuaauuuggaacacaacccagguuguaaagaaaacaguuuuaaauagaccacugauggccaacuagauaaggcauuuauuugacuaagcaaguaaaaauuacauaagguuuaauggaauuccuaauauguacccuaaaacuagucuguuuagaaauuuuaaaaaauucagguuuacuuaguuucauaguacuagacauaaaaucuggaaaauaucuuucaacauuuccugugaaccaguuaaguuuuagcuauguuaagugccaaauaaaguaguuuaaagauaauuauuggaguauuucauuuagguaaccauccuucccuguuccccugaucacaggacucuucagaauuaaagcagaaaguccuggacaaacauaacacaacugagucacucuaauuuacuuguuauaaaguucuggaaauggauaaugggaugaguguaaauacacucagaaaauacacuaaauaagcaaauaaaaagucaggcuuuaucuuccauuacuuaauauaauccuguagcuaugugaaacuaccaaggguacacagaaaguaaucuucugacugcuaacauuuuaaagaguuaagcacuuuaaaaaauguuuaagugaauggggagaguuaaaacuugggaagaaaaaaaaaaaucgauggaacaggccgggugugguggcuuacgccuguaaucccagcacuuugggaggccaaugcggguggaucacuuaaggccagcaguucgaaaccagccuggccaauauggcaaaaccucgucucuacuaaaaauacaaaaauuagccggguaugguggcgugcaccuauaacuguaaucccagcuacuggggaggcugaggcaugagaaucgcuugaacccaggagauggagguugcaguaauccgagauugugccacugcacuccagccugggcaacaaagcaagauucugacuuaaaauaaauaaaaaaauaaaauaaauaaauagauggaacacuuaucgguauugcaaaaggaacccaaaauuaauuugaugcucucuuuagaaauuaccucagucauugggaagcuaccaaucaagaaaccuugaaauaaaaaucuuagauucugugacuuaggaacucuggaagauccuuuaaauuuacagcaauacacucacuuucacagcauagaggaauuuaugauguagaugacaauccagguuugcaauuaaaucuuuuucacauuaaucaaaauugugaaauaggauacuuuggaagagacaaaacuacgccaagaaugcacugacaauguauuuaaauuacauuaccuuguuauuuuguggaaggcacguacaucuaacuuaacugaaaacaaaagcauuaaauccccuguugaauuuaagaaagauuagugcuaccagaaacucuaagaaaugaaagggcaacugggaauauuggaauuaaaaguaaggaaaguuauuaaauuauaaaauuagaauuggcaagaaugauaaagaaaaagcuuuuauuucauagguaagguuucguagguugaaugauccaaagcaaugaggcuauuuacacuguguggcaagaguucaaaucuuuuccuagcugaaauuucauauacuacagaccaaccagcaacugacugaaucccugcagaaaaccccuuuauccuaauuuccuucccuuugcuucaaauacccaccacacaauguucugaucuucauuuggucuuuugaaucuauuucucuauugaaaauagagccuucauucaguuuuugaacaggagggcgcucugggguuuuaguucaaauaucucacuuggggaauggcaggaggagaagguuugguugcugucuucaacuacuuuucagggcuuucaaguggaagaggaauuugaaauucuguauuaucucccagaggcagaacaaagaccauuuguauagaauuacagggaguaaauuucaguucuucauguuagaacugcuuaacauuaaaauggguuuccuucauaguuaaauuccuuaaagugaagauggccuuggagagguaagcugcacagagagugcaugugccagauaaagauuacagcaaacuuguuaagauuccuuuuaauucaaugauacuaauaaucccaaaccaaauaagguguuauagugaaguuuaaggguucuugguuugauuuaaauucacuuagcuuuugagacaucugcaaacaaguuguucauauuaaugccaacuucacaugaaagacaucgacaugcuuaccagagaaggugagagaagagacuuugagggagcugcuuaccugcuuccuguaauaacugaaaaauacaacuggugauuuuauuugagauugcagcuuuuccuuccaggugguuuuuucuagcugcauuuccugcuguaaucugguccuuggacugcaggaggacuuuuccuggacugucuaacaauucguagacuucuuuuguuuuacccucauauaauuuuuuaccaauguucaguacuguggaaauaaaauggaaauagaccaaaauucagaaacuuccugaaugcugaagacuaaaucaccuagaacaauuaaucuguaaauauacagugauuaaguaauauuaauaaaaauuaaaucaucuguauaaaaccauauacucuacaauguauuucucauaccaucacauuugauucacaugaucuugugaagaauuuuaauuacauaaauaauuguagaaauuaguaaagcagaaaucaaaaggguugagggucaugcaguuaggaaauauaagagguagauaaaauccuaacuccucugacaucaaauccugugcucuuuccacuauuaaccugccucucauagcagaacugaacuagaauuaaaauuaauuaagacccacuuaaaguaauguaacuauacuaguauuuucacagacacacucacaguauaguaucuaaacuaucuugcaggaaaaaauaugcgauuuuugcugauauuugcuuuuuuguaggcaaaaugggaacauucagccagaugaguuucuugauuucaaguuaauauucaagaggaggcaugccaucccauugaaguuagcacauuuggaagcaucccucucuauuucuuaauccugucccugcccccauuaauccuuucucuucacuaacaguuguaagaaauugugaggaagugagcacaaaggaauccaauuuugaugcuggucacaaaaccuaagaaguacacaaaaggaugauuuagagaaagaguaaagauaacagauguuuaggaacuuaaaauuucgaaagagagaaaucaacccucauacuuccacaacacucucaguaucaacauuuucccgguguauccaugugccaagggauguaccaguaaauaauaauuccugcucucaagagaccugagucugaggggagcugauauuaaauaagacaucauaauaauagaaugcaauaaauacagacuaugggacuagucuagacauuagaaaaagaagucuacaagaaagugacagguugaaaucugaagaaucaucgaaauuuagccaaaggagagaaagggguagguaguguugaugaauaaauacaagguggucaaaguggauugcagaacuucagucugguuggagcuggagcucuggguauauguacauugcuguugggcaggggaaggggugggggcugcagcuaaagaauggcaggagacaagacuuaagaguuggacaggggccacaucaccagcuaguggagguaaccauuaaacaaaguaguuguaauuuaguuaacaguugccacuguagggcaccuaauuuagaggaugaaucucuacccucccuaauguaaugucuagacucauuaacaugguuuaaaagucccuuuaagauacagcccuggcuuacugcuccaaacucuuauuugucuauuuccuaucuagaacuccaacaucuuuaauucuuauacaaucuuccccuagcuucugacaaucucuucuuuccuaggccuggaaaacuucccuuccauuuugcuacacauccuucuuguuucacaagccaugcugauugaguuuagacuuuaacccaagaagagcuauaaggcuuuuaagugcuaaagcaaaacgcuauuuggaaagaucauuacggcuucuguauggacaaugaagggaggaaggggugagugaacaaaaacuagagcuuggaagaccaguuaggaugcuguugcaguaacuugaacaagaaacgucuggccaggugcaguggcucacaucuguaaucucagcacuuuaggaagacaaggagggcagauugcuuuagcucaggaguucaagaccagccugggcaacagggcaaaaucccaucucuaccaaaaaaacaaaaauuagcccagcaugguggugcaugccuguagucucagcuacuuggggaggucgaggccgcagugggccaagauuugcacuauuucacucaagccugggugauagagugagacccugucucaauaaaaaaaaaggaaaagaaaaagaaaugucuuggucuaaggaaagaguagugggcaaagaugcaagauauuuaagauaguagcuuugagaauucaucauggaggauaaaagagagggaaggguaaagaacagugggccgggaacaguggcucaugccuguaaucccagcacuuugggaggccgaggcgggcggaucacuugagguuaggaguucaagaccaggcugaccaacaugguaaaauccugucucuacuaaaauuacaaaaauuagccggauguguuggugcacgccuguaauccuugcuacuugggaggcugaggcaggaaaaucgcuugaaccugaaaggcggagguugcagugagcugagauggcgccacugcacuccagccugggcaagagagggagacuccgucucaagaaaaaacaaaaacaaaaaaaacagugcccagaucagauaaagaaauuaacauuuauauauauuaauaugcaguaagcccgggcaaaguuuguaucuaaugccccuccccuuaauuuaguugaaucuguauuacuuagucauuaaagagggaaggaauuugaauuaauggguagaaacaacauaagaaacaaccauacgugacauacccugcaaguaccaaaaugguugcuacaaauuuguagaugaauucuggaaagauugaugaggacugaaaaugauucauggaauugaaauuuaagagucugggaaagcacagaauuuacacaaaggauaagaaaauucuaggacucugcuguccaauaaggcagccacuagaaauguggcuauuacaaguugaaaugucauuuguuaaaauauauacugcauucgauauaaaaaauuguaaaauaucuaaagaauuuuucaucuugacuccauguugaaauguauuuuguguauauaggguuaaauaaaauauauuaaaaugggcucacgccuguaaucccagcacuuugggaggcugagacaggcagaucacuugaggucaggaguuugagaccagcuuggccaacauggcaaaacccugacucuacuaaaaaauacaaaaaaaaauuagccgggugugguggagugugccuguaaucccagcuacuuggggggcugaggcaggagaaucacuugaaccuggaaaguggagggugcagugagcugagaucuugccacugcacuccagccugggccacacagagcgagacuccauuucaaaaacaaagcaaaacaaacaaaaaacaacaacaaaaaaaaccuuuuauauauauauauauauauauauauauauauaaacacauugcaccaguuuuuuuuauuauuuuacuuuuuaaaauguggcuuauagaagacaaauuuacauuauauuuccauuagccagcaauguucugggaaaaauaauauaaauaaaauguauauaaugaaaaacaaacuuuggugaauuaaccugacuggaacauagcuaaggauucacaggagagaaaaaucaaaguuagggcugaagagguagaagggauagcaguauucaggauuugaaugaaaagggauuucagacuggacagacuggauuuaacaucucuagagaugccauuuuugccuuuguugccacuuuugccuuuuagagaccauaaaagugacauuuaagaaaaaucaaccugccaacgguacacaaauggaaagaaguggaagagcaaagauuuuagagauuugccauuuuagagguacagguaccaugauugcaagaaaaauucugguccuugccuugauucuagggaguugauacucaauaucaucugaaucuuuuuugcugagucuacagcuuuuuuuuuuuuuuuuuuuuuuuuuugagacagagucucucucugucgccaggcuggagugcaguggcgcgaucccggcucacugcagccucugacuccccgguucaagugauucuccugccucagguucccgaguagcuaggauuacaggcauacgccaccacguccagcaaauuuuugcauuuuuaguagagccgggguuucaccauguuggucaggaugaucucgaucuccugaccucgugauccgcccgccugggacucccaaagugcuggggauuacaggcgugagccacagcgcccggccugagucuacagcuuuuuaaaaucugaauucaguuacuuucuauguggaaaagaauguacccagcagccacaaaagcaauuugccucacuauacauauagcaacuggguguguggaaaaaaccagcauuuguuuuuuuccagcauaaauagcaagaacaaucuuuccugauagugcaacuuuuuugccuaaagguuuuggaguucuucaaagccaucguggcaucaaagacuacuggaacgaacacacacacacacacacacacacacacacacacacacacaccaucauggcaucaaagacuaccuaaaaacagccccccuccccagccaucauggaaucagacuacuucaacacgcgcgcgcacacacauacacacccaugacaucaaagacuacuuaaacacgcacacgcacguacacacaccccaagcuaucguggcaucaaagacuacuucacgcgcgcgugcacacacacacacacaccauggcaucaaagacuacuuacacacacgcccccuagacagguuuuucuuuuucuuuuuugagacggagucucgcuuugucgcccaggcuggagugcaauggcgcgaucucggcucacugcaaccuccgccuccggguucaagcgauucuccuaccucagccuccugaguagcuggggauuacaggcgcgcgccaccacguccagcuaauuuuuuguauuuuuaguaagagacgggguuucgccauguuggccaggcuggucucguacuacugaccucaggugauccgcccgccuuggccucccaaagugcugggauuacaggcgugagccaccaggcccggccucuagacaggucuuucaaaaguuucaauuauuaaccuucuuagaaaggucauuaaccuaacgggcaaagcaagacucagguuuugacgaaucaagacugauuugcuuguauuuugcaauagcuauugauuauaaauaauacuuccaggcaccuuuccaccccuuggccauuucucguucuccucuacuuugcuccuucuccccauccccgaggcaguaaaguucggggaggcccgggagcgccugggccacgugugcgcccgcgcggcugccuagaggcgcugcugcagggaggcgggacagaguuucgcggcucgcacguggccgcgagcucacggccugggggucagggagaccgugaagggcccggaucccuguuacucacccucagcugucgccauuauccuaagugggcugagggcugcgaccgcgccgggaagcgaggcagaacucuagaaaagagggguggucagagagcuucgcugggcggggaaggaggcggggccgcgcgacccugcgccacucuuuucgagcuccgcuacagccgccuaacccggagggguaugggcggagacugaaacgcggauaucggacgaaacaacgccccacug

SEQ ID NO: 191481 - RNA, 184001 nt, Homo sapiens
gaggcgguggcggcggaggcggcaccgauugcugugucggccccagugcggccgaagucgcgguagagcguagccccacgccccucccccguccgcgcccucccucuuucccuggggauggagaaggcgacgguuccgguggcggcggcgacggcugcagaaggagaagggagccccccggcgguggcggcuguggcgggcccccccgcggcggcggaggucggcggcggcguuggcggcagcagcagagcucgcucggccucgucuccucgugggauggugcgagucugcgaccugcuccugaagaagaagccgccgcagcagcagcaccacaaggccaagcguaaccggacuugccgaccccccagcagcagcgaaagcagcagcgacagcgacaacagcggcggcgguggaggcggcgguggaggcggagguggcggcggcggcaccagcaguaacaacagcgaggaagaagaggacgacgacgacgaggaagaggagguuucugaggcaagggccugguuucaaaggaaggagggaggaagggacuguaagggauaggggccgaaggugggaggggauuuggagugggacagauuccaguggguugaucucuuaggggccaggcuuucgacugcccccuuucuucccucggccuaaaucgugaggugugggaaugugggggaggguagcugacacgugggggugggaggaccacggaguucacagaguuggugaacagccuguuaucaugggauggcucacuugguuaaggauggagggaauugguuagauucccuguuugcacgccgggggguggggggguggucugccuggggccaguagggccaccuuagucugaggcgggaucgggaucaaagcgggaggaguaaaauaauggguaaaugagucucuuggggaccaacuaggagguugaucaacuucucccaguugugagguggaggggagcaguuugaggggggacguaagguuguaauggacucagagcuaaguguuuguguaugugagggacacgugagaagcuguacuuuuccauacuguucugcaggguuuuucguaacuauccuggcugcugaaguaacuucauuuccucgaucucccagggauuuucgaugaacugaugcuguauuuguauaaauuuaucaguaacuuuaaauaauuacaaaugaccauauacauuuguaaguggaugaaaaauauauuugauccuuacacguacauacauacaugccuucgaauguuuccuuagugaguuagaauuaagcuaggaccuguugucccguaauaugggacagccaaaggguaggcuuuggagccaggccugguuguggugaguuggaauaggaaggccucucgguuuguccuagugaucugguuucauaauaacuuuauaauuuuuccuggguccacagacaggcggcguugcaggaccuuauuccucacagaagcccuuacaacccaaaggcucaguaaaacauaccauacugacaaccaacugagaguuagcuuuacuaguuauuagcuguuuuaccacucucuugucuccuuccugaaauagaaucuagaaaaaucuuuauuuggagagggaaaucuuuaucagcagagggaaaacagcuuuaaaggcugauuuuaaacuuaguucuaagaggagaccaagugauucaucuaaaaguaccacuuacuauuuauucucuuccacaaacauggaacuuauuuugaugcaagucugguuuuccgaaaauuggaauuauugaauccuggucucuguugaaauagagaaguaccuuuuaaaggauuugacacaugucuauuuguagaagaccagauucucuuuuaucucagacuggaugaaguuguauagguagagauauuaagugcugaaguauguaugacaaaaauaugccaguccuuguuuuuauucccuuuuagccuguuggauucugagaauagguuuguauugauagacuuauauuggccuacuuggauguuuaggauaguguguugcucuggcggcauuugaaacaaggaagagaaagauguaaugggguccuuaucccuaauaaaauuuguuaugguacuuagaaucauucaauuguaugauucuucucaaaggugagaaacauuuuacagguaauucagcccuuuauuuuaaaaaggaggaaaacaagguuuagaggaaagugguugugguggguaguagcaaaaguacaaaucaaaguuuucuaaugucucagaccuguacacuuuuuaauaauaauuuauuuccuuuuaucacccuccugauaucauucagaaaaauaguuacugaauagcaagguaacacaaucaugcagcuauaggcaaaauaccauuacuuaaaauuuuaaauucucgugaaacuauuaagcucugguuuagagcaagguuaugauaguugaaugcaguacuuacugggauauucugcugcaaacuuaacauaccuagguaguuuuguccauuggaaugcggccuaauaagcagaacuuuuaguaauuccuuaaaucaugaagaauggcuguaaguuuguagguauguuuauuuugugggucagguuuguuuuccuuuuguaauauaggaaugguuauguugacuuucaccaacuaugguaguauuucuauguuuuuaacauaccuuauccugucuuuuacaugguguuaaacaauggguuugucauuuaugaagaugagucaggagaaauacguguaagaaagugugcccauuggccgggcgugguagcucacgccuguaaucccagcacuuugggagaccgaggcgggcggaucaccugaggucaggaguuugagaccagccuggccaacauggugaaaccccaucucuacuaaaaauacaaaaaaauuagccgagugugguggcagaugccuguaaucucagcuacuugggaggcugaggcaggagaauugcuugaacccgggagguggagguugcagugagcugagauugcaccauugcaguccagccugggcaacaagaacgagacucugucucaaaaaaaaaaaaguguacccauuuaaaaaaucuauacagaugagggaugagcagacaaaaaggaguacagauugucucugccccaucuucaucuuuugaucaaaguaaagacaaauaaaacuguaagcuaaaugggugaguuguguaauguuuuucucuuaauuaccauuuuacugacaugucagcagaagccuaacuuucuggagcuaggaagucuuguggcuaaaaucacaguguugucuuuucucuaauucauucuguuauaggcuacacaauaaaaaaaaguagauaaaaugaucuuuaaaauuauccuuccaguaaaaaucaucaaaagauuaaaaaggaaugugaaagguuaugguuuugugguauuuaaccugaaaggauaacuuuaauuuaacaaaaauacauagcuuugcuauaaagaaaugcuaucugaauaaucucuguaucugccaaaagaggaaaaauggaaggaaacgagaaucaauucaaauaagagcuucauuuaauuguugaacaauaagaauauaauuucuagacauuggaguagguuauugagaauaggauuuuacuuuaaaguauuucagaauaggguaaucacgucuuagauaauuugcauaacuucggguauaccuggaaacaaauaagaccaagagcuacuugccucccucuccccaucuauuugacacaaaaucuuacauuuaaaauugaaaaugcauaauuuucuugguuuucagugagugacugaccaauauggaaaauacaaauauauuuucuaacauaaaagccaugaugcucuuucaaauuaguggacaaaauuaauuaaauugcuuuugacuauuacaagaaaaaaaucuuauaauuucaagaguugauacuuuauuuuagaaauaacauugcauucuauugaaugcauuuuugaauaugacugaaugaucuuaguauuuuuucuuucuuuuuuuuuuuuuggagacggaguuucgcucuuguugcccaggcuggagugcaacagucugaucucggcucacugcaacuuccaccucccggguucaaaugauuuuccugccucagcuucccgaguagcuggaauuacaggcauccgccaccaggccuggcuaauuuuuguauuuuuauuagagacaggguuucaccauguuggccaggguagucuugaacuccugaccucaggugauccacuggccucagccucccagagugcugagauuacaggucugagccacacugcgcacugcaaucuuaguauuuucuaaggcagaauucaaagggggagaaacauuuuuguugaagaugcuuaaaguauaaauacaguaggaguugaucagaauuucaucuguuuuuguaaguaaccugugacuaaaucaagagauaaaccuagugaagaaauuuuagacaaagggagccgguaaauaaauuaguacugacuuaguauugaaaggauuugcaaggccagggaggaucuguuuacagacagaaaaagagaguugaaaaugagggagaaagaaaaaauauuucagaauuaggcuguguucagcuucauuuggaaauauucuuguuuguuuuuuauuggaaaagugcuaucuaaauuccuuuuuuguaaugcuuagaauccuagauuagcccagagaagcuugcuuguuucaucucuuaauugauguagcaguauuuguaaacuagauuuuaagaucuuugaagcaguagucugucuuaauuauaauuuaucuugucuucucuccugcuuaagcacaguacuagaaaaaaacaaaacauuuuuagugaauaacuaguacuuagggaggauucagcauucauuuagggaaagaagagaaggaauggaaauucuucccuucuuggauccagggcuucugaauagcugaaguucagauuucaacauuuuccaauuucuuaauuccuuuucguagugaugaugaucuucucuaaguauuaaggggagagccaguuaaacuaauaggaauugaugaaugccugguaaguaccuuaagccuccuaaaauuuuuaaagaguaaauaaaaaugaauacuuauucaguaccuacuguuugugaagucuagguaaagguuaaaaguauggauuuuggagcuuggauuuaaauccuugauccaucauuuacuagcauugugaccuuggccgaguuuuuaaaucucuacugcaauuuccucauguaaaugguauaaaugguaaugauaguagauucuaccuuauaacauuguuaugagaguuaaaugaguuaauacaauuuucucguauucucauuuuauucuugccauaacccuaugaaguaggugcugcuauauuucuuucauuauucaauaaauguuuggaguuccuacuaugugcuagguauugugcuguacugcgugagcaauggugaacaaaacuuguaagucaccuugauuuaaaaauacaccaaugaauaaauauuauaaguuuggggaggugugagagugagcuuaagugguuaaauguacaucuugaauaaugugugaguuucaaaguauacaaauguuggcagggagcauucauuuuacagguaaacauacuggcauagaaggauuuuaggcaaccucaucagggucacauagcuaauaaaugucagaaugggauugaaccugggacuguuagauucuacgccuccucauucauucauuuauucucucacucauucacaugcucuguuaugcuguaugguguugaguaccauauuucagauauuggcacauucggcuuguauaaggggagacgcuuuuuugcaguuggacggccauugaagacaaguuggucaccccaaguuuucuuuccaguucuucugaaaaacucacuaaagaaaaagaaagcaagaaauacagaaaaguauagaaaaauaauccauauucccaccaccuagaauuaaguuguuaacaagaugaaaacuucauacugaaaaaccacccuuucuagaggcgauuuaccacuuauuccuugccuuucaaaauauuuacuuuucaagguaaucucuccuuauuaauuugaaaaaaaaaauguuucuuuuaaauagagauuguuaacuuggggucuggcuaggcugugaauccucugauauuaaacaaaagauuuuguugaaggugcuuauaaggcuuuauuuuucuuccuuucugcucuagccccauaugugcaggauuuucauuagauccucaaagaguucugugacccccacccucucccuccuaccuuguuacuuugaaacauucucacuacagauuuaguggggaauuuggucauuuauuuggauuauuaagaguuuggaaacugcuucuaacuaagcagaugaugugguaacaaagaaggcuuauuugugaaauaguggguccaagauugaucacaucuuucugguaaaccagccuuaugccuacucucuuuucucuuauaucuucauguuuugcccuuuaauuaaugaagcaguuuacauugugugcuguggacugucauaucugaaagcaaaagccuugucuuacucaucuguauaucuccugcuauacaguaccaugugucuuauguaagucuuuguaucucugcuagguucucaugaagucccaucucuguaguaagaauaacucauaaauauuucuuuauuagccaccuacugugggaaaucuuugggacuucaagucuugagguaacagaacuugguugcagcuauuauuuacaguagaucccugugggauguuuuaauugaaccauuauuuuuaguuuagucauuuuuaaccucaccaacuuaacuggaguuaguauugugaaaguuuucaguguuuaauaagcaucaaaguagcauauuuugacucucggaaauucacuagacuaucuguuucugcuguuaccugauuaugccaucuaguugauuaggaaaacaguuuuuagguccuugaggcagugcaguugcauuuaugacaguaguuuaucugaauuuuuauaaggauaauuuaauggguuaaaaaauguggauuuaaugaggaccuucauaauuuuuccauacuugaccacagaugaaagggaauuuuuacuucacauugguaugcgaaguagugccugcugguaccacuuauauuuuuguuaggaccaguaggaggcaccaacauccaugguguaaccuacaccaaaccuaacuuuuuucagcuuucaucuuuucaaaaaaaaaaaaaaguaagucauuagggaauugaaggugguggguaaauacgaauacccuucuagucccuugaaucuuaccuaucugguacaguuauguccauccacuucuuacccagaagcaaaauacccuuucugacuuaacagugcuucacuucuuaacauuuuuuugucuuuagaaauuauuauuauucauuccugaagggauguagaguugugggacaauauagguaucauuuuuauaaugauuuauaauuugggguuucaguuauugaaaagggaaauguuaacuguuauuuuccccaagcaugcuaugaaacuucaaauaauauagcucuaauuauugaaagcauaacuuagacugccuucuguccugugaaacucauaaacauuacaugaucuuuuaaaggagucaacuuuuuguguguguguagagauggcgucucacuuuguugcccaggcuggucuugaacuccuggcuucaagugauccuccugccgcaggcucccaaaaugcugugggauuauaggcgugagcuacugcauccagccugggguuaguuuuuaaguuuacuucugagugagacuagagauaaaagagaguggggagaaggaaauguaaagauuuuacauuugaaacaucagagugcuaaaaauagaaaaauuagucgggcguaguggcucccgccaguaagucccagcuacuugggaggcugaggcaggagaauugcuuuaaccugggaggcagagguugcagugagcagagaucgcgcccuugcacuccagucugggcgacagagugagacucugucucaagcaacaacaacaacaacaacaacaacaacaacaaaaaccguuacaguacuugaggaauuccuauuggagccauuauuagugucuuuaaaaacaacucuuuuuuucuguuuuuuuuuuuuuuuuuuuuuuuuuugagacaaggucaucuaugcuggagugcaguggcgugcucucggcucacugcaaccuccaccucccggguucaagcaauucucaucucaccuuccugaguaucuggaguugcagcgugagccacugcgccuggcuaauuguuuuguauuuuuauuagaguuaggguuucaccauguuugcccggcuggucgcaaacucccggcuccaagugauccgcccgccuuggcccccaaagugcugggcuugcagaugugagcuacugugcgcagccuuuauaaacaauuuugauauauggugaaauuucucaaagcuugcugaucauagugaauuaugcugauaagaaugggaaacaagauuauugggaauaaauugaaaaauauuaaauagguuuuuaugcgucaaggguaaaaaaaauguguuuugaguaaaugaucugaaauacagcaugcuuuuuugguaaaagcuuaguauaauguagggugaaguuaaggcguuggcgauaaccagaaucauaauucucauuuuaaauaaugcuaugcuacaucugcacaaaauagauuauguauauuuuuggcugcuguaccaugaaaaugaugacuaaaacgaggucuagagagggauaguuuaaaaaugaugguagggcuagagauggaauccaugauugaggaggacuguagauuuuacuuaacuauauucuuucuuuuuaauuuauuuuuauuuuauuuuauuuuuuuugagacgaagucucgcucugucucccaggcuggagugcaguggcgccaugccgucucacugcaaccuccgcauuccagauucaagugauucuucugccucagccucccagguagcuggggcuacaggcgccggcgccaccacgcccggcuaauuuuuguauuuuuaguagagacgaaguuucaccauguuagucaggcuggucucgaacuccugaccuuggauccgccccccucggccuuccaaagugcugggauuauaggcgugagccacagcacccggccgauuuuacuuaaguauauucuuauugcuuauuacuucauacucaaacugacuuauaagguagagaaaaucauaauguguaccagauagugcuauuucaguuuagaaaauaaauucauuuuuuauuucuugagauuauuugaaaguacauuguagaaauggcacauuuauggaacugcuuuauggcugugccucucuugcagggaauuuugccucccccuuuccuuuucccaaaaauacuauuagcuugccuaauuuaaccuuucacuuuuuuuauccccaucuucccccacaaaagaaaggaauagaaaagaaaaauacgaaagugaagaaauaagaaccugcucuaaaguuauuucuuggucuggguuucuuuauggaucaucucuuaauuagcuuaaaaacauuugauugaaaccuauuuuggaaguaucuauggaaagguugguuccauuaguuuggaauuuagaauaaauauauguuaccauagagaucuauuuuccuuucccucuuuuccugucaaccuaaaugugaagauugacaagaaaaggaagcccaccuguuuguguuacaguuaguguuagaaaugccuuugaccccauuguugucucuuucuuucucugugccauguuuauuuuuuuaauggcauuaauaaugaaaacagucuuguuucaaagccucuaguauagcacauacuagaauuaacuccuacaggaguuaauucuuuuaccugacaaacauuuauuaucuccuauguguggcuguuuucauugucuaaucugaacuauuuccuucccagugaauaugaaaaaaaauuauauuuaaaauuauagcuguauauguuaaauaugaauaaguuaauuuguacauauuguaguuaguaaaacuuacauacauugaaacuuagcacaaugauagaauucaguuuuccacgugauuauuagcuauuaucuaaucuuauuagcuaugauuauuagcuaauaguuuuaucacuauuaguauacucucugaacuaaauuuauuuaagaagcauuauuaacaucuagcaaaauuaccuagguauuauaaggguuuugaagaaauggggacauuauuucuagauucauaaaauuuaaauuuuguugagauaaaacuaguaauaauuuaaaacugugaagaugauuuuagccccguauaaauccuauacuuuuuuggggcaucuauguucauuuuugguguaacugugugccuuaugaucauagggaucauuuuguuuugguuuuugaauacuaguaggguagacuuuauaucuuuuaugagugucuccuggaauacucagugauuuuugauauuuuguuuguucuuaagaugaggucuguauguacgauuuuucuagaguguccuugacaacuagauuauacuaaagagucauccauucuaauuuuaccuugaagguuuuauaguaagaaaggagaguaucuauauuaauauacuugugauugaugcagguggagauauguuaaaauaugaagauugaauuacaagacaguguaggaugaaaauucuuaagauuuuaaauauagcguuacauauaauuaaauguuauucauuaauuuauaccuauuuguagaaacacauauuugcagaaaacuugacaaacucaaaaagaucuaaagaauagaaaaaucaccuauuauucugucuucagaauuaaucauuaccugaaauacgucuuuucauucuuuuuccuuguuauguuguagugaaauuaucacaaagagcagagguaccacuuagaaauuuugcuugcugaaauuuuuauugaugagcuuucuucaaauauaucaauugaagagaugagucuucagauuaugauuuuuauauauuuaaaaauaaaaacuaaugacgguauuuauacuuacaaaaaugucuucuaguauauagggcuuuuuauuccauucuuagaguaaaugcugcuaacaguugguguauaucaaauguuuguuucuuucuugagacugagugcguguguguguguguuagaguauguuaauauuugccacauuauucucauuuacuuaugaauguuccauaauauaaauguucauaauuuauuugaucuuuuauuuugguagacauuuagauuguuuucacuacauugcuauuagugaagugaacauccuuguacaguuauuuuugaguaugaaacuauuucuuugggauggauuccuggaaauggaauuguugggcuagaguaugcacauguuaaauuugauaaauacucucaaguuuugcuugcaucagcaguguaugagaauguuccuagaugugguuaauuuacuuaguuuuaaaaaucuguuaaacaaaaaaugguguuuuguuuucauuuuucugauuacugucaacauugaguauaaguuuuuuaaucuuuguuuuucauuuggaugucuugaaaauuuccugguuuauccuuuaccuauuuuucuauuaggauugucuuguuguuuucuuauugauuuguugauaguauuuauaguauuaauuuuucauaguguuauguguuacaguauucucccuugacauuguuuucacaacauggaaaaauuuauuguuuaguaaaauguauuauucuuuuaugacuucuggagaacuuccucacuccaguauuuaacaauucuuagaaauuuuucuuuguacuuuguuuuucaaagauacauggaucucuuuuuggauauaguauuuaauucuugugucuguuucuuauuuacuccuuuuuauagcaguugacugauucuugcuucuuaaaauguaauccucucuuccucauguaauaccaccuucuccuguuuguaccucacuguuuuuuguuggucaucuugcuuccuuuuaccccgcacagcaaacauacuuugauuauuuaccucauuggacccuuuucuguuuugugucuggucucauuuagaugauuuuaacuauugugucguuacauaucuauauaccagugacuaucagguuuacagcuccaaccuaaaccuuuguuuuuuuugagaauugggcucacccuucuggccaccuaccauuugugcaaaccuuucuuccaacaccuaauuguuucuuuccucaagagaaucaauucaaagucccauccaguuacuacauacagcuccaagugaaagauauauacaaaaugcuuuuccuccuaauucagagaauucuagugaucuauaaagcaauaaacaacuaucucucccucuuuucacccaacccauuguguaguagugaguaggaauaggauaaucauaaugaaaacucuucuagagaagggaagaauaggaaguacacagcagucauugguacauauuaauaaugaaauccuucgggggaggaguugugacaacuuugcucuggcuacugaguaauuuucuugguuauacugauuuuccucuaugagaggaaugcucuuuucacugcugucuguuuccuuugcuuaguucuuuagaugauucuuucuuguuuguuaucuuccuuagccacauuugaaguaguaggcauuggagggugugacaucccuaggaaguguacaacuuuuguagcccccuaccuguugguauagaugcagggccgguaggguuacuuaaaguucaaguguaagauuuuuaggccaguaauguaguuuguugguaaaacucuuucaaaaacauaauagauuucuuuucuguuuuucuuagaucgggacuauguaacaauaacuauagcaaaauaucucuuaguccuaaguuuuggaaaccagcugauucucuuauuuacuggucucugugcuaggcuagcuccucucucccuuagguuuccuggcuaccucgagaggaucugaaauaauagucuuggaugauguaucaguaaggguuuaaccagagaagcagagcaaguagauuuauauaugauuguuauguauuaagagauuuauuacaaggaauuuggcuuacaugauugugagggcuggcuaagcaagugugaaaucuguacggcaggcaguuagugggagaagauugugggcaagguggaauccaugggcuuaggcugaagcuguucuccauaggcagucaggaagggaagauacagcgaagagagaacaauuguagacucagcugcuguuuggagucucauuugcucggaagaaccugaucucuuuuaagagcucaccugacuaggucaggcucacugaggaugaucacccuggcuuaaagucaguugauuaggaacuucaauuacaucugcaaaauccccucacagcaguaccuagauuagcauuugacugaauaauugagagaagguauuugugcuacaaaaugucugcuguccugucuucuuucuaagaagaaaccauuacagguggaaaagcaacacucuuaacuugaucuuugcuacuaccugacagagaacccuugaacucacaaaguuauuuccugguauuuagagcacagaagcagcugccuuuuccauccugggaggccccaaauuacuggacucuuguaggucggaguuugccacugagaaagcuucuuuuuaguagcacuguuuucaugucugucucugcuugcaaacugcuuuauaggugaauugaucuuucuuguugaucuuuaaauagccaacacaccauauuucgaguuuuucuaacugcuuuucuuagaacuacaaacuuaguaggcauaugaugugcccuuccaauuauugcaggcaagaguuuuacuaaauguucugcaacuguauagcacagaucauuagaucuccagccugagauguuuccuugcuaccuguucucuaagccuuaccagagauuuuaggaguuuguuagagcagcgugucauuuccaauuaacuguauuaguuaagguauaggauggaucauuugaacaaagagacuccagaacacaucaggcaagauagaaguuuguuauucuuuuaugugcuacuccagagguagaccuucagguuauucacacaucuaaguaucugcugucuugcacuugauacaccaucccuuaaucagugcuguccaauacuguagccacuagccacagguugcugcugagcucuugaaauguggcuagcgcaucuaaggauuugaguuaaauuuuuuuuaauuuuuaauuuaaauauuacauguagcuaguggcuaccauauuggagagugcauauguagaauauuuccaucacagaaaguuuuauuggacagcucugcuuuggaguguucaucuacaagaucuacuguggcucacuagcaucauguccauguuucagccuguuaugggcugaacuguguguccccaacauuaauauuaauauuuugaagcccuaaccccaaguauuucagaaugugauuguacuuggagauaaguccuuuaaaaauguaauuaagguucaaucaggucauaugagugggccuuaauccaucugacugauguacuuauaaaaagaggacauuugaacacaggacaccggagauacaugcccacagagaaaaggccauguggggauacagcaagaagguggucaucuguaagccaaggagagaggccucaggagaaacaaaucugcagacacccagaucuuggacuuacagucuccagaacugugagaaaauaaauaucuguuguuuaaacuacccagucuaugguauuuuguuaugguagcgcuaguaaacuaauacuggagaaauaagaaacagaaaggucagcauagguaacuuccuuuugaggaauugaccaacaaguugccaacgucauuuuccauuauaucccauugaccagaaauuucuuacgcagccauaucuaagacucagcucuugcugaguggccauguacccagguaaaacuuguggagaaguagucuuuugcuaaaagaaggggacuguggauauuggaggguaauuaauguuuuauauugauacaauucuaugauuauauuguccuuaugacuaccaaaacaagaaugaaagucauuccugguuccugaaauaaucuugugggccaagcuuuggucauguguccauucuugaaccagccacuaucacuaaggaaaaagaugcuuuguuuaggacuaggucauguuucuccacccuauguaggagguagacuaggagagguccauucuaccuccaaaauaugucuugaauuuuucuccuucucuccuucuccacuaccaucgccuuaacccuggcuauuuucuuacuugaacuucauaguagccuccuaauuugaucuccuggcuuuuucuccugaauccccauucuucauucauucuucacguagcauuaggcuaaucuuucugaaaugucauuguuauuugauuucucauugcuuuuagaauaaaauccaaacuccuaacuugccccacagaacuuuguauggcugcuccuuguuguuccagcccuucuaguuccuugacugucgucuaguagcacugacccuccuuguuuugaaacaugcagacuuucuagcuagggucuuuuuacuuucuuccuagugugguguuccccugguucuuuguuuuuucucauccuuuaguuuucagcuuagauauccuucuucguccaguauuguuagagggaacuuucuccccuuacaccacuucuucuuuuaccucccuuuuaguuuuuugccuuaacugaguaaguugcacuguagugaaacauaggaaagagcccuguugguuuuucaccaagcuuuauuaguauuaaauauuuaguaaacucuuaugucuguuucuuacuacguggaaagaaguuuguggguggaaguggggugggagacuuugagugaauuucacaguugaaccuuggcgaaauuauuuuuauaagccacaagucauugaauaucugguuucauaugauucagccuaauauguuagcaugguuugguaucuuagaaggcaguucucacucauugagcuucuuucucaagaguuuuggauauuguucauuuaacaugucagacaugcuuuagaaucaucuuuuguacgugaccaugaaauauucucagauuauacauugaaauuuguguuaauuuuggagagaaauauauguauaauacugaauauucccauucggaaacauggcauacuuauguauuuucaggcccuucaucugucuuuaauaaaauuuuaguuuuuguauagauuuuacacauuucuuguggaauuuauuucagauuauuuuauaguucuuccugcuaucauguaugguauauuuuauuccauuauacuuucuuaauuaguuauuguuggaauauaggaagcuauugauuggcauauuuuaaucuuguauauggccacuaaacugaauucuuguauucaguuuauucuguugaauuuucugacucaaaugucauauugauuccaguaaauuauuuuuucucucauuuccaguauuugucccuuguguuuguuuuuguucucuuauugcgugaguuuugaaccacccccaaaauguugaaugucagugguaacagagguuauacuugucuuucucuuauuuuuaauggaagugcuguuguuuuacuacuaaguauaaugcagauaucuuuuaucaauuuaggguacaucacuuuuucuuaaauuacuuaaguuuuauuagaaauaauguacuaaauuuuaucaaaugcauuuuuggcaucuuuugaaauggucaguucuuuuucugccccuucaguauguccauauggugaauuguaauaaaagauuuccuaauuuuaauuguguuuugaauacuugguaugaugaauuauuuuaaugcacuguugguuuaguuucauuaauauuuuaauuuauauuuucuaugaagauuauucauguuaguuuuucaaauuuauuugaagaaacuguaaauauuuuuuccuuacaucaguuuuguaaagauacucauuuuacagauucaguuuaugugcauccuuuuuccuuuuagucuuauauguuguguuuuuaaccuuauuggccacugaaauguuagaaagaaguuagaguaagugguuuauuugaucuuuuuauaguuuaguaauuuuuuaaaaaguggcuuuaaguaauuuaguacauaccucuuuuuaaaaauaauaacuuacuaguuaguuaauauacuauucucgagguucauuuauguuguagcaugugacuggauuuccuuuuaaauauuccauuguauguauagaucacauuuuauuuauccauucauuaguuaauggaccguuuggguugcuuccaucucuuggcuagugugccucuuaacuuuuacauuuuauucauuuauuucaaauuuauauggguucauugaggggaauaggaacuuaaucuuguauuuccaaauaguuaaucaguugacuuaucuguuucauagucuguccucauuauuugaauaaugccuuuauuuuauguauuuccacaauacaacaauaaaccaaauaucugcucaguauauacaucuuuauaaguacugaauuugggccgggcacgguggcucacaucuguaauccuagcacuuugggaagccgaggugggcggguugccugagcucaggaguucaagaccagccuggggaacauggugaaaccccgucucuauuaaaauacaaaaaaaauuagcugggugugguggcaugcuccuguagucccagcuacucgggaggcugaggcaggagaauugcuugaacccgggaggcggagguugcagugagccgagauugugccacugcacgccaaccugggugucagagcaagacucaucuccaaaaaaaaaaaaaaaaaaaagaauaaguacugaauuuauauaagcugaaggccugaauacuaaaauuggcuacuuguacuaagcaguuuccuguguuuguuaaguagcuaacaucugugugggguuuuaugguuaaaggaauuuuagauguuuuccacuuaaucaagucaguuauguguuuuuuuaaauucuaauuuuuuuaggcacagggucuugcucuguugcauaggcuggagggcaguggcaugaucauagcucacugccgccucgaaauccugggcucaaguguuccucccaccucagccucccaaguaucugggacuacaggugcaugccaccaugccuagcuaauuuuuuuuuuuuuuuuuguagagauagucuugcuguguugcccaaguuauucuagaacuccugggcucaggugauccuccugccuuggccucucaaagugcuaguauuccaggcaugagcccaugugcccagccaagucagugaucuuuugaagcaauuuuucuucuuuuauugcuuaaaccucuaaacaggcuugacauuuuuuuuucuuuucucuuucccucccuuacagauucuaguacagaaguacuuuuaugaagaaaauauaagcaaugccagcaucuauauaguguucuuacugauuugaugaugcccuuagguugucuuugaacuugaaaaucucuauacauuauuauugcaggaccuauaaacuaugacuguuguguaguucucuugcacuaucuuuccaauguucuuugaagaacuguuucacuguuuauuuuaucuauuucaaaugaacuaggaguaauuuaaaacuuacauaguugcuguucagaaaaugucaaaaaagaagagcuuguauaagauacaauguagauaaauuuaauucuauugaggggguaauauccuuuuaagauacaauguagauaaauuuaauucuauugaggggguaauauccuuuaaaccaaacuugucuaaaguuuucaccaaauguuaaacugugaguaauguuuucuuuuuauuuauccauuugauuuuuuuauauuggaggaaucuuaaaauugcaguaucuuuuuccacuuuuauuaaaucauauaguaacugugaacugaaaauuuaaacaguagaggaagauacagaguaagaguugaagauuuuuuauaucccuagguguaaauuguaaguguauguaauccuaugccuuuuucugugcauuuucacacauauacagauauaucuauguaauuuuguuuugcauaaaugagaucauuauaaaaauauuguuugaaacuuucuuuuuaaauuaauauuccaucauagauuuucacguuaauacacauauaguuaucuuaguccuuuaaauggcugugaguauucccuugucagguaucaggacuuaauugcuuuccaguuuauggaaauuuugguuguauccaaaguucugcuguuacaaacaauacugaaguggacuuuuugauauuguuucuguauugugguaagauauauuccagagguaaaacugcuagaccaaagguaugggaaucuauuucuguaacugacauuuuauugugugucagcacuguauuuuaaaaacuagugauuuuguagugguauaggaucugauaggucaaacaucagcuuucaagcccuguucaucucuguucuuucuggauaucccucucuguugacuacuuuauccauaaaagggccagaucauauaucaccucuuuccugaagguguuuauaacaccuagaacauugaauaauuuuaaccccaguaauaguuuagugagugcuuacugugugccagccacaauucuaauugguuuauguguauuacacugcuguauaucauuuaaucuucccaguucuaagagguacauaguaucuacacuuuguaguugaaaaaaucaagguaaagaauaaguaacuuguucaaggucacaguaagugauggaaauggaauauaaacauggguagucucacaugaaagucugcuuucuuaacucucauauuguacugccuucuuaccauccuuuuauggccucccuaguaauugcucaagaaauauguuuuguaugcauuguagaguucacuagccauuucaucuugcuucuaaguccucuuuacagaucuguaugaauaccgucuuacucaaauuuauguauagugaccuauccccaaguaggauaaccagagagaaaugauggaguaaggaggguuauggaagaccuccuuacuccaaaacacuuuaccugaauguagcuaguuaauacugcucuguuuuauuucaucuuguuucccuaacuccugucuugggaacauucauggauuaaucuugggauggauuucauagguggaauaaaugggaaugucacucuucaauauuucugaaacaucaaaucaaaauacauaccuuguagauuaccucuuacaguaagugcucaaaaugugaagugggaagaaugcuguuuuagacccuccuauaccucuuaauucaugcuguuagguaagugugacauguaaaaauuaaauaucucagucucucauaaaaggggccugguaauacuuucuuuugagggagguuaggugaccuaauguuugugaaaauauuugugaccuauaaggauuuucauaaauuaauuguuaaaacugaaguaugaauaaaaauagagagucuuaugaaaauucugacuacugagaugguugguuuuuuuuuuuuuuaauuuaggagaaucccuuauuuuaaauuucuaauucuauuaaauuugguuaucuuauugaauuuauagauugcuaguaaauauuuucaguucuaauuguacauuuugguuaauuguuuuagguggagcugauaguagauagguuaagggguugggauucuguaaugaacaguucacaaaauaaugguuguauucugaauuuguuaaguuuuuagaauuuauguagaauauguucuuaaauuccuugagaacuuaaaaauuuguaguacuuuaucauacuguuaauaaagagggagagauaaggguuaugggaaaugcacauccuuuucugacucuuaaguccuuuucugggaauaugaaagcaaaccauaugccuauggcgucucugcuauaggcuuagcagauaauacuaggguucuagauaaaaugaaaaguaugaaggcaaagauuugaucaugcuguuuucuaaaucucaggaccuuuagaauguaucucuaacucacuuuguggacuccuuucacuuguaccuuuucuuccuuuucuuacucugcauccagauccccaccucacaguccaagauccucucuaccacucaguccagcuuucuggcugccaccuaaacuucaguaccuggcuucucuuggccagaucgaaggacuguaauaugauuuaaguugugaauaugccuuaguaugugagaugucuuuucauaugagggaguucuuaaccuacuuuagcuuaaucaccagauccuuuugucuuuuaugcuaacacauaaaaaacacaggcuugguauuacagcuuuuugucuucuaugcaugagcaguuuuguuuuguaucccagggaucccagaagaacagcuuugcuuggccaggguacccauucauuggcuuaggcaaccuagaauguuaagauucauauaucuuaaucaaauacgaaggucuuccugaccucacuaccauaagcagaaguuuuucugaaaacuuugaucagagagcaaguaggaagaagggccagauuccaguuucauuaaaccacaggcauaugaauacuucacaguuucugugcuugacaaaaauuacauuuaauucugaaauaacccaaugccuuuguauuucuuuucuuacacuauuucuccaggaaaaaagcaugauauggaaagaguuugaaaucaaguugagccacuugcuuuugaauccugcuuuaacacugugugauuuggggacaguuacuacuuaaccuuguugucuucaucuaccuuagggcuaaugauuuauuuuuaacagaguuuuucuaaagaauggagguaaucuacauuauuuagcacacuauacuaccuucuguguuggagguaauuuauuacuuauuuugacauuuuacuggauuuaauucuuauauacuauuuuggaaugaaguugucauuuuuuuuuucccagucaggaucaauuuucuuuaccuuuuuuaggucauggacuuuaguuagauuauaaugaaaaauguagaccuauucuccuccaacauuuacuuaaauacaucauacaacauuuugccaguuguuucugggauauagaguuuuugaggcauagguauuugaggugugaaccauacaauaugaaccuuagcucaagaggacuggauuucaggcugguugcagugacucacaucuguaaugacagcccuuugggaggccaggaggauugcuugaggcugggaguuugagacucuccuggucaacauagcaguaaccaucucuacaaaaauuuaaaaauuaggugggugugguggcacguacugguaguccuagcuacuugggaggcugaggcaguaggauugcuuaagcccaggaauuuaagguuacaguggcaaugauggaaccacugcacuccagucuaggugauggagugaaacccugucugaaaaaggaguacuggauuuuguuuuuuauccauugaggaguuauugaccauccuuuuucccuacucuguccccaguaaucacaacaguagcuacagaauuuuucuuugaaagguuucugucauauaagagagcuuuaaaaaauaauaauuugcuagaaaauuuuaaauuaugguugggcgugguggcucaugccuguaaucccaguacuuugggaggcugaggcaagaggauugcaugagcucaggaguucgaaaccagccugggaaacauagugagacccugucucuauuaaaaccaaaaaaaaaaagaaaaaauuuuaaaucauuacgaaccuucccuucuuccuucuuuuucuuucugaaacuauuggaauccugacuuagaagaaaacuaguaaagagauaauugguuuuuauaucugccuuuuuucccucugaggguggaaagauaagauguacuaaauaaaguuuauagcuauuuccuuauuguauguuuaacaaauuuuaaaaguauaacucuauuuauccgggcuuauuuuaguuauugacugaaauuuuuaaaaaaugguggauuuaguacauuccuuuaauuucuuuucagugucccacugauauuguuuaaagauugaauuaagucauaauucugaaaagcgggaacagauguuauuauauuagucaaacuacccuuaagaggaacaaaaggaccucauuagcucuauaacuuuaauguguacuuggguguauguggggagagagguaagaaacuacaacuuaggugcauagauggaucuaaacuugaauaguguuaguaguauggcugcaacccuguuacugucucaacauuuuuggucugcguuuccuucuguaucagcuuuauuuucagccaaagaugacugucacucaaaggagaugggaaugggauauucuagccagaccuagguauaguggccacuccuguggugacugggaaggcucaccucuacccaaagcacaugaauacauuccccauaaaaaagagggaugauguuguuagcaaaaggggucagggagaaaacauguugaacaguaaaauuacaguucacaguccacuacagguaccaucagaggaccaagaaauuuugaagaagauagaaaguucauggaaucggauugacagcaaaaucccagaggaaacuggaacccaagauaacagagguaagcucagguuuucccagggaaaccuuggaauggcuccaaacuuggagucaacaaacaccaaucaguaguagugggcaguuggguaauacuuaagaauuuucuuaagacuucuuuuccacagugcuaggucaguugggcuucccuccuacccuuucuccagccuaaacaacuaugaugcccacucuuaggccugaaguuucagaaucauucucuuaagaaaguaggucagcaguuuaguaugggcaucuacuuagguguuagaaccugagagagaaguggaggcacugugcuaccccaggagaaaaacaguuuugucuguucccagccaacuugacuuccuauccagguaccuuuuugggguaccugcguauacgcgugcccuaccugcuuaaauuguacuguucuuccauuuaaaggagaagccacuuaggaaaacaaacccaaauaaccucagggaaagcucuuacacucuauauacucuaaaguaaucuuucauuugcaaauauaaacagacagggauaaucagacaauugaggacaaucaagaggaugaaagaagauuaaaaugaauaaaagaacaaccaaccucagcuauaauucagaagaauacuucaaaguguaauuaguauuuuauuuaaaauuuaagaauacguaauguuuaaucauaguugcauuuaaaagggggcauagaacuagaaaagguuuugaaaauuauaaaaauuuuaauugaagagauaaaauuucagcaugaaucaagacucaauuguugauuuuggaauuaagaggaggaacugucugcauauguaaaucaaaagagaaaauaaucuggaaaaacuugagggaaaauuaaagaagcauggaaaauauaucacaguuuuucacauccauaaguaugaguucucagagcaagagauuuaggaaccaugggaaggauagaauaaugaaagaaauaauugaagaaaauuuccugagcuguagaaacguaaugaauuuucagauugaaagagcccaucuaguaaccaaaaugaauggaaaaagauccacaauuuuagaacucuuaaggacaagaagaucccaaaauuauugccagagagagggaaaaaauacggaaaaucaaauaacuaaguucuuagcagcuguguugaaugcuugaaggcaguggaacagugacuucacuguuugagagacaauagauuuugaccuauguuuucucuacccagccccucuauuuuaucaugugaggacaauugcauuuucuauacugggaaaaaacgaugcacuuuguaugaacauauuugagauacaguagcacagagaaaaaaauaaucccaagguagaggauauggugguaguggggggaugggagggugagugggaagaaauagcugcuguggcaaucuugggccuucaaaaagaacugaagaaagcuagaaggaaauucaaguucuauuagucuggaauacaugaacauuucuucaaguaguaaugucuaaacaacauaaaauuaaauuuccuuuagugacuaguauuuauauaaucacauuguaaguacacuuuauugauuuucuguuuuagaaucaaccuagaaaauguauaaaaugggcuuaauuauaguuauggaguagaaugcuuuauaaaccuuuauaauauaaaaauaauaucuauaaauuuaggagauggagggcaacaaacgaaggggucagugcucguuuuuucgguggacagucaguagauaacaagcauauaaaauuuggugaaucaagauaugaaagcaaaauggcauuaaaguuaaacugguaacugugcuagaagucuauuaaugauguaacauguauuuugccauuuugaugcaggaggguaacaagacuuaugguucgucuugugccuuuguagccuuugaauuucuuaaaaacccuaaguggaugcaucacauuuauaauguuaaaaagauugcaaggcugggcacagaggcucaugcuuauaaucccagcacuuugggaggccaaggcggguggaucacuugagguuaggaguucgagaccagccuggccaacauggugaaauccugucucuacuaaaaauacaaaaauuagcugggcgugguagcugcgccuguaaucccagcuacuugggaggccgaggcaggagaauugcuugaaccugggagguggagguuucagggaguugagaucauaucacugaacuguagccugggcaagagagugaggcucugucucaaaaaauaaaaaggggggguauugcagacaugugguggccucuaccuaguuguuuaauacugcucuuuaugaaguaaauauguucucgggccaagugauuuucggaaauugucugagguacaaauagaagacacagggauuaauucuaggaaauuagaaaguuguguagaauacaaaugugacucuuuuaauguaagaugccuaauucuuucuugacuggcuuacaugcucgauuuugaguguuaauuucugaucccuuuccaugaaauuugacaggaaacucuuuuuaaaaaacaaauguuuauugugaaaaauucggaaguacaaaaaauuggaaaauucugaggccuacuuccuuccagugccucuaaauaagaugacauuuuauccgauggacuaaggaccaaguauagaaacuaguuuguccuuaagguggaagucaugugaucaaggagagcuacaacuacuggaggcaagguaugucuccuggaagagcuagaagaaggaagguggaaauagaaauugccuuuuucucccccuuccuucuaaagacguggcugaucuuauauacuuagcccucucaucuuugcugaggacccauugugugucccauggccuauaaaucaggguucucaugauccccuucuugaguuugauuaauuuacugagcagcucacagaacucagggaaacacuuauguuuaauacauuuuauuguaaaagauauuacaaaggauacagcugaagagaugcauaggguaagguaugggacaaggggcauggaaauucugcccucucugggcgugccacccuccaguaacuuccacuguguucuguucucugaaagcccuucacgcccuguccuuauaggcguuuauggagacuuuauuacauaggcaugauugauuaaacuaucagccguuggggaucgauuucacuuuuauucuccccuuuuuggaguaugggaguuggggcugaaaaucccaaccauuuaaucuuccccuggucuuucugcuaaaaccaacccuuauucugaagcuaccuagggccugucagucuucagucaaaucuuagcauauaggaagccacauaaccacuuugaagauucuaaggauuauaggaguguaugccaggaaacuggucuaagaccagagaccaaauguauauuucaugauaucacaggcagucuuuugguacuuuaaauaauugcuugcaaaaguuacaucuuuaaauaauugcuugcaggcaaaccauucaagguuuguuaugaauagauuaggcuggaaauagcagagcgcagagugguaacagauaucuugagaccagacugauuggagcuugucagggaccccagaccauuaaggaaccagaggagagccagugauagcaaugagauuccaugguuacuuggguaguuuuuacuuccugauuauuuuccaugcccuugaugcuaucuugaguuacuuggaacuguuucuucauucccccagagugguagaaaccggugacucaagaaaauugucuuuagauuuaagcuuuuucuuguaauuuaaauuuuuauccccagguccccuagaccuccauuuugugucugugugugugugguguguauuucuuucuguugguagauauuugcuuucaaguggaggacaaauguguugcugacgagguugaaagugcuguaucaucaauagauuuaaccuauuuaaaaucaaaaacauugaaauaaguaauuucuguuauguaugcacuuguuuuuauuuucauuugaaaauguacaauucagacaaaugggaggguugauuguaaacaauaaauauuuuaucaguuuuguguacauagaaccuauugugaaaugcuggaaaaagaaugaauucauggugugacccaccauggguagagacaacaaaugcgaguguccaacagacacaacuauuacuggggaugugaaaagaggcagcauugcuuuguuucuuacuuuguuuaguacauuacuuacguugggacaagacuaugcuuguauuucauucuguacauaggacacaucuggaugaagcguuuuguaucuaauauaauucucuucuguacuuuucuagguugaauuucagauuucauuuauuaguuggauuagagaagaaugggaaggggaccaauuagagaaaaaaaucauugaaguuuuuaguauuaaacauugucaagaaucaggauuguguucuagauuauagccucuuggagguggacuaauuuuauuugccauucugucuccaguguauauaguauaaacccugccaccuaguaaguacucaguaaauguuuguuuaaaugaaugaucaaaaugcuaaugaugaucuuacaaaacaauuguacuggggcuuuuuauaguaugagccuugagaaaaauguuuaagcaaaaaaaaaaucuuuaauuauuugaauauuacaaaguaguacauacccucccuaccauuccuuauauuuagaauauacuacuggauacuauguugcauuauuuuauuuauaauguuacaauuuuauguaucuuuaacuuaguccuuucuuacauauauccuuuagauauucuucuacauuucucgaagcauguucaacugucuuauuuuggcaguucuggugaaggcuuaaucauucuuauuuuuaaauguaaucaucaaaauuagaccuggaaucuaugccaagaaacugagauagaaacuguuuagugcuuuuuauguucauaaaaauuguuuauguguggcccuguauucuuguacauuagauuuuuuuaauaugauggauuacuuuagaauuucaugcuuuaaaaagaguaauuugaacauaaauguagaaggcaaagaaauaaauguauccagcaguauuuuauuuagugagaauauacccaaauauuucccaaacaauucugggucuuuaaaauacuaaauucuggcagaagcaucuuuucacaacuuacuaccagguuaaaaaacccauuaaauauuggggggaauuuguauuuuaucagaaggagauuuuuuuuuaaaggguagaucauuggacuccccauucuucucucuucuccaccuguauaucagcuguauauauauauauagacucugcauugugguuggguuuuuuuuuuuuaaauaaucaauugaaguucuuaauuuguuggagaauuuauguguuuuuuuugauaaggauuuuuuaaauuuuuuuugaaguuagaugagaggagguguaacuuugauuugugauucuugaaaaguagaaaugaugaacuaagaauaaaucuggauacaugauuuaaaacuaauauugauuucagaucuggauuuuuaguagacuugugucaguaacacuuuauauuuguagggaagcaggcagucucacucacugucaguauaaauuaguucaacuuuuuuagaaggcaguuaauuggguaacaucuaaacuuuuauuuuauuuuauuauacuuuaaguucuaggguacaugugcacaacgugcagguuuguuacauauguauacaugugccauguuggugugcugcacccauuaacucgucauuuacauuagguauaucuccuaaugcuuucccuccucccucccccuaccccacaacaggcccuggugugugauguuccccuuccuguguccaaguguucucauuguucaauucccaccuaugagugagaacaugcaguguucgguuuuuuguucuugcgauaguuugcugagaaugaugguuuccagcuucauccgugucccuacaaaggacaugaacucauccuuuuuuauggcugcauaguauuccaugguguauacgugccacauuuucuuaauccagucuaucauuguuggacauuuggguugguuccaagucuuugcuguugugaauagugcugcaguaaacauacgugugcaugugccuuuauagcagcaugauuuauaauccuuuggguaugaacguuagaaacaagauaaaugccugcuggacugguuaaauacauuaugcaguucugcaaugaaaauuugagcagcugucaaaaaucaaagauaaauauuuauguacuaaucugaaacaauuauggaguauuaaauauuaaaauugggauacagaaaguaugcauaauaguauccaucuguauaaaaaauaauguuacccuaagaugugcuugaaauauguagguuauuucuggaaggauacaauaacugguugugucucuuaggauggcuugguaagagguagguuugcuuuucucuuaaaccgugaaugcuuuccauguacauguauuacuuuuacauaaaaaucauaguuaauaaagaagaaaauaaacuauagugguaauaaaaagaauauuacuuuuuauucuuuauuuugugcuacauuagacauauaucuagauuccucagucauuuuauagcaugaguaguuuaggagaaauaaaagguaaaaucaugagaauguguuguuuuaauaauguauggacuuucagaaaucuuaccaaaucguauuagccuuuuaacuuaaauucuguuuuaauaucuuucacuuauacuugguuuaggcucuuucacacuuggguuucauacuuaugcuuuacuauaauuuacacaguagaaaagagaaaaagagagauacuauaaaguaaugauuaaauuuaauaauuuuaagagguagaauuguuuuaguuuuuuuucuaguaguuuaugugagugggcaaaaucauuaaauuuuuccuaccaccaguugucaguccuuguuuuguuugaauauauagauuuugaagccucaccauucccuaaguuaaaaaauugauaggaaugaaacuccuuuacaaggaguuuucuauuaaaguuuuacaugaagggaacaaacaacaaaguguuaagucaugcaaaacagaguugcuugcuugucagcacauuucuacauauuuuuuuguuuugauuuucuuuuuccuucuucaaggaaaccaaugcugguccuaaauaaaauugucaauuuuggaagauucuuucauucaaucuagguauuuacugagcuuuuuuguccuuuaccuucuuuuuaugagagguuucacucuucauuuuggauauuugaacauuuucagucaauauuuucuuuuauuauuuuaaauuauuuuuauauguuuacauuuguuugcauagcuuaauauguuaauugcuauuuacacuuuaauacuucuguuggcaaaauaaugaaaagucuugugccauugaaauccauuuuagauaaaugggaagacaauuuucuugccuauaaaauuagguugaggcugggugcgguggcucacaccuguaaucccagcacuuugggaggccaaggcaggcggucacuugaggucaggaguucgagagcacccuggccaacaugaugaaaccccgucucuacuaaaaaugcaaaaaugagccaggcgugguggugggcgccuguaaucccagcuacucgggaggcugaggcaggagaaucacuugaacccgggaggcagagguugcagugagcugaaacugcgccacugcacuccaaccuggagugcaaagcaagacuccgucucaaaaauaaaauuagguugaacuggaagguggcuuguuuuuaggaugacagguuuuagacaaauauguauaaauuucucuuuauauccuuuugcccaugguauccugcagugacauagguaaucauauugaugaaaaggacuggaaaacagaauuaaaggggauacauuauuuugcuauguaacaaauaacugcagaaaaucugaaauuuagauucuguuuauauucaauacuucuaauaucuuauuucagugauccagugaccuaaagauagaguaaaagaacaaaugcuuuuguuagaaauuguggcacgugccuguagucccagcuacuggggaggcugaggcaggagaaucacuugagcccaggagguggagguugcaaguuagccgagauugcgccacugcauuccagccugggcgacagagcgagacuccaccucaaaaaagaaaaagaaagaauaaagaaauuacuacuauugggccaggugcgguggcucacgccuguaaucccagcacuuugggagucugaggcgggugaauuacgaggucaggaauucaagaccagccuggucaacauggugaaaccccgucucuacuaaaaauacgagaaauuagcugggcaugguggcaggcgccuguaaucccagccgcucugguggcugaggcaggagaauugcuugaauccagaggcggagguugcagugagccgggguugcaccacugcacuccaccccaggcgacagugcgagacuccgucucaaaaaaaaaaaaaaaaaaaaaaacagaagaaaagaaauuauuacuauuaguagcaauaauuuaaaagguauuaggauacuguaguggauaucagacaauucucuuaucugugaauuuguucauuuaaucaaaaaaugcuggcgggcgcgguggcucacgccuguuaucccagcacuuuggguggcugaggcaggcagaucacuaggucaggagauggagaccauccuggcuaacacggugaaaccccguuucuacuaaaaauacuaaaaguuagaugggcgugguggcacgcgccuguagucccagcuacucgggaagcugaggcaggagaauugcuugaaccugggagacggagguugcugugagccgagauugugccagugcacuccaaccugggcaacagagcgagacuccgccucaaaaaaaaaaaaaaaaaaaagcuuaagagccugcucuaugccagagugcuggcucuagguaugcauuggugaauaaaguguugccuaauuucuuuuuucuuuucuuucuuuuuuuuuuuuuuuuuuuuuuuugagacagagucuugcccuguugcccaagcuggagugcaguggcgugaucucgacucacugcaaccuccaccucccggguucaagcgauucuccugccucagccucccaaguagcugggauuacaggcgcccaccacuacagccaacuuauuguuuuuguauuuuuaguagagacaggguuucaccauguuagucagacucuucucgaacuccugaccucaggugaucugcccgccugggccucccagagugcugggauuacaggacaggcaugagccaccgcgccuggccaaaguauugccugcuuucaacaguguugccugcuuuuuucuagucuuuaagggagacagauaauaaaugauagccauaauucugugagaaagccauaaucacauauguauuguuaaaaacaacaguaaaugucagaaaacagaagcaccccauaauccuagaauggaagagaaggggagagugaaagguuuuauuaacuuuagucuuaggggcccccauuucuugucagauaaaggauuuggaaggccuauucuugguuuauggaaaaggagaguguuccagcauacguuccuugaacucaaaccuaucauugcuugauagcauuagaggaaaauuugaggaagggaaacuuuguugacgacuuguuuuaagucuaaagauggagcaguuuauuugaagcauagaaagaauugaccugggaggcaggaaauaacaaaagccaguuuguaguuucuguuuaagccaggucucaacaauguaaauuacuuugagcagccuuuaaaugccaggcauacccauaccuaaauguaaacacuagguaugguaugagguaaaacauagugucauuuguuugccauuaauuccacauacccuuugcaaucaguucuggauuugcaucuggauuugacucugcauauaacugugugcccugucugauacuugguucccuuauucguaaaaugagauuaucacagggaagaaguauaguugaugauucuggauauggacuccagucuggugcaaacugccugaauucagaucucaacucuucaacuuaauuagcuuagcuugaaauaauugggcaaguugcuuaaccucuuuuugucccauuuccacauacguaaaauggggauaauaauaauauguuuuaggauuacugugaaaauuaaaugaguuaauauauaaaaagcauuuaaaauggcauauaguaagcaaaauguaguuuaaaaauaugacauagcuggguuguuaugaggauaaauaauauguuuauuuuuuuaaaaaaagaaaucauauauugcuugacacaguauggguauuucuuaaauaccagaaaccguguaguagguacuuuauaucauuuaaucuucauauaaacuguuaagaaaccauaaucugucuaguugacugcaccuagagcaguuucugauauuucaaguugaaugaauauuaucccauuucaugauuaauaaauugaggcccaagaguacuccaaaaucaccacuaaaacaugacaucacuuugaggagauaguaccagcaaugucaugcacaucaucacaucacuuuucucaguuuagagcauaaaacauuguuccuuuuuguuuuuggagacagucucgcucuguugcccaggcuagggugccaguggcacaauggcaacauccaccucccggguucacgugauucucaugcagccaccugaguagcugggauuacaggcaugcacuaccacgcccagcuaauuuuuguauuuuuaguagagacgggguuucaccauguuggccaggcuggucuugaucgaacuccuggccucaaaugaucugcucgccucagccuccccaagugcugggauuacaggugugagccacugcgcucggcccauuguuccuuuuucagugcauuuuuucauauucaaaguuguauaaggaagaaauuugacaaucuaacaaguuuuacuaaauggaagaucaauuacaggaaugaauauaauauauauuggcuccacugucacucacucacuuuauuugcuguuugaugauccagauuuggugucucuaaauuucauuuaucuaggauauuuuagucucuuagaguauuuauuguaagagaaaaaggccauuucuuugguuaguaaaugaaguuaaaggcacuacuagaaaaugcauauaucaaauauuauagcuugcuucaguaacuguaaauuaguugaauguuaaccugguucucauaaguauuuacaagcagauuaguuuauaaaaaccaauuuacuauuaaaaaaucuacauuaggauaauuauuuuugaaacccugaagucaacuguaauauguauguuauauaauacauuugccugauguagcaaauuucuaacuuggcauuaucaugccuccuucuuugcgucuuuaauacaaccauuaaucucacuacaaggcuuuacuaaggauaaauugcugcguaacccacuucaaccucuuuuguucaaccaggaagccagacguguuaaauagcuuuuuaaaaaauauguuauuucuuuuuugaaauuuuaggauuuuaaaaauugaagugguaaaauaagagacuuuauuuugucuguuaaaauuacuugacagaaguuugcuuuggaauagagcuucuguaucuuuaaaaaauacacagugagucacccccugcucuuuugguagaugccuggcuagugaacagcuaagcugcuuuaggcauguaauagaacauuccauuuccuguucccuugcugacacagaggaguguuccugcuggcaaugaucuaaucauagugcaguaagaaacauggcaguuugauaaaacaugguggagacagcggcugaaauggaagcauauguucuagaagacauucuugagguagggcuagguuuguaagugaaaugaaaguugaaaucugaacaaagaaaucuuaucugccggaauuauuuuacagaugaauagauuagaggagagagcaaagagaagcagagcauaaaagcaagacacggucagaccuauuccgugugagaauguuucagacugguucacaugauuacuauagacgucuauaauuauuuuguuuaaacuucauguuucauaaauuguagauauauguuuguuagggaaaaaggggagacucaggcuuaauaaaaagccuugugcugguggugaccuuuagauuaacucauuagaagguggggucugcaaagcagcuuugaguaagguuuaguaucauaugucuuagaauucauuuacauaucuaagccuaaagcuuugcugcaguuaacuauuaaaaacgguuauuuuagcuuuaaacuaagcauguuuauaucaaucugauugcuuaauuuagcugguauacucugguccuagauuuuucaugugacuuugauuauuauaaaacaaauuauuaaauuaaaaauauuaaaacccugaaauuuagggcacugaugcuagagagacaucaauacaaaauuacuauaauuugaaucaugaacauuuuaaauuauauuuucucuuuucugguuguaaaaauuuuauaagauccuauuugaguauaaaucaguccaaggaaauacaugucaaagugaaacuauaauugcuuuuggcauugaauguaguauacuauuagaaauuuguauuuauagguauagguauuuaaaucucauauucuuaucugugggauuguguaggguuuuucuuuuuuuuccucauuagauaaaaccuggguaauucagauaaagaggcuuuaugguggugagugguauuccuaauacuuagacuguugagauaauuuauuaacuauuucacaucuucaggaagauuauuuuacuguggggagagggcuugggagaagaagcugcaaagggaagcuaggcgggguuagcaggagaaaaaagccuaugcgcauuauaaagugcugcaugaucaaugaguauuuucuggagucccucagugugugcuuggagcugacauugcagcaagucucaugguuguucugcagaaugaaaacugauuccauuuauuaccuaccuccuugcagacaccugccaaugugcucuuuuccccuuuccuaaaagcuguuaggucuaaguugaauugugguuaauuuuuauucuuuucucuuuuauuuuuuacuuuguuucuauuagugaguuuccuuaaaaaugugugguaaaauuaucuacuuagaaauaguaguauaaacuuucaucaaaggaguuuaguaauuacaaguggccacaugacuuuuuagugguucaguuuaaauaagccuaauuagauuacagaguucuaguguuacauuuuaauuugcuuuuaaaauuuuuugguuuggauuuuaaagaagugugcuuuggagauuuugauaaaucuauuugacaauuuuucuuagccauuuaaaacuucagcauauaacagauuuuagaagucuuauuuauguucugaggaaauccuacuugagcacuguuuugugcuuuaugcauagguuuuuuuaaugcuaccugaacaacuggcuuuuuauuaucucaauuguuuaauaccauguuaagauuucauguuaccuuauuuauucaauguugcuaguuauuaaaacaaccucugcaauuuuaguuuuccuaauucucaauuuaucuuaauuuaguuucuauguaccuguugcauccuaucauacuaaauaaguagcuuuuucucuuuauuuaaaauaucauuugacuuaaauauuugucaaucuugguaacauuuucuaaguaguaauaaaagagccuuauccaaaguuauaaguacucauaaugacacagugcuaaaaauacagagugcaaagaauaaauuugcuaacuuugcagauaaauguaccauuuucuaaagcaccucauauugcaaguaaacagauauuuauuacauaaugagcuuuccagaaaaauauauucccuagcccucuaccccccacagggauaacuccuugaauaaauguccaguaauggauaaugaaguucaucuguauaccacagugacaguuuuauuauuguacuuaauauugagcuacuugaaguucauuaccguaauuuucaccuuugugauuuuauuuauugaacauacggaauuuuauguagauuaugcuuauuugcauugaauaaauauuagacucuuuuuuuccugucuuuguaacuugaucuuuugaaucauaaacuucuuaaagguacucuuauugaauauuaguuaacaaaagucaauaucauuagugaacauaacacaaaugauuucucauaauacuauggcuuaccuuuuaaacugugauuacugauuauauaugcccacauauauuuaaguugacuauuuagaccuuuaaaaucuuaaguaaaauacucucuaaaauguauaauaaaauuagaaaagguggauuucaacuuacaucauugcuuuucaacaguccaagguaagggauuaaauagagugucuuggcuauuucauuuauucaaauaauccaggcaguaauuuucuucuccaaaccaaaggcaucaaaguauuuccguuccuucugccuaccuucuguaaaaggaacuaauacucaggaaaguagccauauacagauggcagaaaaagggcugacagcucauauaaauaccucuuuucuuguucuguuuauguuuuccugagacaugauuauaauuuuagaauuuugaugaccuuccuguaaaauuauguguaacaauagauuguacuacuuagaaugaucaauaagaggaaaaaugucuuccaauuuuauaucccaaauuuacauggccaagggcuguguauauaaaccugugguuuauauguuggcuuuuuuauaugaaaacaugaaacaacugagagaucauuucagaaacuugguuacuguauauuuaguguuauuauuuauaauugagccaguuuuaggagucuuaguaauaagaaaucuucacagauauuuccauccuuuaauuuugauuaaguucagauuguucuggguauaguauuugauauauuuuugcuuuaagaaaguaggaaauuuuaugaaaauaaaaauguuuauauuguuaaguguaauaauaacucucauacccguucuuauucuuuugucaucuaaagccaggauguccagcuucaucuguacuugauguuauagguugugguauauaaaauaaaagugccaacucucuaugguucugucuauggacaguggguugaggauuugacugaacccuuuagguuggaacugaauuaagguucagauuuaagcaaaguaaguagguuuauuauggaagcuuuucuugcucuguauuuaucuuagcuguuuuuguuuuuuaaauaaaauugaaagagucucaaggaaggcaucauuuccuuuugauugccaagauuguggacuaaugguaaauagugaauucuaggucaaacaagggaaauccacuugcuauuuaccauaaaaauuauuuuugguaaugauaucaaaucuccaugugguagacuuuuuuugacagauacguguuauauuucuuuuuauucuguaaggcacauuguuauauguaaugcacaucauuucuauacuauaccaguaagucuuucauagauuucuaaaguaaccauggugacauuuuucacuaggaaaaguuguaguaacucuuagaaccuaaauuggucuagugacugaaaaguuuagauaaauauguaaaucauuaagaguugauaaaaguaauauuuuccauucaucaagaaguuuuggaaucaaguugagaaauguuggacagauauggguuugguuuguuuguuugagacggaaucuugcuguguugccaggcuggagugcagugacucuuaucucagcucacugcaaccucugccuccuggguucaagugauucuccugccucagccucccgaguagcugggauuacaggugcaugccaccacacccagcuaauuuuuguauuguuaguagagacgggguuucacuauguuggccaggauggucucaaucucuugaccucgugauccgcaugccucagccucucaaagugugggauuacaggcgugagccacugcauuuauugaguaccuucagugugaggcacuugaaauucaaugagguuaguccagcuaauuuugucucacagagguggaagugcagaaguagaagaagaugaagaagaaaugucugccauugguaucuuuuuuuuuuuuuuuuuuuuugagacagagucucacucugucacccaggcuagagugcaguggcaugaccuuggcucacugcaaccucccccucagggguugaagcgauucucuugucucagccucuggaguagcugggauuacaggcaugcgccaccaugccuggcaauuuuuuguguuuuuaguagagaugggguuucuccauguuggccaggcuggucacuaacuccugaucucaggugaucugccugccucggccucccaaagugcucaguaauggcuugagccacugcagccggccucugccauugguaucuuaaacagucuugaauuuaggaugcauagauacauauuuuaauacuaguauuuuacuucauugauuccaucugaauaguuugaaacucauguuuucagcaguggacuuaaaaagcggauaucccuuaugcauucugaauuuuucaguaagcagauauuuuucuuuaucuggacaccuuuauguugucacuuuuaugcaaaucuuuuuguuauauguauuuaugaauguggugcugacaagaacauccacugguucucauuuuuaccuauaaaccagcauacgcguguguauacacauaccuacaauacauauauucacauuuauacuuacauauacuccacacacacacaaacauacacacacauacucauacacucauguucugcuuuagguggaauauuucuuaucuaaaauguuugggaccagaaguguuuggaguuuggauuuuuucagguuuuggaauauuugcguauauguaaagauaacuuggggaugggacccacaugagauuuacuuauguuuuauauauaccuuauacacauaguccgaauguaguuuuaugcaauuuuuuuuaguaguuucgugcaugaaaacaaaguuuugauugaucugucacacgaggucaaaugcagaaguuuucacuuguggcauuaugucagugcucaaaaaauuacugaucuuuggcuaggugcagugaguggcucgugccuguaaucacagcaauucgggaggcugaagcaagaggaucgcuugagcccaggaguucaagaccagccuaagcaacauagugagacccuaugucuacaaaaaaguaaaaauuaaaaaaaaaaaguuuuggauuuuggagcauuucagauuuugaauuuucagauuagggaugaucaaccuguauauuuugcagugaggauacucuuauuuggaaguccaauuuuucauguaagggugggguugauguuauaacauugcuuucauaugccaauuuugggagaauuaauggggaaguaguauaagauacacuuauguuaguuaaucccuguaaagaagaaugauauuuuaguggaauauggaggcuccaaauagcuuguggaaagguaguauaacuagaaguaugugaaucaauguauuacucuuauaugaaaguaaaggcacgguuguccaaugaaccacuaguuucccacugauccaucguagucugguaauuagugcauguuauggagcauuaauuagaaaaggucuacaucauauauuauccauuuauagaggcaacaacauuggcccuuuacugguucugaauugugagaggccuuuguuuugacacuugauaacagcucauucugauaugaagucacuugaucacuacaaaguuggugagcagcacagucuuguuaaccauugguuugguuuaguauauaucuuccaaauuugccaaaccaauggcuuuucacaagguguuuauaauuguuaaaugccuaugaggugauaacuuucaugugugguuggauuaauacuggccauuaauaauuuagucuuggauggaaucagaacucuaacuaguuggauauguguuguaaguaggauagcacauaguuuuaugguggcaacaguaauuggcacauuagcuacccuuuauugaguauuuaaauuauauauagagagggagugugccagguacuacauaagcauuguuuuauuuaauccucugaaugauucugugaggagguagguacccacuucauaagcagcuuauaaggaauaaaugaaguaaucugcauaaacauuuagcacagcauuuaguuacauaguuaacccuuaacuguuaacccuuuuuuaacccucaucuucuauccuuaugcugucacccccgccauuugacaggaaaauuugagcgucagggauuauuagagcaauaguuuuaaauucuuuuggucuuaggucucuuuuucacuguuaaaaauuauugagaacucaaaaguuuuuuguuucugagaguuauaucuaucacuauuuacuauauuagaaauuauaguuuaaagaaaauuaaaauuaaaguugaaagaaaaauuuaaaaacauuuacauauuuauucauuuaaaaaaaugauaaaccauugcauguuaacaugcuuuuauaaaaaaauaauuauuuuccaaaagaaaaaauuugugagaguggcauuguuuuacauuuuuauaaauaucuuuaacaucugacuuaauggaagauaacuagacucucauaucuucuuuauuaauuuaauuuaacuuuuauuuuagaguugaggucucauuacguugcccaggcuggagugcaguggcuguucacagguacagucauaaugcacuuuagccuugaacuccugggcugagcagucauucugccucagccuccugaguagcugagacuacaggugccagccaccaugcccaucauaucugcugucauauucagucuauugugauacauuauuuggucgaagucucuaaagaaauuuagugucacauuguuaggaggauaaaaaaacaaaaacuauuuucauagcccuuucagauaauuguggauaaucuucuuuaaaaccauuccuaaacuccacaagugguaguuucuuaaagguuaguugcaguguggaaucugaaacaauuaccggugaacuuucugaacuuuguuagauuaaaacucacuggcuuauugugcacuuugaauuuaucaaaaccauguaugauuuuuauaauauuggucauaguaaaauacugguuucuuuuauucugcaauauuuuuaaaaaucacauuuucagccaggcgcaguggcccacaccuauaaucccagcacuuugggaggcugagauggguggaucacaaggucaagagaucaaaaccauccuggccaacauggugaaacccugucucuacuaaaaauacaaaaauuagcuggguguaguggcaugcgccuguagucccagcuacucggcaggcugaggcaggagaaucacuugaacccgcgaggcggagguugcagugagccgagauagcaccacugaacucaagccuggcgacagagcaagacuccaucucaaaaaaaaaaaaaucacauuuucuaacagcaucaguguucucagaaaagucaaaaacugggaagcugucacgugucagauauaagaucuccaaaauucuaauuuugcuuggaaguuugaauuuuauuauugaugacaaaucauuugaauuguuuuucuugaaaugacaggcucauaucauucguucuugagaaaaugucugccaaauuagugaauaauuauaguaugucuuaagaaaagaugguauucuaugaaaaaaaguuggcuaccauuugcaguuugcacaaguguuuuucuugagacagcuaccguacuuuggguauguaauagaagugcuuucuguuuuaucacacagaauauuaaaguaauauauucaagacugaaaaaauuucuuuuucuuuucuuucuugcuuuuuuuuuuuuuuuuuuuuuaauagagacgaaaucucacucuguuggccagguuggucuugaacuccuggcuucaagcaguccuguuuuaggagucucaggcuccuaaagcgcuagcauuacaggcgugagcgacugcaccuggccuaagauugaaaauguuuaagaaugauauuuucuacugcuucaugaaggaaacuggguuuuucuuuuucucucuuuuuuuuuuaauacaaaauugugagugcaugcagagaagaauaugauaacuacuaacuaguacagauugguaucauggccuugaucgauguuaagaaacuagcagguuuacccaccauugcuuuugugucaucagugcaagugucaacacagugcaacaggcaaauaaccaucuuaguuguuuaaaaauaauuuugaccucacagacucuuuaagagucuuggagauucucauagaucccauggaccacacuugcacaacugcuguuuuacaguauauugcccaguuuacaaguuuacacucauuaagggaguaaaaguaagauuuagacaagucugcuugauucaaauguauucuuuacuauuuuauaaaauuuauuaauuaaucacauaguaccaacuucuccagucucuuugacacacccuguaggucacucuauccuuuaacuacaauauagcaauuuuaaagagccggagaaaaaccuuguguggaaaucugugugggaauuugaauauugcuuuaaaauuaucaguccaagauuagucauucagaauuucaggaagucaggaguuugaggauuccugaaggaaguagugaaugcaaagagaagcuauuaauagaaauaaguagaaaaauauuuugcuuguggaguaauauuaagugguaagugaaacagauauaugaaauauuugucaaauuugaguauuuuuuuugaaggcuauaaagugucuuuccuauccuucccuucuuucacagguaucacuuugguuuucaucuggucaagagaaguucuuucucuuauuuuauauagucuaugaaaaugaaaaauaaaauucagauaauguagaucuuccucuauuuaaaaacuaagguuuuucaaauuucuucauauagagguaaaauugagucauuuaagauuuacuucucaccuucuuuuguuuauauaaauaucaauguuuauauauaccauauuuuugcaacaauuuauuuuugauauuagcuuuggaacaaauaauguuuucacugggaaagagaaaggucaguaacaucuguacaucucugucuuucucauucucaaauuccauaucuucccaccaccauaaaauuuugaggaacugcuugaggugagaaauacaguguuagguucaguguuaaaaguguuuuugguguucugugcugucuggauucuuugcuguccugagcuuuugucauuuaaccucuuucucucaguuuugguaauacugccuacuuaaucaugauuucuuuuucuugcugcagguuguccagauauuuauccugaacucaguguuugaauauugcugccagccuaacucuuugauuucacacagaccuucucacuucuugaccuuauucaucuaacuaguguuuauccuuaccugguucuaaccuugaaucuguccuguugccacuugccuaguccuugucauauguucagcauuuguaauuuaugcacugucaucauaagaccaacauauauuugugugacaugcuuaaguuugagaaacuaaaccucaauuuggcuuugaauuauauauuauuugacuugauucuauccacucagcuucuaaauucuuauauuucuuuuuuuuuuuuuuuuccccugaaacggagucuugcuuugucucccaagcuggagugcaguggugugaucuuggcucacugcaaccuccaccucccagguucaagcauuucuccugucuccgccucccgaguagcuggaauuacaggcacacaccaccacucugcgcuaauuuuuuuuuuuuuuguauuuuuuuaguagagacgggguuucacaauguuggccaggcuggucucgaacuccugaucuuaggugauccccgugccuuggccucccaaagugccgguauuacaggcgugagccacugugcuggccuaaauucuuauauuucacaaagaaauaacuaguuaagauuuuccaaaaacaugugguggguuuaaauguucacacauaucagaaaguuuucguuuuuaagauuuuguaucacaucugcacaaguacuuuuuuuuuuuaauaucuuucucaguuucucuguucuauuauuuuuuaguuuucuccaugaaauaaagucaagggagauagcucuagauagaaauaugcucucuucugaaaacuuucauuagacaaccagaauguuaagauuaagcccuacauauaucauuuaaaaaauaaucuuggcagguggaucguuucguaaauguuuuaugaauuauggaagaauauaucuuuuauaaaguguuagguaaauggaaaugcugaauuauguugacagugauuuuaaguauuucuagacauuuaauggguuuccuuuuucauugucuugagcuuuuaguguuauagucugauuuucugugaauagcuuuguuguugguaucuucagugacucaacauuguacuuagaacauaguaaaugcugguuuuucauuuugaguuauucuuguacagugaaagaaucgccacccucuuucccucugcccaacccacaccuugggaguguguuuagacucuccuuggcuuugguuagguguauauauuguauaaagaagaacuaaaaguaauucauauuaacucagaucaauccaggugaucaguagguugggauuuuaaggauaauaagcuuuguacaucauuugaaauacuauacauuuuucuuuauuccuguguuuuuuaaucucuaaaauuuaguuguaccauauaguuucucuuaagaccccuucugcuuaugaaagcuuacaauuagauuuuuuuuuuuuuuuuuuuuugagacagaguuuugcucuuguugccuagguuggaguacaauggcaccaucucagcucacugcgaccucugccucccggguucaagugauucuccugccucagccucccacguagcugggauuacaggcaccugccaccacgcccagcuaauuuuuguauuuuuaguagagaugggguuucaccauguuggccagacuagucucgaacuccugaccucaggugauccaccugccucggccucccaaagugcugagauuacaggcaugagccaccacaccuggccgacaauuagauuucuuaagguaguggcuccaauaacuacuaaacaaaaaguuugagaugauaguguguaucuccuauauaugucaaagccuuuguaaccuguuuuacuguguuauuuuacauuuaagaaucaaacuaaagcucaguuuggcuuugaacuauacauuauaugacuucauucuauccacucaacuuuaucuuuacaacacuuaaucucaaccguuugccuuuacauuguauccuaauacccuguuauuacccauguugucuaccugcuacccucuuuaucuucauuauucagagcuccaccuagauccuaccucuucucuaggguuuucccacccuagucuucuuuucacauucuuuagcuccuacuauuuucugcucuguaaaaguaaugugagaccauauacauuuaaaauauuuuauggucuguauuaugugcuugacuauaugguuaauuuuuagcgacccugacucuuuaaguuaaaaaaaagucaucuauguauuuagguaaaagauauuucaucccccaaaaugauuugaaguaguuuagaguauauacucuaaaaaaauaaaaauacaaagguagaauuaguaaauuaagaccaaaggaaaauggauuauacagaaaaauguauguaauauacaguuauuaaacuuagauucaguuaacuagcaaccagagccaaauuuggaaacuugaugaauuuugagauuugcauaguccauagcuucauagguauacuagaugauuuggaggacucauauuuucugaaauugagaucugagaaaaaauuucuuuugggcccucauaauggagauacuccagguaguagauaacuuuuucagcauuucuaaaauauacccuucacauuguuuauacagaguauaaacuaaagauuugcuaauaaaaugcaauuugguugaaaacaauaauguaguguaaguacuagguuuucugauggucuuguuuguuucaacaauaaaauuuagaacaucuagggcaaagguuccaaacuuguggcuucuuggccauaucagacuuagaacuguguuuuguguaguucauauaacauuggcccacacagugagcaugacacauauacacacacacucauuuauuuauauuuucuuuaauuucucucagcacuguuguauaguuuucacuguucaggucuuauaaauauuucaugaaauuuguuccuagguguuuuagguuuuugauauuauuguaacugcuaauucuuuuuauuuugcaauuguuuguuguucauauguaggaauacaguggauauuugugggcuuaaauucacuuaguucuacuaggguuuuuuuuauuuguuuguuuuuuugguagaucuuaggauuuucuaucuacuuggaucauauguacaaauaaagucaguuucuaccuucaucucccaugguuaugccuuuuaauucucuuauuuucaauauucuaccuuauugccuuaaguagggccuccauaaaauguuaaauagaacuggugacuaugggcuucuuugccuuguuucugauuuuagggagauaaguauucagucuuucaccauuaaguauucuguuaccuguaguuuuuuucuugauuccuuuaucugguugaggauguucccuuuuauuccuaguuugcuaaggauuuuuaucaucaaaggguauugaauuuugucaggugcuuuaaucugcaucuuuuuaggugauccugugauuuuccacuguucuguuauuguaugaauuauauuaauugacuuuugcauuuuaaaccaacuuuguauucuugggauaaacuccacuuggucacaaugugugacuccuuuuguauauggcagcauuugacuuacuaauaucuuguuaaggauuuuaaggcauagugcucuuuauuuuucuuguaauauauuugaucuuuuuugcguaagggaaaugcaagccucguaaaaaaaauugggaguauauccuucuuuucuguuuuccgaaaguuugggucgauugcauugaccagugaagcuaucugcaccuaggguuuuguuuuugggaauguuuucaauuaaacauugaauuucuuuaguagauauagggcuguuuagauuuuuuuucugucagauuugauaaauugugauuugcaaggacuuugucaauuucagucugugguguugaauuaauugacagaguuguucguaauaguccuauacuguuuagauaaugacaggauuugugauaguguuuccucuuucacuggcaauucacauuuucucuuuucaauaaauuuucaguugauuuucauuuugugucacugauuauuuucuauuuuguuuuucuuuguuuuguuuuguuuuuuguuuuugacccagagucucguucugucacccagacuggagugcaguggcacgaucuuggcucacuacaaccuccaccuucuggguucaaauaauucuccugccucagccuccugaguagcugggauuauaggcacgcaccaccaugcccagcuaauuuuuguauuuuuuaguagaggggaguuucgccauguugaccaugcugguuucgaacuccugaccuuaggugaucugcccacccccggaagugcugggauugcaggcaugagccaccgcgcccagccuauuuuguucauuuuuuguuuaauugauuucugcucuuauuuuuucccuuuuuugaauucaguuugucccucuuucuaguuuuauguggaagcuuagguuauuauuuguaaucuuucuucuuuucuacuacuaauauuaaacacuauaaguuucccucuaugcacugcauuagcuguauacuacaaauguugauaucuuuuauuuuuauuagcauuuaguucuaaauguuuucuaauuuccccuggauuucuuugacucauucugccugucuuaacugggguuuccuuggaggauugaucucuaaugccuaaggcuguuagucacucuauucucuccugugcuugugcuguauuaugguacuauuuauauaacauuuuuaggagaacugagaaaguagucacucaaauuauuuuuggccauccaugguucauauaaggaacccuuuuggggaaaggcuauguggguuauuuaaaaguugguuauuucauuucuaaauauguuggcauauuauaggcuucccauuuaauuauguguggucagagaauguacuguacucuuaauuuuaguuuuuaaaaauguauugaagcuuguuuuaugccccagaauaugguuuauuuuguugaaugaguuuuuuaugggcauuagaaaagaauauguucucugaaguuguuguguugaauguuccauaaaugaccaauaaguuaauaauguucaaguuuuuuuuuuuuuuuuuuuuuuuugagacggagucucgcugugucgcccaggcuggagugcaguggcccgaucucugcucacugcaagcuccgccucccgggcucacgccauucuccugccucagccuccggaguagcugggacuacaggcgcccaccaccacgccuggagaauuuuuuuguauuuuuaguggaaacgggguuucaccguguuagccaggauggucucgaucuccugaccucgugauccaccugccucggccucccaaagugcugggauuacaggcgugagccacugugcccggccucaaguuuuuuuaauacccuuacugauuuuucugucuacuuguuuugccaaaucugagagaggaauguugaaaucuccaaaauauaauuguagagagucccauucuuccuuuccgauuugucaguuuuugcuucauguauuuuggagcuuccucaugagguacauacacauuuagaguuacuaugucuucuugcugaauuaauccuuuuauuguuucaaaauauuucucuuuggcuuuguuaauauuuguuguuuugcugaaguguacaguaugugaaauugauaauagcucuaccagcauuucuaugauuaauguuugcaugguauaucuuucuccauucuuuuaaccuaucucugucuuuauauuuaaaguauguuucuuguagacagcaugucgauagcucuugccuuuuuauacaaacugucaauaucugcccuuuaauuaguauauuuaauccauuuucacuuaguauaauuagcaauauuuuauauuucauuccaccaucuugcuaauuguuucccacuucucccauuuguuauggcuucuuuuuucccuuuguucaugccuuuuauuagguugaguuuuuuauuuguuuuucauauaucuuuaaucugacuuuacuuuuauuuaaauugacaaauauuauauauauuuuugguguacaacaugauauuugaaauauguauacauugugaaauggcuacauugagcuaauuaacauauguauuaccucauauacuuauguuuauuuguggugagaucacuuaaaaaucuacucucuuggcugggcacgguggcucaugccuguaauccuagcacuuugggaggcugagguggguggaucgccugaggucaggaguucaaaauaagccuggccaacauggcgaaacccugucuccacuaaaaauacaaaaauuagccaggcuugguggcaggcuccuguaaucccagcuauucgggaggcugaggcuggagaaucacuugaaccccgugggguggagguugcagucagccgagaucacgccccuucacuccagccuggggguaagagugaaacucugucuugggggaaaaaaaaaucuauucucuuagcaaauuucaaguguacaguacauuguuauuaacucuaguuaccaugcuguaaauagaucucuugaacuucuucuucuucuuaacugaaaauuucuguccuuugaccaacaucuuucugguccacccuccugaccccucaccuucccugucaaucccugguaaccaccauuuuacucacugcuucuaugaauucagcuuuuuuagauucuacauauaagugacaucaugcagugcuugcauuucugugccuggcuuguuucauugagcacaguguucuccagguuccuccauguuguugcaagagacaagauuucuuucuaucuuucccucccucccugccugccucccuuucucuuuaucucucucucucucucucucucucucucucacuuucuuucucucucucucuuucuuucuguucuauuguguauauaggccacauuuuucuuauccauucauccauugauggauacuccgguuuauuccguaucuuggugguugugaacaauggugccgugaacaugggugggagugcagauauuccuucaguaugacugauuucauuuucuuugaauauguguccagaagugggauugcuggaucauaugguaguucuguuuucaauuuuuugaggaaccucuguacuguuuuccauaauggcuauauuaauuuaccuuccuacuaauaguguacagguguuuccuuuucuccacauccuuaccaauccuugcuaucuuuugucuuuuucuucauagcuguucaaaccccugaaugguagugucucacugugguuuuaauuugcauuucucuaauuauuagugauguugagcauuuuuuccacauccauuggccauguguauguuuucuuuggagaaaugucuauucagguccuuagcccauuuuuuuaaaaaaaucagguuguuuucuugccacuaagauuuuuauguguuuuuggcauuaaccccuaaucagauauauguuuaaaaauauuuucucccauuucauagauuuaucuccucacucuguugauuguuuccuuggcuguauaaaagcuuguuagcuugauguaaucccauucaucuauuuuuacuuuuguuauuugagcuuuuggagucauauccaaaaauucauugcccaaccagugucauggagcuuuuccccuguauuuucuucuaguaguuuugcaguuucagugcuuauguuuaagucuuuaauccauugugaguugaguuuuguauuuguugugagauaggauguaauugcauuuuuuugcaugucaguaucuaguucucccagcacuacuuauugaaauuacuguucuuuucacauuguguucuuggcaucuuugucaaaaaucaauugaccauaaaauggguagauugauuucuggguucuuuauucuguuccauuggucuguguuuuuuugcuagugucaugcaguuuugguuauuacugcuuuguuuuuuaaauuuuuuauuuugcuaaaaaauuuuuuuuagaaauggucuuacucugucacccaggcuggagugcaguggcaugaccauggcucacuguagccugggcacaagcgauccucucaccucagccuucugaguagcugcaacuauaggcugugugccaccacacuuggcuaaauuuuaauucuuuaaauuuuuuuauuguagagguggugucuugcuuucuugcccaugcuggucuuuaacuccuagcuucaagcuauccucccaccuugaccucccaaagugcugggauuacaagcaugagccacccugccugggcugcuuuguaguauauuuugaaaucagguagugugaugcauucagcuuuguacuuuuugcugaagauugguuuggccauucuuuugugaguauuuuuacucacaaaaaaaguauuuugugaguauuuuuaguauuccuuuuugucccuuuuauugguguauuaccuguuuuuauuauuuuauuugugauuguucuagugcuuguaauauauauguguuagcuaauaauuguugucacauauaauaccacuucccgaaaauauuaagaaccuuacgacaguauauuucauuccuucucuuaugucucuggucugaauauugucauguaucuuauuucuaccuauguugugaaucgccagaauagauucuuauuauuuaaagauauuuucuuaaaugaggaaaaagaagauauccauuuuaugccauuucuagugcucuuuauuacuuuggguggauccaguuuuauuagguaucauuuucuauccacuugaagaauuuacuuuaaaaaaauuuuuuauagugcuugucugcuggcaacaaauuccuucagauuuuguuugagaauaucuauuuucccuuauuuuugaagcauauuuuuacugcauauugaaaacuuuguugaaagaaagauuguuuuucuuuucuuuucuuuucuuuuuuuuuuuuuuuuuuuuugacggagucucacuuugucgcccaggcuggacugcaaugacgugaucucggcucacugcaagcuccgccucucggguucacgccauucucccgccucagccucuugaguagcugggacuacaggagcccgccaccacgccuggcuaauuuuguuuuuguauuuuuaguagagacggguuuucacuguguuaccaggauggucucagugaccugaccucgugaucgcccgccugugccucccaaagugcugguauuacaggcgugagccaccgcgcccguacaagauuguuuaucuuuuagcacuuuaaaggucuuuuucaugugauuucugguuuuccuucuuuugaauaagaagucagcagucauucuuaucuuccuuucugugcacaugaugguuuuuucccccccauggcuguuuuuaagaguuuuuucauuguuguugauuuuuaguaguuucauugugaugugccuuggugcacuuuucuucguguuuuucuugaagacuguggaacguauuggauuuguaagguuauauuuuucuauccaauuuugagaauuuucagacauuauuucuuuuucuuuuuuuuuuuuuuuuuuuuugagacggagucucgcucugucgcccaggcuggagugcaguggcgugaucucgacucacugcaagcuccgccuccuggguucacaccauucucccugccucagccucccgaguagcugggacuacaggcaucagccaccaagcccggcuaauuuuuucguauuuuuaguagagacgggguuucaccauguuagccaggauggucucgaucuccugaccucgugauccgcccgccugggccucccaaagugcugggauuacaggugugagccaucgcgcccagcccacauuauuucuuuaaauguuuuuucuacccuccuucucucuuucuggaauuccaguuacacguuuuuagauauuuugauauuguccuaaaaauaacauugccucuguacaucuuuuuucagcuguuuuucucuuuauuguuuaguuuugccauuuguuauuauaauuuaguucaagacacaaagaugaggguuuggagaaacugaggcauuuucuacuaaaaaguaggggcagaaaacugggaaagggaaaacugggaaaagaaguguuggggagcuguaaacuaaacaaacauagaaacucccacaggguugguugagaaacaucaagaucuaaccaaccagaggaaauaagccuauaguuuugcuauuuauauuugcuauuauaaauucuacugcuaucuugauguucacugaucuuuuuuugugcaaugucuaaauuaacugugacagaucauccagugaauuuuuauuucaaauauuguauuuuucagcucuagaaauucuauuugaucuuucaguuuuauagacuucauuucucucauuguuucacauuuucuuuaaaucauugagcacuugcaaaaggacugucuuaaaguuauuguuugcuaauucuacaucuguuucuguuuaccuuuuucccuccuaauuaugagacaccuuuucuugcuccuuugcaagucuacugauuuuuauuagaugcuggauguugugauauuauauuguugaaugucuggauuguauuguccucuuuuaaagaguauuuauauuuggcuguaagguuacuugaaaaucagcuuuauccuuuuaaggcuuguuuugaagcauuguuagaucaucuuucuaguagucuguacucuaaaguuagaauagcccuacugguauguguagccuuucuggauuuucugcuaaauaccuauguguucaaugaaaucucucuccucuggcugguuagauuuugauauuucuccaccaaucuuuuggaguuucuauaauuguuuaguuuacagcuccucaauaguucuuuucccaauucucccuaguuuucugcccccacguuuuagcugcauuaauuucucuaaacucugaucuuuuucuccugaacuaaguaagacuucaguucugugccuuuuuuuuuuuuuuuuuuuuuuuuuuuuuaauccuguuccugccuuggguuugguaaauacugcuagguuugacagaaagaugggaaggaguaggacugacuucaucguuucuuuucagugggucauacucuuuuaugccuguucauugucugaaaagaggugggaagucuuuccaagucccaauugcucuguugugccuauaagccacaucguacuguauuugaacuacugauugguggagagaauuaugcuaaaguagaccuacugugcuguggcaaauuugcagugaaaaaucuuucauggcuaauaaagugccacaucuuagucuuuguagcccuuucuguuuaguugugaagucauuucauuuuguguaauauguacucaauagaaauagugucagugcagugccauuguagaugcuuuugccacagaugacugccagauaguguccauguuuguauagcagcaucuaauauguuuauguuucacaguaugucuuaaggaaaccuaaacauuuuuagugagaaagccugaaaauugcuccaagcagcuuauguuuagaaaagugaauacauuuuaaagcaauuuaaaauaaacuguuucagguuauuccuaauggcaauuacuauauuauuagcucuuuaggaaugacauggaaaacuuaauuacaaaaucucauagaaaacuuggaaaacauaaaaagguucaaagagaauuauaagccuguguuagaaaaauuaaugguguuauauuuugauacauuuccuuucaguucauucucugugcaaauacagauauauacacauuuuuaauauauugggacuguauuauuuaaaaauauuuguuucuugcuuuuuuuccucacgcacuguuuacauuuuccuguaguuuuuuuuucuauuuuauuaauuuuucugaaaaucauuauuuuggugauuguauaauauucuagcuugggaauauaacuuacugugcauuuguguuguugcauaacuggguuauuuccaauuucccuauaguaaaaaaaguuuauagauacccuuuagccauuuugcuaaugagaugugacuuuauuuuucuagagaauuuuuguauauugaugugaaucuuugucaagugugauaaacauuuuuuuucugacuguuauuuacauuuuuugguuugggauauuuuuugcauacauuuuaaauaaaugugucuuuucuuauucuuugugacuuuuuaugucuuuuguucuccuguaauucagguaauauuacucuauauggcauuuuauuuagucuugcuagaauuuauuuuaaaauuuauauuguaauacaugcaguauugugaugagauuaagaaucuccccccccccccgcccauacuguuuaagcaggugauuaauucauaaagcuauaccuuuuuuauucuggguaucuaaguucagccuuuguuggaaaggagagagugaacauaguggugauugagguggaggcaucugaaagguggagggaaaugacugauuacaagaguacagggaucugguucuucagugccuagcacaguauugagaaauuacagguuuuuugauaagcauuuguuuaauaacugacagaaaggaugggaaagaagaauucugauuuuuuaugugacuuauaaauuggcaguuuuugaauaucaacaaaaacuaauggcauuuagaaugacuaaaugccuuucagucaagauagguuauuauaaucuuuauauaauaaacuacuuucauaauggaguuauuaauuuuaaucuuuuaagcagugguuuaaccuucaccugguauuaguaucaccuggggagcuauaaaaaaucccuaugcccaggccacuccccaaaacuauuaaaucauaguaucugagaacguggcccaggcuuaguuuuguuguuguuguuuuaaagagacaggaucuuacuauguuacucaggcucgucuuacacuuuugggcuuaaaugauccuccugccuuaaccuuccaaguaccuuggacuguaaguauguaccccgaugacaauuuuuauuuauuuauugauaauucuagugugcagcuaaaguagagaaccacuguucugagacaaagaggauuuaaagcaaugugccugaaaacucuccaagagaguaaagauuuauuuacuaaauacugaauggaagcagacauuugaauugccugguacuuuauaaaaaauuucagauggggagauuuauggucugucaugguagacuuuuucaauauuuaagaaauuuagacaaaauguuuccuccuguauaauuuuauuuuguaaucuaaauccauuuuguuccauaaucaguguuuauagagacaaaagcucuucuguguuuccuuuuuugcuuguaucuguaaaacagaauucacaugaaauuugagcuggauaaaaaauauaagaaaaucucuguuagaauaagagcacuuuuagcauuuaaugucuuucuaguuucagaaaggacauauacuaauguaauauucauuuaacaaauguuuauugacugcccucuagguguccugcacuguucuugguucaaacuacaacaaaaagacagaugaaguuauuacucauauugagcuuucguugucguuggaaagacugacaacuacaauacuuggauaagaaaauaaauacuacaguuuuauauagucauuaguacuacuaaauaauaaagccaggauaauggggcagaccgugacugaggggaggagguauucauaaggacuuaggagugacacauuuaagcaaagaccugaauguugagaagcagcuagccauuugaagaucuucaugaauuccagguagaaggaacuguaauuguuaaauuucugagguaugccucuacaguugauguuuugaaggcaauugagagaagaugaaauuaauagggguacucuauauaaaguaaugggaaauugagacaauguuuuucucagcuaaauucuugcugggagguugaugaaugaaaggugcuuggcaucucgccuuucucuuugucuuucuggcuggcuuuuuuucccuccuuuuuuguucuuuuacuuuccuuguuuuccccuucccuccucccaacacacacacacacacacacacacacacacacacacagccaaacuguauguuuucgcagccuguuaggguagcaguucugauuagccaugaagaaaggcucagggcacucauggagaugacuuuuauaacaguaacaugauugcugaugucuugucuucauaaucuugagguauaauuugagcccaugacuagaaugaaauguauugggaagagugggaaaauuuagaauuuuagcauacuauagaaguuuucucuugaauuuguucccaaagaguaguuuaaguuuuugaugcuauacucuucaaacucuugaauaucuuuuuauguguuacaaguuuuacgucaccuuccuuacccagaauauuuaaccuucacaauuccugacauuuguaguuuauuuuguuugggcucaucuaauuuaucauacaauucaugggagaaugucuuugaguaucauuaagggaaaggauagcuuugauuuuguugggaucuguggugggggccagauguccagugaaaggaauauuuauaauuuugauuuaaucuccuuugugacuuugggcaaagcuguaguauaguaagaguaaguuaucuuuuaauuuuuuucuuuuugcucucauacuagacuguuuauacuaagaauucuugaaauaguaauguugagucaugacuaauaacauuuaauuuuucuuucuccuuuuacaaaauuauggguuuuggaugaaauuuugcauauacauauuucauucauuuugccagcauaccauauagacaaguuacccaaauuucuuggagauuuuugagugucaaguagaccuauccuuauauaaccuaauucuuuaucaagugaaacacagagccauuggguauacaaauuuguuaaguauacuuugcaguauaccaaauuuuucauuuucguugagaaacuaaauuuguuuggauaauuuaaaagucucauuauauagucuuaaauauuuauauugccaauuaaaugaugauuauuuuaucacuagguaaugggucaaagucagugauauuuuaguaaaacuauucuguauuuaaugcuucuauaaugugaauacuugcagacaauuagcagguagauggaguagccacauguuuuaauuuguuugggacaauucuaguauauaccuauuuuccuggcauaauuuuuuuaaaaaguuuuuagauuguauguauggagacucuaaaguuagaggaaugauggugguuuaaaucugaaguuacaaucauuuauacauaguuuuccugaauauuuauaaguuuuguagcaccaaaugaaaucaacugaauauaaaguauacuaacauaguugaauacaagccaaaaacauauauuuaauacaauguucauuuaccugaauuucuucaguuuagcucaauguucucucuugaaaguacguuuucguuuuuguuuuuuugagauaggcucuugcucuguugcccaaccucgagugcagugguugaucacagcucauugcagccucaaacuccugggcacaguccccugaguagcugggacuauaggagcaugcucguaugcccggcugauuaaaaaaaaaauuuuuuuaauagagaugggucuugcuauguugcucaagcuagucucaaacuucuggccucaaguuuauccuuccaccucagcuucccaaagugcagggauuacagacaugagccauggcaccuggccuugaaagugcuuuuuacaggauucucuucuuuuaaaagugaagacuuggaauuuaauaugucuuaagugugcuaguauuuguauuacaauugcuguuucuuucucucagaguucugacuacagaguugcguaaguauugaguagaauguccccagcucuguuuucucccuaaacuauauuauuuuaaugugguguuuuacagauugggagguuuaucacauugcauuuauugcaugauagcacaguuaucuguauugcuguaaacaucacauaagccuugauuuucauaaugcagacaguauucucuauauggcuguaggaauauaagacuucagugguguuugcauaguaacuccuuuuucaccuucuacuacaagagccccucuuguagcuggggagugcacccacaagaucuaacagcuguuucagagcugcucauuuuagagugauugguagggaguugguggcucagagguccuaaucagaauguguccuggguucugaaugacuagcagacuaucauuaaccaaauaaauuaugggauuuugucuuaauuauauacauauacauauacacacacauacacauacacauacauguguauauauucccuaaaacuuaauaaagcucaaauaauaaaaucagauuucuuaaguauuccaauucccuuuaaaauguaaaucagauuuuauaauucuuuuguucaaaacuguccauuggcucccauuucacuuaaaucaaaagcuaguuuuuacaauaagcuaagauagcaaacauuauuaucuauuuacuuaugaguuacuuauguaacucagcauccaauaacacuguaggugcucaauaaaauaguugcugaauggauaacuuucacuauuuggaugagauccaacagaaaagaauacucuuagcuugacaaacaaugguaaacagaaguaacauuagaacacuagauccuugcucacuuaaaaucagacauaaguauauguuuguguguguguguaaauauaaacguauauauguauauaaacauacacauacguguauauaugguacauauuugaauuaaaugaaauauaucagaauuugugguacacgauuaaagcuuaggucagaaaagaagaaaguuuucaaaucagcgauauaauaauuuccaacuuaagaaacuagaagagcaaauugaaccaaagcaggcagaauggaagaaagaauaagauaagaaaaucaaugaaauuaaaagcaacagaaacuaaggccaggugcaguggcucaugccuguaaucccaacacuucgggaggccgaggugggcaggucacgugaggucaggaguuugagaccagccuaaccaucauggcaaaaccaucucuacuaaaaauacaaaaauaagcugggcaugguggcaggcaccaguaaucccagcuacucgggagacugaggcagaagaaucacucugggaggcagaggcuguagugagcugagauugccacugcacucuagccugggcuacagagugagacuccaucucaaaaaaaaaaaaaaaaaaaagaaacaugguucuucgaaagaaucauuaaaucugcuaaagcucuaaucauacuaacagagggagagaacauacaaauuauuaacacuggcagugaaaaaauguaauguugccucccaucccacccauauacacuaaaaggcuaacagggacuaauaucuguuagagaaauuguauuucacaugaaaaauucuucagcaggcugggcacgguggcucaugccuguaaucccagcacuuugggaggccaaggugggcagaucacgaggucaggggauugagaccauccuggccaacauggugaaacccccugucuacuaaaaaugcaaaaauuagcuggguguggugguaugcgccuguagucucagcuacucgggaggcugaagcaggagaauagcuugaacccgggaggcagagguugcagugagccgagauuguaccacugcacgccagccuggugacagagugagacucugucucaaagaaaaaaaaaaucuucagcaaagaaaacucuuaagucuacaugacuucgugcacauauuacaugauauguuaaagguaaaaauaauacuaauucuucacaaacuuuuacagaaaauauaugaugagggauuacauuuccacucacauuaugagaccagcauuacccugauaccaagaccaagcaaagauauuauaagaaaagaaaauuaaaaccaauauauaucaugaacauagauaaaaaauccuaauagaauauuagcaaacaguccaacaauauguaaacaagauagcucaucaccaaaugguguguauccuaggaauauaaaguugguuuaaauuguuuaacguuuacugauccaucaauguaauucacuaucagcacacucaagaaaaaaaauuauaaucacaguagauacagaaaaggaacuugacaaaauucaucauccacugauaacaaaaaauucuuagcaaacuaggaauauaagagaguuacaauaauuaaucagugaguuuagcaacguuuuccauuccuauauauuagaaaugaacauuuggaaaaugaaauuuuaaaaacgcaccaauucuaauugcaccaaaaaacaugaaacacuuaggcauauaucuaauaaaguauguauguaguuuuugugcugaaaacuaaaaaaaacaguuaaugagagaaauaaaaaaugaccuaaauacaugaaaaaauauguaguaucuaggcuuaugauuuauuucagguuaauuuuugccuaugguggaaggaguagguuaaagucccaagcaauagguugauagccagauguuucagcuguauuacaguauaugauauauacuacaauguauaguauauauauuuccauguauuuuuaaaagucaauacuguuaaauguaaauucccccgaaaacaagaguaucaaugcaaucccaaucaaaaucccaccagauccucuccuuuuuuuaauuuacaagcuuuuuaguaucuauauagaaaaggcccuauaauaaccaaaacgguuuugaaaagcaagaacuaaguuggagaauuuaaagauuuauuauaaagcuaaucaaaacaguguggcacauauauuaauggaucagaauagucuagggaagauacauaauacuugacagagaugccaaggcaauucaauagagaaaauguagucuucucaacaaaugaugcugaaacguuugacugucaaccuauguuuuggaacuucaaccuauuccuuggcacuaugugcaaaaauuauccugacauuaaucauaugccucaauguaaacaaugcaacuucuagaagagaacauagaaaaucugugacuuuggguuagauagaaguauuuuauauauggcaaaaaaccacaaacauaaaauaacccccgauaauuuggauuucauugaaauuaaaaacuuuuguucuucagaagauacuaaaaagaaaauaaaaagacaaacuacuggcuugcagaaaauauuugcaagccauguguuugauaaaggacuuguuugguauauauuaagaauucucacaaaucaauauugagaaaacccaauaaaaagaugauuuuuuuguuguuguuuuugagacaagguuucacucugucacccaggcuagagugcagugucgcaaucaugggucacugcagccucaaccuccugggcucaaaggauccuccugccccagccccgaguacuugggaccacaggugugcaccaccacgccuggcuaguuuuuguauuuuuuguggagaugggauuuugccacguugaccagggcuguugcagaacuccuaggcucaagcaaucagcccaccuugaccucccaaagugcuccaauugcagaugugagccucagggacccagccaggaaaagguuuuaacagauacuuuauugaagauuugcugauggcaaauaaacacaagauaaagguguucaacaccauuaauuagccauuagggaaaagcagaguaaaacuacaaaggggggaaaagccagaagauaccaaaagcuagugagaauauguagcaacuggaacuuucauauauugcagguaggaauguauaguggugucacguaaaagucuggcaguauuuuauaaauuuaaacauacacuucucauaugaccuguccuccucuuauguacguauuuaagagaagugaaaccaugccugcauaaaguaguguauuuaaauguucauuagcuggugaauaaccaaacaaauugugauacauccauaugaugaaguacuguucaccauuaaaaagaaaugaacugaugcaugcuacaacauuuaugaaucucacaagcauuauguguuugagaaagaagcuacauucagaaaccugugauuccauucauucuggaaaggaaaaaaugaaaguaacagaaaagucaugauuguuagaggcaaaagguagugguacaugauugccuacaaauggacaggacaaauuuuugaguguuaaaauacuguguaucuuaauuguagauuauauauuuuucaaaauucguagauuuguaccacgaaaaaagggugaauuuuacucuaaaguauacuucaauaaaccugauuuucaaaaggaaggaaaaagaauuaaaagaaaaagaauuaaaagaagagaacauaauauguuccugauuuuacuuaucuugagaaaacgagcaguugcuuuaacuaauucuuacaauauuuuauuuuguugccaaaacuuuuucuuucauuuaaaaagaaugagguugcauaugcauacuuucagaugaguuacauguaccagcaaguuaauccuauauaucucaagacaauacaaauuguuaugauagcucuuucagaauuuauucuagaaauauguaaaugguugggugauucuuuauauuuuuguuugaaagucuaaagaaguuguuuuuucucauuaauuguuugcuaaaaaucacgguagaaaacugcauuuuuuuuuuaagguaagcaauauagaaggguauggaguaaguaaaaagguacaauucucucuuugauuucauucuuugauuaccacuguuaauaacuuggguuuacccaucuugaaauuuuuuguguacauucuugcacauguguauaugcuuuauuuugcuuuuuaagucaacuuaaauagguacauaccauguuuuuguuuuuguuuuuguuuuuuuugcuucaggcugcuuuuuuccaccuaacaaugugaagaucauucugcaucaauauuaauguauccauuugguaaauauuuuuuaaguaguuaauguuuaaggcacuauucuagauacaggggauagagcaaggaacaaaauagguucuuuguccaagugaacuuauauucaagugagaggaagacaauaaauuggggggaaaugucacuauuaauaaguucaugaagauaaauaauguaggcaaaagagaugagaggugaugggacaaaaugagcagcacagauaguugugguuuaggccuuuauguguaaaucugcuuuauucuuaagguagcuauuauuccauauauaauuuauuuaaccauaguauugauggauauauggguuauuuauagucuuuccuguuaaaauaaaaagaacuuccauauacguaguugguugcuuacaugugcaaguauuuuuauacuaaauuucuagaaagaaaauuguauuuuuaaauguugauuuuagauucugaaaaauuauccuugaaaacauuagauauuaucugucaauggaugaaaaauauuuuauuuuaauuuauauugccugauucccagugaaacugggcauucguauuuauccuaugaauugccuacucuguaauauuuugcccauugugguguuugucuuuuucuuacuaaaauuuaaaaauuucuuuauaauccucuuuuuaauauguacauuauauuuguaauauuuucuccuagccugucaguuuuuuuauuuuauggcaucuuugaauuuuuauucucauacuguccacauuuauuagucuuuuguuuccuaguuucuagguuuugugucuuuccagaaaagcuuucuugucuacaaaauuauagcaacaacauaaucucuuauauuuucuucuacuacuuaguuuuauuuauguuucuaguagauuuuccuuuacaucuggagauacacacacacacacacacacacacacacacacacacacacacacauauauauuuuuugguaggggccuauuuuuuccagcuucauagcuguucucccaaaauaguuuguugagcaguaugucuuuuuccuacugacuugaaaucuuaccuuuaucacacuuuauaagucccauauauauauguucuggauucaauacuccacuguuuugguuauugucauuuuauauuauauuugacaucugguagggcaucccuccccauugucuuuuucaacaaauuuuuuuggcaauucuuguguauuuucucuuccagauaaacuuuagaaucaacaugucaaguuccauuaaaaaucccuuugggauuuugauuggaagugcauugaauuuacagauuaauuuggggaaaauugacaucuuuacacuauugaaucuucccauccaggaacaugguaugccucuccauuucuucagguguuuuuuuuguuuuuguuuuuguuuuguccuuuaguaaaguuuuacaguuuuuuuccuguaggucuuacacuuuucuuguuagguguauuccuggauuuuuuuuguuuuuguuguugugaauuacauuuuuuucuuccauuuuacauuuuauuuucucauggguuauugcugguauguaggaaggcuauugauuuuuauguugaucuuaccauuuacuuaguuuucaguugcuucucuugaaguuucuagaaggauggcuguauuuucugcaaaugauagcauuuugucauuuccuuuuccuuuuucuguauguguuuacacccuuacagguuuuuuuuguuuuuuuuuuguuuuguuuuuuuuuuuggaggacauuuguuuuguuuuucuggucuuacuacauugguuagguuuccagaauaguucauuacuaguuuugauuuggguaucuuguccccgauuuaaaugggaugcuucuaaguuuuaaacuucuacaauaauauauaucuuagauuucuaguagaauauuuauuuauuuauuuauugagacggaaucucaucccaucacccaggcuggggugcaguggcgcaaucucagcucacugcagccucugccucccggguucaagugauucuccugccucagccucccaaguagcugggauuacaggcacaugccaccacaccugucugauuuuuguacucuuaguagagacaagauuucgccauguuagccaggcuggucucgaacuccugaccucaggugaucugccagccucagccucccaacaugcuaggauuacagguguaagccaccgcgcccagccccagaauacuuuauaaagaauaaaaguuuucuuuuuggcuuaauaaguauuuuaaugaaaauggauauugucuuuaaucacguacuuuuguugagaugauacauauucuuuuuuaccuguaauaccucaauguggugauugcauuaauguuagucauaauguguucuauuuuuaauauuuauucagcagauaccuguuugguuauugcauugugucaggaacuaugucacacacugguguuagcacuaagucugaaagguucauuuuuuuuuauggagaagaaauaauaagcaaguauccaagaacaagauaauuucaggcugugguaguauuauggaggaaauaaagaggauggugugguagaaagauaaggagagaaacuccguugauaguaucaucugaguaaguaaaacauaagcuaagaccugaagaacgaaaggguugggaaaagcauuccagacagcugagugcgauggcucacgccuguaaugccagcacuuuggguggcugagggggcggaaugguagccaggcaugguggugaccgccuguagucccagcugcucaggaggcugaggugggaaaauagcuugaacccaggaaauggagguugcagugaaccaagauggcgccacugcacuccaacagagugggacuccguuucaaaaaaaaaaaaaaaaaaaacauuccaggcagaggaauaucaccguauauguaugauuaauuuuauuugugugugugugagauuugugacagagaaacagaaaaaagaaaggauuauauuucuuaguguucucuauuauccccuuucuuguaguugucuuuuauacuacuacuaaauuuaauuugcuauuggguuuuuguuguuguuguuguuaucucguuuagguuuguuaauuggcuaucuauaaugaacuagagaguuuuuccaucuguuuucugggccuuguaaauaaaaaaguagugcucuauuccuuaaauguuauaauaaugcuauguaauuuugauagaaguugccucuaaauucauuuggguuuaggugccguuuugaaggguuagauuuaucugucauugacguugcuucaguggacauauucuacuuagguugucuaccauuucuugaguuaauuuugauuaucuuucuuucuagaaaaccauccauuuuguuuaagacuuuuagauuuauugauucauagaugugcucaacuuucugacuuuaauaacuccuuauauuuuucucugucucucauuuuucauaaucauucucgccaaaggcuuauauccucuuucuagacuuuacccaagaaacuguguuugguuuuauuaaugaaacuuuuaccucuucucaauuuucucauuuuuguuuuuucauuauaaauuauguugaugcauuuugauuuguauucuauuuugaagcuuuucauuuauuuauuuuaaaucucagguucuaaugaauuuaauacauuucaagcucuaaauuuuucuuuucuuuuuuguuuuuuuuagacggagucucacucugucgcccaggcuggagugcaguggcacaaucucggcucacugcagccucugccucccggguucaagcaauucuucugccucagccuccugaguagcggggacuacaggcgcauaccaccaugcccggcuaauuuuuauauuuuuaguagagaugaggagucaccauauuggccaggcuggucucgaaccccugaccucaugauccgccuaccuuggccucccaaaaugcugggauuacaggugugagccaccauaccuggccuaaauuuuucuuuaaagaucgcuauggcuaaaucccauaugaaauaauaugcuuauaauuuuauuuuucauuuacucuguauucugagaguuaauaguaggcuuuuuuuuuccuuuucuuuuuaaauuuuaaaguagugucgucaucuuauagcuaaguuuuaguuucuuucaacuuuauggaccaagaaugugcccuuguauaauuucuucauuuugaaauguguugagauuuucuguuuugcuuaagauaugaucagguuuuuguuuuuaaagacuuuucucuguuugugauauacuaaguucuaguucacuaugaaauauaaguauuacaguuaauuacuucuauuucuaaauccucuuuauccugccccuggaaaaauggucuuccaugaaacuggucucuggugucaaaaagguuggggagcacugcccuagaacauaggcuuuuggcauuauuucauuugaauccuggcuuucauauuuucaaaauaaucagaaaucuuugugauauauuuauguuauauacuucuguuaacaguggaggauguccagguucuuggcaucuggaacaaagaauuggacaaaacacacaaacaaagcaaggaaggaaugacgggauuuauugaaaauggaaguacacucaacagugugggagcaggcccaagcauuggugcucaaaggccuccuuacagaauuuuugagaguuuaaguccccucuagaggauuccauugguuacuucaguauguccuauguaaauggaggagaugaaguaaaguuacaaagucauuuauggcauauacucuaacagagaggauauuuccuguuacagccgaaaugugacucggccuuauguucccugccaacagaccccauuuuccugucucacuuccacuuuuauaacuuuagugaaucauauauuaagaauuaccugagauauuaaaaauacguuguauuauacugguuucuuuucuagcugcuuagucuugcaauuccaaggcugccccuuucuuggauggguuuuucuucuugaaguaauauuuucucuaaauucagaaaauguuuguggcuuuuaaauuucauaguguuuacauaccuaaaaaaauuucauuauacaguuuggaauuuuacuuucaaacuguucaucagaacuuuuaauugcacagauaucuucuagcaucuggugcuguauuuaggaagucugaugucagucugaccccuaacagguccccacugcuaccauccuggaaguuuucuagacuuuauauccuuagaaguuugaaaugucaccaggcuuaugacuacagguuuugugguguguauauauguguguguguguaucuguguguguuguaaagccaucuuauaagaauauuuauauucugcagcugcuuuuacaauaauugauaaaugauaauuccuggagcaggcuaaauucauaauugaauugcauccuacuauugauaaguaauuuugggagaauuuuugacaaaccauauaacuuuaauucuguuacagaaaaaccacuuagaaacucuagauuugagaauuccauagaacuuugucuuauuugaaauauucauaauuuguccacuuuguaaaguuuauguuaaaaauuuuauauugaauuguuaguaaugucauacucaauuguugcaggcaaauagcaguuugaagcauaagaagucacguuuuacgaaagugcuauagaacaaagcuguguuaacuguuauaucacugauuccuagauuauaguagcugcuuaauauuugucaaauugauagacaaguaugaaugaaaaaauauaagaauagaucagugguuuauucuguaaauagacuuuuugaaagguaaauuaucuuuaaugagguucacuuuaguuuuauuuacuauaaucucagaauaccauaaugaaucauugaccauucuuuuuacaagaaagauuuuauuucuuuaaguggguuuuuauuuucuuucaacuuuucaaauuucagucuuauacuuggauuaguguucugugacauuacugaagauuuugucuuuguauguauagaaaaaauauuugaauuguauuaauuuuggaauaauuuaccccauuaagaauugugguauuuuaucaaaguuuacccuuauuuaagacuauaaaaaauacagacaaaaggaauuauuucugggucauguucagaagagacuaaauugugaugacuuuacaauuaugaauacuucuuauuucuuauuuuauguguaaaucugcuuaucaguauucaaagaacuauaagagcagauagccauauuuuuccaggcuuacuugagagccagaaauuauuauaauuucuuaauaaauuaagaauuuauucagucacugucauaaaaugaucauaaacucaaguuucuuaauuuuucuauucacuuuuuaauauucaguuuuuaaaauauguauucauauguaaaauguauuucauauugauaaaaccaaaauuaagacuguuguugccuucaauuauguucacauagccugugcuuugaauaucagugaauauguuuuauauguaugaguuauauaauucaucccauaaugauagccguaagucauuucuaaugaacuuuuauuuuuuguagccaaagugguguuaguuauggauuuaugucuguaaacccauuuuauguuacugaaaugucuaaauugguccuaaaaaucaaucauugacacuuacuaaaagaaaaauuuagaaaaaauauaaaaucuuuuuggagggauuuuucugcauugacuggauuuauuaagagaucuuaaaauuuuaaguaugguaaauuuuugacugaagauaacuucuuuuccuggaauaaguguggggauuauuuguuuuaaaaugcuuuuauaauauagucaaaauuuagaacaccuuuucugaaauguagauuacugguuuaaaauucagauuaccagcuuuugagauucagugauaaauagaguauuuuccagaacaacaaaaacaauaauaaauauuuuuauuuauuaccagcuuuugagauucauugauaaauaggguauuuuccagaacaacaaaaacaauaauaaauauuuuuuauuuauuuuuuaaauauuuuuuauuuauuauuauuuuuucuucggaaaacaucagaugggggaugggguuaguguugaauguaaagaagucuaaauuuugcgguugccagcauuuuacuuuuauaaaguauguuuaugcuuagagacuggcccuuuuuuccaucuucaccucacauaaugcauuuguuuuacuuaaguucguaauugguuguuuugucucuggugucacagcugucuaaaaugaucuuuaacauggucucuaauuaucuuuauuuuaccaguuauuugccuuaaugcuuaaauccuucaguaacuuaauauaaauucugaacgcagcacaguauugaaaggcgccaucuuccugaagcaucauugcuuuuagcacucucauucauaauuguuuucucauuucucugcacaaucacuguauuaguaucuguuuaguacuucuuucaaacuuguuugauaguuauuugcacauagaguugccuuucuuuauuguguauuuauggaagguauugauuauaacaaaauuauuuuuguguuuguauaauccaaugaguagccuacugcuuugcacuuaguauguaauuuguaguuauuuguuaaguuggaguuuguauguaugguaucaguuaauuaaaauauacuaguuuucuuuucuuuuuuuuuuuuuuuuuuuuuuuuugagaggaagucuagcucuugucccucaggcugggugcaauggcgcuaucuuggcucacagcaaccucugccucccagauucaagugauucuccugucucagccuccugaguagcuaggauuacaggcaccugccacaacaccuggcuaauuuuuguauuuuaaauagcaauaggcuuucaccauguuggccaggcuggucucgaacuccugaccucaggugaucugcccgccuuggccucccaaaaugcugggauuaggcgugagccaccgcacccggccaaaauauacuaauuuucuuauccuuuggaauaaauacgaguuuauuaaacuacagaacgaaccauucuucucuaguauggcaguaauauuucuaacuugaggaguaguuugaaauguaaugcuaacgaugacaguugguccaaaugaccccgcauuaccaaauuuccaugugacuuuguguuuugaguguagaaggauuugaauuaccguuaaugacaaacaaauucauucagcucugaccauuguuaaaagaccuugguuuucauuauuaaauauuuguauuaagucagacuuaauuuggggagaaagugaaaaagaauucuaauuaucuuagaaaucuaaguaauauuacuguuaaauaauaguuuuucuguuuaaauaaaagcaacuucuacagugaaaugucaucaccuuuagucuuucaaaauuaaaaggacuuagcaugaacaaaaguacagagacucguauaaaaaaaaacucuauagaccggguaaaaguggcucacgccuguaaucccagcacuuuugagaggccgaaacucaccucuaccaaaauacacaaaacuuguguuuuggugaaaacucaucucuaccaaaauacacaaaaaucuaggugggccugguaucaugcgccuguauuuccagcuacuccggaggcugaaggaagagaaggaggcugaggugggagaaucgcuugaacccaggaggccagaggcugcagugaaccgagauucugccacugcacuccagccugcgugacagagugagacccugucucaaaaaaaacaaaacaaaacaaaaaaacccucuauauaucuauuucucagaugcaacauuuucaagaauuugccaugaagcuuuguuuucuuuaaguauuugaugacaaauuuccgacacuauuccuucauacuucaguaugcaugucugaaaaacaaggauauuuucuuacauaaccaaaguaauuccuuuauauuaucuaauacccaguucacauucagauuucuugucucaaaaauacuguuuuuacaguuguccuguuugaauaggauuuaaguaagaccuauuauuuugcugguuauaucucucgagucucuguaauucagaacaguucuuacucuauucaaaaaagauuuuuugcucccauucuacuuacuugaaggaaauggucaguuuugcugcaaaauguuccacauuuuagacuuuccuuuuuggcuuauauuuaacccagugauucucaaccucuuucuccuucaugauuuuuguuguuguuguuuuuaauuuucucuucuaagggaacauuuagcaaugucuggagacauuuuugguuguuacaaccugaaggaguguugcuaacuggcauuuagugaguauaggccaggguugcuguuaaacauccuaaauuacacaagacagccccaaacaacaaagaauuaucugguccaaaauguuaauagugcuuuuacauugagaaacauugauuuaucuuauuccuguauuugcuuuacuaauuuucauguacuggaaguuauuuacacgucuaaaaguucuaguagauuauuguuuauuggggggacaagaauucuuuauaggaggugcuguguauuuuauguugcauaaaucgggggcauguuagguuuguuugucccacuuuuaguaauuaaacaauggguucagguaguuaacagccugaucccuaaauguaaaauuuaaagucaccuuucccagagcagugugaaaguucaaccccuuauuauuccagcauuguauuugcugguggaaaguauauugagcuaguuaauuggauaacuggucucuuggugcuagguauuuagaaaucuccuauuuaaauaaagguccuugugucugguuuuuucauguguaaacacugaauugaaccuggugauuucuacgccucuugcauuuugaugguucuuuaugccuaaacaucauuucauaaaauauccagcuggucaaaacaacacauucaaaccacuuuaaauacaacuuuuaaaaaaggccaguuguaacuuugauaacuuuuuuccccccuuagagaauacauuuaguaaggacauuucuuuccuuugucuucucucuucauggaaguuauuuauauauuucauucaaauaaaauauuuucgaauacuuucuuuuaaauuuuuuuuuuuuuuuuuuuuuuuuuuuuuuuuuuuuuuuuugguggggacggagucuugcucugucgcccaggcuggagugcaguggcucgaucucggcucacugcaaccuucaccucccggguuuaagugauucuccugccucagccuuccaaguagcugggauuauaggagugcaccaccaugccuggcuaauuuuuguauuuuuaguagagacaggguuucaccauguuggccaggcuggucucgaacucccaaccccaggcaaugcacccgccucggccucccaaagugcugggguuacaggcgugagccaccgugcccagcucaaauacuuauuuuaauuucuuauuuggaccauuuuuaauguuuguuauguuccagaaguugguugugauucaaaaugauuuuuuuucuguagaauaauauaauaaaaaugcgauagguuucagagggaaaauucauuuuaguuuuuaaucugaacugucucagcuggggaugugguauggcagagagguguaugcccauaauuuaauaaaggaauacuuauuuuuguauguuuauaagauugcaucucuuuaugccagucucucuucacuuguuuuguaauguaacgcgagcucuuucuaguuggaaaaagaggaacuggaauuaaaggaggaaguucucuuuuuccucgcugaacuuuuauaccucuuuuucuuucucauuaccuuaugcacuuucuauccuguauuaugguucauuuuuacacacacucauuaaagaaguaggguccuacauagcaaggcugguaucaugcauuucuuuaucucccauaguauuaaacaguauuuuuuacacauagaauguuugcaauaaauguguguguaauaaaucaaugaagauagcauuuugcaccaccuacuaccuaauguaagauucuguaucuccucuaagaucuauaaaauauaccuuuagauguauuuauugugauuaccccuuuguucuccaaauacacuagagccuuuuagaaucugaaagggaagaauaccaaaaucaucugguaaauuucaccuucuuuacagauucugacuuauucaauaguugcuugaauccugacagugaguuagacacauuucuaauugcuggguguacaugacuaaaccaaaaaaaguguuuguuuuuacagagcuuagaaagacuguauguauaauauucaugugugauaaaucuaugaaaaaauuaagcagaauugggggucuaaaguuauagauggcugagagagagacuugguuaggucacauagguaacagcuaaagcaauucugguacuuaggccuucauauuuuagcaguguccuugaaaguagcuccuucauuaaucauaaaugagggauagggaggaaauaauaaauauucauuccuguucuuuucugucauuuugauagccccucucuuuucuaaagcugucuauaagaauuucauagucauuugaauuuacaguuuuuuaaguuaccaaguuuugcauauagugagaauagugggccuaagaauaacauaagaacuuuuguggagaagcuuaaagucaguagaaaguaaauguuucuguguuuauuauaucucaucaagagauggaaaugcaauuuuccuaguaaguuuucaccaggcuaguuaggauaucuguggcauaggggacuuuguguaagacagucgcuucugauugaaauuugauaucuucugugaucuaacuucuaaccuaucuuuucaaaccuacaguaaaacccuguguaaaacccuguguucuaucacauagaaauuuuuuacuugccaguccauguuccuucuuucucuucuuuuauacaaauuaauuuuuuuggucaaaauccuuuuauauuauucuuuaugcaugcagugucuccuuugaacaucuuuagcaccucugaucucuaccuuugauuaaucaguuaacuauauacugcuuuuugaugucuucuacuuucuaaaauguucauuuaaaauauuguauuaugguauuucaucuauucauuuuaccuguucaauuucauacauuuguuuauuugcuuuuaucuuuucuuauuaaauugaaauaauuguaaauauuuuaauaaauuucagauauuagaaaauuucauuaggaaacagcuuuuucuuuagaaagacucaucuucuggaccuuugacaauaaaacaaauuuuuuuacugcuauaauuuugaaucacucuuugcugugcccaaaaauuugcuuccuaaaguauaauacuuuagucagccuuuaaaauucuuccuuucucauacuuuuacuacuaccuuuaaagauaacuuaaaauuagccaggccugguagugcaugccuauaaucccguccuuugggaggccaaagugggaggaucacuugagcccaggaauuccacauccuguugcuacaaaaauaaaaaaucagccaggcguggugugugccuguaaucccagcuacuugggaggccaaggcaggaggauuacuugaucccaggaguuugaggccagcuugggcaacacagugagacuauccaugucucuuuaaaaaaaaaaaaaaaaauauauauauauauauauauauauauauauacacacacacacacacacacacauauauacauauauacacagauauauauacacacacacauauaugcacacacauauauauauaauuuaaaauauauauaauuuuaaaaaauuguuuuuguauuuuuuaucuccuugccauaaggaguuauagauuaauuaaaguuaauguagaacaaaauuuuaugaaauuuaaaaaauauuuacagaauauuuuuagaauguuguguuuguguauaaaauauuugaaaucucaaauguuauuccacguuaaacugcuuuaguuuaauggaacuuuguagagaaacauauuauuucuucccagauuuaaaauuuaguauuaaauguuuugauuaauuauagcaguauuccugguuacuugauaguugacuuuucaagauggaacaguaucguuucugagguuaugaugguuaaggauuuauuccuuaaguugucuuuuuuauuguugaccuucuggauacuaggcaugagcgugauuguauucuagcuuauuaguuauuuuuacaucuauuuugguuauugcaguguuaguaguaccuuagauuugugaaauaaacugaucauuuuagugauauuuuauauaauaauuaccaauuuuuaucacuaagcagaaaagaauauguuuuaguaccuauuuguaaguagcacugugauagggaauaucaaaacaaaacuuuaccccugucuuaggaguuuguuauuuucuaauucuuuaaauuuacuugaaucggcuagacuuauaucaguguuucuuaacacaguaaauagaccccucagggcccagagaccauuucaagguguccaugaggucaaaacuauuuuuaucauaauauugagauguuacuugacuuuuuuacuauguugacauuuacgaugauggugcaaaaacagugguggguaaaacuuauggacccgaaggccauggaaacaaacuguacugauaugauuguauucuucacuaccacgugcuugaaguuaaaaaaaaaaaauuaaaugcuaguuuaagaauauucuugaugaagcgauaaaauuauucauuuuaugaaaacuccccuuuugaaugcauguucuuucaauauuaguguguguaacaaaaugggaaguacacauaaagcacuuuugcugcauauaaaaaguauaguguuugucuggaggaaaaauaacugcaauuuuuuuagaugugaggugaauuagccuuuuuucccccaugaaaugucauuuuuaugguaaaguacaaacgaaaaacuauaguuaucaaacuuggauauuuggcaaaugcuccucuaaaaauguuugaagugagucugucacuuuaaggaaaacaacaauacuuguugccaaugauaaaguuaagcuuugaagcaaaaauuagaauuuuggaacuuguuugccuaggcuugacagcuuuccaguacuuaaagacuuuuuggaugaaaucaguggugauauuaaugaaugugauuuuuugauagugauauuuguuacuuaauuuccaguaugguaaauaucaagaaauacaggguuuauauaaaguccuugggaguucaguacuucauugaguccugaaagcaaaacauuuaaaaacugcugauuuaguuaggucuucuauucacaguuaaaguuuucacaaccuaagcaucacacucaacccuacauauaccuaauaaccaaauuaaaguagaaaagaauauuaguaaagaaaauuaggcugcauaugagaaauaaaguuuugaauucuuccacaaaaaaauuucuucuuuuguuaaucaacaggcuuagaugucauguugaacuuuuuaggguugcacuguguuuaccauuguuaauuauguuaacauauuuuuucccuccccugcuuucuuuuuauuucucuccccucuuuuccuuucgcuguucauuucucccuuccucccucuuuuugcauuuguuuuauagguggagucuuucauuuuggaucaggaugauuuggaaaauccaaugcuggaaacagcuuccaaguugcucuuaucagguacugcugauggugcagaccucaggacaguagauccagaaacacaggcuagacuggaagcuuuacuagaagcugcagguauguacucuacauaguaauaagucuaccuuguuauguaaaguugcacaucaaucuaauaaaagcucuuguuaaaaaugaaugauauuggguauuuagaaugauacuauuaauaaagguuaauugauuacuuucugcugaauuacauggagcguuuuacuaaagcauauuguaauuuucauuaccagaguaaaguccaugugcuacaguugaccuuacaaagagagauuuuucaguugaguuugauuauucgugaauuauguauuugugaauuugccuaccugcaaaaaugcauuuuaacuucaaaaucaguacuagcggucuuucauaggcauguauaaagugguggaacauuugaaucacccuacaugcaugcucccaguagaagucgaacaaagugaugcucuacauucuuguuucagcucuccugcuauaaauaaguguccuuuuguggccuauuuaaugccagguuuuacacauuuuugugauuuuuguugguguuaauuuuuuaauuuuuaauuuuuguggguacauaguagguguaaguauuuaugggauacaugagauauuuugauacaggcaugcaaugcauaauaaucacaucaggguaaaugggcuauccaucaccuaaagcauuuaucccuuguguuacaaacaacccaguuauacuuuuuuaguuauuuuuaaguguacaauuaaauuauuuuugaccauagccacucuguugugcuagcacauacuaggucuuauucauuuuuucuaacuuuuuuuuuuugauacucauuaaccauccccacugccccaacuacccuccccagccucugguauucauccuucuacucuaucuuggcuauugugaauagugcucuaauuaacaugggaaugcagauaccucuucaauauacugauuuccuuucuuuuggguguacaccuaggagugggauugcugggucaugugguagcucuauuuuuacuuuugggagggacuuccaaacuguucuccauaugguuguauuaauuuacauucucaccaauaguauaugaggauucccuuaucuccacauccucuccagcauuugucauugccugucuuuuggauaagucauuuuaacuggugugaaaugaugucucauuauaguuuugauuugcguuuuucugaugaucagugauguugauaccuuuucauauguguauuugccauuuauaugucuucuuuugagaaaugcuguucaaaucuuugacccauuuuuggaucagauuauuagauuuuuuuuccuauuguuugagcuccuuauauauucugguuaucaauucauugucagcuggguaguuugcaaauauuuucucccauucugugguugucacuucaguuuguugauuuuuuuuuuuuuccugugcagaagcuuuuuaacuugaugugaucccauuuguccuuauuugcuuuaggagcccaugcuuuuaugguauuacucaagaaaucuuugcccauucuaauguccuggagaguuuccccaauguuuccuuuuaguaguuucauaguagaggucuuauguuuaagucuugaauccauuuugauucuauuuuuguauauggugagagaucggggucuaguuucauucuucugcauauggauauccagcuuucccagcaccauuuauugaagagacuguucuuuccccacuggauguucuuggcaacuuugucaaaaaugaguuggcuguagauguauggauuuauuccuggguuuucuauuguauucuaguggucuauauguguacuuuuaugugacaaucaugccauuuugguuacuauaacucuguaguauaauuugaaaucagguaaugugauucuuucuagucuuguucuuuuugcucaggauaucuuuggcuauucuggaucuuuugagguuccuuguaaauuuuaggauugugauaugguuuggcucuguguccccaccaaaaucuuaccuugaauuguaauccccauuauccccaugugucaagggaggagcccagugggaggugauuggaucauggggacaguuucccccaugcuguucuuguaauagugaauggguucucacaagaucugaugguuuuauaaggggcucuuccccuuccgcuccucacacuucucucuccugcugccaugugaagaagguccuugauuccucuucaccuucugccaugauuguaaguuuccuuaggccucgcagccauguggaacuguaggucaauuaaaccucuuuucuugauaaauuacccugucucgguuauuuauagcaaugugaaaacagaccaauauagauugcuuuuucuacuucuguaaauaaugucauuaguauuuugauaggaauugcauugacucuguaaguugcuugggguaguauguacauuuuaacaguauugauucuuccaacccaugaacauggaauauuuucccauuuuucuugugucgucuucaauuuuuugcaacaguguuuuauaguuucccuuguagagaucuuucacuucuuugauuaaguuccuuccuagguauuuuauuuuauuuguagcuauuguaaauggcauuaguuucuugauuuguuuuucagauuguuaguucuuggcauauagacaugguacugaguuuuguauguugauuuguuuccugcaacuuugcugaauuuaucaguuuuaauaguuuuuuugcugaagucuuuagguuuuuccaaauauaagauuauauuaucugcaagcaaggauaauuugacuucuuccuuaucaguuugguugucuguuucucuugucugauugcucuggcuaggacuugcaguacuguguugaauagaaauagugaaagugggcauccagaucuuguuccaguucuuggggggaugcuuucaacauuuucccauuuaguguaauguuggcuguugguuugucauagauggcuuuuauuaccuugagauaugucccuucucugccaguuuugcuaaagguuuuaaugauaaagggauggcuggauuucaucaaauguuuuuucugcaucauugagaugaucaugcaauuuuuguuuuuaauuccuuuuaugugauguaucacauuuauugacuugcauguguuaaaccaucucugcauuccuggugugaaacccauuugaucaagguauauuaucuuuuugcuaugcuguuggauucuguuagcuaguauuuuguugaggauuuuugcaucuauguucaucagggaucuguaguuuucuuccuuccuuccuuccuuccuuccuuccuuccuuccuuccuuccuucuccccucccuucccucgccuuccuucucccuuccccuccccuccccuccucuccuuucuugguuuugguauuagggugauacuggcuucauagaaugauuuagggaggauucccauuuacccuguggguucugcugaagaaaguuuaugcccaguugaaauuauuaugaaauucaguuggaagcuuuuuucacccugugaccccucccuaauucugcuagcugccuucccugagggcccuaucagaugcagucagggauggcuucccugggcucgagcuggagacugggugugcuuacaaggcucuucccacugcugcuucuaccuuuauauuucauguggcucccuguauucauuuuuguuauaggugagguuaaauccuucuccugugaucuggauuuucagauuccccaguggacauguguguuuggagacagguuuuccugcucuuguacuuugggaacucacaguuauuugacugucuugcagaauuugcagcgaugugucacuucuuucagagaaucugugaauuauuuugguuuuccugguaauguuccugcagugguucuuagagccggaguuuguggugugagucuccacaugcuauucugcccauccaagugggagcugcacauuagcccugucuccucuccucucugccaucuuucuuucuaaguccaauguuucuuuguugauuuucucuguggaagaucuguccaaugcugaaaguggaauguuaaagucuacagcuauuuuuauauugggguucuaucuuuaccuuuagcucuaguauuuauauagcuuugugcuccaguguuaggugcauauguauuuaaaauuguuauauccuguugcuuaauugaccccuuuauaauuauauaaugaucuugucucauauuuuuguguugaaaucuauuuugugcaauguaaguauagcuacucuugcgcuuuuuugguuuccaguggccuggaauaucuuuuucaaucccuuuauuuucacucugugugcaucuuuauagguaaaguguguuucuuguaggcagcaggucauugggucuuguuuuuuauccauucagccucugcauguguuuugguuguaguccuuuaaguccauuuacauucaguguuguuacugauaagugaagacuuacuccugucauuugguuauuuguuuucaaguuguuuuguauuguuaacuuccuucuuuccuuccugccuuucagugaaagugauuuucucuggugauauguuuuaauuucuugcuuuuuauuuuuuguaucuauuguauguuuuuugauuugagguuaccaugaggcuugcaaauacuaucuuauaacccauuauuuuaagcugauaacagcuuaacaccacuuccauaaacaaauuuaacaagguaaaagaaaaccaaugacucgacaccuuaaguuugucugcuacuuuuuaacuuuuugucauuucuguuuauaucuuacugugcugcauaugucuugaaaaguuguuguaguuauuauuuuugauuuguuaaucuuucagugcuucuacuuaagguaagcguuaacacaccacagguacaguguuauaauauucucuguaguuaauauuaucagucaguuugguaccuucagaugauuucuuuuugcucauuaacauucuuuucuuucugauuaaagaaaucucuuuaguguuucuuguaggacagaaguggcgaugaugaaaucucucagcuuuugucugggaaagucccucuuucuccuucauguuuaagggauauauuugccagauguacuauuauaggauaaaauuuuuuugccuucaguacuuuaugucaugccacucucuccugggcuguaagguuuccacugaaaagucugcugcuagauguauuggagccccauuguauuuuauuugugucuuuuugucuugcugcuuuuaggauccuuaccuccuugaccuuuggaaguuugauuauuaagugccuugggguagucuucuuuggguuaaaucugcuugguguucuguaaccuucuuguacuuaaauauugguaucuuucucuagguuugggaaguucucuguuacuauaccuuuaccuuauaaacuuucuaccccuaucacuuucuuuaccuccucuuuaaggccaauaacuuuuagauuugccauuuugaggcuguuuucuggaucuuguaggcaugcuucauucuuuuuuauucuuuucuuugucuccuucaacuguguauuuucaaauagccugucugcaagcucacuaauucuuucuuccgcuugaucaauucugcuauuaagagacucugaugcauucuucacugugucuguugcauuuuucagcuccaauauugcugcuugauucuuuucaguuauuucagucucuucguuaaauuuaucugauagaauucugaauuccuucucuguguuaucuuuaauuucuuugaguguccucaauacuguuuugauuuuucuuucugaaaggucacauaucuguguuucuccagaauuggucccuggugccuuauauaguucauuuggugaggucauguuuucugauggucgugauccuugcagauguuuguuggugucugggcauugaagaauuagguauuuauuauagucuucacagucugcacuuguuuguaccuguccuucuuuggaaggcuuucuaaguagucgaagggacuuggguauugugaucuaagccaugucugcauuggggugcaccccaaucccaguaucgcuaugauuuuuuauggauucauagagguaccaccuuggugguuuuauuuaagaucuagaagaauuaucuggauuaccaaguagagacucuucuucucuuuucuuucucccaaacaaauggagucucagucucucucucucucucucucucucucucucucucucucucucuccccccucugagccauguggagcugggguuggggugacacaaguaccccuguggucaccaccacugggacuguacuaggugagacuugaagccagcagagcacugggucucacucaaugcccguugugacugcuaccuggcuaccaccuauguuugcugaaggcccuagggcucuauagucagcagguggcaaagccagccagacuuguuuuuuuccccuucaggauggcagguuccccuaggcccugagcugauucauagaugccaucugggagccaggaacugaggucaaaaaccuuagaaaucuaucuaaugagggucuauuguacuguaucuuugcuggcacucaaaccacgauauacaguccuucccacucuuccucuuuccacagguaaggagucucagcccauggccgucaccaccagaggcccacagggaguacugccaggcuaccgccaaugugcaguuaaagcccaagggcucuucagucagcuugugaugaaagcugccaggccugagacucacccuucagaacagugggcccccucucucccaggacagcuccagaaaugucaucuaagugccaagccuuggaauaggagaccccgagaguccacuuucuacuuaacagccccccgccccccgaccccaacugugcugucacuguugccaccauagcugggaaugugcugguucucacaugaagccagcacaucucagaaucucaaccaaggcagguggcauacuacuugggugucgcugcugguucuucagggcccaagggcucuuuagucaguaggugauggauccuuccagggguggguucuuuucuucaagggagcagguucccuucuggcacaggguguguguagaaagauuguccaggagcuagggucuggaauggggggccucacgaaucugacuggugcccuauccuacuguggcuaagcuuguauccaagaugcaagaccaaguugucucugcucuuuucucucaagcagaaggaaggggucucuuuuggagccuuaagcugugcugccugaaguugggagaggggugacucaagcacucccuuagccacccaagugguggcucaggaaguugccugcuccccauccccaguccagugacuccaaguccaucuuggcacuaggacuugccuaggaauugcaguccugugacuuagacugccccucagcuucacuuagggccccagaacacugcagcccguguugacagggcuugcuggaagucaaauuuggacugcugggauggacaauuuccuugcggcuaugccugguccaaaagcucccuccacgagcaggcaucagcugaguucagccuguuucugcucuccgcugugaccgggcagcacugaguucaaugcaaaggcucacaguugcuaugcucuccgucuuacaguugcacaguucuuugcaccauguggggagcugcuaggggauuagggaggggugucauuggcaauucaaaacugucuuuucuacccucuuuaaugccuauuucagcaaugcgaagucaaaaccaggcacugugugugcucaccugauuuuggguucuuaugaagaugcucacuuuguguagauaguugccaaacuuggggagggguggggagaucacuagagcccccuuuucagccaucuuacuccaucuaucucaguggugaagccagccagacuuuuuuuuuucccuucaggguggcuaguuccccuaggcccugaguuggucuagagaugccaucugggagccagggacugaggucaaaaaccuuagaaaucugucugauauucuauuguacugugucuuagcuggcacucaaaccaugauguacagucccucccacucacuguuuaaaauggcgcccaagcauagugcugucuaguguuccuaagugugagaaugcugugaugugccuuuugggaaaaacauguuuuagguucaggcaugaguuuuacugcuguuggcugugaguucaauguuaaugaaucaacaacauauauuaaauaaguuauauuuuacaucauggaauaccaugcagccauaaaaaagaauaaaaucauguccuuugcagcaacauggaugcagcuggagcccauuauccuaagugaauuaacgcaggaacaaaaaaacaaaugccacguuauuacuuauaagugggagcugaacauugaguacacauggacacuaagaagggaacaauaggcaccagggccuacuugagaaugggaggaaggugaggauugaaaaguuacuuaucagauacuaugcucauuaccucggugaugaaauaaucuguacccugaacccccacaacaugcaguuuacccacauaaccaacuugcauguauacccgcuguaccuaaaauaaaaguuggaaggacacacacaaaaaacguacauuuaaacagaaacacacguaaaacaggguuaugugcauuaaugacaaugcuguggccaggggcuggcuaacgcuauauuucucccaggagcagugguugaguguaguauuugcuaauuccguguuucuagcgacuuaacauaacuacugugaauaacugaauaaugagaauugacaauauauaauuuuccccacuuguuuguuagagacuguaggcugaaaccucaugugaaucaucgugguauuuuugugaaguggaucauuauauuauccccauaggaacaauguuuuaauugaggaguguauauauauauacacacacacaaucaaauauuuagcacuauauaucauaucuuaaauauaaggcagugauaaugaaaucucuauaaucauuuuaaagacaugauguuuucuuagguuuuguaaaguagacauaaauacacuaugaacacuaauuguucaugguuuaagaaccccagugcacuaccuauuauacaugcaaugcauguaaacugcuacuuuauuauagcauaaaacugaccuaauacuguucaauaaugcuuucaguaaacaucuuguaauacaguaaauuuuuuuuuuuuaauuuuuuuuugagacggagucucacucucccccaggcuggaguacaguggugggaucuuggcucacugcaagcuccgccucccggguucauggcauucuccugcuucagccuccugcuguagcugggacuacaggcgucugccaccaugccuggcuaauuuuuuguauuuuuaguacagacgggguuucgcugcguuagccaggauggugucgaucuccugaccucgugauccacccaccucagccucccaaagugcugggauuacagacuugagccacugugcccaaccgguauuuaaauauuugaaggauucaugguuaaacuugauuuccauccaagguaaaauucuagaauggauuauuaaaaggaucuuaaccaaauagacuuggaaacauaaucagggcaugugcacgguccugucuuggaguaaagaaaacuauuuguacagaagaguagagaccuaauuuagcauuuuccggcaauuugacauugcucuagaaguuuaugagagagaaaugcagauuaugaaauuauuuaaaaauauaccucagaggagcagggaauguuucuccugaagacaagaagacucagguugaauaaaguguucuucaaaugcuuaagagacugucauauagauuuguuuucuguggccccaagaggcacaagaagauucaaagauguuacacggaaguagauuuuacauaaaagcugauuuuuggagauaagauaccuuuucauacgaugcaaauaguugcuucauuuuucuaaguuguguaauuauuucuauuuuuuauauuuucuuuaugguagcuaacaagcuagccuucccccuacuucccuuucuuucuuucuccaccucucuuucacuuuuccucucccucacuccuuuauuuccuucccuuuuuaaauggaaauucucacauacaaaucuaagagaauagcguaaugaaaccuguguauguuuauccaucauccagcuucagcagccuucaguguacaggcagucuuuuuucauaucugccuauuaccaccuugcugacauugccaccuauguuaauuuaaagcaaaucuaagcaccauaccauuucauauauauaaauauuuuaguauguaucuguaaauuaagaguguuuaaaaagaaauauagccauaauacuauuucagauuuaaaggaaaaaaaaguaauuccuuaauauugccaguauccugucaauguugagauuucuucaauuauuuucugucuuuuuacaguugguuuaaaucaggauccaaaccagguuuacauaguuuuaauguuaauuauuuuucuuaaauauauacacauacuauguacccaugaaauuaaaaauuaaaaaaaauuguuuuaaguuuaaucauaacaguuccucuuuuuuuuuuuucuauuuauuuguugaagaaauagucauuucucucacuuuauggauuuugccaguugugcuucuguguguuguauuuccuauuuuagauccagauacuugaucagauucagauuuauucugauuuugacaagaauagucauucauaaugcuguguguuuccuuauguaucacauaggcacugucugguugcuucucuuuuugugauguugagauugaacaagguuuagguauccaauauauuucuugagaaaggaugcuugagagguaaaauuuuuuagacugucugaaaaugccuuucuuacuauccucauacuugauaguuuagcuagguauagaguuccaguuuaaaaaaccacucucagaccuuuaaaguuacuaaacuucugguguugccaaacuuauuuaugacuuacccugucucuguaccacuugucccuauucuccuuccccaaagcuuuauaauuuuggcauuauaaaauuucagucucauuuucaauacuuugguuggcuuuucauauuuaagauuuucuucagaugucuggugauccuuggguucuguuuuuagucuauagcaaugccauaaaaagcuaaauuggaaagucuggaugcauguuuuguugguucauuucacuguacagcauggauuaguuuucuauugcagcauaacaauuuacuauaaauauaguggugugaaacaacgcccacuuauuaucucuuaaauuucugugagccagacaucuggggacaguguggcuggauucucuugcuuauggucucaaggcugauaucagcuauccuauguuccuuaucuguaggcugugggugaacauuuacuuccaaauuuauuguuauugguagcagaauuuaguuccuugcaauuguagaaccaagauccugauuuuuuuuaugggcugucaucuccauaagguugcccacauucuuugacauguggcacccuccaucuuuaagucagcaguggcaaguagaauccuucuugugcuuuuaaucucugacuuccuuaucuccaaccagccaaagaaaucucugccuuucacaagcucauuugauugggucaggcccaccaggauaaccucgcugucuuuaggucaacaaugcuauauaacguaacuuaauuuugggaguaaaaucugucaaauucacagucccaagguuguaggauguguacaucagggacggguaaccuuaggaucauuuuauuagacacacaccugccaguguuugucuucugaauaauuaacccagcuaccauaauucugacagugggagcugacagugggaauggggcugaggauuucacuacuuaucauguaaacuuucacuuaaugcuuuuauguaguacuucaugucauccuccuguauaccugaugucuccuaguccagggccuuucuaguuugguuucuuuagagaauaaucaccuggcuguuuaguuuggcaaugaaaacuugugucugauuacuccucacaaguguucagcuggucucccuuuuuucuaaccaaagccucaccccuguaucugguacaucucauaccugacuccuguugggcuaauggucuguuucucuuuugauagugguguuucaguuuauucuguucuauaaguuaguuaguucucugguuuacuuugucuuuauacauuuuagcuuauauauucagcuuauauacagauuuuuccuaguuuuaccauagauggaauuucucuugcauuuuagcccucugaguaaguucugagaggaacauaauuacgcauucaauuaucuuaaaaucagauaauauuuaauaaguuuaauaguguuaguaauauuaauaauuuuauuauaaaauaauaauauaaauaauauuuuaaugugcccucuaucugaauuucuaugguuuuguuguucaauugauuaaaugagagcauuuggaaauaauaaucuggucauuuuguucuuuuuuuuuuuuuccuuuggagagagucucauuuugucgcccagccuggagugcaguggcacaaucuuggcucacugcaaccuucaccucccggguucaagugauucuccugccucagccucccaaguagcugggacuauaggcgcaugccaccauguccagcuaauuuuguguauuuuuaguagagacgggguuucaccauguugcccaggcugaucuccaacuccugagcucaggaaauccacccgccaaguaguaggauuacaggcguaagccaccacacccagcucuuuucuguuuuucgaucuucacuuuaauauucaauagcuggauaagaccagaaaaaaaagaaucaccauaauucaggguagcuagaauaaauuaauuuuugauuacugcuaauuaauuugaaagguuaccaucuaugucuuugguuucuuccuaguuacauuuauuaaaauaguuaucuuuacuuaugaagauacaagaaguucauaaagauuuaaagugagauuuuuuuaaaacagugguuaguuuuuacugagccagaucuguccucuugccuaguugcuguugcuaucacugacaaauauuuguuauauagugaucucagauggcugaaaaauuggagcuaauuuuuuucauguggaaauucuucugugauguugaucucaauagugccuucauauauuuaaccgaaagaugaucuauuaaauauuguaguagauucagaauauaguaugacuuuuaauauuagugacauaaauuauacaguagguaucagucuuaucagaccaagacaguuuuuauucuuuauacaucuuaacuguagcagauaugaaauuugacuacucugaacauuuuuuuauggcuauaaucauaaaggcuucuuggcagauuuauuuuugguuuugugagauauaacauuugcuauguuaguuuuuuuauuaaagaaaagcauaaaaauauaucuaaaaguacuaaucuaaaaaucauucaggacggcaacagaaaaaaaauauuuuaaaggcagagaugguuaauaaccaccuguaugaaaccuaauuguugcuuuugcagauaucgcuauaaagcaugcuuaccccuaaccuuuuuauucuaacucggugcuuaaucuaggcugccuauuuuauuauaaagugcacuguaaaaguauacacuuucaaaacuuuaaacaugaaacuuaugugauauuauugaacaccuuucacuguuacauacuuaucugugcagauauauuuauuaccaagugagugguccuuuuuguuucuuaguuaacuaguuuguuguaaaaccuauaauagccuuucuuuaaugugcauuggaaucauauggggaucuuuuuuaaaaugcagguuuuggaucaguacaucguagggccugagauucugcauuucugacaagcucccaagcgauagcagugcuucuauucaguggaccacauguuggauagcaggguucuguaauauccaucauaacauuagagguaaagguuuuuaauccuagcuguuuaucagaauugccuuagagccuuuaaaauauguaggugccaggcccugcuuucuacuuacugaauuggauccccagauguagaaaaccucagcaucuauauauuugaaaaccacuacagggggcuggaucacacguguaaaccuagcccuuugggaggccaaggcauguggaucacuuaaacuaggaguucaagaccagcuugggcaacauagugagacccugucucuaacaaaaaaaaaaaaaaaagcaauuagccaggcauggugacaugcgccuguggucgcaggugcuuaagaggccaaagugggggaucacuugagcccgggaggucgaggcugcagugaaccaugaucaugccacuguacuucagcuugggcaaccaggugagauccuaucuuaaaacaaaaacaaaaacaaaaacaaaacaaaaaagcaccacaagugaugcugaugggcagcuuggauuaagcaccacugaauuaaaauaauaaagguuagggguaagaaugcugcaugcuuuauagggauaucugaaagagcaacaguuagguuucauauagaugguuacuaaccaucucugcuuuugaauuuuuuuuuuaauuuugcaguucugaaugguuuucagauuaguacuuucagaugauuuuaaguauaugugauaaguuguagacauaacucauuuauagcuuaucuuuuauauauagucuagaaugccuuuuuaggccauauuuuguucacagaugauagcccaguaaacauucuuaagcaaaaauagacauuggcccgaugaaguaguuuacaccuguaauugggagcacuuugggaggcugaagugggaggaucacuugagacuaggagaucuaaacuacccuacacaacauaaaugagacucuaccucuacaagaaaguuuaaaaauuagcuggguguccugcugcgguggcucacaccuauaaucccaguacuuuggcaugcugaggccggaggauuccuuaugcccaggaguucgagaccagccugggcaauguagugggacccugauuccuccaaaaaguaaaauaauuagccaagcaugguagugcacaccuguagucccagcuacuugggagccugaggcaggaagauuuugaacccaggacgcugaggcugcaguaaacuguaaucguggcaugcacccagccuggguaacagagcaagacccugucuaaaaaaaaaaaaaaagagagagagaaaaaucagccuagugugguggugugagccuauaauuccagcuacugggaggcugaguugggcggaucacuugagcccaagaguucaugacugcagugagcuaugaucaugccaccguacuccagcuugggugacagaauaagacccugucucgaaaagaaauauauauaaauuaaaaaaaauaaaauguagacauuucccaaaucauagagauggugcuagcuucuggcacuacuggcgucaaugaguuaaaaauaauuuuaucaggacucuguccccuucucuuucugugucucuguucuccucuauguugacuuuauuuugggcagucuuuuucuguauguggugacaaaaguggcuaaauagcuuaugacucacaucuuaccaauuuagcaaccuuugaauauacguucuuucagagauaugacagagucuaauugucccaucauaggccaaagacccguuucuggcaccagagggucacaggaucaaguaccuaugaaccacauggaaugaauaagauuauuagaaaacuggagaagagugauuucucaaaagaugcugggcagccaauauauaugucuacucuaccauuuggagguuauuuguuaacauacacaguauagcuuuaaguaacuugaauuuugcuuuguuucuccuuuuggguguguccauauuggugugaaaauaauauaauaggaauaggaaaauuguccacggcugaugguaaagccuuugcagauccugaaguacuucggagguugacaucgucuguuaguugugcguuggaugaagcugcugcugcacuuacccguaugagagcugaaagcacagcaaaugcagggcagucggacaaguaaguacauuuuugcugccaucaguaugaaaucauuuucuuaaaaauaauaacaaauagcuaacauuuacugagcauuuauuuugugccuggcuggcacugugcuaaccacuuaacaugugaugucuuauuuagauucacaaaaacuuuauaagguauagauuuuguuuuuacucccauuuuacagaugaaaaguuaaagagagaugaguaacuuaaucaagaucaaauagauaauaaguggcagagcaccagugucuuuccgacugcaaggcugauggccuagucaauauguuauaaaagacuuuuugcuuauuuagauuuuuuuuaaaaauguauuggugacaaagaaguaaauguuuuacaauuaggccauuuuacaguucauuugcguaguucugaccauuuuaaagaguaaggcuuuuuauuuauuuauuugcuuucugaagucuuaaaagaaguuauagaucuaguuccuauaacuugaaugugaguccagggacuuuauuuuuuuauauccuauaauuccuuguauauagauagcacuuuacaguuaguaaggacucaguaaauguuuugugacauggcauuuuaagcuguucugaugauguuauccaauaaaaaucacaccaucucauauauaaacacaauuauggauguauauugaaaaauggaagccaggcaugguagcucacgccuguaaucucagcacuuuggaggccgaggcgggcggaucaccugaggucaggaguucaagaccagccugagcaacauggagaaacccugucucuacuaagaacacaaaaauuagccgggugugguggcgcacgccugcaauccccgcuacucgggaggcugaggcgggagaaucgcuugaaccugggaggcagagguugcagugagccgagauugcgccauugcacuuuagccugggcaacaagagcgaaacuccaucucaaaaaaaaaaaaaaaaaaaaaaaaagugauaagaaaaauggauagauacuucaaggaagcaacuagaaaagaaucauuaauacauguuaccauuuucaaccguugguggcuucuuuuugccuccucuaauaaaaugaagccauuuuauuuauuuuagcaauugccuuaaaacaauugagaacaucugaauauucuauuuggguuuagagaguaaauuauagcauuuaagaauucuuuguugucuaaugguguuuucauacaacauuuuuaagagcauaaaagagagguuagauaguauuaacaaggucaugaauuugcuguuucucuuggcucuuuauuaguguucauucaucuagauuuuuguguuuguauuaacuugcuuuaccauucuucucauagguugacugacucccuucuuuaguuaaccucgguuucuauuccauaguaaauguucaguuuuacuagccuacaauaucauugguaaucuccaaauauuuuuuaauguggugccuacuaagauuggcaagagaaagaauuaaaacaccuugaaggguauacuaaaaccaguucaagcaggaaauagaauagaaaaauaaagucacaaaugauuuugcauugaaaauacuggaauuuaacagcaaaaaaaauagaacauauuugugagaauuauauuuauucaacaaaguuugagaaagaugguggacuuaagugcagugaguacuaugugccacauuuuuauauuaguuaaggacagugccaugugccaggcuuaauaugcccuucgcccacaaguucuuaaguucagcuguugcuagaguagauccuguaagguuguuuucaagcugguauacacacauggaaauugaaugaaaaauucaaaugauaauguaaauuaggguauaugcauaaagaagugaaagagacagagagagacuacuuugaaagagagaaaagguaugcucuuauacaggaaaugucuuaugggaaggauuuguucuaaacaugcuuaaaaaugauagcauugagucuagggacugucaguguccugugaaaugggaaaucagaagagauguuuaaaagacaaauuuauuuaguacuggucgagacuuucacuuugguaaggggacaauacaauuaacauguaaauaaaauauauaguauugcacauaauaauauaacuaugggaaaaauugaaagggaagugcuaagacaguguuuggguuggaggucaucuugguucauuuucuguugcguguaacaggauuccugaaacugggcaagaaaaggaauuuauuucuuacaauuauggaggcugagaaguccauggucaaggggcugcaucuggugagagccuucuugcuggcagggacucugugcagagcccugaggcagcacaggccaucacauggcaaguaggcuaagugugcuaguucagguuucucuuccuuuuauaaagccuacccagucucacuccaugauaaguaauaguucauuuacccauuaauccauuaauucaugaauggauuaaccgauucaugaagacaaagcccccaugacucagucaccucuuaaaggccuuaccuaucaguauugccacauuugggguuaaauuucacaugaguuuuggagaggacaaauaugcaaaccauagcagaggucauauuacauuuuuuaauagcguggucagagaaguccucacuuaaaaugguggcuuucuaggaaagaccugaaauagggaagggagugagccaugucugagagaggagcugucuuggcacaggaacagcaaaugcaaauauuuggagguuggagcuuauuuagcauauuugaugaacagcaagaagaccaauguggccaaaguggaaggaauaagggugagaggguaggagauaaagccagagaaguaaaagggaagaggaauaugguauccugccacuaggcagaucuuguaaggauuucagcuuuuacugugagugagauuauaggccaguggaggguucugaguagaggaaugacauguucuacuuuucuuucuuucuuucucucucuuucuuucuuucuuucuuucuuucuuucuuucuuuuucuuccuuucuuucuuucuccuucuuucuuucucuccuucuuuccuuccuuucuuuccuucaagauggagucucacucugucacacagacuggagugcaguggugugauccuggcucacugcaaccuccaccuccuggguucaagugauucuccugccucagccucccaaguagcugggacuauaggccacgcugccaugcccggcuaauuuuuuuuuguauuuuuaguagagacaggguuucaccguguuagccaggauggucucgaucuccugaccucaugauccgcccgccucggccucccaaagugcugggauuacaggcgugagccacugugcccggcggacguguucuacuuuucuuuuaaaaagaucucucugguugccuuguugaaaagagccugaaggagagcaaguagugugaaggcaaggagacugguuaggaggcuuugccauaucugagacaaagauguuggucuuaaaucuggcugaugguaauaacagggcuauagaaaagugauuaucuguaggugccuuuaguaucugaaaugaaagggccauauuuuaagaggauaauaaaauaauugaguuauauuugaaauaaaaagaauauuaauagcccuggauuuaguuuuaggauuauuuuauacgaaagugagaaucuuuagaaaugucuacaauuggaauuguuuugggaaguuuauggggcauacacuuuucucucaguuuaauuuuuuguuacuccacuuuuuccacucucauuuugcuugaguuuagcuuuuucuuugccuggauuugaaacuuccccccaaauuugauuguauaaguaaauacuuucaaaaccaaaaccaaaaaaggcucaucaguuauucauuuauuaauauuacauucucccaucuuuuccgucugauuucccuuuacuugauggaaggacucacauagaucuuuauaauuaguggaaguuuugcacauuuuauacuuuuuaauuaaauuuuauaaaaaauuuucuacugaccgaacaaaagaaguauaauuaugaccuguuauuuguaugugauuucuauaaacuuuuauguuuuaaaauuuuauguucuuucuccacuuaccaguaaauuagacuuuauccuucaguugcauaacugaaaacauuuuggaauauugauaauuuuaauucagugccauuaauauguagauuguaaaaaacucaaugaauucaaucauuuuugccuuuuuguuaugaaucauauugaaauaaucauccuuguugagcacuaauguuagcauuagucuguucucacucugcuauaaagaacuaccugagacuggauaauuuaugaagaaaagagguuuaauugacucacaguuccacaggcuguacaggaagcauagcgaggaggucucagaaaacuuacaaucaugguggaaggcaaaggggaagcaagcaugucuuaccauggcacagcaggagagagagaggggaagcaagcaugucuuaccauggcgcaguaggagagagagagagagcaaaguggguagugcuacacacuuuuaaacaaacagauaucaugagaacucacucauuaucaugagaacagcaagggagaaauccacccccaugaucuaaucaucucccaccaggucccuuccccaacaccggugauuacaauuuaacaugagauuuggguggggacacagagccaaaccauauuaacugucaagauuugacauaaaaauccaauacucuggcugggugugguuguucacaucuguaauccuagugcuuugagagucugaagcaggaggauugcuugaggccaggaguuuaaggcugcagugagcugauugcaucacuguacccccuccugggugacagagcaagacuccguuucuaaacaacaaaaaacaaaacaaucaaaaacaauauuuaugcugugcaauuuuuuaauauucuuauauucugguauugugauauucuuuccguaauagccgcaguuuggcagaagccuguucagaaggagauguaaaugcugugcgaaaguuacucauugaagggcgaaguguaaaugaacacacagaggaaggggagagccuccuuuguuuagcuuguucugcuggauacuaugagcuugcacagguucguauuaucaaaauaaagcuuauuuguuguuuuuuuaaaaacuggcuugcuuacuaaggaaauaauaaaauaaauccuuccaaccauuaggauuauuucaacaaauaguuuuguuagauaaauuuugugugcuuauagcucuuuuacuaugacuagguagacguuauauaaauacguguucaaaauuuuuugacgauuauuuccuaauaucuuuuuaaacuauuuuucucucauaagguuuuguuggcaaugcaugcaaauguggaagauaggggaaucaaaggugacauuacaccuuuaauggcugcugcuaauggaggacaugucaaaauugugaaguugcugcuagcucauaaagcagauguuaaugcacagucuucaacaggucaugccuauuucuuuuucaguuuuacuacauaguaacaucauuugguaauaaugauuuugcaugaaagugauguuuagugcuaauuuuucaguucucuuauuagaagugcuacauauucucacacaucuguguaugaguuuugaaguauauagaauauauuucaaaugauauucuuccuguuuuguuuaugagggcaauuggccuuuuaagauucuuuaagauaaaaguaaaacacugacccaguuagauggaccacucucuuggaaauugagaggugugggccguagugcucaaauccauguuuccaguuuuuuaggagaggaaugggaagauagggagaccaaacaauuguggaacaaaaggauaguucauuguuuccuacuguuacuaaauuguggcccacagaaaaaaauauugugaaaacauuguguccugaagaagagcauaacuuuagucuaaaauauauauuuuuuucaaauuugggccuagauagauuuguguaaaaauucuaaaauuucauggaaauauuuugugcauuuccuucauucagauuuuucaaauuuauuaaauuuuuuuuuuuuuuuuuugagacggagucucgcucugucacccaggcuggagugcaguggcgggaucucggcucacugcaagcuccgccucccggguucacgccauucuccugccucagccucccaaguagcugggacuacaggcgccugccacuaugcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggcccguuauuaaauguuuuuuaaggucauguucugauuugaagggauuuuuagaaauucuuauuuuacccagaagguugauuuuucuuguaacaugggaaauuuuuaucagcagaaaagaauguuuuagaaauuauugaauucaaauucaaauuuagaaauuugaauuugaucaguuaacugguauuugaaguuguaaugaaaacauauaugauuaaaagguauaguauaaaguauguauaugaugaguaauuuuagguuagaaacauuaaaauuaaaaaaaagcuugugaagcauuucucugauaaacauuaaaacaacuuuuuucucaucuuaagguaaaacuuagcucuggggcagaguugcccaguucuuuuacaacuccccagucuggauaaguguauaugauuuuccacauguauuugacuuugguuuuaaauggaaaaggagaauagggaguugauuucagaaagauaaaaugcaguaggaaaggaauuuuauauauagauauauauuuacauauauguauauguaauuuaauauuuauuaugguuguagucuucuguuuccauuuucuuaauguaaauuagcacuuuaauuuauuuugguauuuuauguuaaugucuuuuuauuuuuccuaauuaaaauaggcaauacagcacuuacauaugcuugugcuggaggcuauguagauguuguaaaggugcucuuggaauccggugcuaguauugaggaccauaaugaaaauggucauaccccucuuauggaagcuggaagugcuggacauguggaaguagccagauugcugcuagaaaauggggcuggcauuaauacgcauucuaaugaauuuaaagagagugcccuuaccuuagcuuguuacaaagguacaguauaaaccuuucuuaaaacaaaguuuuuaaauaugugaaauuauaauuauuuuauguaaucuuguuucuaaguuaaaaaauaaaacaaugauaguauauaguauguaauuaaagguuaaauaaguguuugcaguguugcaguuuguuuacuauuuaaauuuuuaaaauauagauuuaacuauaaauauugucacugaaaaaugaguauuaauugaucuaauuguuuuaucagaaacaguucuuuuaauaugaacuguauaauagcuuugcauguugggaagauuuugcuugguaugaagggguacaugguauuuuaaaugaugucaaugaaccugaaaauauugauaguacagaaaaugcccuccuuuggcagaccggacaauugccuagaaagauauuuugucuguagauaauuaauguucuauauucuagauuguuaaaacacagccacagagcugaacauuuuuuagacuccacauguaugacagauaaauggcuguaaaguaagguguuuuacuuuuuaagaaaguaaauuaagaaaauuuuuuauuaaggaaguuuuuuauuaaaaaaagucauacaauuuuguguuuagccacucauuucuguguuuuaugucaucugucuauauaguugucccauauuauuuacgucauaaauucuugaccccuaggcaucaagaaaaagcuuuugcaaaaccuaguaaaaaauuuaaggaggcacucauucucagugacuaaccuuucacuugcacaagcuuacaugugaguggcuccuuaaauuuugcacccagcacuuugauuuccucacccuaguucuggcccugguguuguuuuguucuauauaagaguagccaagguuguaugaugccuuuuggaauaauuucauuuauaaacaugaaaauaauccuuauauauuuggauuaauugacuaaaauuuaacuuaaauuugaaaaauaugguuuauuuauaaagugcuuuugauuaucugauguuaauagauuuucagauagggagcacagcugaggucccuuaguucccuuccccaauccuguuuauaauuaggcagaggcugaucuucacugggaggagaggagguaagccuuggaguggguugauuggguggcucucuccccuucucacaaauacuuuugaacccaguacuggcugcauuucacuacugagucccugcuggcuagagagcuuugagauggggcugcuuguaacuacucugcccucucgccuuugcuuguagccccacccugcuauccaaaagggggaucugagguuggggcuugcaggcuuuaauuagaagcuggauagcaaacugagcugguggagaacaucucugcuacuuccagguauccauggacccccuucccuuccucuccuucuggugagguuuuguaggauauagacugacaaggaggaguuagggaagagagacaagucaggcugagacugagcacuaauguggauuuuggggaggggagaaugacagagaggaaaagggaugguagguaguugacaaauauaagacgcggcagauacuacacuuacuuauggaaguaaauuuuguuuaauuguuuaccugugacuccacuaucuguccuucucccgccucccaguugaauaagaauugauuguagcucauuccaaauaaagcuggaaaaaauuaaauaauuuuucuauuguuuuuugcauaggaucugaagucuuuuuuaaauuauaauuugucgucugcuuuuuaaccacuuguaucuuuaaaugaacugaagcauaugguuuauuugaaacugcauuaauguguguacauguuuauauuauaauuaaauauauaaauauaaauuaaauggugugguuugaagaauauuuuuauacauacaguucccaguuuauaagcagguuuuuccuaaaguguuucugaguuagguauuggaacuuuaaauacauuuucucacagaaauaacuugacugaucauuaucucaggcuacuaguucaugaaaacugauuuauuccguagcauauauaacauaacuauauaacaugccugggcucuuaaaagguuguagagggaacauuuuggguguuggauuuuaauggcaucuuuguucaccucuagcagggacucuagaagcagcaguuuauagggcaguaggguaagggguagaacagcaagaucacuuguauaauuuguguucuacaauugaggguggcuucuaguugacuuuauuaugcuuauaaauuuaaugcuguaaguuaaauauaacuuuucaaaauauuauaauuuuaaaaaauauuuuggaauaauaaaauauuuucaaguaaucuuguacacuuuugguuuaggacacuuagagauggugcgauuucuuuuggaagcaggcgcggaucaagagcauaaaacagaugaaaugcacacugcucugauggaggcuugcaugguaagauuggugaaauaugucaaauauguuuauauauuaaccagggagagacagaguaguauacaaugaaugccuuuccaaugggugcuaugauucuguuugucagaaccuuauugaaucaguuguacaacauuaacuucuauuaaaguuacuuucugaagcuuuacaaugcuaccugcauuuucuuagucucauauaacuauaccaaagucacucuuguaaagauugguugaggauaugaaauaggaaaauauggccaggcaugguggcuuaugacuguaaucucggcauuuugggagaccaaggugggaggauuggauuaacaaauuaaaauggaugccagcaguucaagaccagccuggccaacauaccaagacccccucucuauuuaaaaaaauguuaaaaaaagaaaaaaggaaauauaauucagaguauguacauuauuaauaagcauaacauaccucaaaccaauaaauugacuaaacaaaaauuuaaaaguagggccuaauuuauguuacauaauuuccccucucucgaggucuuuucugagcccuagauugucuuuugaagagcugcauuuuagaguuuguauucgggaauggcucauaacaguacucuuaaaccuuuguaucuuuguuuauuuaugacacagaaaugggccaaaauaucauagaaaaauuuaugaggagaacaggccagcgguagaaagggcccccaaagaaucugaaguuucuugucucaucuucccuucagagaguaauuauugaaaggauguuaaauuuuauuuacuauuuuuuaaaauaugagguagccauuuaagacuugaguuaucuguuguuuuccuuauugccaucuuaguguuugcuuuagcaaauuauuuuuuuuuaacaaauaaaaguuuuucuaagcuuuugaguucuucaucuguaaaaugaggaaaauaucuuucucuggaguugugaggauuaaaugagauaaugggcauaaaacacauuaauaguauuaacaguaacaguuuuaaaaguuccccaugauaaggaaauuuaaacauucuugccacccccuacugaggaaauggccuguguguagauuaagaaauuaaaauggaauaaucuguaggucuagccaacaugcacuggaaguaaauauuauaagugaaagauauuaguaggggccagacauuugaaagacuugcuauaauacugaguuuuuaaacuaggauuuaaaggaaaugugggaguucgcuaucgaggaagaagauucagcacugaagaaauagcaaaguaaucaaacuaauaagacauuagagucuucucuacaaauugaaauagaaaaaaaaguaguaagccauuaaaauuguguaaugugacaagcauagaggcaaaaauaggcauggcauguuugaaagaauaugucugggagauaacauauagauggaaaaaaauuacugaaggacaaaaagaagggaaaagagggccuugaaguugccaguaauuaggaaagcagugggaaaaagugaccagaagacagaauauagaauuuucuuuucuuuuuuaauucauuuuugagacagggucucacucuguucccaggcuggagugcagucgcaugaucauagcucacuauagccucaacuuccugagcucaaaugauccucccuccucagccucuugaguagcugggacgaagugcacaccaccacgccuggcuaauuuuuguauuuuuuguagaaaugggaucucaccauuuugcccaggccuggcucaaacuccugggcucaagcaauccucucuccucagccacccaaaguccugagauuacaggcgugagccaccacaccuggcccuuuucuuaauuucacugguacuuggacgaugaacaauauagaaaguaccauguacgcauuuguguuccccuaacacagcauguauccuucccccacuucuccaaaaaggguuccauuuuuuucuaacuaaucaaaaguuugcuuauccuuaaagauucuuaugaaaauucuucuuuuccucucuaaacuuuauccuuuuaacauuuaaguuuguaccauauaguguugaugucucacuauagucucuuauuucacauacuuacuguuuuuuuuucuaaugguuaauaagcuucuugauugaagguaucauguuucuacuuauuuuauauuuucaaucucuauuucccucuucuauguuaacagaauauaggcagugcauaauaaauacugauuuacucaacuguuaaauguagcucuauuccuuuuugaguggagauagauaaacuucauuguauaguaauugagaagucuucaaauuuuucaagauuuuuuuaauggugcugauuuaauuuuuuaaauuguauuaucauuaggauggccauguugaaguagcuagguuacuucuugacagcggugcccaagugaacaugccugcugauucauuugagucaccauuaacuuuggcugcauguggugggcauguggaacuugcggcuuuacuuauugaaagaggagcuagccuggaagaggucaaugaugaagguuauacaccauugauggaagcagcucgagaaggacaugaagaaaugguggcauuacuucuuggucaagguaaccguaucuaucaagacacuaaaguauaaauguguaaaaccuaagaguauaauuuuauaaaauuggauuuuaguauuucaccuuucuaguagaguugcaaugagcuauuacacaaaccagugauaaaguauuuacugugaaaauggcucccauacuguguuaaaacaaaaucaaagaaacuucuuucauauagagcuuucagagacaucaugugcuauaugugaacgaaaaacagaacugguguuggcaaggcuugugaguuaaauaggggaauauaagagccaacauuucuaaagguaauagaucaagagaauguauuccuuugggggcggaauaccuacuaauaaguauuuaauagaucuaauguuuuaaaaaacaguaugggaaaccacgcaguaaagacuaacuugcugagagugcaagaaugcgcacauauuagaagcugccaaggggcucaguacauaaacuucuuuuuugggaaaagugaaacaauuacuucaauauguuaagauaucuucaguuuagaaguaaucucccaucucuguauuuguagugugauuuuauuuuucuuucaguaguaaaguuuuugucuggacaaauuuaagaggaaugacacuuuuaaaaaaaacuuuuguuuuuauuuagaaguaauguugacuaugauuuuuaaagcguagguuuuggagcagacuucuuagguugaaucauaacuccacugcuugccaauuuuguaacuuuaggcaaguuucuaaccuucugugccucaguuuucucguguaggguuguugugauaguuaauacguguguauaaagcuaauagaacagugcuugucauguagugccuguuaagugcuagcuauagugauggugguaguauugaugacaauaauguugugaccuuguauaaguuaaauaaccucaguuuccuuagcuguaaaauggaacuaauaauaauaauaauaauaccuaaauaaguuguaaaaugcuuugauauugccugggaaauagagcuuauugaauguuaagauuuuuauuaucaucaucaucaucauuaucaccaguaucuuuaucauuuuugaaucacuauaaugagaggauguagcuuauuuuuuugaguucuuuuaucacccgacuuguaccuucuggcugaguaaauauuacuccagcugugguacaucaaaucugggugugauuuuaauaguuuuauuuauuuuuaguuuuaacugccuuaggaguuaggagagaggcacuuucuuauuuauuauaguaauauaaauguucauuuuaaagauucaguuuauuaagaaacaaucauguuuuucauaucucuggaauaaguuaaugacuuucuuuaaauaauuagaaucuuuauuuuaggagcaaauaucaaugcacagacagaagaaacucaagaaacugccuugacucuggcuugcuguggaggcuuucuggaaguggcagacuuucuaauuaaggcaggagccgauauagaacuaggguguucuaccccuuuaauggaagcugcucaagagggucauuuggaguuaguuaaauacuuauuagcugcagguaggcauuuuugcauuugggagaaguuuuuuacaugauuuguuuaaguaaaaaugucauaaugcaaauauuuuuaugaugcuaugauacacugaaugugugaguuuaaaaaaacgugugauauaccuuuguauguauucugaacaguuuaccuuacugcuguuugaaguaucugcagcuuuaauuucaaccaguuuuguuuguaauuuuuuuaaugccuacaauauucucuguuucuggaaaugagugaaguuugaauuuguuuaacuugaggagguaugacuuaucuagaagaaguuuuuauuuucgucauauaugucuuauggcuccuuuauuaagucuauguauuauuuguugacuacuacaggagcuaacguucaugcaacaacagcaacaggggauacagcacuaacauaugccugugaaaauggucauacugauguagcagaugucuuacuucaggcaggcgcagaucugguaagcuauguuacuuuuuaaaucuuaauauuuaacaauaagaaauuaauuuuaaauuauggagagucuagacaaaagguauuucuuuaccuucaguuuuauuguuuuuuuuauuuuuauuuuuuugccauucuuucucucacuuagucacauuuuuuuccacacuguuuaguguccauccuuaauaggguuauucacugcauuaucccucauuuuccauagaaaaaggaaauuuuuguguuacagauauuaaugcagacugguuuucccuuagauauuaacuauuuuuagaagcuuuucugauuugauauaaaaaggcaaauguggcuuagaggaauuucaguauugcuuaggaaauaaauuaugccuacaauauucagaacauuauuaaauaauaaaagaguuuaaaacauaaauaauaaacuuuucccucaaguacuuuauaauuucagaaaaaauaauaggugacaaauacugagguuauuauaagagauguuguagugaaaaugcagaguaaagaagaucagaagguaaagcagucaucugauguauuauuuuggggauggcuaaaguuuagaaagauagauauggcaguguuguggcuaaagagauauuucaauuggaaaaaauguuaugagugaagccugagggguaagaaagcaugaagcaacuguguguggguagaauagguggucuuccagucuagccugcgggguaaaaggaauaagacauccaaaggcccauuuuaguuaaaauguaagcacccauauauuuauggccccgagauucuaagauuaauaagcaacugugcucuuuccuucacaguuuaugacaaauucaugugcaggcagcaacaagccccccuucaguaauuaauuuuauaaacuuaauaauuuauaauuuaaucuuucuuuugucauuuaugagaagagaauguugaauuagauuauugcuggggccacuuaguguuagcacuaagucuaacaagggagacauaagcacacaacuaacuagaauagaacguauauaauaagugcuucgagcuuguuagacuuagagcuucuucaguguaagaacuguauuccuaguguuugccacaauggcucugaaacauacagcagugaaaucuuuaguacuugguuaguugauggcaauuagaaaaaccuaggauauggcuuaagagaaaaaucagaaauuguucaucagaugugaaggcuuuuuaaaaaaagaaauaaaaaaugccauacaaaagauacuuuuucucaaaucuuuauuuuuuuaagauugaaaauuucaccaguaguguucuugauuacuuaguaaucauaaguaugcaguagagucuccauccuuuugggacccagaaagcucuuguaacaucuuagaguugaugguuuuagaaaaguuuguuaucauuuuuguauaagggaaacuagagauaauaggaagucuguaaagagaugguaaugauguacuuacuaaaauucauagagaugggauacacucauaagaggaaaauaacuuggaguggaugaggauaaugcucauuauauugauuguucggagaaggccaugcuagaguaccauacaugcauauucaaguaccgcaauucauuguguagagagaaggacaaauuacucagaugcguuuagaugagggcaucaugaucacgugacuauaacuucaaauuuaaaauuauuuccagugcucacuuuggcagcacauauacuaaaauuauuuccauagaacauguuuaugauuugagauuuuuuuuaaauuuaaaaguauauuucuuaauuugcuucaaagcauuauauuuaaauauuuagauucagaaaucaguccaauuauuuuccuuuugauuuccaugaaaaagaauacuuguucacuggcaauuaaaugucaagucuuuuuuuuuuuuuuuaaacaggaacaugaaucugaagguggaagaacuccuuuaaugaaagcugcaagagcuggucauguuuguacuguucaguucuuaauuaguaaagguagguuuguauaaaacaguugucuuuuuuugaaagguaucuaccccugccuucauuuagagauuuaaggguaaaggucuuuugaaggcaagaggguaucauaugaggagggaugcuacugacauuuaaugauugaguggauaguugauaaacauccugccaugcacagaccagcuucaaacuagaaauaauugucauaccaaguagcacacuuguugugaaacguauaaaggaaagggaaauuucucuguguaaaaacugaggauuuagguaacaaacucugcuguguucauguacuauagcacuuucuugaaaccuggaauuuuaugauguuucugccacuaaaaaaguuuguggcaaguaacauuucuacuauuucccugcuucuauguuuccuuuuuuauaaaauacagggagcugguuauaaauauaguacaaaaaauguucacaauagaaaugugacaaauauagcaaauugcaugaggauuuucauucaugaucagaaauuuuaguuugaauaccaaagaccuuaaugaccaaauaaaauaaaagggaguauauuauuacuuucuuuaaauuguuucuuaacgugcuuacuaggaaaguucuaguugagacaguuuucaauucagaguucaucauauucuuaaguauaagagauuacagauuuuauuuuugauucugcauugauaaaagaaagaggaagccaggugugguggcucacccuuguaaucucagcucuuugggaccucgagucaggaggguccuuucagucuuguaguucaagacuagccuggacaacacagugagauucugucucuacaaaaaauuaaaaaauuagcugggcaugguggcuugcaccuguagugccagcuaguugggaggcugagguaggagaagcacuugggcucaggaguucaagauuauagugagcuaugauugugccacugcacuccagccagggugacagagugagaaccugucucaaaacaaaaaaaagauguaggccauauacaauuuuaaaaggcaauaauauaccauuuucuucacauuauaauaauaguaacgaaaucucaaguuuauaauuguuuauagguaaagaaaauuugaaauaacuuacuggcgaaauuacuuucaacauuuucccaugcacuggugauaugcuuuagaauacuguuaugaauauauagcauuauguacauaaucgcuguccccucucauugguuaauuuuaaugaguuugauuucaguuucuuucugcuguuuuauuuccauuucucacauuaccuagcacaguaauccaaauuagggauagaggucaggugcaauggcucaugccuguaauuucagcauuuuggcaggccaaggugggaggaucacuugagccuaggaguuugagacuagccuagguaacaugcauggcaagaccccauuucuacgaaaacaacaaacgaauaaauuagggauacauuccuauuugggaauaggggugaauuaucuauuuuccuugucaggaauuuacuaaugggaaaaaaaaugguacuauucuuucuauuuaguguuuauucucuacauaaagcccauagagggcaguauaguuuauuuuuauucagucaucuuuucuacugaagaacuuaaaauacaaauaaaacuucauauuuuacuuuuaauacaguuauuacauuaggaguaauggguacuuugguaucuuuuacuggugcauacucaaaccuuuucaaauuauaucguguuugucugggauuuauuuacuuuagaauaauccaagaugggagaggagaauuaauguaggauauuugugaaaugagauuggccuuguguuuauaaucauuaaagcucgguaauggguauguggagccucauaauacuauuuucucuacucuucaugauuuuuaaauuuaccauaauuuuaagaaaaaccauucuacuaauaugauuuuccaugccuuuucuguuuuaggagcgaaugugaauagaaccacagcuaauaaugaccauacuguacugucccuggcuugugcagggggucaucuggcagugguggaacuacuuuuggcucauggggcagauccuacucaccguuugaaaguauguaacucaaauguuugugcagaauugugaauuaguauuucucucuuggucauuguuacaacauaucauguacaaguuccauucauaauggcauucuaaguguaaauuuucuccuuuuucacuugaagcguucuuuaccaaaccuaugauuuuaaugcgucugggaccuguuggcuuuaucuuccuaagugauucuguaaacuaacuuauuuuucuucacuuuuuuuccccuuccauauucacucuuuuaggauggcucaacuauguugauagaagcagcaaaagguggccauacaaguguuguuugcuaucucuuggauuauccuaauaacuugcuuucagccccuccaccagaugucacucaguuaacucccccaucccacgauuuaaauaggguaagauuuuaaaaauuaaagcauuuuaugguaugucuucuuuauccuaauucuuucacuuacaguuucuguuuaaauuaggguuuuuuuuuguucuaauauguaguucuguuuguaaauauguacuugauacaguuaaugaacaucugguacaauauucagauccuagaugauaugauuaugcuuuagcuuuuaaaggucacaacuugaauucaaagccuacuaaaaaaugucgugguaaacaauuuggugccaacauauuuuaaguaaauaugucauugucuaagaugacauauuaaaaauauugucaaaaaaucucuaauuuauucuuuauuuagagcauauuacuuaauggauuguguaggacacuaauagucacuuaguguccuuugucuuaggcuccucguguaccaguucaagcacugcccaugguuguuccaccucaggagccugacaaaccaccugccaauguugccaccacucuucccaucaggaauaaaggucaguuauacuucuaaagacuguuucuuacuugguguccagguaaaaauaagauuaccaaaaaauagacauuucuacaaacaaagaaguuuacuaaguuggcauuacuaaauuuuuaacccaugauaaaagcauguuauugggagaaaaaaauaguuaauagcacuaauuugugcuacaauuagaaguuuuagcaugagaaauucagaugcucaucuuugaugcaguucugauuauccaugauuuccuuuaauaguaauuuuuauucauguaaaauguuaagcuggguauaguugagcaauauuuuuauaaauuacuuaccuaaaucucugcaguuauaaaggcauaaauuaacaagauguaucaaauauuagaaauuuauuuuagaaugacuggcuuaauauagauuuuauaucugaucugggauaccuuuucucaaccaauaauucaguuacuugagauaugcuuguuuauuucucuagaauucugagguccauauuugacuuguguauguuacaccauguguguucuuaaguaauguccccaaacauuuuauaccuaccgguuugaaucaguuuuucuuuuuaaaaguuuuaccugaagaaacagugcaguuuuuauuuuuugguuuuuggcuacguauacucuuuuaugaacaagaaugcuaaguauuuucaccagcucuuuucagucacuacuaucaaccuagagccuuggcaccuuuuucaguugguauagcaaacaauugauugcuauaccuauagccagaucugucuguucaccuggcugucagaagauacaguggauggcauaguccagcaucuuuucuuccagggaaacugaaucccaauucucuacuggccagauagcugugugaauaugugaauuuauaucuugccucuauuagucuugaagaugguaggccccaacaaagacauauauuuuacucagauuuuaauuucuuguuacuucuuagugguuuggguacuuuuuguguguauguguguguguuuaaaaggcacagacuaugaaaugugaaaaaaccugacuuagaggucuguuuccucuucacccuaauaauuuagcauuauuguucuguucuuaugaugaguuuuaacaucuuuaugaccauauaaaauaucuacacauagccuuagauguuacuuuaauugcacacuuagauaucacaaaccugcauuccucuauugucuaauuuaagccaugugcuauuuuuaagauucugaaauuaauuuacaaagauuuugcacauaaaauacauacauuuuauauuugugaaaaagaagguggauuuguuuuuaauuuuuuaacagugcauuuucaccuguuauggauaugauuacuuagugcauaacuguuggcacuaaaccucccaacaguaacucuguaaugaggaugccauucaugugcacuucugaggggguuucuuuuucacacagcugcuucuaaacaaaaguccagcagccauuugccagcaaacagccaggauguacaggguuacaucaccaaucagucuccagagagcauuguagaagaggcucagggaaaguuaacagaacuggaacagaggauaaaagaagccauagaaaagaaugcacagcugcaguccuuggaacuggcucaugcugaccaacuuaccaaggagaagaucgaggagcucaacaaaacaagggaggaacaaauucagaagaaacaaaagauuuuggaggaacuacagaaaguagaacgagaguuacaacugaaaacucagcagcagcuaaaaaagcaguaucuagagguuaaagcucaaagaauucaacuucagcaacagcagcaacagucuugccaacaccugggauuacuaacuccuguuggaguuggagagcagcuuucugagggagacuaugcacgguuacagcaaguggauccuguuuuacuuaaagaugaaccccagcagacugcugcucagauggguuuugcgccaauccagccucuggcgaugccucaagcuuugccucuggcggcaggucccuugccuccaggguccaucgcaaaucuuacagaacugcaaggagugauaguuggacagccaguacugggccaagcacaguuggcagggcuggggcaaggaauucugacagaaacacaacaaggguuaaugguagccagcccugcucagacccucaaugacacgcuggaugacaucauggcagguggguuuauauuguuaugagcagguaucaaauaugauuugcuuaaggcgaguaagaauguacccaaauuuuuugccguuacccaacuugagaacuauuuuuggacugacucaugucuagcuuuagaaguauuaguucaaucucagaaguucucagauggauacaggucaaauuaaagauuagcucauucaguacaaaugacugaagcuuucuggcuuagcuugguagcuugagaaucuagguuuuucaguagugggguugauguuugauuuuuguuuuuguuuucauuuuuuuccuuuaaguucagaauacugagauugaauuuuggcauuuugcuucuguauucacaccaauaaacugggaaauugauagaaguugaagugcaaaacuaguaggacacaucaggaagcuuauuuaugaacagaaauacuuuauauccuaauggaucagacuucaaaccugauggauauuuaaaaaaaaaaacacuuuuacaaaauuaauaaaguucaaaaccaaauaggguuuaauuauacuguauguaagugauuuuguccccugugaauguuaauguguagucucuuucuaacuguaucaugagaagguguggccccccugaaaguaucauaaaugauauauuuuuagauguguagccagauaaauuuuauucgauuauaacuaguuucauugacaagaagauacacuuuagaagacuguuuuuaugcuucuaguuuuugguacuuauuuuuuguguuuuguaacaaaguaaugggaugagguuuuauaggguugugaaccauaagaaugcuguacugagaaggauaauuugcuucauuaaaaaaagaaaauuugaaaaggaaggaaaacagaaaaaugaaaggaauaaacaguggaauuuuggugacuuccaucugaucucuuccccuuuuuuauucauucaucuguacuuagaggaugauugacuuuuucuaauuuaaaaacuguuucaguagcauuaaauaugaugagcuuauuuuuuuuuaaguuucaucuuuuaaauggauaauaggaaacuaaacuguauaguguuuagauauuuagguaacguucagacacuaagaauccagcugagauagauuuuauacuuaaaaauaucuguaaaguuugcuaguccgccuuuaauagcaccucaguaguuauaacauguggaaugaaaauuucugcuagucuuaaggguuaaauaaccacauuggaaaaaugcuaguaauaauuacuaguaagaauuguacgacucuuauugaugagugcaaaauuuuucuauagauuugaaagucacuacuaaucaugacuagcugauuauaauaauugagaguaaacuuuuaaaauuauuaaauauccugugaaaguuggagcacaguaaccauuaacccuaaauuugauacuauguccauaugaauucagaucauaauagugcucuaucaugugaaacuacuaaaggauguauagaguuaaauauuacguauccacuuuaaugaagaauagguauuacacaguaaugguuguuuaaaaaaauuuuuuuuauauaauaucagaguuuaccugaugugcuugggcaugcauaguugucaacaaugauuugcuaguuguacaguuuuguaugcugaucagaauuaucagaaguuuguaaaguaucuuuucuuuugauucauacaugaaacaaaaacaauucuguguauucucaguguucuguauaaaaaaauuuuaagugcauauaacuuuuuaggaaauaugacagaugcuugucauaauacaaaaauauuuuacuuuuuuauuaugcucauuucuauggggagagaaacauagccagaaggaggaagaguaggauugaaaacauuuggcuacuuaccugcaacucaucccugacaacaggcaugugcacauucacacacaugcacauauacucaugcacugacuuuugcagccucaaucuuaaauuucugugguaggauguauccuuucaguugcuuaaugaugauuuccacuucuuucuuagggguuuaaaguauauuacagccucauuagucucaucgucuucuuuuccucccucuagcacagucccugcucuuuauuucuuaggcuucauuuauuagacuucuaccauaaaauuugcugaccaaaaucgucugucuuuccuguucuucacacuugccaaaccagaaucagcucccuguuuaaccugucucaacaccuugccuuugcuaucauuucaaguucccuuuuuucuaugcugacauuaaaacuuuucugaugugugguucucccucucuaaaucuaacacuaaaaugaagccccacauguaaagauuuuuaccagaguuccuucagguaccuacauauuuuacauuuguuucuuuuaguuguagagaauggaugugugauugacagucaccuaauuuuaguaaaccaauuuuauagguaccccgaaggaaaugaugagauaauugauuuuuccugucuccuuuuagaugaggugauaagaacaaccaauuugacuuaaaaaaaaaaaaaaaaaaaacucuguaauuuugguagguucuuuaaaagaaaauauuccaguugaaauguaaauuauaauuuagucauuuaacaauaaaacuuagauuuuuuuuaaccuguuuaguauuaugaaauaaaauuuagugauucggacagacugguguucauccuguuuaagcuacuuuuuguauuuagcaguuuuauugugaaaauccaaucaaaggagauauggaaucaauuuaaagagcucuagauuuuauaugauuuugaaauguauaucaacaauauguacauuuaaauuaucuugaucuuuucguaacauacaaaacuaucaauauggaguaacaauauccagaucgcuagauuaucaauuuaauauauuaguauaugcccuuuucuauuggucuggaucccuaaggauucaaacaguguuuuguuuuguuuuguuuuguuuucuccuucguuuuuccuuuggcuuuuaaguggacuuaaaaauguauaauuauagaauguguguugcuauaauguauaguguauguuugugccugaacuaaggauuucauguaaaauagauuucuuaauucauaauuauguuuauaauuguuauaauaagaucaauuucaguuuuauucuugacaggaucauaaucucuuuugccugguuucagauccaguugugaaucaugauuguuuucugucugauguaguugauaacuacuuugguaauacacauccacaguacuguugaccagucaaagauaaaugcccauacuuuaauacuauagcauuuuuaaugggguugggggagaugauguucaccuaucaacuccagaaauaaggcaaugagagaauaaaguacccucagcugaaucuacaguauauccuaugccagcauauuuggaguccucccaccucaaguacugaucagaauagccuuuucuuaaguugcauauuuuggugaaaauaauaucacagcaacaucauacuuagaauaauaguaauccauauuugaagaauguuugugugcauacauuuauuucuacccuaaucuuuuaauuuuguccuuaagucagugugauugcuggauucauuggugagcauuuuagcucccucagaauaauucuucacaugagcaacuacacuucugugugaggauaaauuuuuauauuugaauauccugucauuccagagggcuacaaugcagaauauuacuauaucccagucugcaguuaguaaaacaguauggcgguguuuuaaaugauugcauagugagauuucucccuccccgacagugauauuaauuuuacuaguucuagaauauaaggugugaaauuggcaaguaaaaaccacauauucccccuucugaucuugacuauuuuaccuuugauccccuuucuaauuaggauauaauggacaaguuuccauuugcauuuauauuuaauacauaaacauuuuuguuuucaggguuauuuugaauuaagguuuuacgacugcuuauaacaggggaauuuguuuuucaguuggauuauuauuuagaaaaugaguuacucaguauacauuacaauuuuacacugucaucagugaauaauaaccaggaaaauuaguuauuagugcuauaguagucuuccuguagacauauuguuuuaagaagucuuuaaauauuuuugagugaauaugucuuaguauuacuuaacaauguuucauccuuauuaagugcaguuauuuuguucaacagcagucaguggaagagcaucugcaaugucaaacacuccuacccacaguauugcugcauccauuucccaaccucagacuccaacuccaaguccuaucaucucuccuucagccaugcuuccuaucuacccugccauugauauugaugcacagguaagucccaaacuuaagagagaugguuuuuucauuggaauuaugccauaauuaaaaacauuaacuuucagagauuuaaaccaugaaagacugcuuugucucuaggcaaagucuugagccaguuuuaaauuaauuaaaguucacauuuaaaaaauaaaaugcuaaauauagauuauuagugauaauuaugugauggucugguuuccaaggucaucagguaaccuuuuuuuuaacuuuaguucacaagaggauauaaaagaaaaauaauuuauuuaagauuagugcauaacuucuucuaauaauaaauuaauagaagauaugguuugaaauauauaauggauugcauguaaaagaaaaaagguucuaacauaaaauuauauuuuuguaugucauacacaugauugauaucauauaucaucuuugaaaauucucaucuuacugauugaaauauguggugagucugugucuguauuuguaaaauuuagcuguacgggauuccaggcacuuuuugaagaaauaacauggaguggggggaggacacuguuuaaguuaagcuuuagaaaguuugagagcuauuaaguauaauuuuuuauuaaaaaguaguugaccaugaaaucucagggcaaggugagauuggagagaauagugcguguuuuauccugaagaaaaguuaagaggucuaguuuagaagacugcugaauaaggucaagaguacauggccaucaggacuaagaaauguuugcaguuuacuuaguuuuuguauuuugaugguaccugggguguguacauuauaaaacuuuuaauuuuauauaugauuauuucuuuauaauaaagccugaauuuuagcagggguaacguggggagaaagagagaggagugaguguauguguguuuguguuggauggaccauuaagggcauguacucuuaaccuauuaaaaauaaaguuuccuuuuuauuaaaaugauccucaguaacacuaugaaaaaggaauuuuauuucugcucuuacuuguuggccaaaugucuguuguuuuuuauguacugacuuuuguuguuguugaguacuuaaaauugccagggacuauuuuaaggaauugucucaucuaauccucagaccacauacaugauguagcuacucuuaauauccaucucccugaagaagacauuguagcuaagagagagguuaagcauuuuguuuagucacuucauuuaggcuaagaagcggcagggcugggaaucauucagcaugacuucaaagacaccauucuuuuuuucuuuuguaauggguucuugccaugcugcccaagcuggucucaaacuccugucucagccuccugaguagcuggaauuacaggugugccaccaucccccaaagacacucuuaacuaccaucuacauagccuuuuaaaaaaaaauacgagauggccgggcgugguggcucacgccuguaaucccagcacuuugggaggcugaggcgggcggaucaccugaggucaggaguuugagaccagccuggccaacauggugaaaccccaucucuacuaaaaauacaaaaaaaauuagcugggcauuguggcgcaugccuguaaucccagcuacucgggaggcugaggcaggagaaucacuuuaauccgggagauggagguugcagugagccgagaucaugccacugcacuccagccugggcaacaagagcgaaacucugucucaaaaaaaaaaaaaaaaaacacgagacauucauuugaugagccauaguuguuuacauuuaauauugauagcauuguagaauugguuugaacuuggcauugaauuugcauuauuuuuccccagucuuuuuugcuuugaggcuuuuuauuuuuuuuuuauuuugagacggagucucgcucugucacccaggcuggagugcaguggcaaucuuggcuaacuguagccuccgccucccagguucaagcgauucuccugccucagccuccugaguagcugggauuacaggcgcccaccaucacgccuggccaauuuuuuuguauuuuuaguagagaugggguuucaccauguuggccaggcugguuucaaacucguugaccucaggugaucugccugcauuagccacccaaagugcugggauuacaggcgugugccaccgcacacagcugagacuauuauguuuagcaagagguaguuuucugauuuuugugggcccaagaauugauccauuagcaaaaauaaguacuucaccaaaauguaaaaagacuucuuuauaaaaauguuuuuaaacaggcacagaaaaguuuguccagucauugauuuuacugaauaugaaauuacuguagugauggugaaaugauuuuucugggcuguaccacucaccaacuaucaccauguuauaacuuaguucugagaaguuacauguaauuuuuuaauuaaaauuauuuuuaaacuuacauuuuaaacauaguagacaugcuuuuauagaaaaauuugacuaugacuccuuaaaaaucuacuuuuuuuaucugaucucacaucaagauuugucauuuguuggguuagccagaccugaguuaaacuacucucuguggaguuuuaccauauguguuuaguuagagauuaaaaaguuccuaccuuggaaaaaaauacuguucaaaaauaauuguucaccauuuuucuccuuuaauuuuugauguuuguuuuuaaaauuuacuaguuuugaccaggugugguggcucacgccuguaaugccagcgcucugggaggccgagguggauggaucaccugagguuaggaguucgagaccagccuggccaacaugaugaaacccugucucuacuaaaaauacaaaaauuagccgggcauggugacacacaccuguaaucccaccuauuugggaggcugaggcaggagaagcacuugaacccagaaggcagaguguuggccagugagccaagaucauaccacugcacuccagccugggcgacagagugaaacucugucucaaaaaaaaaaaaaacaacuaguuuuuauaucaagcagguaauuuaagugauuaaaaaugaagauccuuuuauacucaaucaaacaaaagcucaaaguuuuuguuuugauaagaaaauaaaaauuuugugggcucuuacauaguggguacuuugauuaugugugauaauacugugcugugacaaauaauauaaugaagaaauuaauaccaagauugcuauucugaaagauuaaacauucuuuaauacuuagaucuuucaucuguuuauguaacaaacccuaacauacaggcuuaaugccuugcagauauuaacuucuuuaacuuaaucuuuguaacagucccaugaaguagguacuauuauuauuacauuuuccauuugaggaauauaagacauaaagauauuaacuaccuugcccaacagcuaauuagugguggagccuacuuuugaacucagacacucuggcucuagacucuuuucuuuuauuaaccacugcacuauguuacauuguuuuuuuauuuuuaacuuaaguguguuaaccuugaauuugaauuauguuguauuagccugguaagugggaucacagaaacguguccacugccuagaugguaagagaucauuugucuuucaucuuugcauacuuaacaucaaaauauaaggaagaacaaaggaaauguuaaucuuuuaaagccucaaaguauaacuccuuuuaaaaugcuaaugauucuggaaaauggucagaccuuuaacugcuuuaguugaacauuuuagacaggagcuaauauuuuuaacaaggauuagcaggaaucauauguuuuauuucugauccuugacaaaugcugaagaguuugcauucuucauaaggggcuucaacucucugcuacacaacuagaacucacuugccaagggugugccacagacuuuccaacucuccaguuuuacugaaucaaauuugucuagguauuuucaaaacuuuuaagaugaauaccacauacuuugcugcuaucaaaaucuguuuuaggaaaccaauaaauaauaguuugaaggaauuauuugggacuauuuuuauuacaccuuuugauagcauugcucugaccuuuguguuuauuuugcuugaguuuaaguugaguuuauuuugcuuaaguuugguauaaccaaacuuauuuguggguucuguacauacagaaaugaggaauuauguagagauuuuuuaaaaccacaggcuuuauguggaacaauaauucugacuugaagguuagaacugaauaccacaaguuaauuaaauauuuuuuguauuuuauuguguaaaauaugaucgauucuaggagccacuaccaaugagaaagaaccaguuguuuuguucuugggcuauaaaaacuuguuccagccucuuuuuugucacauguccucccuauauuccuaaacugcuuguuguuuuuauucugaggccgcugaagucuuuucuugaacuuggaguaccuuauucuaguacaucucaaaacugaaaaaaaaaaaauagaucuuuauagaauuuugcuuucuuucacuuuuuaauaauuaacauauauucauuauuuuaaagaaggguagacaucaaauuucacuugugacguaucaagacugaaauuguuaaguauguaaaauuauauuuuaccuuuaaugguauaaguauuauaugaauauuuuucucuauucuuauugguuuugcaauauaaagaacaguuuaaucacagugauuuaacaugagaaauuagagaggccagcaaaaauuaguuaacagugauacauauauaauaugcuaccauuaaagcauucugcuuuaaaauacaugcauucuacuuguucauaugaacugcuuuuaauagguuauuuauuuuacugauuauucucauuuauugaauaccuugaagugcuaucccacuuuuuaagcuuacauguaaccugaguggguuagagaaugagauauuaaggauuuugaagguuguggaaguguaaaaaaaguucagcucuuuaaguccuaguaguuuucaagguaauuuaauuauguuaagaguaauuaauaggcagagugcaguggcucacaccuguaaucccagcacuuugggaggccaaggugggaggaucaugaggucaggaguucgagaccauccuggcuaacaccgugaaaccuugucucuacuaaaaauacaaaaaaaaauuagccaggcgugguggcaggcaccuguagucccagcuacucgggaggcugaggcaggagaauggcgcaaaccugggagacggagcuugcagugagcugagugagccacugcacucuagccuuggcgacagagcaagacucucucucucaaaaaaaaaaaaaaaaaaaguaauuaauagauguacuuuuuuguuguuguuguuguuguuguugagacagggucucacucuugucagccagguuggagugcaguggcaccaucacagcuugcugcagccaugaacuccugggcucaaaugauccuccugccccaaacucaugaguagcuaugaguacaggcauugcacaccacuucuggcuaauuuuuugcagagauggggucuugccauguugcccagcuguucucaaacuucuggccucaagugauccuccugccucagccucccaaaguguugggauuacaggcaugagccauuguacccagcguauuuccuuuuuuaaagacacuucacacaguucagugcuuuuucaccugaauuucagcucauuaaaaguugucuuuccuucaguauugccaucuguguuacuauuucuuguuuuucauucuguaccaccauuauaaaauugaauagucauguugauaacuuacagaauauuuuugcauuaaauauauuuuuuaucauuuuuuauaagccagaauucaucauaacaaccucuauuaaugguauagaaugguguauauauuauggcaucaugggcuaacugaaauuuucuuuagaauagaaaccugaaugagcucuuaaagcucuggacaucuaucuccuuuuucagguucgggacuuucucuuagaucugugacaaggaauauaacuucuugacuaauguaacuuugugcaauauaauuugaaucuaaggauucuuccuuuaauugguacuuugccuucuacaaaauagucagcuguauuauaauuauuuccaugauuagcaguauuugaaacaccuguuuuuuucuuuacuuugucauuauuaauauuaacccaaauuucuauuucaguucauuuguuuauugauguauucagaaauagagugauauuucugucauguuaguugguuuaguuucucuuaaugcagaaauacaauggaguugcccacuuuuaacuucauuuccacaaggaauuuaaagcuguuuucuuagcuuuaaauguuuguuucuugaaaucucauaauauauuauuaugcuugucuccuaguuugaaccugaauuugcccuguguaguaaucaguaagcuucuuugaguccuguauuaucuuugucaacccucgagcacuuaguagagugcuuugaauauaaaaggugcuuaauaaaugucaguugaauuuauguuuuauaauauuggaaaaaacauuuuacugauccacuaaaauuuuccgugcuuaucuuuugcaaauuuuauguacaucucuucauuuucuauuuaagcuuuccuaaauuacucuuuaaacccuggaagaauuuuagaaaccuuauaaacuucaucauaaaauugauucuucugcugauugcauaugcaccaacguagaguggacauaagacacauacacuuaacauuauauucagcacaaucugcuuugccuuagggccccucugugauauaguggggagagcaggauuuuguuaucaagaucuucuuggguuuuuuaaagcacauaucuaccaguuguuagcuuauguggccaucggaaaguuauuuaucagagccuuuaucuccuuuucucugaaaucagauauaauuucuuccuauaaaccugaaaugaagaucaaauaguauaacacagucagagcugucacucauuuaaguuucauguccuucuccauuguuguaguuggugcaucucucccuuguggccaucccugaucucugcagucaguagcucugcucucugccagccucuucugcagagcagcuuuugccgucucccucuucaucacugacuaguaggcuuuuucuuuuuucuuaacucuuacugauuuugccuuuugucuuuuguuuuucauuucuuauaauggaauuuggucuguagaguuauuuacauucugggagaauaugcuuuuccuuuuuauaauuauuauguacauucuacaaauacaauguguaaauguaaucaaugcuacauauauagucccuugcuuauuauguuuauuaguaacaguuuuugaaucuaugaccuuuugcagcuauugccauucauuuuacuuaacuaucauuuauuauuuccuaaguaauuuaucacuacagguagaaaauacaaacauggauaagacauguuccuuaccucccaggaauuuauagucucugugggugauaaacauauaaggcagauuggugauaaguacuauaauagagauacauaugugaaagugagggaaaugcuuagagcaacacuguucaguugaaaaauaugaugagauuguaauuuuaaauucucuaguagucgcauuaaaaaaugugaaaagaaacaaaugggaugaauuuuaaaauauauuuaauuuaauuuaauauauccaaauauuguuuuaacaugucaugcaaucaauacaccacaauugcugagauaauuuacauuuuuauuucauacuaaaagucuucaaaacuugggcauguuagacuuacagcuggagugaucaaaucauuuugguuuuccugggacuuuccuguuuuagcaccagaagucccucaucccagaaacccccucagucccagauuugucacccuacuuaaaguauaucugaauuuggauuucauuggaaauacucaauuuguaucuagauuuaauuaaaugugcagucgaaaaguagauucauuuacucaaauuguuugagacauccuaaauuuuccaguaaccaaauugaauaucaguuauuacauuuaaauuaaaguuaaauacaauuuaaaauucaguuccucuguuacacuaaccauauuucaaaugcuaauagucacauguugcuuguagaguacuaaaagguaucuagcugggcgugguggcagacgccuguaaacccagcuacucaggaagcugaggcagggagcguugcgugaacccaggaggcagagauugcagacagccaagaucgcgccacugcacuccagccugggugacagcgagacuccaucucaaaaauaaaaaauaaaauaaauaauaaaaguaugagaaauuagauaguuugcuagguuagcauugaaacuauaacagaguaugaacacugguaaaucuaauauguuggucauuaucauuagcagaaggcagaagcaaaccauauguagauagugucaugucucauuauaauagucuuuguuuuucaaaauacacaguauauuuuggauauuugguuccuuuaaguauuuuggggcuuuguucucaaauacagcuaaguuacuuggaaacaauuuuuuuuuuuuaaauuucaaggccuacuucucaguuuguuagguggguccacaacugcuaauuuggcccuacuacugaggauucuacuugacauccuguguguuuugaggucuuucuacucuggcuggugggaaccaaacuauuccuggcuccgugugagcccuggguauuauucagccugacucucucuggugguccuuuccuggccugggauaauuuccucaugcacauggacugaucaaaacucagcugaagauuugaggggaauccucugcacaucuccagaguacccuuucugcaguacucuccucuucaauaaucugcuccaugaauucuagccaccuugaucucuccaaauucugucuucucaaguuggggagacugccagguuguuuggauacuugcuccuugcacuauagccuggaaacucuccaggcaguaaguugggcuaaucauuucugucuucagagaucacucuucugcacugccugucuaaacaccaucguuucaaagagguuuuuuuucuuuuuuaguuauuugaaauaggaaaauaaaucugaucuauguuucuccauuaauggcugaaagcaaaaguuaauccacaguauuucuuucaaucacgugauugaaagucauacuuuauuuuucuugauguuuguagccuuuuuaaaaaacucgcaaguuggcugcuaauauggaaacaaguaaaccuugcuuuucuuuucuuuucuuuuuuuuuuuuuuuuugagacggagucucgcuuugucacccaggcuggagugcaguggcgugaucuugguucacuguaaccucugccucccagguucaagcgauucuucugccucagccuccgaagaagcugggacuacaggcacgcaccaccacacccggcuaauuuuuauauuuucagucaagaugggguuucaccauguuggccaggauggucucaaucucuugaccucgugaucugcccaccucggccucucaaagugcugggauuacaggcgugagccaccacgcccguccauaaaccuugcuuuucaaaugcuugauauuguagagugguacauauguauuuguguguauuugauauguuugcauauuauguauuugauauuaacaucuuaaguuauuuaauaaacuaaccaaaaaauaauuucuuauagacugagaguaaucaugacacggcacuaacacuugccugugcugguggccacgaggaacugguacaaacacugcuagagagaggagcuaguauagagcaccgagacaagaaagguagggccuacuuuuguuuuauuuuuuggaauacuggucaaaaaauuuauuuaggaacauuauuuuuuaguccuauuuugaaggucagauauuuuguucuuuugccuuagcauguagugagaagaucauuauuuuucuccagguuuuacuccacucaucuuggcugccacagcuggucauguugguguuguggaaauauugcuggacaauggugcagacauugaagcccagucugaaagaaccaaggacacaccacucuccuuggcuuguucugggggaagacaggagguaauguuuccccuuaguguaauuguuuuccuuucucuguuuagcaaauguguacuuucacuuauauuauuuuuucuaucagaacaaugcuuugacguuuagauuucucacaauaacugaaacuauuaucuauuaacaaaaagaugaguaucauuguuagcauaagcuaucuugccagaaaaaucacacauuguuuagaauccugcucaucuaaaaguaggaaugccaugcauuuacgguaggagaaagacuauuccaagucaaaucaguaaguuccuaauguacagggccuauauucacucaucuuugccugcccuauaguacauggcauagaagguacuuaaucacagucucuguugcugucuguaagauuaguagggaauuaagaauauucaauuuuuauguguuuugagaacucuugucuugcuuugauuuuuccccacccuuucucaacucuggaggaaagguucucagauaagaugguaagauuauaugaccuuuuguuuuuuuaaggaaacuagaacaacugauagagauuagcuaggcucaagaaaauguagcuuuacacucacuuauguaucuuguggcauuuuauaaucagcuagauaaccuuuuuuuuuuuuucaaauucaguccuuuguacaggggauauaaaccagauguguugucuccauagauucccuucucuaucaaggaauuauugaaucuuagauuuggaaagcaccuuaggucauucagaucagugucuuagcuuuaaaaucuuuuuucucuuauucuuuuauaagguuuuccuauuuaucaggccugaaguaugccuuuuuuguuuccccacaguucuuaguuuuguucuuuaaacaaauagaaagagguuuaaccuuuucuaucuucagauuuuuuuuuuccugaagucaccuauucuuugugugaaacaagucuuguuucgguuguuagccuaagaauaccuuuuccaaucccuucaucaucgugacuguuucacccuuuaugucaguauccuucuuaaaauauuauauguaaagguauucugacgagugaacuggggaacuguuaccucccauuugagcaucuuaaacuagcuuuuccccccacuuccccccagucauagcacauaagguuauauugagcucuaguuaguuaaacccacuagauuuuuaaaauaaacuaauaaauaaacaauuuuaauagauauaauaauuccuauacaaaagaaugggaaaucuaauaaaauuauguaagugcaguaaggguagggcuuggucauccuucauuuuguaaauuaaaaagaacugaaaucuauuaacagugauaauauaggcauuuuuuuccauaauuuuuguucccuuauauuuggaauagauauuauaugaauggauaguuagauacacuuauuacuagaauacuccacacaagagacaaggagccuggccugucccuacuguuuuguuucuucuacuugugucacuuuuuucuucuauaauucauaguaggggcaauagauagguuaaaaguauuauaagccaaauauuaagauagugaaaaaugaaccacuuaauuugauaaauuauuucuacuauuccagaaaaaguaaaaauccccauaaaucccggaaagcaaaauuuugccuuucaaucauauugccuuucaaucauuauuuagcuugaaaaaauacuugcuuuauauaagaacagauuuuuucaauauugagucaagaagauauuaguugauuuucuuuauuuaaaaguaguauuaaagccaauagggcacuguaauuuuuaugaauuauguauuuuuguuaaaauauaacagauuagguuauaacaauuguugaaguauguuaggguaacaauuuugccuauaaacacuuuguuacuuuaauuuggugucaauagaagagguaaguauuuugaagugauuaauaaaauguuggaaagucauuuuacuauaaaaaucauacauuuuuguuguauauuggauguuuugggagcagaagaguucucugaaagaauugagaaauauaauggcauugagaaaacuugagaaauuugauuagaguuuucuacuauacuguuuauaaaauagccuaacgcuauauuuuuucuuguuuuuauaaccuugucacucgcucugaaagcaaaaagugauggaaagaaugugauaucuaaaauuggacauagcuuugcugagaugcaagauaaaccacuauucauuaacauuuauuauuugccaguuaguauuuuaggauauauuauuaauaguaagagcagggguaagagcuaugaucuugagccagucuugacuucucuauaucuuauuuauaaaaugagaaugaauauugugucaaaggauuguuuaggcauuaaauggcauaguggacaaugaucugugaauggcccaucaguacuuaaauaaaugcuaaauauuuuuagguuucaggaaaugcaauuaagauccagugggauacaacuacacauccacuagaauggcuaaaauugacgacuggcaauaacagauguugccaagacucaugcuacuagaacucaugcauuauugaagggaguguacauaguacaaccacuuuaagaauagccuggcaauuucuuacaaaaccauacacccagaaauucugccaguaggugggaccuaaaaucuagguagugaauguauauaagguuuuuuaauguuaucuuagaaaauuuucauaaucuugugaaaauauaggaccuuuuauaccaugcuuuuaaaauacuuacugauuaaaagguuuaaaaauauguuaaauacauucacauguauaauacgaaaaaaucuugucccauauuacucuauuuuaccgcuuuguggugaaauaacaaauauuaauuuccaaagcaugucacaaaauuuucaguccagaccuuucaugaacacauuguagcauuuuaguggauuucuacauggguuuuacuugagaagguaucucuuuguuggcuucuaagaccuccugcuaucauuagaggcugauuuuaugcagagcaugaaggaagaacuuuccccuucuuuuauuguacaguauaccagaaaaagaaauuuaaaaauacacacuuugguaauuugucucuccauaagaaaacauauuuuuuucuauuuuauuuucaggugguggagcuauuguuagcucgaggggcaaauaaagagcacaggaauguuucugauuacacaccucuaagucuggcugcuucugguggcuaugugaacaucaucaaaauauuacuaaaugcaggagcugagauuaacucuaggcaaguuguauucccuuucuguaagccccuuauuuaguaagacuguuauagauauuuguagaacaccuauuuuuuagugccaaauuuaguaaaucccuuuauuacaaauuuggcauucaaaguguuagagauuuuugagaugaacuuuauuuaaguaauuaaaacuugauauagaguuugaaaaauauugaguacuguuucuuaugauacuaaauguaaacaucuuagaagcuuuuauuaagcaagcuaauacaugcuuuaagauugaaaguuuauccuaauaacuuauuaaucaccuuccagccuaagucauuauguugagugaaauacaaaaaauauucuaauaaaacauuucuaauggagucuugguaguaucucagagacuuacuaagguugagaaaaauggauauuuuaaacaauccuucaaaauaaucuuagauuagaauuauauaucaucuccaauuuuucugucauuuaaaauauauauuuuuccauuuguuuuccccauaccugcaccccuagaacugguagcaaauugggcaucucuccucugauguuagcagcuaugaaugggcauacagcugcuguuaagcuccuguuagacaugggcucugacauaaaugcucagauagaaaccaaucggaacacugcccuuacuuuagccugcuuccaaggaagaacugaagugguuagucuucugcuugauagaaaagcaaauguugaacacagagcuaagguaagaaaaagucugagauuuacacaugaauuuauugcuuugauauuuaagauauauaguagcaacauguugauuauaauuuuaguucuuucuaguaacauuuaucuccuauguauauauuuaauuagaaaucauucuguauaacucagucaaacauuaacucuugaaaauaccugagugauaaauuuuuauaggcaacaaugacaguaggauuaucagcugaaaaagagagacuauuuugaaaaggaagggaauggaacauuuauugaguaccaguuauaugccaagugcuugcaucuuaaacagauuuuuuuuucuuucuuucuuuuuuuuuuuuuugcaauaccguugagauuagguagaauuauuuucuuuuaauagaucagacuaacucaaaggagcuaauaagggucagugauuaaauuuaguugugaaucuugguaacagcuguaucauauuccuucuucaaguuguuauucuuuacaauuuuagaucuuuccagucucuuacgugucauuacuuuuaauuuuacacuaaacuuagacuggucucacaccacuaauggaagcugccucugguggauaugcggaggugggccgaguucuuuuggauaaaggugcugauguuaaugccccuccaguucccuccucaagagauacagcuuuaaccauagcagcagauaaagggcauuacaaauucugugagcuucuuauuggcagguauguuguuaccauacccuucauauaugaacacaaguguuacuagugguuaucauucucucuaggcaauuaaacuauuuaaaaaaucaaaugugauuauuucuucuuuuauaaacaagugcuuuuucccccaaaccuacccauuguuuuccaacccuccagagcuaugcuacauugucugauuuguuucuguguaaccuaaaaauguuuuucuuucauucuugucuauauuacuuuuaacgucuacaauaacaagcuauuugaacauccaucuguuaucagacauacuuacaucccccacacacaagucuuaaaagucuggcagugaucuaaggcuucauuguccauuuucuuguucuucacaguaauuaaggcuuuuaggugugguuaugggacuauuuaagauaaacagacaggauccaagguacuuucuacuuucagucacguagaaguugccugcuaguuuuccaaagaugcuugucuguuuaacuuguuuucgugcacucucaaagaccuuugcaugguauucuaagcaguaguauuuggcaguaacugcuguuaacucuuacuaaccaugguucuucccaucuacaucaugcccacugaaugaaugcuaaaccugcauguuaucuuuaacauaacuacaaaaacagauugaguaucccuaauuggaaaagcuccaaaguauggaacuuuuugagcccuguuaugacacucaaaggaaaugcucuuuggagcauuucagacuucagauacuggauuucagauuagggauggucaaauuguauaugaauacaaauaaucugaaacgguuacaguugccucauaggauauuguuuguguaguauaauucugagagcaagacauauuuacaucuuugaauauugaaaacaauuuuuaucuuuacagaauauuuucacauguugauaguugauuuuuguuacugugucauuucauucuauuuaagacaaugcuaggcuagguguggugacaaugccuauaauuccagcacuuugagagguugaggcaggaggauuacuugagcccaggaguucgagaccagccuggguaacauaggaagacuccaucuccacaagaaauuuaaaaauuagcugagcgugguggcaugggacuguagucccagcuacucuggaggcugagguaggagaaucauaugaccccuggagguggaggcugcagugagccaugaucucaccacugcacuccagccugugugacagagcaagacccuguaucaaaaaaaaaaaaaaaaaaaaaaaagacaaugcuaucugugucauugguuuuuaggggagcucauauugauguacguaacaagaaggggaacacuccauuguggcuagcagcaaaugguggacaccucgaugugguucaguuacuggugcaagcaggugcagauguggaugcagcagauaaccgcaagauaacuccucuuauggcagcauuuagaaagguauaagucuuucauccucauuuaccuggauguuuuuuuacuuacacuaggaaguacauggcuuagugaucacuaaagacucauuuugugcuuuugcagcugugaugaaagcaauaauaugcaaauaauuacucuuauggcaacauuaaauguagauauauacagguuuuucagaaaagccauuaauuuuaaccuuauuggacaucagagcuaaguaaacuuuuaaaaagcuguucuaaguaauguguucaaaaucuaguugcagucuuaaucuucacaaaguguaaauccaguuaagauacuuaaguaaguaccuccaguuaguuacucuuagugaguguuuucuuguauuaccacuacagagaaaaauaucacuuaaacugguuauuuugcugggggcggggguugugccacgcaugguggcucaugccuguaaucucagcacuuugggaggccaaggcaggcagauguagcgaagcccugccucuacaaaaauuauaaaaauuagccgagcguggugacaugugcuaauagucccagcuacucaggaggcugagauaggaggauggcuugagccugagaggcaaagguugcagugagcugagauugcaccaccgcacuccagcccgggugacaagaguacgaccccgucucaaaaaaaauuuguuuucauuucaauuauugacuuuacuaggaaaaaaaaugaauuaaauaaugaaaaugccacuaccagcauuuuaaacuacuaaguuucaaguauauuacauuuaaagguaaaaauacaaauuccgugaaaguaaaacaaacuuucucuuucuguacauagcacagagcuguguguaaguaauuugauuuaaugguuuguuugauaauccauugaucucuuaaauccagcuuuaguuuguuauugggaauaucagauuacuguuacagggauuauaauuuugaguuuugucauuuggagauauguagauaaaauucccuguagaugccaaaauguugaaaauuuuuaauaaauaaaucacaauaagcuauuucuuccuuuuucucuuauuaucucugaccgcuguucuuuauucuaccucuucccuagauaaucuggacuaccagugacucuguauuuuugacucucuauauuuuuguuucucagcaauccaacuuauuccuucucacuggcuagcugccucuucuccaagcaagcuagcauaucauuaucaaguuaaucuuucuaaccacucuacuauauuagagaaccucuucaagaaccuuucugugucuccccaguuucugaaaucauuugaaauccaaucuuaguuugguauucacagccaccacaauuuagugcuuguagaucuuaucucccauuagaauccuuaauguggagaauuaucuucuugcuuggucuuuuccuuguuccuaucucucacaucaccuuuguucucaucucauagaaugcccaugucuuucuucauuuuuccaaaguuacucauucuuuaguuauaguugaagucucuccuaccaaacucuucauccuauuugaguucacaucgagaucucuaaucucuagaggucguacaaguuugacaguguuuaucauucauuuggagaaauacauauuuuuauauguuauuacucuaacuauuagaguuguuauuuuuauuaguuauuacucuaguaucuaacaugcauauaucuuuccagauagacuuauugacuucaguugagcagugcuuaucuuuuauacucuuauguauuuguuccauuauuucuugaguaccuaacaugugcaacugugggcuagaguacuauauuauauagggugcaacauaguauauguuguguauauaugucuauauacauugucuauauauguauauacauauugucuauauauguauauauaacauauacuauguuauauaggguacaauauggaaagguaagauccauacccaaaguuagguaacuguuugaguugucccauguaaauaguuuaaacacuguagaaguauuagagagauccuuagggaaugaugcaaguggcauuugagcuauucauuuagagaaaaguuuagaaacaugcagucuaaaaggaagagauagaggcaauagaaaaaauauacuaaagauuaacagcuguuuaucccgacuggcuaacuucagauguugugucagaaagcaacaguaugggcuagacaaagugggaauggcguuuaagaaguaggaaagggcaagucuaaagauuuugaacuuagauacuaacuuguguugcagugaauaaucauagcuuauucuucaugaaaguauauauucuuucacacuaccuaagacaguauuauacauuuguuuuuuaucugaaggaaugaaaaaacaaaauuauuauuuuugcccuuuuaauccuuagaauugaaacuagacucucauauuuagggaguuagcaaagaaaaaaauaagaauccccaccccccaccacccuucagacauauccccuacucuuuguauugauuuugggauuauuguuuuuuuuauucagaguuguuuagaauuuuagcucauauuauuauguacuuuuuuuggaggguaggaugagaaugaucaauguggauuuaacucacuggaaccaaagccugucucuuuuucauuuauaguguaaauaugcaauuuagucuuuacuuuguggcccuaaucuuaacuguuaaaguuaguucaggcauagauuuacugaacuguuagagucuguuuucaaucugacauugauaucuauuuuuuagggucaugugaagguggugcgcuacuuagucaaagaagucaaucaguuuccaucagauucugaauguaugagauacauagcaaccaucacugauaagguaauauguuguucacuauaugagcaagggacucuauucgguuaauauaucuuccauucuaagaauuccuaguuugaguaguaaaguguaauauguagccauuuucauuuaucuaguauuugggaaugaaguaugcgauuuaagagauucuugcagauuauuuacuuaccuaaugaaucaauaaaacauccucugcuauaggauuaccuuaucuuuaaaaauaauacuugaggccaggugcaguggcucacccuuguaaucccagcaguuugggaggccgaggcagguggauugcaugagcccaggaguucaagaccagcuugggcaacauggggagaccccaucucuacaaaaauacaaaaauuagccuggcauguuggcaugugccuauaaucccagcuacuuggaaggcugaggcacgaaaaucgcuugaacccggaagguggagguugcagugagccaagagugugccauuguacuccagccugggcaucaaagcaagacucuugucucaaaaaauaaaauaacaacaaaaaaauucuugagcuaauuuaauuuuuaugugaacacuaaguaauucaaagcaacauguuauuauucauuagggcuguccucuguauauguguguuuauccagacugauaccuauauugagaaaguaaugaguccaauagauuuuuauuuccuaguaaaaugaacauacuacuuuuaaucaugagcaagaagucuugagcgugauguaaaaguuaggguaacuaacuuuuaguuuuaacuaaguuuuagaaugaauuggcuaggaauuuugcaggaaaugcaaauuuugcaggaaauuuuauggaagauaaaacugaauccuauuagagauccuaauugagaccuucuccuggagacauacauuuugauuuggaguuuacacuaacacuugaauaagauccuaacacaugccucugaaaaccaaagaggacaacaaaucuuaaaaaugucuucuuaugacguuuacacaguugcuauuacaugauagugaacagcuuuucccuauaaguuuuaauuuaaacuagcuaggucacugucuuuccuagcucuagacuuguccaugacaauuaacauuccuauauaucacagguuuuuaggggcagagggggagauuaaaaauaaauuauuuuuaauaauacuaagaauaagacugguucaguggcacacagcuguagucucagguacgcauuagucucauguacuugggaggcugaggugagaggauugcuugagccuaggaguuaaaggauacaguauacuaugauuaugccuguuaauagccacugcauuuaagccugggcaacauggcaagccccuaucucuaaaauuaaauaaauaaaaauuuuauaaaaauaaggaaguaguguuuuacuguccuaaagugugacuugagaaugaaaucacugagaaaauuauguaaguacauguaucugauuccuuuguaaaugauuauuguacacaaaauuggagcaacaaagcuuaaauauuugaggacauuucuugaaaaauuuucacaucuguuuucuuuguugacauuauuuccuuuagccuguuaaccagccaacauaaauuauuguaguucuguuugcuguacaauuucuuauauuuaaauuagaggauaaaugacuuuaguuucugaagugccugcuaaauggauauuauuuugaagaauagcaaaagcuacucuuugauucuucauuuguauauauuccuaaauauaccaugucaauuacguuuuuauuugcacaccuuuuuucccccuuucauggaucuuuauugcuuagguuugaguaccuuacuaaagaucuucguguuuuuaggaauuucucuaagugagaauuguucugugagccuggaaaaaucuuaauuuuucauuauaggagaugcugaagaagugucaucuuuguauggagucaauaguacaagccaaagauagacaggcugcugaagcaaacaaaaacgccagcauuuuguuagaggaguuagacuuggaaaagguaacaauaaucuuuacacaugaaaacuacccacuuuuuuccaucuuguuuucucuucuuuugauuuguaauccgucuuuuuguuuuguuuuguuugcuuuaaauuacguacaugauuucuuucuacauuuggcucaaaucguggagagaauuaugaguacauugaacaucauugaaagcuucuuuguaacuaacaaaauuuuguuauaggaauuacauugaucuggaagucagaaaacuuagcuucuaguucuggauuuuagucuuaucucagcuaaugaucucuuaauccucaaccacaucuguuguuuuuugaucuuauaauuuauuguuuuagaccuuguaauuuauugccaacagguuuaucacaaguaccaaaugcacuaccaaggcauaaccaacuagugaaauacaaaucuuggaaugucaaaugaguacacuuuuuaaaugggugacuucucuuguacuuuucucuuucaggcagacuacaacaucauucccaucuauucccauggggaguaaaauacaccaaaacagcauauaguuuggacagucuuauagcuucuucacuucccuuuucugccacauuuuccccuauaauucuguacucuagaacuuaacugaauaguaaucauaggaaaauaauugguuuggcauugaauauuauggaacugccauaucucaucuuuuauaaaaaggucaguggcugggcgcaguagcucacgccuguauucccagcacuuugggaggccgaggcgggcacaucaccugaggucaggagcuugagaccagccuggccaacauggcaaaacaccgucucuaccaaaaauacgaaaauuagccggacgugguggugcaugccuguaaucccauuuacucuggaggcugaggcaggagaaucacuugaaccugggaggcggagguugcagugagccaagaucacgccacugcacuccagccugggcaacagagugagacuccgucucaaaaaauaaauaaaauuuuuuuaaaaaggucaaaaugcuauaaaauuuaacaucuacuauuuaaauuuauaaaggagaugcagugauaauuaugcauaugcguuuuuugacuuguuagcuacauucuuuuuuacuauacuugcuuucuuuauuaaguucuacauuuuguccuacauuaauaugaaucauuugaaguacuuuauucuaauuuaaauuugaaaauacuauuuucugaaaaaauguauuuuauuuuggaagcucuucauuuuuaaaaauuugugguuuauauucugagcaaauuaaaaguagcuguuuuggccauuuaaaaauguuaaaagaauaugagugcauuaagagauauaaugaccacuauaacuauuacuugaccuguuuuuauauucacuaccuaacauuuauuuaaugccugcuaaauacaaggcaguauaauugagccaguuugugugauagaauauauauuugauucuuuaaauuuuuguuuuuuuauuauaacagugugcucaguuuaaacugugaaacaaagacaagaacagcugccaucauuuuaagauaacugaaguuagaaaugugauaaugguuguuuuaaaaucuuuaccucugcaauuaccuauaaggccuuuuaagauccuguaaugaucugccuacccacaccacuucuuaaaccucucuggccuuguuuuuuauuacucuuucucuuagucaccuugcucuauccauacugaccauccucuuuuuguuugugcugucagcagcaucuuccaugaaugucccuuagauguccucauguuuuaguuuccucuucacaagcacuuuucugcucuucucugcuuuauuuuucacuuuucaacauucuaaauauuguauucauucaaaauacuuaauuaucuuguuugucucuauuacuagaacauaaaauagugucuggcauauaguaggcacucaauaaauauuuguugaaugaauaaauguucacacugauugugaugguguacuuuuuuuaaaaaacagaaucaugcaaacauauuacucuaauacuugcuuuccccucucuuaguaacugauggauauugucauuugauagugauuuuaaauaacugcagaauaguccauaauaaguuuguuuccaguuuuuugucacgacaaauaauauuguaauaaacacccuuauacauauuuuuuaaauauuuugcuccuuuuauuuuuaugaaauaaguuccuucaugugggucaacauauaguagucccuuuauuugugguuuugcuuucccuauggucugaaaauauuaaauggaaaauuccagaaauaaacaauucauaaguuucauguugcaugccguucugaguagugugaugaaauuuugcgccguccuuuucugucccaccugggacaugaauccuccuuuugucugguguauccacuuaguagcccucaguuaucagauugacuguugagguaucacagugcuuguguucaagaaacccuaauuuuacuuaauaauggccccaaagugcaagaguaguguuacuggcauauuguuauaauuguucuauuuuauugcuauuguugcuuaucuuucauugugccuaauuuauaaauuaaauuuuaucauggguuucuuugaaaaaacauauauauacaggguccaguacuauccaagguuucaggcaucuaccagggaucuuggaauguacuuacucaucauggauaagggggcacuacuguauuuuuaauuuaguagauacuugcagaauacuuuccuaguaccauuagcaauacaccaaugucauuuccuuguauucuugccagcguuauuuaaccuuaauguuuauacuuucaagagccuuaguuuuaagagaagucaagagaagcuucuuuuaaauaucguuguauauuuuuccauaauauuaaaaccaaaagcuaaugaagaauucuuaaucauuaaucaauucuaucuaaauugauuccugcacaugcauuauauacuuuuauguauaguuuugagugaacguggaacauauguaaaauuuuuaauuauagagaagccacuuuuuuccugaacuacagcccauauuuuuauuugaaagauuaucacauugggauauuagaguuuggcucacuauuuuuuaauuauaauuuacaucugggaaaauggacuucuuuagccuuuugagauauauuacauucuggcuucaucgcuggaguuggucuugacugguccaaguugagauucuccauacguaaguuauuccucguauaaaagugcuucuuuggucagucuuucuaauuuggaaaauuugguuuauaaaaacugcugcagaaaacugggcauggugguacaugcuuguagucccagcuacucgggaggcugagcccaggaauucaaauccggccuggccaauguagugagacccagucucuacaaaagaaaaagagaucaguggccauuauguuaaggccagcagauuuuuuaauacuuauuaaguaaacauuuauuuauugagcauuuacuaaguggaagagucccugcucugaaguaguuccaucuggucaaguuauggaaucuucuuaacaguuaauugcuugcucucagaacauuaacaacuaaguuacguucuuggcuguuagaaucccuagcagauauuuuaaacuuacauuuuugauauaauuauuucacccccuucacuucauuuuaguuuuuuuccucuaccuuuuuuuacccccuucacuucauuuuaguuuuuuuccucuaccuuuuuuuuuuuuuuuuuuuuuuuugguaaacuuuuagggagcuagguaauaguauauuuuucaaacacaaccuaucccauucucgguuucacacauuucauucucugauuauugcuuucuaucuuuucaacuuuacucccucuagaauucuacuuuuaauaauccugccaacaccaccgaccaauaaaugguaagaaccauuuaugucauacuacccuuucauuguuucuuacuccuuucuucuuauucucacaugaaccucaguaacuaaacgugucgagaaaaaacaaucuuuaugacuaauuuuacuugaaaugugugacaacgaacccuuuuaugcugacaguagcuuuacuagauuucccuagcccuuuaaugcugaccaguaguuaaaaugcugcauuuccuuaguuuaauuuagucuuccauucauuuagaccacuguuucuuacuuucucccuuauccuaggaacuccagcaccaccucucuuucaccuucaguaggugaccuugcauccugagaaaauugaacuaucagaagaaaacuugcaaagacuuuaccuacaccaucuaucugcccaccaauaccugcaccuccucuucuuuaccuuuaaugagaaaauggaagcaucaaaagaaaacuuccaaagacuuugccuacccuaucuauccacccaccaauaucuacacccauauacuuccuaccagugacuagauaaaguuuuuuuuuuuuuuugagacagcgccucacucugucacccaugcugcagagcaguggugcgaucucagcucacugugaccuccaccucacagguugaagugauccuucugcuucacccucccaaguagcugggauuacagguaugggccaccaugcccuacuaauuuuuguauuuuugguagagacuggguuucaccauguuagccaggcuggucucgaacuccugaccucaggcaaucugcccgccuuggccucccaaagugcugggaauaacaggcgugagccaucaugcccagccuagauaaauuuuugguaaccagucccuucauuguguaccagauccuauaugguuucuccuucucaacagcacuguccguagcaauuccuuuucuuucuccuauuuuuuucccucucuugaaucauucucaucagcauacacacuuauuucuccaaucuuaaacacagaaaaccuuuugacuucaacccucuugccucaaccuuuuagcuacagacccauuucucugccucccuuugcgguaaagaucccugaaccgccgcuuucagucaccuccauuuuuucuuccauuauccugaaucuguuccugacaggcuggcucucaacucccacaacucacuaaaauuaugcuuuugugguuuccaguaacuuucauauagcuaaauccaaugguuacuucuccucuccaucuuuuaucuuacugaacuaauaacauuugauauacucucuucacuuggcuuucaugccacuacaggcucuuuuuuuccuccuaccugucuggauguuccuguguccucuugcugguuccuccucuucuccccuaccuuuuagcgaaaagccuuuugacuuguuacauggucuucuuuauccacugguggucuuauccugcccccuaacuuuaaauguacaccaguugauuccaaauuuguaucucuagcccagacuucuuugcuaaacuucagucucguguauucagcuagcuauucaacauguccauuugaauaccuuauuaggcaucucacacuugauguguccaaauaugaacuccugauccuugcccaccccaaacccacaacucuuauugcucaggccagaaaccuugaaaucauccuuaauuucucucuauacuccaucgcguugaaaaaucccguuaccuuugccugaaaauuagcuacucaggagguggaggugggaggaucaccugagccuggggaggucacugcggugagcugugauugugcuacuguacuccagcuuaggcaacagugugagaccuucucucaaaauauagauauauaaucuuaaucacuucucaccaugguucaaacaauuaauuuaaucucauaccugcauuagucauuuaacuggucucccugauuccaucauugcuuguaguuuauguagcacccugauccucuucaauuaucuaaaucaaaucauaucacacuucuguucagagcccgacaaugacuuucccucucaguaaaagacagucuuuaaaaugcucugcaaggccuuaggugaucaagccuccugauacuguuccccgaaacucauuugcuacuguucuuagccacgcuagcuuacuugaauauacuggguccaguucuaacuuagagcuuuuguacuggcuuuucucuuuggcugaaauauuuuauguccuucagguguucacuuaacuucaucucaugagggguacacugauuacccuauuuaaaaaucaaaacccuccauuugucuccauacacacauuuuucaucucgcugcucuuuuccccuuuuuuacauugcacuuaucaccuuuuaacaaacuauaauguaugcauucuauuuaucuguauccacccuccccuaaccaacuaaauguaaacuugaagacagggauguuuuauccgguuuacugaugaaacuagaaccgugcauagcacauagcaaguuaccagaaaauuuuuguuggaucuuuccccuaccuuccuuugaaacuucuugaucucuuucugcuguugauauuacuacucuuuauugagaaaugaaaucuugaugcuacuuuuagguucucaauuauuuuugccucccauucuuuacauccaguaaaugaauuaacuuggugaguuaacuuagaccaguaucuggcacauauuagacccucuauauauuagcuguaucagcacugucaucaugauuauuaucaucaucacuaccaucaccuuuuauuuagcuuuggcagucucugugucugccuucuguuccauccacuuccucucugagugaucacuucucacccaaaauuuugcauuuggcuucuuaaaagucuaccuguauacauaucugugucucucucuuaucuuuugucuucaguauuccuuuucugcuccgguguaacuuuuacaguuucgcuuuuuuuuuuuuuuuuuuuuuuuuaaagacggagucucacuccauugccaggcuggagggccauggcgcaaucucggcucacugcaaccuccgccuccuggguucaagcgauucuccugccucagccugccgaguagcugggacuacaggugcgcaccaccacacccagcuaauuuuuguauuuuuaguagagaugggguuucaccauauuggccagaauggucuugaucucuugacaucgugaucugcccaccuuggccucccaaagugcugggauuacaggcgugagccaccgugcccagcccgcguauuuuuuuaauacacaggugggaugccuuacuuucuccucagaaacccucagugccucuucguugauugcaugggaaauucuaaacauucaggucuucucucuuauuucuccaggcucaucuuucacuaugguuugcuacuucucacauaucccauucacuuucauauaucuaaaucugcaguauuuguuuagucuggacuggcuuuccccaaguccuuaaauucuuaucuuauaaagccuaacucccaagugucacuuuguuuccugagcccucaauuagaaaucaucaguuggguuagugcccuuucccauuccacagugaaguuauuuuuauuuauuuauuuuuuuugagacggagucuugcucuguugcccaggcuggagugcaguggcgcgaucucggcucacugcaagcuccgucucccagguucacgccauucuccugucuaacuugacccuuuuucucagagccucuaaccucccccacacacacuaacaaacaugacagcaguucuccaagaaguaaaaugagauuuaggcuuaugagagaaagugagagaaaauauagaaagugagacugaauuuuuaguuuuauuuucuuaugccucuggacguauuugaaucuucaugguuuaguuacucuuuccauaugcugucugggauuuucuaucaguuauuagcaccucucccuaugccuuuaucuucaauuucuacuguuuuacuaacuccuacccacuaccuacagcuucagucaaggcagagguacaaucaggguagcucuauccuaauggaacuuuuucucaaauuuaguauuuugccuuucuuuuaaugcuuauaauaaucucuaugucuuauuaacuauuuuaaauuaaaucuuaggucugaaccaugugaccuccuucuccaauaaacuaacugugguggagguaaccaauggcaucuuaacugacaaauccuucuuuuuuuuaaauuuuauuuuuuguuucuuuucaguucacaaagcacgccaaauccauuuaccucuuuucaguucuuauugaugcccaccacuuuugugagguuuaccaguguugaucuggccuuccuuuucccauuggaguugcuuucuccuguuugucuuccucugauuaugccuuucagaagccucauuuguucuuccuuuaccccuuagauauucugucacacacacauauacauaaacucucuuuauauauguauaauaucuauauauuuuauuauauauaguaaaauaguagguguauguguguauguauacacacacacacaguuacaccuuuuuccucugguuaccucauuuguuaguuucagcuaccgccugcaaacuuaugaugccucuuaaauccuguaucuguugauccacacuugcuaauucugcuuacuuuuagagcuccgugccauguaaaguugggucauuuuguagccauaacuugguaucuccccccagaagguuucccuaggaccucugaauuagugcccuaccuacucucagugaauucagaggguuaguaaaauauaucagauuaucaaaacgccggcuuuaaaacuucaaaauuuagaaacgagcaaauacuuaccucuuaggguuaaacucugaaguucgauaauccaaacucauauuacucuugccaaagggcuaccccugacugacucugccagcccugagaaauuuacauaucuaagacccagccacacccuaugaccuacccaaaccuaccacccccaucaacaucuaggacauaugggcuuaaaugaaauccugcuuucugaauuaaaacucuuauucuuuuaaaaaaaauucuccacccccaaaucccccccaccucccgcuuaaauagcagucauaauuagcuccugcuaccagguaaguacaaaauuccagcaaaaugaacaacccaucauggaugagccaaaauucuaaaacuucauuugcuguuuugauucucccccaaagcauuccuuucccaggauuuuucugucuauacagauacgauacagauaaaauauugauuuuguuauuccuaauccugaaguagagagacuuaauacacacuuguagccauagcugcuuugauaauacguuuuucuggugcacguuucaccuuugcuuucacuccuccucucccucuuauacuuacuuaccuguuccacaaaaucaaagcuagacagaacaagcacacuucucccuccuucacugggguccacguggagaaaacacauaagcaaggcucaaaugagcugagucacacaugcucaguuucuucuuucaaacucaccaaucagauauuacuccucccuuguggugauccagggaguaaaggucaccaguuacuguuuuguuccuaauacuucagcagggguaaaagcuccucuacugaucuucagacuggagcuuucugggaguccagcagaaauuuccaggguuacgaugcaggcaguuucuguaucuuuagcuuuuagaugcauucuuuccuaaaaucgauuugcuggagaaaguauggguauucuaccuacagguuuuccuucacuguugcccuuuucaggaacaagacuuaucucucaccuagccuaagguaaguauguugcauuaccgcaggguguaaaaaccugguggugggccaaacuuuucaagaaccuagcagagagcugguuugagugucauggguuaucagaacuuauuaacguuagugucacuaaaguugguauacaacccccagcugcuaaauuuggcuuaaaaaaaaaaaaaaccggagaggguuaauuugaaaggcaggacagagaguaucuagcaaaagcacagcacuuaaaagaugaagucagacuuuuuugaaugaaaacuaaauauuguuuggcuuaugaauuuaugaggacugguuuuacauguuguaggcuccaugccuuaacugacauuguuuugacacauauuuaaaauacacauaaaauaauucagaaugcuagauuauggguggagaauaguuuuuaaaaaacaucuuuuagaugacaugcagacagaguuugaagaugauuuucauaccuuuaugagccaagaaagaaaauuuaacaguuaaaauaguuuauuaagauauauuuuuggacuuuuaaaccuacaguuaguuuuuugacuaugaaaguaauaauguacucauuuuaacaaauagaaacacuguauaguuauauaaaguaaaauugaaagucaccaucauucugcuaucccuccuccuguuccacccuccagagguagucucuguuacccuuuuauuuauaacuuuuaugguuuuuuuuucuguauuuauacaaaucgaugcacaaagaggguucucuucucucauaaaagugauuauuagucuucagugugccuuuuuuucuccuaacaaauguaaacugggagcauuuucccaaguacauauuuauaauacuuacggugccuaucuaguauucugugaauauauacuguuaauuuauuccuucccauugacagacuuaccuuguuuccauguauugccauuauaaucaauuugcaaagaaaauugcugaacccuuguuuuuucacuagagauagacauuuuauauaauaaguuguugggauaagcaguuuguaauuuuuguuaggaagcuuucaaauuacuuuuucuaaaauguaaauauucaugcccgcagcaguacaggagagaauucaguuucucaaacuugugcugauaucugauaccuuuuuaaauuucgccaaauuaaugaucaaaaaaugguauuuugucgguucaacuuacauguccuuaaugauuaaaagcuauguaucuguuuauuauuuacccauuuuaaaauuagucuuauauuguuaauuugaucuugauauuguaaaaauauugucucuuuagagugguuugaauaugaucuugauaaaacaaugaauugaacuagaugacuuugaauuuuaugauaucaugguuuccuuaugauuaaaugauuaugugacaacuucuucuccaggguaaauuucaacguuauauuucugcuuuauugaucuuuaacaguuaagggaagaaagucggaggcuggcuuuggcugcgaaaagagaaaaaagaaaagagaagagaaggaagaaaaaggaagaacaaagaaggaaacuagaagaaauugaagccaaaaauaaagagaacuuugaacuccaagcugcucaagaaaaagaaaagcuuaaaguugaagguauuuucucuuaacaaccaucccauuuguuuuauauucuaguuaaaauuauauuuacuugauuaucagucacucuugaaaauaugcuuucaaguuauuaaccccuuaacauaggccaggcacaguggcucacgcccguaaucccagcauuuuauggcaggucaaggugagcgagucacuugagucuaagaguucaagaccagccugggcaacaaagugagacugucuauacaaaaaaaggaaaaaaauuuuuuuuaauuaucuggacacaguagcauacuccuguagucccagcuagcuacuggggauuggggggauggggagguaaggugggaggaucacuucagccugggagguugagacugucaugagccaugaucuggcaccacugcacuccagccugggugacagagcaagaccuucuaucaaaaaaaagagaaaagaaaagauauaugcuuuuuuuuuguugacugaauuccucccuaacuuuauuaugaaaaguuucaaaacuacagacaaguugacagaugauaaaaugaauaccugaauacauuccaccuagauugacaaaauuguuaaaauuuuaccauauuugcuuuauuuuucucuuuaaguacuuguacauauuuuuuucugagccaucuaaaaguaaauugcagaauugcagacauccugacauugcgccuauaaauccuuuuuuuuuuuuuuuuugagaccgagucuuggucuguugcccagacuggagugcaguauuaugcucucgguucacugcaaccuccguuucccggguucaagcuauucucccaccuuagccucccaaguagcugggacuacagggacgugccaccaugucccccuaauuuuuguauuuuuaguagagaugggguuuugccauguuggccaggcuagccucuaacuccugaucucaagugauccccccugccucagccacccaaaguacugggauuacaggcaugagccacugcgccagccaccuauaaauaauuaagcccacaucccaagaaugacauuugcuuacaucaucauaauaccauuuuagguauuauaaaugguaauuucauaauaucaucuacaauccagaucaucgauuucuucaaaugaaggaaucauuuuuaacuagguuauaaucaaaagguuauuugggauggaaguauaguaauccugucccuuuauauccacaggggaugguuuccaggacccucacggauaccaaaauucagauacucaagucuuuauauaacaugguguaauauuugcauaaaaauuaugcacauucucccauauacuuuaaaucaucucuacauuaccucuaauaccuaacgcaaaugcuauguaaauaguuguuauacuguauuuuuuaaauucguauuuguuuuuuguuuuguuuuuugaauacuuucaaucuaguguugguuaaaucuauggauaaagaggacugacuguauugugggaaggaaccauugccaugaaaccaccaaaaauaugugcaugcaauguguguauguguguguguguuuuguuuuguuuuguuuuuaauuucccuucuccagcauuuuauuuugaaaauuuucaaacuacagaaaauuuuaaggauuaauaugguaaauaccucuaugucaccuacauuuuuaaaacauuuuggcacacauggguugugucuucucuuuuuuugaguuguuugagguaagcuauacauaucaugugaaaucacccccagauacuugauuauguaucucccagaaagaggacauuauuuuacauaacugcaacgacauuaagaaauuuaauaauuacauaauaauacguaauauacaguacauacuuauauuuuccaaacuguccccccaauuuuuuuuucuccgagaaaaggauauauauauauauguuuuuuuuuuuuauucaaguaacugcaaauaggaaaccagagggagagccccaggcuggaacaaaucauggcuaccccuccccaacagaacagggggaggggguggucccuacacccuuuauggucgauucaggcccccuugcucacucugcugcagcauccuaggggcagggccccaccuuccuugggacugggguggucggucacccagccugccaugugccagccccucuuccccacaaagaguaucuuaggggaggggaucguggccagaacaggaggcaaugaggaugaacauuuggugcugguagcggcagcaauaacggaugucgaagaauggaacacugaacaaaaaacaccaccacuguccagagguaguuugugaacagaggaaaaauggaaccagaaccuuggggggcagggaggagcaggaggguugggagcaggcagggugagcuccuuguuauuggugccccuucugaggagggggaaauggcugaguggcagaagcaaaguaaguaugggggagcggccccagcccaucucagguagccacagggcuugugggccucaccuggacaauaaaugacugcaucuccaucaccgcaauguguacucagaucccagguggagggcaacggggcuggggccacagugaagaggaaguaagaggcucacaccccuccugccuuccuguagccaaaggggacuguccaaccuagugcagggacuaggggaggugggaaaggaugaaaagugugaaccccacauagugacaaacacaguuuggcugggggaauccuggcgccagcacccccuccauuggccacaccugcugcuagggcaguggaguagggcaugccaggaugagauggggcuugggccccuuuuaaggccaggggaauccucccagaccacacuaugggaagccagagggaacaguggaggagcagagagggugcccccaucaccagagagcaguguugcuacuacuaagggaguggggaugcagcaugugcaggguguggcuaagugggauguuagcauuguccaggaggguacguguguaugugugggugguugcggggagcugggaacugaggccaggggaaaacugcuucccacucagcccauggggccccugcaguggcuggugugcuguguagugugguggugagggugcagguggaaggauggggguggcagccggaggcaguggugauggugagccugggaaaggggcgggggcggugggagcggagcaaaagcuguccagucccagaaggaagcugcuccuucagugaggcacaggcagcacacacggucacugcuccuccucugaggacuccugccagaugcccuccucuuccuccuucuccaguuuuuugggucugccccuugguuuccuuccuggaguuguggugguuuuccgggucuuggcagcucccuuguuuuugcuucccuuugguuggccccaaggucucuuagguguuggcacuucacugggcuccuucugacucccuaccagugcugucccggaacucaccagaggcugcuugcggggccugccccggccccgcuucucagugcuguccauuuccugcuuggaggccaagggcuggcuggacuucaagcucgacucacucaucuucccuucucuaaggagcagguggaagauugauggcuggaauggccuuccuggagccacgccagcaccagaaaugccccccaaaauauuuuuuauaacuaccugcuauucuuugaacagaacguggguacacagaguauaucaguccuauccagcucauuaccgaugaaugugagaauaacuuacauggcuaauaguaguagaguaucucuccuggguuuuucuuuucuucaagugcuuauagcuaaauacauucugggaacacuuagaacuugcuaauucaguauugcuacuuuuacagaugagccugaagucuugacagaaccuccaagugccacaaccacuacuaccauagguauaucugcaaccuggacaacuuuggcagguucucaugguaaaagaaauaauaccauaacuacaaccaguucaaagaggaaaaacaggaaaaauaaaauuacuccagaaaacguucaaauuauauuugaugauccacuaccaauuucauacagucagccagagaaggugaauggagaguccaagagcagcaguaccagcgagaguggggacagugauaacaugaggauuuccagcugcagcgaugaaaguaguaacagcaacagcagucguaagagugacaaucauucaccagcuguggucacuaccacugugagcagcaaaaagcagccaucaguucuuguuacauuuccaaaggaagagagaaaaucuguuucuggcaaggcuucaauaaaguuaguuccaauuuuuauuuucaauauuuauagugucaucaugaaauaccuuauuacugaauuuguugguaaagaaaguaaauuugcaacuugcaaaauaggauuuuucuuugugcuaaagaagguacuguuucaauugaauugaagaauaagcuuuuguuuagauuuuauauaaugagacaucaaauuauuuuuacuauguaauuucuuuuuuuuuugguuguuaaacuuagcacaugaaaaauauggauugugguuuccaagggauuauuacugugauuaaacucugcuaaauguguacccuagauaguaucuucuuaaaguuggcucuucaggcugggugcaauggcucaugcuuauaauaauagcucuuugggaggccaaagugggaggauuguuugggcccaggaguucaacaccagccuggacaacauagggagacccugucucuacaaauaauuuuuuuuuuuaauuagccaaugugauggcaugcaccuguggucccagcuacucaggaggcugaggcagaaggaucaccugaacccgagagcucaaggcugcagugagcugugauugcacuguugcgcuccagccuggguaacagagcaagaccugucucaaaaagaaaaaaaaaaaaaggcucucuauauuauaugcuaaauaugaggagaagugaaaaauaaggucgucauuuguuauuuaaaaauaaauuuuuaaaaauuggguaguagacuaccuuuaucauuuaaaaauucuacaucuguuccauauuuaauguacuuucccucucuuuguuaaagauugucagaaacuaucagugaagggaccaguaauucucuaucuacuuguacaaaaucugguccaucuccccuuucuucuccaaaugggaaguuaacaguagcaaguccuaagcgugggcaaaagagggaagaaggauggaaagaaguuguaagaaggugaguaauuguuuuugucauucuuuuuaugugcuauauaucacagucaaguguuaucuaccuuauaauuaaauuccuccuacucuucuaaagguugcaaacaaacugaugguucaaggcuaaauuugaccaacagagagagccugugccauauuuuagaugaaaaaaauuacguguuaauuuggccccucaaaaguauuggaguuugcuuugagaacuauuuuagauugugucuuucucagcuucguuaucucaaagccuuauauaauacaaagaaguauuauaaaagcuacuuguaaacauuugaugaauuaguagguauugauguuaaacuguugaucuaaucauaguaacuguugucuuuaaaucauaagauaacuuuauuuuaaggguuucaggauaaaaauauuuuguuuugcaugggauuuuaaaaauaauauguauccaagaguaaaaauacaauaucucagaaacguaaaaggagguaagacaccugaaauccagaaagaaugugauccauugucacucuuugauaacuuauuuuaaagaacuuuccggaaauuucguaaaaauuuaaacuuuugguuaucugaaacaaaagcuauagugaaccaaacuuaguaacuacuguuaaucccuaagugcaguauacagguuuuuggcuuauuuccuccguauuuuagaccaaaucuuguccccgucauaccuauguuuauuucugucucuauuuucacacacuauacacacauucuuucuuucacuccuucacauacacacucuauuggauuaauugaaaucacaucaucagaauauucucuauacacuaauaagauaauuugguuuuuguauaugcauuuaauacuguguuauacaguuuggaaaugaugaucacuggcugauuaucaugcucuuuagguuaaaaagaguuguuagguaacuuaguuguauauauagagaacagggaucaugcccuuccuuuuagaaaauaugacaauuuuuaauacuuaaccauucucaauaaauaauuugcuuguuuauugaacuauacuugacugcuucucuuuauugagaacuuuauacuguauuucuuuuagaaauauuguuuaaucagcuuaucaggaauucgggccugacaccuguggcucaugucuauaaucccagcauuuugggaggccaagacaagaggaucacuugagacuaugaguucaagaccagccugggcaacauagcaagaccccaucucugcuaaaaacaaaauuaaaaaauuagcugggcaugugguuugugcuuguaaucucagcuacuugggaaaggugggaggauugcuuaugcccaggaguuugaggcugcagugagcuaugaucacaccacugcauuccagccuggguacagaacgagacucugucaaaaaaaaaauaauaauaaaggaaaucuauaaucuauaucugaauguuuaaaauuaaaauguaauuuugcaaguauuagauggauauugcuuuuuuuuuuuuuuuuuugagauggaguuuuacucuuguugcccaggcuagaaugcaauggcgugaucucggcuugcugcaaccucugccucccagguugaagugauucuccugccucugccucccgaguagcugggauuacaggugcaugccaccaugcccggguaauuuuuuguauuuuuaguagagaugagauuucaccauguuggccaggcuggucuugaacuccugaccucagguggaccacccaccuuggcuucccaaagugcugggauuacaggcgugagccaccgugcccggccucagauuuugcuuuuuaaauucuaguaggauuuucuuuuuccggacauuauuaaagauuuuuagaaaguuuucauauuuguggauggucauuuuaaugcuacuauaagaauacagggaaguaaugaauauuuuuucuuuuuuccugagaaggaguuucacucugucacccaggcuggagugcaguggugcaaucucaguccacagcaaccuccaucucccggauucaagugauucuccugccucagccuccugaguagcugggauuacaggugcacaccaccaugccuggcuaauuuuuguauuuuuuucaguagagacaggauuucacuauguuggccaggcuggucucgaacuccugacauaaagugaucugccugccuuggccucccaaagugcugggauuacaggcaugagccaccacucccagucaugaauuuuuaacaucacucuuugaguuauguauauuagagaauaaaaagaagcauaugaguaaagcaccaaaaggggcccacaagaagucuuucuugacucuugaggcuagauuagaugcccaaccaguauauauacacacacacauauaauauauauauauacacauauauacauguauauauuauacguauauacauauauaugucuauauauacauauauguauauauaauacauuuguguguguguacacacauacuauugcaacacucaugacauggugguguuuucauaauuagcguguagauagucaauauaugugggcagaaacccaugucugucuuauuuaccguuaguauuugcauuagcacagcacgugucuacauaguaugugcuuuaccgauacaagugaagaaugauaaucaacaaagcaaacaaucuuugauagugagaugagaagcuauaauaaagcuuaucugucuguugcuccugauugccuuuucucuguucaucuagaguaagaguaaauagaagaggcuuauucaacaauauucuguauuuauagaaagacauuuuaguaauacucuuuccucuuuuaaaaauuacaauaacuauuguuaaugacuaaucuuaauuuauauauacaacuuuuaaacaggucaaagaaaguaucuguuccaucaacugugauauccagagugauuggaagaggaggcuguaauaucaaugcuauucgggaguuuacuggugcacacauagauauugauaaacagaaagacaagacuggagaccggauaaucacuauaaggcaaaacuuugucucuuacauuuucuuccuuuauuuuauugcacuauagcuuaaugaaauacagccauaugaguuuucaguggaacuuuguguuacauaguauacuuuuuaaaaugggaauuuuauuaguguuugagaagauaaauuuuauaguuuucuuuuuuccuagguaauacacuuuugugaaguguuucagagacuuuuauaggaauuuguaugcauguguagcaaagguuuaaauaaauaauuucuguacauaaacuguuuauaugacauucuuaaaaauuuguucugagacuuuuagggagcgcauuucuaacauuuuaagcaguggguuuuugucuuucucaaauaaccuuugagauuuguuauucugagauugugucuuuagaauuugaguucuugggcugggcacgguggcucacgccuguaaucccagcacuuugggaggcugaggcgggcggaucaccugaggucaggaguucgagaccagccucaacauggggaaaccccgucucuacuaaaaauacaaaauuagccgggcauaguggugcaugcuuguaaucucagcuacucgggaggcugaggcaggagaauugcuugaaccugggaggcagagguugcggugagccgagaucgagccauuggacuccagccugggcaacaagagugaaacucccucaaaaaaaaaaaaaaaaaaaagaauuugaguucagauuugaaucugaagugaagauauaacuuaucuugaauaacucgucgaauaugucuaugccugaauauucuuaaaauaaaagugauguucuaagaaaucauaagaauguaggaagcuauauuuaauuacuuuaaaguaaauucauguuccuuugaaaaagaguuuuauauuuuuuacauggcagauauaaguuuguaugaggcagaugccccuuugcauuauauaggagagcuaauaguuacaucauaccucaaaaauaagaaagcaaguagccaucucuauuuuauucaucguccucuccuucugacugguuuuccccuggguauuuggguagucacagccuaucuuaucuagaaaagagggaaccagauacccuuuauugguaauugcucccuugaguuuccauaaauaucaaauauuuuccugaagauccagcacuaagguuuuauauggcuauuuuuggcacuaucaggauuccugcaucauuuuaagacaucuucccagaggaguuacaauaauuauccuauuaauagacaaacuacuaaugaauuuuuaguagacggagucaucccagauaccaagauuuaaaauaaaauacuguuuucuuacucaguuguauuauuuuccuuguuuacuucuauuauuuuuaguguugauuaacuguuucaauauuuuuaggauuaaauguuucaauaacauuguggauuacauaggcuuuuaugugcagugguuuuucuaacuguaguguauuuuacaguaggaaaaugguuucuuagucuaaggaaacaauagugaaauguauuuuugaaaaauaagucauuuacuauucuucugaaaaauaaaaguaguaauucaggacaguuuauugcuuuguuuguagaauaccucaggaaugguaagaaaauugcugcccagcuuuuguuaucuguccuuuguuuguauguguguauguauauacacacaaaacuguguguguguuuguguacauaaauacauauuaaaaacacuuuacauacucaaaaguagggaaaauucuaccuaauuuuuuuuucucaauuuauagggguggcacugaaucaacaagacaagcaacucaauugauuaaugcuuugaucaaggauccagacaaagaaauugaugaacuuauuccaaagaaucguuugaaaagcuccucagcaaauuccaaaauagggucaucagcaccuaccaccacugcugcuaacacuuccuuaaugggaauuaaaaugacaacuguagcucugucaucaacaucucaaacugccacagcacucacugugccugcaauuucuucugcauccacucacaaaaccauuaagaacccagugaauaaugugaggccugguuuuccaguuucucuuccauuagcauauccuccuccacaguuugcacaugcuuugcuugcugcucagacuuuccagcagauccguccaccaagguugcccaugacccacuuuggagguacuuuuccaccagcucaauccacuugggguccguuuccugucaggccuuugagcccugccagagcuacuaacucgccuaagccucacauggugccucgccauagcaaucagaauagcagugguucucaggugaauucagcagguucuuuaacuucaagcccaacaacuacaaccaguucaucagcuucaacggugccugguacaucuacaaauggcaguccaaguucaccuucuguccgaaggcagcuuuuugucacaguugugaagacauccaaugccaccacaacaacagucacaaccacggcaagcaacaacaacacugcacccacaaaugccacauauccuaugccuacugccaaagaacacuauccaguaucauccccaucuuccccaucaccaccagcccagccaggagggguuucuagaaacagcccuuuggauuguggaucagcaucuccaaauaaaguggcaucuuccuccgaacaggaagcagguaguccaccaguaguagaaacaacaaacacuagaccuccaaacagcagcaguucuucugggaguucaucagcucauucuaaucagcaacaaccuccgggaucuguuucucaggaaccaagaccaccucuucagcagucucagguuccucccccggaaguuagaaugacuguuccuccuuuagcaacaaguucugcuccaguggcggugccuucuacugccccagugacuuacccuaugccucagacaccaaugggaugcccccagccuacuccuaaaauggaaaccccugcuauuagaccacccccucauggcacaacugccccucacaagaauucagcuucagugcaaaauucaucuguugcaguccucagugucaaucacauuaaaagaccucacaguguucccucuucuguccagcuaccuucgaccuuaaguacacaaagugcuugucagaauucaguacauccagcaaauaagccuauugcucccaauuucagugcccccuuaccauuugggcccuuuagcacauuguuugaaaacagcccuacuucugcucaugccuucuggggaggaucuguuguuucaucucagucaacaccagaaucuaugcuaucaggaaaauccucauauuugccaaauucagauccuuuacaucagucugauacuuccaaagcuccagguuuuagaccaccauuacagagaccugcuccaagucccucaggugaguuuauauuuucugagauucugcagcuguucauuugcacaagugaugugaaaauucuuggucauuuucuaauauuuuuauucucuggacgauauagacaaagauuguuggauuuaguuaacucagaugcuguuguuuguguuuaguaugguguuauuuuuaaaaaucuuuuuaaaagcuaccauagauuuuuauuuaauuuuccauaaauaagucuucugaucaggcgggguuuuuuuguuuguuugcuuuuugagacagagucucgcucugucacccaggcuggagugcaguggcaugaucucagcucaccgcaaccucugccucccagauucaagugauucuccugccucagccucccgaguagcugggauuacagacgugcaccaccaugccuggcugauuuuuguauuuuuaguagagaugggguuucaccauguugaccaagcuggucucgaacucucaaccucaggugauucacccaccuuggccucccaaagugcuaggauuacaggcgugagccacaguuccuggccuaggcguguuuuucucucucagaagucuuucauguuuuaauuuaauaagguacugucaccaaaaguuuacauuuauuacaaauacaaaauaacagauuuaaaaaauuggguuucauuucgcauuaucuuuuuuauuucuaaaauaauuuuaaaaauagagcuacacagucugauaugguagccaauaaccauguguacuuuuuaaauuuaaauuaaugaaaauuuuaaaaauaaaaaaauuagcuucuuaggcuacccauauuuaagugcuuaaaaaacacuuguggcugguagcuaccauauuggacagcaaagaucuagaacauuucuauuauccaaaauucuacugggcaacacugauauauguagaagauacaaagaucuccugauuguaagcuauugcuuuuuuaaaaaaaacuuuuuacuuuaaaauauuuuuagauuuauagaagaauucuauaauuccucagcuucccuucaugugaccaucuuacauaaccaugauacauuucgaaacuaaaaaaauuaauauugguguaguacuacuaacuagacuacagauuuuaggcagauuucacaaguuuuucaaguaauauccuuuuucuauuguaggaucuaauccaggaugccaguuuccauuuaaagcuguuggguuuuaauauaagcauuucaaguaauuaaagauaguccacguaagagauggacacacuauggucuaugggccaaauuuggccugcugccuguuuuuacauuucuuaaauguuuaaaaaaaaauuuuuuuuuuuaagaauaggcuuggcacgguggcuugugcccguaaucccagcacuuugggaggcugaggugggucgauugcuuaagcccaggaguuccagaccagccugggcuuaaggggagaccccaucucuacaaaaauauaaaaauuagcugggcaugguggugcauaccuguagucccagcuacuuggggggcugagguggaaggaugacuugagcccuagaggcagauguuacagugagcugagaucacaccucugcauuccagccuggguggagacccugucucaaaaaaaaaaaaaaaaauuuaaaaagaauaaacaugcaacacaaaauaugaaauuuuaauuucaguguuuguagagaaagcuuuacugaaacacagcaaugcccauucauuugcauauuguauaaggcuacuuuuaugcuacaaugacagaauugaguagcugggacagagaccaugugaccugcaaagccuaaaauauuugguauuuggcucuugguugccaacucguuaucuguguuauuggaaauaugacauuccgggacaaaaauuuccaaguuuaaugggaacucaauguuauuuuuaccuauuucuguaacauguaaauaaaauuuaaugaagguggucaguaaauauucuuugcuaaaagucaacugaaauauuuauguguacuaugaaaaauaauuuauuuuauauuaaaacaauagaaucaauauaauuagauuuuagaucauuaugugccagugcguaggaaaugcuuuaaguuugauuuuuauaguaguuggaauuuaauacuuuaccuuuccaaaaaugugauaaucuaggugugggauucagaaaggcuaaaauuaagcuuuagagaacaaaaaaauaaauuccuauuuuuugaaaagguauagaagaaagaccucuguaagaaaggugagguuuuuagggaguguauaguugaugagagccaaaauuagcauugaaguuuaacuuacaagucaauuaccuaauucaggucauuuugaguuaaagauacuccuuuuauuacauaggaaguauguccuuuuauuuucuccuaaaccucucucagauccuaauuuucacuucucucuacuucuuccuaauucauuuuguguuccauauuuuucuuccuuuguuuaacuuuucuuauguaaauaauuugauuauuuguauuuuagacucagaucuguuuuuauaguuuguauuuugaaaaguuauuuaagucacauaaagaucuaaggacagaauaagcagcauaguaaauacuugguauuuccacauuuauuaauauauucucugcuuguuaacaucuuuucaaacucucucccucacuccccucccuuccucucuccccuuuuccuucuucccuccuuuuuuuuccucucuuuugcugcuuccuuuucuucccccucucuugucuugucuuaccugucucuccccuucuucauccuucuuuccuccuuuucccccuuucuauccuaucucuauuuucuuuucuuccccaucuuuugucaaaucaugagaagauaacuuucaaacaugauacuuuaccccuaaauacuuugauauggaucuucacaauguuugccuucacagcuaugccacuauuacugcacccaauaaaaugaggaugaauuugauaauaacacccaacauaaaaugccauuuucccaaauauauucuuucugacuaugugugucucuuuuccuugccauuugauccaagacucaaucaagauucacacauuacuuuugguuguuaugugucuuuggucucccucugucuaaaguauucuacugccuuccucuguaauucuugacauugacucugugggcaaguuuaauucagugauuaugucaauccaugauuagauucagaucaaauauuucaggaaggagcaucauauaggugauguuuugaaccucacacugcauuuuaucaaugacagauuggcuggaugugguggcucacacuuguaaucccaacacuuugggagacugagacaagaggcucauuugaggccagaaauuuaagaccugccugggcaacauugugagaccuugccucuacaaaaauaaauaaaaaagcugggugugguggcauguaccuguaaucccaccuacuugggaggcugaggcaggaggaucacuugagcccaguagauggaggcuggggugagcuaugagcaacagagcaaucuccugucuccuuaaaaaaaaagaaaaaaugauaaauuguuccaguauuggcuguggaaagcauggccgugugguuaguauguaauuaucagaucucuucauuguagaauuguaucuacagcccuuuuuugcccuguaguuuuauacaacucuuugguccuuaaaccuauuuaaaauccuacagauauauauauauauauauauauauauauauauauuuuuuuuuuuuuuuuuuuuuuugagauggagucucacucggacgcccaggcuggagugcaguggcacaaucuaggcucacugcaaccuccgccucccagguucaagcauaaaauccaauauugacauguguucuauaaaagcuaauaaaagguaaaacaaaaauauagcuagguguaauggugaacaccuguagccccagauacucaggaggcugaggcaagaggguugcuugagcccaagaguuuguggcuaccgugagcuaugaucacaugccacugcauuccacccugagcaacagagaaagcugucuccuaaauuaaaaaaaaaaaucguugacaauuauuuucuuucuuuuuuuucuguauuuuuaacccguuagacuaaaaucagauagguuacuuguguaauaguuuaguguguaaacauuuguaauacuuuuuuaaugaacauauuucaaaaacaaauguguaccuguaagagagaaaaagaagaggaagaguaaauguuuuaucuuuaucccuaaaaauaaacauuuaaaaaaaaauguuaucuaaaaaucccuaaagguaaacguuuauucuuccucuucuuuuucucucucacaaauacacauacauucguuuuugaaauaggaacaucuggaaguuucacuuucuguuuuauauaugguuuuugguuuuggauuuuuuaaauaaguuugcauuaauuuuaugaucaauaaaggcaacaaaaguccacuuugacagaaagcccauguaaaggaaaacuaaugauccuuuuuaacuaaaacauuaaugcccacuagugcugaaaguacuaaaaucaagaauuaaauuuguucccaguaaauuauaauuugaauuuaagaguauaaugugauaauuguuucuuuuauaauuaucuacauaguuuaguuuuuugugugugugagacagggucucacucugucacucaggcuggcaugcaguggugccaucacagcucauugcagccuuaaccuccugggcucaagcaauccucccaccucagccucccaaguaacuggaacuacaaacacgcaccaccaaacuuggcuaauuuuuuuuuuuuuuuaauuuuuuguagaggcagucuauccuggccuugaacucuggguucaagcaguccucucacuuuggccccccaaagugagauucaugccugggauuauaggcaugaaccaccacacccagccaggaacuuuuuuuuuuuuuuuuugagguggggucucgauguguugcccagaccagucuugaaugccuggccauaagcaguccucccaccuuggccucccaaagugcugggauuacagaugugggccaccacucccagccgggauuuuuuuaauuaucuaaaauaguuuugaauauauuuagggccuuuuagaauuuuaagguaucucuauuucuugcaggaguaacuauuauaaauuaugaugaccuucuacauuauagguauugucaauauggacucgccauaugguucuguaacaccuucuucaacacauuugggaaacuuugcuucaaacauuucaggaggucagauguacggaccuggggcaccccuuggaggagcacccgcagcugcuaacuuuaacagacaacauuuuuccccgcuuaguuuguugacuccguguucaucagcaucaaauggugaguuuuauacaccguaauuccauaagaaucugcauauguuuucuuaaaaacagcagguuucaaaccucaucauaauuuuaauaccauaaaaagguaauuuguacucuuagaagucuggaauuucaaaaaaauuucuagguauuuaaaugauuagaaucaaccuagguucuaucaaaccuaaaauauugaaguuuuucuaagagggauuuuuauuauuuuuuauuuuuauuagagacaggcucucacuguguugcccucgcugguuucgucaaacuccugggcugaagcagucuuccugccuuccaaagagcugggauuacaggugugagccaccacaccuguccugagggaucauuuuuugggggaaaaaaauuaauccuuguaccuguuauuaauuuauguuuacuuuuaguuuugagaauacagguaccaaggagaaagauuucuacccuugagugaaaauuacauccuuuuaguccaccuuuaaaucucaucuaggcugggcacaguggcauacaccuguaauccuagcacuuugguaggccaaggcggguggaucaccugaggucaggaguucaagaccagcucggccaacauggcaaaacccugccucuacuaaaaauacaaaaauuagccaggcguuguggugugcaccugugaucccagcuacuugggaggcugaggcaggagaauugcuugaacccaggaggcggagguugcagugagccgagaucacaccacugcacuccagccugggcaacagagcaagacuucaucucaaaaaaaaaaaaaaaucucaucugcauuaacaacacaacagauuucacauuaucacauguguuuuuuaacuacaggcagacuuuugaagcagugauuagauuuucuuucuuucuuuuuuuuauuugaaauggagucucacucugucacccaggcuguagugcaauggcucaagcgauucucccaccucagccuccugaauaaaugggacuacaggcaugugcuaccacaccuggcuaauuuuuguauuuuuaguagagacaguuucacuacauuggccaggcuggucucaaacuccugaucucaugaucugcccaccucggcuucccaaacugcugggauuacaggugugagccaccaggccuagauuuucaaacuaaugaagaucagucagcaauagagaauucaacucaacuaagagaauucuguaguaagguuggauauguuuguuuuccagguaaagaugugaaauugcuuaucccuuaaggaaguuauaguaagacuucgguuuuuuuuuuuuuguuuuguuuuuuuuuuuaacuaucaaauuucuucuaacuagcaauacuggaauaaauaacaguuaaccuaauuaacuuaaugaaagaguaaagaguuauaauuauuuuagagauacaugucagaguacauugccaguuaaagcaugagguaaauuguagccugcaaugaauuuauauauucauaguuuuucuuguguuugucaaauaguggcagucauauagaauauuaauuauccuugcacagcucccaaagugcuggaauuacaggcguguaccaccacaccacccagguuagguuuuuuaauacaugcuuuugaauauagugcuauauuguaaauacagaguaucauugagggcauuacaauugcuuuuauuguugccacauuccaguaacuauuuuguuacaaaaaauuucagacccauagaaaaguuaaagaauaguucaaggaauauccauauuuccuucgccuaaauuucccaauuauuuuguuauauuuauuuucucucucuacuguuuugcugaaccauuuguaaauaaggugcagauaugacacuucagaccuaaaaacaugcaucacuuaagaauaaggauauuuucuuaugcaaccaugauaccauugucaaauaccuaauagguuaacaugaauucaguaagaauuaaucaguccauauucagauaucuucaauuauuccaaaacguuuuuuauagauguuucuuucuugaaccaggaacuaccacucaaggcucacauauugcauuugauuaugucucucagauuuuguaauuaauaauuuuaaacuuucaagaauaccacaaggaucccuuguauauuuuucccagauucaccaauuaaacugcauuacuuccuuuccucaucauauauuccucuguguguguguaaaauuauuuuauuccugaacuauuuuacaguuaguuguagacgucaagcccuuuugccccuaaauaacuuaguuuccuaaauauaagaauguucccuucaacaacuaugaugcaguguuuaaauucagcaaacuuuacauuuuauauuauuaucuaauauauggugcauauuuacauuucaucaguuaucucaauaacuuuauuauuuucucucauccaagauucuaauuaggacugcaaguuacacuuaauucccauaucucuuuagucucaaauaaucuagaacuguucucugagucuuucuuuaacuuucaaagaaagauucauuuuaugaagacuacaagccaguuguuugcuagaaugccuuuuauuuuuauuuccuacuauuucuuccugauuaaauucaggguauguuuaauaaacacugaacuaaacugugagaaaugugcaguguaauuuuacuguaggagcacuuuuuguucuucuccuuucuuuucauguaauuuuacuguagaagcacuuuuuguucucuccucucuccucuccuuuucuucucacgaguucugucucugucacccaggcuggaaugcagcagugugugaccauagcuuacugcagccucaaucaaacuccuaggcucaagcaguccucuugccucagccucccaaguagcugggacuacaggcacuugccauagcacccagcuaauguuuuuauuuuauuuuuauguauuuauuuuuuguaagaugaggucuuaccauguugcccagacuggacuugaacuccugaucuccagagauccucccacuuuagccucccaaaaugcagagaugcugagauuacagaugugagccaccacgcuuggccccccuuuuuuuuuuuuuuuuuuuaaauaaaaagauaauguaucucucuguugcccaggcuggaauguaguggcacaaucuuggcucacuguaaccuccaccuucugggcucaagcaaucuuccugccucagcuucucaaguagcugggacuacaggugugcaccaccaugcuuggcuaauuuguuaaauuuuuuuuuguagagaugagguuuuaccacguugcccagccugaucucaaacuccuggccucaagugaucugcccaccugggccucccaaaguguugggauugcaggugugagccaccacacccaguggccccacuuuuugaauuuguaaaucacauugcucuuucaauuuuaacucaggacucuguuaucauuucuaaacuguggugaaguuaccgugguaucagugaaacuuaaauccuuaggccacuucauuuuaugggguacuuccaagugcuguacaugauuuuuuuauuuguaauuuuucauucuucuaaaaaagguucccaaaauuuuguaaguuuaaggccccacaaaaccuagaucugccccauccucugaaaccuguuucucuaauauauaagcugauguuuuuaaauaacauggcucugaauuaaauuuugcuuuuuuucuaauugaaguaauuauaauaauuagagaugugaaaauuauuuuaguuagguucuuuucaugaaaaggaauauaggcccauccagggacucucauggaaaaugauguuuauauaaggcuaugcagaaccauuuuccaaaccguccaggacuuagggauagcuauucucucucucucucucucuuagaggauuuguggucucucacucauggucuguuucuugucaguuucuugcauucugcucucuuuacaccuaaacuucuucauaaucuuaccuuguauaugcacaucagugguucaacuucauaauuaauuaaaccaguuaacccuuuaauuccccauucuuugaugaggaaugugauuggcucagcucauauguucaagucagaccauuucagucagauuacugacuagccuaaaauaaaacuuggaugggugccuauccuuaauccaauaguugugcagagagggagcagaaaacagggucaucugauaaaaacuaugacuagagggguggcagaaucugugcagagaguaaacuucuuaaauggcgcagcucagcgggcaagccuaguaauucuguuuauuaaaauagaauguguaggaggcugaggugggaggauggcuugaggccaggaguuugaggcugcagugcacugugauugugccugugaauagucacuguacuucagugugggcaucauagugagaccgucucauaaaaaacaaaacaauguggaagguuguuguuauuuugcucuacuuugguucuagaaggauacaggaaauaaaagggaaaccagagugaacacagagguuaagguaggcucccagggaugaaccuaggggaaagcaggauucauuuguuuauccuucuuuccuuccugccugccugcccugacuaugucuugauguuaguuguucuggguugauuuuuccuagagguuuagguguggccuuucaauauguagguuuuuaaaaaacaagcuuuuguuauuuaucuuuguguuuacauuuacaugucuguguauuccuuguaguuuuugucuguuuucuacugcauguauaauugcagaauuugguuuuauuuggucuuuagcuaaaauauucuuuuacuucuaacacuuuccugaguuuugucauauuguuuccguuuuacuaauucugaauuaugcuguuccuucauaucauuuucuuuucguucauuuuugaauuuuagguuauagcuuuuuuucuggagugcuuuuauugucaacaggaaugcuauaggucuuucucuuuuaucuuauauaauaggcuuauuuggaauucaacugcaguucuguugaaucugcagguaacaguuuugauuuuuaagcuucagacuccuuuauuauuuauaccauuuuaguuuaaaugugcuuuaauauuuaagcuuuuuugggagggggaggggggauggagucaucuugcucugucacccaggcuggagugcagugacacgaucucggcucacugcauccuccgccucccggguucaagugauucgucugccucagccuccugaguagcugggacuacaggcgcgugccaccacgcccggcuaauuuuuguauuuuuaguagagacaggguaucaccauauuggccccucgaacuccugaucccaugauccgcccgccuuggccucccaaagugcugugauuacaggugugugccaccgcgcccggccaauauuuaagcuuuucacauaaaauauaauuuugguuauuuuuguuuuuucucaauaauguauagagauugaaucacuaaugaauagucucaaaucaagaaauccaccuuguuugcauaaguaaaaaagauucucauuaccaaaagcauguucugugaaguacucacaagauaaaauaaaacagacuuaggcaaugauccucuuauugguauuuuaucaguauauauaauguucuauaaacuucaguucuaauuugaagaaacuuuuuuuuuuuaaacuggacaugauggcucaucccaguagucccagcuguucaggagguuggggugggaggaucgcuugagcccaagaguuugaggcugcagugaguuaugaucgagccucugcacucuagccuggacaauggagcaagacucugucuccaaaaauacauaaauaaaauaaauaaaaaaugaauaaauaacaaagaaacguauuucuuuuuccuaggcuagguuuuccaaauuuauuagauagcugaaucucuuuuucaucauaacacaaagagcaaguauucccagggaauacaguuuggagauugccacuacaggcagugauucuuacccaucuccauucuguuguuguugguuuguuuuuuaauuuaaaugucuuauugcuugcuacauuuuacuuaaugucaaggguuaauucauuugaauauuauuuaauuuaaugguuuauuaccuuuguaguugaacauuuugcagcauugacaucauauucuaccuugaagucauggaacuuuagccaaauuuuaauaugcaucauuuuuaaguauuauuuuuacacuuuguuuuucugagaauauauauuuaaaacaucuccugguuuuaagauuugguuuuauaaaauuacauguucuauagaugaccuguauuuuauuucaaaauaucucuucucuagauucuucugcacagucaguauccucgggaguucgugcaccaucuccugccccaucaucaguaccguuagggucagaaaagcccagcaaugugucucaggacaggaaaguuccagucccuauugggacugaacguucugcacguaucaggcaaacuggaacgucagcuccaucuguuauugggagcaauuugucuacaucaguaggacauaguggcaucugguccuuugaagggauugguggcaaucaagguaggauauucuguccugcucucuagaaauuaacuuaaugcauuuaacuauaauguaaacaguauuuaacuuuaauagucauuuccuuuuuuuuuuucuuuuuuugagauggaguuucacuuguugcucaggcuggagugcaauggggugaucuugguucacugcaaccuccaccuccccgguucaagcgauucuccugccacagccucccaaguagcugggauuacaggcaugcgccaccaugcccagcuaauuuuuuuuuuuugagacggagucucgcucuguaacccaggccggacugcagcggcacaaucucugcucacugcaagcuccgccucccggguucaugccauucuccugccucauccucccaaguagcugagacuacaggcgcccgccaccacgcccggcuaauuuuuguauuuuuaguagagacgggguuucaccguguuagccaggauggucacgaucuccugaccuugugauccgcccgccucggucucccaaagugcugggauuacaggcgugagccacugugccccgccuguauuuuuaguagagacaggguuucaccauguugaucaggcugguaucaaacuccugacuucaagugacucacccaccucagccucccaaagugcuggcauuacaggcaugagccaccacgcccagccucguagucauuucuaaaagaucuguauuccuauuuuuuuuguuaugugaauauuuaaucacuucuuuaugagcucuguccccaugugaccuuucucauuacauguauuuauuacugcuuucagaaaauaucuaaugcaagcauguucuuuucuuccuuucaucauauuaaggacauaauaauauuuccuuucagucccuuuagguuguacuuagguuuuuuucuuuuguuuuauaacaccaaguuuuuagauuauuucauuaagcuauuaugucacuacuuacaaaccauggaaauauugcuguaaauauauaaaaguaggucauuauauugaaauaauuuacgguucaauguggaaaauauuagaaaaacaaaauauuugauuuugauuuuaaauauuaucuauuuuuguuuugccucuuuguuugcccucagacaaaguagacugguguaacccugggaugggaaauccuaugauccacagaccgaugucugacccaggaguauuuucacaacaucaagcaauggagcgagauaguacaggaauuguaacuccuucugguacauuccaucagcauguuccugcaggcuacauggacuuuccuaaaguugggguaaaguccugauuuuguacuaguuauuuaagggaggauuuucugagaaaauguuuugaauauaguaggcauauguauaaucuaauguuaaaauaaguuauauaauggguaauaauuuuuagauuucuuagauaaguuacacauucccaggaugaggugaacuuucaaauaucaauuuuaaggcuauugauuauauugggaaaaaugaacaaugacuuggauguuaauguguguguuuuccuuuuuuaaggguaugccuuuuucuguguaugggaaugcaaugauuccuccaguagcaccuaucccugauggugcuggaggacccauauuuaauggcccucaugcugcagacccuucuuggaacucacugauaaagaugguuuccagcuccacggaaaauaauggcccucaaacggugaggcugaucauucagugaauaaacaguuguuuuguguuuaagaaaugcaaagacaaauaggauucagguaacucaugauagcaagagaguuuggugaauaugggcaguugaggaaaucuaauauagcugcaauauagcagagggcugugggcagugguaccaaaggcagguuuggggcuaaaauuaugaaagguauuguauauucuacuggguagcagauaauaaaugaaagauuuuaaguugcaaagugacugucauaugauuuuauacauuaaaguuuacuaguggugugaaaagaccaucuaaagguuauuuauuaaagguacuauaaauaacucugagaauucacauaaaugguuguauauuuuaguuuaguguauguuuaauaucuuugauuuauuuuucuuccacaaccgugaaucuauaaaugcucagguaaugauuuuuuuuuuaaagguuguaaaucagauucuguuugagggauaagagguaggaaaauaauagaaaaaagguuuuuaucauuuuuuuccauuaguuccuaguauauugcaaauugaagaguaccuccuuaguuuuuuaaaaguuuuauuuuaauaaaauauaugcuagauauauauuuuguaaaaugcaugcucuauauucauagguguggacuggacccugggcaccucacaugaacagugugcauaugaaccagcuuggcugaugaggaucagcuuguuagccugcagauuccuuuucauuuggaggaaaucacaaguggccgaaaaaaaaaauuaugcucccaaaucauucuacugaugugcuugacugaaguguguaggcuuuuugcagaagaucuuacuaacugaccuauuuucugugaacauuugugacugcccauuccccaucaucauccguuuuaccuuaguuagcauuuuucuuaucauuuuucuuuuuuucuuucccucuuccccuuuggacauaacuuucuguugaagcuguucuuuggcugguugguuuuaguacuguaaacugcuucugagcaaacacggaaauuuagcaaaauuauguaaacuugauccugaaguuuuagaauggcaaauaaauguacaauuguuuacauaacagaaaaggcuaagcagaaaguaaauuucaauaugucaguauagaggcucuacuuuauguagacuuaaauuaaugugagauauguaccuucauauucagaaaucuggauguuuccuucauacauuaaacuauuaauaagcauaacuuuucuacugguguaauuuaaguauaaaguaaaauaaugggcauuaucauuggauguuuccccacauuggcuuuuaaaauacccaucuugcuuucuuuuugguuuauuuguagcaaggcacauauagaagaagaaauuucuggcuuuuccauguuguuuuauuaccuuuucucacuuuuaaaacuaauacagacuuaucuccucacuccuuuuucucuccuuaccuuuaccacuaauaccaguaaaauuaucuuucugauagugaaaagguucugucaagauuuucacuguaauggcugcuacagagauggaccaucuucaucaucaccagugguuucuucuaauuauaaaauguuuaaacuuucugagaauuuaaaaagccaccacuguucccagucagcauauacaagcucuuaauauucuguuuauuaaauaauucaauguacuauuuuauauuggaugauauugauucuuaacauuggcuuuucagucaucaacagucaacauaaaaauuucaauuuucaguaauuuaguggaaaauaucuuauuucuuuuuucaauuuuaaaggcuuccugcuuuuuuacccuuguauauuaucagugaaaaggaucaacaguuaauuugagccaaguaauaaaagaaauucugcauuugucacgaagacaauuuaugguagacagauaaauacacagauuacaguguaaagucuccauuuaaccuguuuauaaaagauacaaggccacacuaaacuacucagugggauuuauauauuccauccacuugaaacaauaaacaguaauguauccaagaagauuauguguccuacccugucucauggaaaaauuaauuauaugguugaaauguaaaagaaaguaagcauaaaaaucgaguaauguaua

SEQ ID NO: 191482 - RNA, 184001 nt, Homo sapiens
uauacauuacucgauuuuuaugcuuacuuucuuuuacauuucaaccauauaauuaauuuuuccaugagacaggguaggacacauaaucuucuuggauacauuacuguuuauuguuucaaguggauggaauauauaaaucccacugaguaguuuaguguggccuuguaucuuuuauaaacagguuaaauggagacuuuacacuguaaucuguguauuuaucugucuaccauaaauugucuucgugacaaaugcagaauuucuuuuauuacuuggcucaaauuaacuguugauccuuuucacugauaauauacaaggguaaaaaagcaggaagccuuuaaaauugaaaaaagaaauaagauauuuuccacuaaauuacugaaaauugaaauuuuuauguugacuguugaugacugaaaagccaauguuaagaaucaauaucauccaauauaaaauaguacauugaauuauuuaauaaacagaauauuaagagcuuguauaugcugacugggaacagugguggcuuuuuaaauucucagaaaguuuaaacauuuuauaauuagaagaaaccacuggugaugaugaagaugguccaucucuguagcagccauuacagugaaaaucuugacagaaccuuuucacuaucagaaagauaauuuuacugguauuagugguaaagguaaggagagaaaaaggagugaggagauaagucuguauuaguuuuaaaagugagaaaagguaauaaaacaacauggaaaagccagaaauuucuucuucuauaugugccuugcuacaaauaaaccaaaaagaaagcaagauggguauuuuaaaagccaauguggggaaacauccaaugauaaugcccauuauuuuacuuuauacuuaaauuacaccaguagaaaaguuaugcuuauuaauaguuuaauguaugaaggaaacauccagauuucugaauaugaagguacauaucucacauuaauuuaagucuacauaaaguagagccucuauacugacauauugaaauuuacuuucugcuuagccuuuucuguuauguaaacaauuguacauuuauuugccauucuaaaacuucaggaucaaguuuacauaauuuugcuaaauuuccguguuugcucagaagcaguuuacaguacuaaaaccaaccagccaaagaacagcuucaacagaaaguuauguccaaaggggaagagggaaagaaaaaaagaaaaaugauaagaaaaaugcuaacuaagguaaaacggaugaugauggggaaugggcagucacaaauguucacagaaaauaggucaguuaguaagaucuucugcaaaaagccuacacacuucagucaagcacaucaguagaaugauuugggagcauaauuuuuuuuuucggccacuugugauuuccuccaaaugaaaaggaaucugcaggcuaacaagcugauccucaucagccaagcugguucauaugcacacuguucaugugaggugcccaggguccaguccacaccuaugaauauagagcaugcauuuuacaaaauauauaucuagcauauauuuuauuaaaauaaaacuuuuaaaaaacuaaggagguacucuucaauuugcaauauacuaggaacuaauggaaaaaaaugauaaaaaccuuuuuucuauuauuuuccuaccucuuaucccucaaacagaaucugauuuacaaccuuuaaaaaaaaaaucauuaccugagcauuuauagauucacgguuguggaagaaaaauaaaucaaagauauuaaacauacacuaaacuaaaauauacaaccauuuaugugaauucucagaguuauuuauaguaccuuuaauaaauaaccuuuagauggucuuuucacaccacuaguaaacuuuaauguauaaaaucauaugacagucacuuugcaacuuaaaaucuuucauuuauuaucugcuacccaguagaauauacaauaccuuucauaauuuuagccccaaaccugccuuugguaccacugcccacagcccucugcuauauugcagcuauauuagauuuccucaacugcccauauucaccaaacucucuugcuaucaugaguuaccugaauccuauuugucuuugcauuucuuaaacacaaaacaacuguuuauucacugaaugaucagccucaccguuugagggccauuauuuuccguggagcuggaaaccaucuuuaucagugaguuccaagaagggucugcagcaugagggccauuaaauauggguccuccagcaccaucagggauaggugcuacuggaggaaucauugcauucccauacacagaaaaaggcauacccuuaaaaaaggaaaacacacacauuaacauccaagucauuguucauuuuucccaauauaaucaauagccuuaaaauugauauuugaaaguucaccucauccugggaauguguaacuuaucuaagaaaucuaaaaauuauuacccauuauauaacuuauuuuaacauuagauuauacauaugccuacuauauucaaaacauuuucucagaaaauccucccuuaaauaacuaguacaaaaucaggacuuuaccccaacuuuaggaaaguccauguagccugcaggaacaugcugauggaauguaccagaaggaguuacaauuccuguacuaucucgcuccauugcuugauguugugaaaauacuccugggucagacaucggucuguggaucauaggauuucccaucccaggguuacaccagucuacuuugucugagggcaaacaaagaggcaaaacaaaaauagauaauauuuaaaaucaaaaucaaauauuuuguuuuucuaauauuuuccacauugaaccguaaauuauuucaauauaaugaccuacuuuuauauauuuacagcaauauuuccaugguuuguaaguagugacauaauagcuuaaugaaauaaucuaaaaacuugguguuauaaaacaaaagaaaaaaaccuaaguacaaccuaaagggacugaaaggaaauauuauuauguccuuaauaugaugaaaggaagaaaagaacaugcuugcauuagauauuuucugaaagcaguaauaaauacauguaaugagaaaggucacauggggacagagcucauaaagaagugauuaaauauucacauaacaaaaaaaauaggaauacagaucuuuuagaaaugacuacgaggcugggcgugguggcucaugccuguaaugccagcacuuugggaggcugaggugggugagucacuugaagucaggaguuugauaccagccugaucaacauggugaaacccugucucuacuaaaaauacaggcggggcacaguggcucacgccuguaaucccagcacuuugggagaccgaggcgggcggaucacaaggucaggagaucgugaccauccuggcuaacacggugaaaccccgucucuacuaaaaauacaaaaauuagccgggcgugguggcgggcgccuguagucucagcuacuugggaggaugaggcaggagaauggcaugaacccgggaggcggagcuugcagugagcagagauugugccgcugcaguccggccuggguuacagagcgagacuccgucucaaaaaaaaaaaauuagcugggcaugguggcgcaugccuguaaucccagcuacuugggaggcuguggcaggagaaucgcuugaaccggggagguggagguugcagugaaccaagaucaccccauugcacuccagccugagcaacaagugaaacuccaucucaaaaaaagaaaaaaaaaaaggaaaugacuauuaaaguuaaauacuguuuacauuauaguuaaaugcauuaaguuaauuucuagagagcaggacagaauauccuaccuugauugccaccaaucccuucaaaggaccagaugccacuauguccuacugauguagacaaauugcucccaauaacagauggagcugacguuccaguuugccugauacgugcagaacguucagucccaauagggacuggaacuuuccuguccugagacacauugcugggcuuuucugacccuaacgguacugaugauggggcaggagauggugcacgaacucccgaggauacugacugugcagaagaaucuagagaagagauauuuugaaauaaaauacaggucaucuauagaacauguaauuuuauaaaaccaaaucuuaaaaccaggagauguuuuaaauauauauucucagaaaaacaaaguguaaaaauaauacuuaaaaaugaugcauauuaaaauuuggcuaaaguuccaugacuucaagguagaauaugaugucaaugcugcaaaauguucaacuacaaagguaauaaaccauuaaauuaaauaauauucaaaugaauuaacccuugacauuaaguaaaauguagcaagcaauaagacauuuaaauuaaaaaacaaaccaacaacaacagaauggagauggguaagaaucacugccuguaguggcaaucuccaaacuguauucccugggaauacuugcucuuuguguuaugaugaaaaagagauucagcuaucuaauaaauuuggaaaaccuagccuaggaaaaagaaauacguuucuuuguuauuuauucauuuuuuauuuauuuuauuuauguauuuuuggagacagagucuugcuccauuguccaggcuagagugcagaggcucgaucauaacucacugcagccucaaacucuugggcucaagcgauccucccaccccaaccuccugaacagcugggacuacugggaugagccaucauguccaguuuaaaaaaaaaaaguuucuucaaauuagaacugaaguuuauagaacauuauauauacugauaaaauaccaauaagaggaucauugccuaagucuguuuuauuuuaucuugugaguacuucacagaacaugcuuuugguaaugagaaucuuuuuuacuuaugcaaacaagguggauuucuugauuugagacuauucauuagugauucaaucucuauacauuauugagaaaaaacaaaaauaaccaaaauuauauuuuaugugaaaagcuuaaauauuggccgggcgcgguggcacacaccuguaaucacagcacuuugggaggccaaggcgggcggaucaugggaucaggaguucgaggggccaauauggugauacccugucucuacuaaaaauacaaaaauuagccgggcgugguggcacgcgccuguagucccagcuacucaggaggcugaggcagacgaaucacuugaacccgggaggcggaggaugcagugagccgagaucgugucacugcacuccagccugggugacagagcaagaugacuccauccccccucccccucccaaaaaagcuuaaauauuaaagcacauuuaaacuaaaaugguauaaauaauaaaggagucugaagcuuaaaaaucaaaacuguuaccugcagauucaacagaacugcaguugaauuccaaauaagccuauuauauaagauaaaagagaaagaccuauagcauuccuguugacaauaaaagcacuccagaaaaaaagcuauaaccuaaaauucaaaaaugaacgaaaagaaaaugauaugaaggaacagcauaauucagaauuaguaaaacggaaacaauaugacaaaacucaggaaaguguuagaaguaaaagaauauuuuagcuaaagaccaaauaaaaccaaauucugcaauuauacaugcaguagaaaacagacaaaaacuacaaggaauacacagacauguaaauguaaacacaaagauaaauaacaaaagcuuguuuuuuaaaaaccuacauauugaaaggccacaccuaaaccucuaggaaaaaucaacccagaacaacuaacaucaagacauagucagggcaggcaggcaggaaggaaagaaggauaaacaaaugaauccugcuuuccccuagguucaucccugggagccuaccuuaaccucuguguucacucugguuucccuuuuauuuccuguauccuucuagaaccaaaguagagcaaaauaacaacaaccuuccacauuguuuuguuuuuuaugagacggucucacuaugaugcccacacugaaguacagugacuauucacaggcacaaucacagugcacugcagccucaaacuccuggccucaagccauccucccaccucagccuccuacacauucuauuuuaauaaacagaauuacuaggcuugcccgcugagcugcgccauuuaagaaguuuacucucugcacagauucugccaccccucuagucauaguuuuuaucagaugacccuguuuucugcucccucucugcacaacuauuggauuaaggauaggcacccauccaaguuuuauuuuaggcuagucaguaaucugacugaaauggucugacuugaacauaugagcugagccaaucacauuccucaucaaagaauggggaauuaaaggguuaacugguuuaauuaauuaugaaguugaaccacugaugugcauauacaagguaagauuaugaagaaguuuagguguaaagagagcagaaugcaagaaacugacaagaaacagaccaugagugagagaccacaaauccucuaagagagagagagagagagaauagcuaucccuaaguccuggacgguuuggaaaaugguucugcauagccuuauauaaacaucauuuuccaugagagucccuggaugggccuauauuccuuuucaugaaaagaaccuaacuaaaauaauuuucacaucucuaauuauuauaauuacuucaauuagaaaaaaagcaaaauuuaauucagagccauguuauuuaaaaacaucagcuuauauauuagagaaacagguuucagaggauggggcagaucuagguuuuguggggccuuaaacuuacaaaauuuugggaaccuuuuuuagaagaaugaaaaauuacaaauaaaaaaaucauguacagcacuuggaaguaccccauaaaaugaaguggccuaaggauuuaaguuucacugauaccacgguaacuucaccacaguuuagaaaugauaacagaguccugaguuaaaauugaaagagcaaugugauuuacaaauucaaaaaguggggccacugggugugguggcucacaccugcaaucccaacacuuugggaggcccaggugggcagaucacuugaggccaggaguuugagaucaggcugggcaacgugguaaaaccucaucucuacaaaaaaaaauuuaacaaauuagccaagcaugguggugcacaccuguagucccagcuacuugagaagcugaggcaggaagauugcuugagcccagaagguggagguuacagugagccaagauugugccacuacauuccagccugggcaacagagagauacauuaucuuuuuauuuaaaaaaaaaaaaaaaaaaaggggggccaagcgugguggcucacaucuguaaucucagcaucucugcauuuugggaggcuaaagugggaggaucucuggagaucaggaguucaaguccagucugggcaacaugguaagaccucaucuuacaaaaaauaaauacauaaaaauaaaauaaaaacauuagcugggugcuauggcaagugccuguagucccagcuacuugggaggcugaggcaagaggacugcuugagccuaggaguuugauugaggcugcaguaagcuauggucacacacugcugcauuccagccugggugacagagacagaacucgugagaagaaaaggagaggagagaggagagaacaaaaagugcuucuacaguaaaauuacaugaaaagaaaggagaagaacaaaaagugcuccuacaguaaaauuacacugcacauuucucacaguuuaguucaguguuuauuaaacauacccugaauuuaaucaggaagaaauaguaggaaauaaaaauaaaaggcauucuagcaaacaacuggcuuguagucuucauaaaaugaaucuuucuuugaaaguuaaagaaagacucagagaacaguucuagauuauuugagacuaaagagauaugggaauuaaguguaacuugcaguccuaauuagaaucuuggaugagagaaaauaauaaaguuauugagauaacugaugaaauguaaauaugcaccauauauuagauaauaauauaaaauguaaaguuugcugaauuuaaacacugcaucauaguuguugaagggaacauucuuauauuuaggaaacuaaguuauuuaggggcaaaagggcuugacgucuacaacuaacuguaaaauaguucaggaauaaaauaauuuuacacacacacagaggaauauaugaugaggaaaggaaguaaugcaguuuaauuggugaaucugggaaaaauauacaagggauccuugugguauucuugaaaguuuaaaauuauuaauuacaaaaucugagagacauaaucaaaugcaauaugugagccuugagugguaguuccugguucaagaaagaaacaucuauaaaaaacguuuuggaauaauugaagauaucugaauauggacugauuaauucuuacugaauucauguuaaccuauuagguauuugacaaugguaucaugguugcauaagaaaauauccuuauucuuaagugaugcauguuuuuaggucugaagugucauaucugcaccuuauuuacaaaugguucagcaaaacaguagagagagaaaauaaauauaacaaaauaauugggaaauuuaggcgaaggaaauauggauauuccuugaacuauucuuuaacuuuucuaugggucugaaauuuuuuguaacaaaauaguuacuggaauguggcaacaauaaaagcaauuguaaugcccucaaugauacucuguauuuacaauauagcacuauauucaaaagcauguauuaaaaaaccuaaccugggugguguggugguacacgccuguaauuccagcacuuugggagcugugcaaggauaauuaauauucuauaugacugccacuauuugacaaacacaagaaaaacuaugaauauauaaauucauugcaggcuacaauuuaccucaugcuuuaacuggcaauguacucugacauguaucucuaaaauaauuauaacucuuuacucuuucauuaaguuaauuagguuaacuguuauuuauuccaguauugcuaguuagaagaaauuugauaguuaaaaaaaaaaacaaaacaaaaaaaaaaaaaccgaagucuuacuauaacuuccuuaagggauaagcaauuucacaucuuuaccuggaaaacaaacauauccaaccuuacuacagaauucucuuaguugaguugaauucucuauugcugacugaucuucauuaguuugaaaaucuaggccugguggcucacaccuguaaucccagcaguuugggaagccgaggugggcagaucaugagaucaggaguuugagaccagccuggccaauguagugaaacugucucuacuaaaaauacaaaaauuagccaggugugguagcacaugccuguagucccauuuauucaggaggcugaggugggagaaucgcuugagccauugcacuacagccugggugacagagugagacuccauuucaaauaaaaaaaagaaagaaagaaaaucuaaucacugcuucaaaagucugccuguaguuaaaaaacacaugugauaaugugaaaucuguuguguuguuaaugcagaugagauuuuuuuuuuuuuuugagaugaagucuugcucuguugcccaggcuggagugcaguggugugaucucggcucacugcaaccuccgccuccuggguucaagcaauucuccugccucagccucccaaguagcugggaucacaggugcacaccacaacgccuggcuaauuuuuguauuuuuaguagaggcaggguuuugccauguuggccgagcuggucuugaacuccugaccucaggugauccacccgccuuggccuaccaaagugcuaggauuacagguguaugccacugugcccagccuagaugagauuuaaagguggacuaaaaggauguaauuuucacucaaggguagaaaucuuucuccuugguaccuguauucucaaaacuaaaaguaaacauaaauuaauaacagguacaaggauuaauuuuuuucccccaaaaaaugaucccucaggacaggugugguggcucacaccuguaaucccagcucuuuggaaggcaggaagacugcuucagcccaggaguuugacgaaaccagcgagggcaacacagugagagccugucucuaauaaaaauaaaaaauaauaaaaaucccucuuagaaaaacuucaauauuuuagguuugauagaaccuagguugauucuaaucauuuaaauaccuagaaauuuuuuugaaauuccagacuucuaagaguacaaauuaccuuuuuaugguauuaaaauuaugaugagguuugaaaccugcuguuuuuaagaaaacauaugcagauucuuauggaauuacgguguauaaaacucaccauuugaugcugaugaacacggagucaacaaacuaagcggggaaaaauguugucuguuaaaguuagcagcugcgggugcuccuccaaggggugccccagguccguacaucugaccuccugaaauguuugaagcaaaguuucccaaauguguugaagaagguguuacagaaccauauggcgaguccauauugacaauaccuauaauguagaaggucaucauaauuuauaauaguuacuccugcaagaaauagagauaccuuaaaauucuaaaaggcccuaaauauauucaaaacuauuuuagauaauuaaaaaaaucccggcugggagugguggcccacaucuguaaucccagcacuuugggaggccaaggugggaggacugcuuauggccaggcauucaagacuggucugggcaacacaucgagaccccaccucaaaaaaaaaaaaaaaaaguuccuggcuggguguggugguucaugccuauaaucccaggcaugaaucucacuuuggggggccaaagugagaggacugcuugaacccagaguucaaggccaggauagacugccucuacaaaaaauuaaaaaaaaaaaaaaauuagccaaguuugguggugcguguuuguaguuccaguuacuugggaggcugaggugggaggauugcuugagcccaggagguuaaggcugcaaugagcugugauggcaccacugcaugccagccugagugacagagugagacccugucucacacacacaaaaaacuaaacuauguagauaauuauaaaagaaacaauuaucacauuauacucuuaaauucaaauuauaauuuacugggaacaaauuuaauucuugauuuuaguacuuucagcacuagugggcauuaauguuuuaguuaaaaaggaucauuaguuuuccuuuacaugggcuuucugucaaaguggacuuuuguugccuuuauugaucauaaaauuaaugcaaacuuauuuaaaaaauccaaaaccaaaaaccauauauaaaacagaaagugaaacuuccagauguuccuauuucaaaaacgaauguauguguauuugugagagagaaaaagaagaggaagaauaaacguuuaccuuuagggauuuuuagauaacauuuuuuuuuaaauguuuauuuuuagggauaaagauaaaacauuuacucuuccucuucuuuuucucucuuacagguacacauuuguuuuugaaauauguucauuaaaaaaguauuacaaauguuuacacacuaaacuauuacacaaguaaccuaucugauuuuagucuaacggguuaaaaauacagaaaaaaaagaaagaaaauaauugucaacgauuuuuuuuuuuaauuuaggagacagcuuucucuguugcucaggguggaaugcaguggcaugugaucauagcucacgguagccacaaacucuugggcucaagcaacccucuugccucagccuccugaguaucuggggcuacagguguucaccauuacaccuagcuauauuuuuguuuuaccuuuuauuagcuuuuauagaacacaugucaauauuggauuuuaugcuugaaccugggaggcggagguugcagugagccuagauugugccacugcacuccagccugggcguccgagugagacuccaucucaaaaaaaaaaaaaaaaaaaaaaauauauauauauauauauauauauauauauauaucuguaggauuuuaaauagguuuaaggaccaaagaguuguauaaaacuacagggcaaaaaagggcuguagauacaauucuacaaugaagagaucugauaauuacauacuaaccacacggccaugcuuuccacagccaauacuggaacaauuuaucauuuuuucuuuuuuuuuaaggagacaggagauugcucuguugcucauagcucaccccagccuccaucuacugggcucaagugauccuccugccucagccucccaaguaggugggauuacagguacaugccaccacacccagcuuuuuuauuuauuuuuguagaggcaaggucucacaauguugcccaggcaggucuuaaauuucuggccucaaaugagccucuugucucagucucccaaaguguugggauuacaagugugagccaccacauccagccaaucugucauugauaaaaugcagugugagguucaaaacaucaccuauaugaugcuccuuccugaaauauuugaucugaaucuaaucauggauugacauaaucacugaauuaaacuugcccacagagucaaugucaagaauuacagaggaaggcaguagaauacuuuagacagagggagaccaaagacacauaacaaccaaaaguaaugugugaaucuugauugagucuuggaucaaauggcaaggaaaagagacacacauagucagaaagaauauauuugggaaaauggcauuuuauguuggguguuauuaucaaauucauccucauuuuauugggugcaguaauaguggcauagcugugaaggcaaacauugugaagauccauaucaaaguauuuagggguaaaguaucauguuugaaaguuaucuucucaugauuugacaaaagauggggaagaaaagaaaauagagauaggauagaaagggggaaaaggaggaaagaaggaugaagaaggggagagacagguaagacaagacaagagagggggaagaaaaggaagcagcaaaagagaggaaaaaaaaggagggaagaaggaaaaggggagagaggaagggaggggagugagggagagaguuugaaaagauguuaacaagcagagaauauauuaauaaauguggaaauaccaaguauuuacuaugcugcuuauucuguccuuagaucuuuaugugacuuaaauaacuuuucaaaauacaaacuauaaaaacagaucugagucuaaaauacaaauaaucaaauuauuuacauaagaaaaguuaaacaaaggaagaaaaauauggaacacaaaaugaauuaggaagaaguagagagaagugaaaauuaggaucugagagagguuuaggagaaaauaaaaggacauacuuccuauguaauaaaaggaguaucuuuaacucaaaaugaccugaauuagguaauugacuuguaaguuaaacuucaaugcuaauuuuggcucucaucaacuauacacucccuaaaaaccucaccuuucuuacagaggucuuucuucuauaccuuuucaaaaaauaggaauuuauuuuuuuguucucuaaagcuuaauuuuagccuuucugaaucccacaccuagauuaucacauuuuuggaaagguaaaguauuaaauuccaacuacuauaaaaaucaaacuuaaagcauuuccuacgcacuggcacauaaugaucuaaaaucuaauuauauugauucuauuguuuuaauauaaaauaaauuauuuuucauaguacacauaaauauuucaguugacuuuuagcaaagaauauuuacugaccaccuucauuaaauuuuauuuacauguuacagaaauagguaaaaauaacauugaguucccauuaaacuuggaaauuuuugucccggaaugucauauuuccaauaacacagauaacgaguuggcaaccaagagccaaauaccaaauauuuuaggcuuugcaggucacauggucucugucccagcuacucaauucugucauuguagcauaaaaguagccuuauacaauaugcaaaugaaugggcauugcuguguuucaguaaagcuuucucuacaaacacugaaauuaaaauuucauauuuuguguugcauguuuauucuuuuuaaauuuuuuuuuuuuuuuuugagacagggucuccacccaggcuggaaugcagaggugugaucucagcucacuguaacaucugccucuagggcucaagucauccuuccaccucagccccccaaguagcugggacuacagguaugcaccaccaugcccagcuaauuuuuauauuuuuguagagauggggucuccccuuaagcccaggcuggucuggaacuccugggcuuaagcaaucgacccaccucagccucccaaagugcugggauuacgggcacaagccaccgugccaagccuauucuuaaaaaaaaaaauuuuuuuuuaaacauuuaagaaauguaaaaacaggcagcaggccaaauuuggcccauagaccauaguguguccaucucuuacguggacuaucuuuaauuacuugaaaugcuuauauuaaaacccaacagcuuuaaauggaaacuggcauccuggauuagauccuacaauagaaaaaggauauuacuugaaaaacuugugaaaucugccuaaaaucuguagucuaguuaguaguacuacaccaauauuaauuuuuuuaguuucgaaauguaucaugguuauguaagauggucacaugaagggaagcugaggaauuauagaauucuucuauaaaucuaaaaauauuuuaaaguaaaaaguuuuuuuuaaaaaagcaauagcuuacaaucaggagaucuuuguaucuucuacauauaucaguguugcccaguagaauuuuggauaauagaaauguucuagaucuuugcuguccaauaugguagcuaccagccacaaguguuuuuuaagcacuuaaauauggguagccuaagaagcuaauuuuuuuauuuuuaaaauuuucauuaauuuaaauuuaaaaaguacacaugguuauuggcuaccauaucagacuguguagcucuauuuuuaaaauuauuuuagaaauaaaaaagauaaugcgaaaugaaacccaauuuuuuaaaucuguuauuuuguauuuguaauaaauguaaacuuuuggugacaguaccuuauuaaauuaaaacaugaaagacuucugagagagaaaaacacgccuaggccaggaacuguggcucacgccuguaauccuagcacuuugggaggccaaggugggugaaucaccugagguugagaguucgagaccagcuuggucaacauggugaaaccccaucucuacuaaaaauacaaaaaucagccaggcaugguggugcacgucuguaaucccagcuacucgggaggcugaggcaggagaaucacuugaaucugggaggcagagguugcggugagcugagaucaugccacugcacuccagccugggugacagagcgagacucugucucaaaaagcaaacaaacaaaaaaaccccgccugaucagaagacuuauuuauggaaaauuaaauaaaaaucuaugguagcuuuuaaaaagauuuuuaaaaauaacaccauacuaaacacaaacaacagcaucugaguuaacuaaauccaacaaucuuugucuauaucguccagagaauaaaaauauuagaaaaugaccaagaauuuucacaucacuugugcaaaugaacagcugcagaaucucagaaaauauaaacucaccugagggacuuggagcaggucucuguaaugguggucuaaaaccuggagcuuuggaaguaucagacugauguaaaggaucugaauuuggcaaauaugaggauuuuccugauagcauagauucugguguugacugagaugaaacaacagauccuccccagaaggcaugagcagaaguagggcuguuuucaaacaaugugcuaaagggcccaaaugguaagggggcacugaaauugggagcaauaggcuuauuugcuggauguacugaauucugacaagcacuuuguguacuuaaggucgaagguagcuggacagaagagggaacacugugaggucuuuuaaugugauugacacugaggacugcaacagaugaauuuugcacugaagcugaauucuugugaggggcaguugugccaugaggggguggucuaauagcagggguuuccauuuuaggaguaggcugggggcaucccauuggugucugaggcauaggguaagucacuggggcaguagaaggcaccgccacuggagcagaacuuguugcuaaaggaggaacagucauucuaacuuccgggggaggaaccugagacugcugaagagguggucuugguuccugagaaacagaucccggagguuguugcugauuagaaugagcugaugaacucccagaagaacugcugcuguuuggaggucuaguguuuguuguuucuacuacugguggacuaccugcuuccuguucggaggaagaugccacuuuauuuggagaugcugauccacaauccaaagggcuguuucuagaaaccccuccuggcugggcugguggugauggggaagauggggaugauacuggauaguguucuuuggcaguaggcauaggauauguggcauuugugggugcaguguuguuguugcuugccgugguugugacuguuguugugguggcauuggaugucuucacaacugugacaaaaagcugccuucggacagaaggugaacuuggacugccauuuguagauguaccaggcaccguugaagcugaugaacugguuguaguuguugggcuugaaguuaaagaaccugcugaauucaccugagaaccacugcuauucugauugcuauggcgaggcaccaugugaggcuuaggcgaguuaguagcucuggcagggcucaaaggccugacaggaaacggaccccaaguggauugagcugguggaaaaguaccuccaaagugggucaugggcaaccuugguggacggaucugcuggaaagucugagcagcaagcaaagcaugugcaaacuguggaggaggauaugcuaauggaagagaaacuggaaaaccaggccucacauuauucacuggguucuuaaugguuuugugaguggaugcagaagaaauugcaggcacagugagugcuguggcaguuugagauguugaugacagagcuacaguugucauuuuaauucccauuaaggaaguguuagcagcaguggugguaggugcugaugacccuauuuuggaauuugcugaggagcuuuucaaacgauucuuuggaauaaguucaucaauuucuuugucuggauccuugaucaaagcauuaaucaauugaguugcuugucuuguugauucagugccaccccuauaaauugagaaaaaaaaauuagguagaauuuucccuacuuuugaguauguaaaguguuuuuaauauguauuuauguacacaaacacacacacaguuuuguguguauauacauacacacauacaaacaaaggacagauaacaaaagcugggcagcaauuuucuuaccauuccugagguauucuacaaacaaagcaauaaacuguccugaauuacuacuuuuauuuuucagaagaauaguaaaugacuuauuuuucaaaaauacauuucacuauuguuuccuuagacuaagaaaccauuuuccuacuguaaaauacacuacaguuagaaaaaccacugcacauaaaagccuauguaauccacaauguuauugaaacauuuaauccuaaaaauauugaaacaguuaaucaacacuaaaaauaauagaaguaaacaaggaaaauaauacaacugaguaagaaaacaguauuuuauuuuaaaucuugguaucugggaugacuccgucuacuaaaaauucauuaguaguuugucuauuaauaggauaauuauuguaacuccucugggaagaugucuuaaaaugaugcaggaauccugauagugccaaaaauagccauauaaaaccuuagugcuggaucuucaggaaaauauuugauauuuauggaaacucaagggagcaauuaccaauaaaggguaucugguucccucuuuucuagauaagauaggcugugacuacccaaauacccaggggaaaaccagucagaaggagaggacgaugaauaaaauagagauggcuacuugcuuucuuauuuuugagguaugauguaacuauuagcucuccuauauaaugcaaaggggcaucugccucauacaaacuuauaucugccauguaaaaaauauaaaacucuuuuucaaaggaacaugaauuuacuuuaaaguaauuaaauauagcuuccuacauucuuaugauuucuuagaacaucacuuuuauuuuaagaauauucaggcauagacauauucgacgaguuauucaagauaaguuauaucuucacuucagauucaaaucugaacucaaauucuuuuuuuuuuuuuuuuuuuugagggaguuucacucuuguugcccaggcuggaguccaauggcucgaucucggcucaccgcaaccucugccucccagguucaagcaauucuccugccucagccucccgaguagcugagauuacaagcaugcaccacuaugcccggcuaauuuuguauuuuuaguagagacgggguuuccccauguugaggcuggucucgaacuccugaccucaggugauccgcccgccucagccucccaaagugcugggauuacaggcgugagccaccgugcccagcccaagaacucaaauucuaaagacacaaucucagaauaacaaaucucaaagguuauuugagaaagacaaaaacccacugcuuaaaauguuagaaaugcgcucccuaaaagucucagaacaaauuuuuaagaaugucauauaaacaguuuauguacagaaauuauuuauuuaaaccuuugcuacacaugcauacaaauuccuauaaaagucucugaaacacuucacaaaaguguauuaccuaggaaaaaagaaaacuauaaaauuuaucuucucaaacacuaauaaaauucccauuuuaaaaaguauacuauguaacacaaaguuccacugaaaacucauauggcuguauuucauuaagcuauagugcaauaaaauaaaggaagaaaauguaagagacaaaguuuugccuuauagugauuauccggucuccagucuugucuuucuguuuaucaauaucuaugugugcaccaguaaacucccgaauagcauugauauuacagccuccucuuccaaucacucuggauaucacaguugauggaacagauacuuucuuugaccuguuuaaaaguuguauauauaaauuaagauuagucauuaacaauaguuauuguaauuuuuaaaagaggaaagaguauuacuaaaaugucuuucuauaaauacagaauauuguugaauaagccucuucuauuuacucuuacucuagaugaacagagaaaaggcaaucaggagcaacagacagauaagcuuuauuauagcuucucaucucacuaucaaagauuguuugcuuuguugauuaucauucuucacuuguaucgguaaagcacauacuauguagacacgugcugugcuaaugcaaauacuaacgguaaauaagacagacauggguuucugcccacauauauugacuaucuacacgcuaauuaugaaaacaccaccaugucaugaguguugcaauaguauguguguacacacacacaaauguauuauauauacauauauguauauauagacauauauauguauauacguauaauauauacauguauauauguguauauauauauauuauauguguguguguauauauacugguugggcaucuaaucuagccucaagagucaagaaagacuucuugugggccccuuuuggugcuuuacucauaugcuucuuuuuauucucuaauauacauaacucaaagagugauguuaaaaauucaugacugggagugguggcucaugccuguaaucccagcacuuugggaggccaaggcaggcagaucacuuuaugucaggaguucgagaccagccuggccaacauagugaaauccugucucuacugaaaaaaauacaaaaauuagccaggcaugguggugugcaccuguaaucccagcuacucaggaggcugaggcaggagaaucacuugaauccgggagauggagguugcuguggacugagauugcaccacugcacuccagccugggugacagagugaaacuccuucucaggaaaaaagaaaaaauauucauuacuucccuguauucuuauaguagcauuaaaaugaccauccacaaauaugaaaacuuucuaaaaaucuuuaauaauguccggaaaaagaaaauccuacuagaauuuaaaaagcaaaaucugaggccgggcacgguggcucacgccuguaaucccagcacuuugggaagccaaggugggugguccaccugaggucaggaguucaagaccagccuggccaacauggugaaaucucaucucuacuaaaaauacaaaaaauuacccgggcaugguggcaugcaccuguaaucccagcuacucgggaggcagaggcaggagaaucacuucaaccugggaggcagagguugcagcaagccgagaucacgccauugcauucuagccugggcaacaagaguaaaacuccaucucaaaaaaaaaaaaaaaaaagcaauauccaucuaauacuugcaaaauuacauuuuaauuuuaaacauucagauauagauuauagauuuccuuuauuauuauuuuuuuuuugacagagucucguucuguacccaggcuggaaugcaguggugugaucauagcucacugcagccucaaacuccugggcauaagcaauccucccaccuuucccaaguagcugagauuacaagcacaaaccacaugcccagcuaauuuuuuaauuuuguuuuuagcagagauggggucuugcuauguugcccaggcuggucuugaacucauagucucaagugauccucuugucuuggccucccaaaaugcugggauuauagacaugagccacaggugucaggcccgaauuccugauaagcugauuaaacaauauuucuaaaagaaauacaguauaaaguucucaauaaagagaagcagucaaguauaguucaauaaacaagcaaauuauuuauugagaaugguuaaguauuaaaaauugucauauuuucuaaaaggaagggcaugaucccuguucucuauauauacaacuaaguuaccuaacaacucuuuuuaaccuaaagagcaugauaaucagccagugaucaucauuuccaaacuguauaacacaguauuaaaugcauauacaaaaaccaaauuaucuuauuaguguauagagaauauucugaugaugugauuucaauuaauccaauagaguguguaugugaaggagugaaagaaagaauguguguauagugugugaaaauagagacagaaauaaacauagguaugacggggacaagauuuggucuaaaauacggaggaaauaagccaaaaaccuguauacugcacuuagggauuaacaguaguuacuaaguuugguucacuauagcuuuuguuucagauaaccaaaaguuuaaauuuuuacgaaauuuccggaaaguucuuuaaaauaaguuaucaaagagugacaauggaucacauucuuucuggauuucaggugucuuaccuccuuuuacguuucugagauauuguauuuuuacucuuggauacauauuauuuuuaaaaucccaugcaaaacaaaauauuuuuauccugaaacccuuaaaauaaaguuaucuuaugauuuaaagacaacaguuacuaugauuagaucaacaguuuaacaucaauaccuacuaauucaucaaauguuuacaaguagcuuuuauaauacuucuuuguauuauauaaggcuuugagauaacgaagcugagaaagacacaaucuaaaauaguucucaaagcaaacuccaauacuuuugaggggccaaauuaacacguaauuuuuuucaucuaaaauauggcacaggcucucucuguuggucaaauuuagccuugaaccaucaguuuguuugcaaccuuuagaagaguaggaggaauuuaauuauaagguagauaacacuugacugugauauauagcacauaaaaagaaugacaaaaacaauuacucaccuucuuacaacuucuuuccauccuucuucccucuuuugcccacgcuuaggacuugcuacuguuaacuucccauuuggagaagaaaggggagauggaccagauuuuguacaaguagauagagaauuacuggucccuucacugauaguuucugacaaucuuuaacaaagagagggaaaguacauuaaauauggaacagauguagaauuuuuaaaugauaaagguagucuacuacccaauuuuuaaaaauuuauuuuuaaauaacaaaugacgaccuuauuuuucacuucuccucauauuuagcauauaauauagagagccuuuuuuuuuuuuucuuuuugagacaggucuugcucuguuacccaggcuggagcgcaacagugcaaucacagcucacugcagccuugagcucucggguucaggugauccuucugccucagccuccugaguagcugggaccacaggugcaugccaucacauuggcuaauuaaaaaaaaaaauuauuuguagagacagggucucccuauguuguccaggcugguguugaacuccugggcccaaacaauccucccacuuuggccucccaaagagcuauuauuauaagcaugagccauugcacccagccugaagagccaacuuuaagaagauacuaucuaggguacacauuuagcagaguuuaaucacaguaauaaucccuuggaaaccacaauccauauuuuucaugugcuaaguuuaacaaccaaaaaaaaaagaaauuacauaguaaaaauaauuugaugucucauuauauaaaaucuaaacaaaagcuuauucuucaauucaauugaaacaguaccuucuuuagcacaaagaaaaauccuauuuugcaaguugcaaauuuacuuucuuuaccaacaaauucaguaauaagguauuucaugaugacacuauaaauauugaaaauaaaaauuggaacuaacuuuauugaagccuugccagaaacagauuuucucucuuccuuuggaaauguaacaagaacugauggcugcuuuuugcugcucacagugguagugaccacagcuggugaaugauugucacucuuacgacugcuguugcuguuacuacuuucaucgcugcagcuggaaauccucauguuaucacuguccccacucucgcugguacugcugcucuuggacucuccauucaccuucucuggcugacuguaugaaauugguaguggaucaucaaauauaauuugaacguuuucuggaguaauuuuauuuuuccuguuuuuccucuuugaacugguuguaguuaugguauuauuucuuuuaccaugagaaccugccaaaguuguccagguugcagauauaccuaugguaguagugguuguggcacuuggagguucugucaagacuucaggcucaucuguaaaaguagcaauacugaauuagcaaguucuaaguguucccagaauguauuuagcuauaagcacuugaagaaaagaaaaacccaggagagauacucuacuacuauuagccauguaaguuauucucacauucaucgguaaugagcuggauaggacugauauacucuguguacccacguucuguucaaagaauagcagguaguuauaaaaaauauuuuggggggcauuucuggugcuggcguggcuccaggaaggccauuccagccaucaaucuuccaccugcuccuuagagaagggaagaugagugagucgagcuugaaguccagccagcccuuggccuccaagcaggaaauggacagcacugagaagcggggccggggcaggccccgcaagcagccucuggugaguuccgggacagcacugguagggagucagaaggagcccagugaagugccaacaccuaagagaccuuggggccaaccaaagggaagcaaaaacaagggagcugccaagacccggaaaaccaccacaacuccaggaaggaaaccaaggggcagacccaaaaaacuggagaaggaggaagaggagggcaucuggcaggaguccucagaggaggagcagugaccgugugugcugccugugccucacugaaggagcagcuuccuucugggacuggacagcuuuugcuccgcucccaccgcccccgccccuuucccaggcucaccaucaccacugccuccggcugccacccccauccuuccaccugcacccucaccaccacacuacacagcacaccagccacugcaggggccccaugggcugagugggaagcaguuuuccccuggccucaguucccagcuccccgcaaccacccacacauacacacguacccuccuggacaaugcuaacaucccacuuagccacacccugcacaugcugcauccccacucccuuaguaguagcaacacugcucucuggugaugggggcacccucucugcuccuccacuguucccucuggcuucccauaguguggucugggaggauuccccuggccuuaaaaggggcccaagccccaucucauccuggcaugcccuacuccacugcccuagcagcagguguggccaauggagggggugcuggcgccaggauucccccagccaaacuguguuugucacuaugugggguucacacuuuucauccuuucccaccuccccuagucccugcacuagguuggacaguccccuuuggcuacaggaaggcaggaggggugugagccucuuacuuccucuucacuguggccccagccccguugcccuccaccugggaucugaguacacauugcggugauggagaugcagucauuuauuguccaggugaggcccacaagcccuguggcuaccugagaugggcuggggccgcucccccauacuuacuuugcuucugccacucagccauuucccccuccucagaaggggcaccaauaacaaggagcucacccugccugcucccaacccuccugcuccucccugccccccaagguucugguuccauuuuuccucuguucacaaacuaccucuggacaguggugguguuuuuuguucaguguuccauucuucgacauccguuauugcugccgcuaccagcaccaaauguucauccucauugccuccuguucuggccacgauccccuccccuaagauacucuuuguggggaagaggggcuggcacauggcaggcugggugaccgaccaccccagucccaaggaagguggggcccugccccuaggaugcugcagcagagugagcaagggggccugaaucgaccauaaaggguguagggaccacccccucccccuguucuguuggggagggguagccaugauuuguuccagccuggggcucucccucugguuuccuauuugcaguuacuugaauaaaaaaaaaaaacauauauauauauauccuuuucucggagaaaaaaaaauuggggggacaguuuggaaaauauaaguauguacuguauauuacguauuauuauguaauuauuaaauuucuuaaugucguugcaguuauguaaaauaauguccucuuucugggagauacauaaucaaguaucugggggugauuucacaugauauguauagcuuaccucaaacaacucaaaaaaagagaagacacaacccaugugugccaaaauguuuuaaaaauguaggugacauagagguauuuaccauauuaauccuuaaaauuuucuguaguuugaaaauuuucaaaauaaaaugcuggagaagggaaauuaaaaacaaaacaaaacaaaacacacacacacauacacacauugcaugcacauauuuuuggugguuucauggcaaugguuccuucccacaauacagucaguccucuuuauccauagauuuaaccaacacuagauugaaaguauucaaaaaacaaaacaaaaaacaaauacgaauuuaaaaaauacaguauaacaacuauuuacauagcauuugcguuagguauuagagguaauguagagaugauuuaaaguauaugggagaaugugcauaauuuuuaugcaaauauuacaccauguuauauaaagacuugaguaucugaauuuugguauccgugaggguccuggaaaccauccccuguggauauaaagggacaggauuacuauacuuccaucccaaauaaccuuuugauuauaaccuaguuaaaaaugauuccuucauuugaagaaaucgaugaucuggauuguagaugauauuaugaaauuaccauuuauaauaccuaaaaugguauuaugaugauguaagcaaaugucauucuugggaugugggcuuaauuauuuauagguggcuggcgcaguggcucaugccuguaaucccaguacuuuggguggcugaggcaggggggaucacuugagaucaggaguuagaggcuagccuggccaacauggcaaaaccccaucucuacuaaaaauacaaaaauuagggggacaugguggcacgucccuguagucccagcuacuugggaggcuaaggugggagaauagcuugaacccgggaaacggagguugcagugaaccgagagcauaauacugcacuccagucugggcaacagaccaagacucggucucaaaaaaaaaaaaaaaaaggauuuauaggcgcaaugucaggaugucugcaauucugcaauuuacuuuuagauggcucagaaaaaaauauguacaaguacuuaaagagaaaaauaaagcaaauaugguaaaauuuuaacaauuuugucaaucuagguggaauguauucagguauucauuuuaucaucugucaacuugucuguaguuuugaaacuuuucauaauaaaguuagggaggaauucagucaacaaaaaaaaagcauauaucuuuucuuuucucuuuuuuuugauagaaggucuugcucugucacccaggcuggagugcaguggugccagaucauggcucaugacagucucaaccucccaggcugaagugauccucccaccuuaccuccccauccccccaauccccaguagcuagcugggacuacaggaguaugcuacuguguccagauaauuaaaaaaaauuuuuuuccuuuuuuuguauagacagucucacuuuguugcccaggcuggucuugaacucuuagacucaagugacucgcucaccuugaccugccauaaaaugcugggauuacgggcgugagccacugugccuggccuauguuaagggguuaauaacuugaaagcauauuuucaagagugacugauaaucaaguaaauauaauuuuaacuagaauauaaaacaaaugggaugguuguuaagagaaaauaccuucaacuuuaagcuuuucuuuuucuugagcagcuuggaguucaaaguucucuuuauuuuuggcuucaauuucuucuaguuuccuucuuuguucuuccuuuuucuuccuucucuucucuuuucuuuuuucucuuuucgcagccaaagccagccuccgacuuucuucccuuaacuguuaaagaucaauaaagcagaaauauaacguugaaauuuacccuggagaagaaguugucacauaaucauuuaaucauaaggaaaccaugauaucauaaaauucaaagucaucuaguucaauucauuguuuuaucaagaucauauucaaaccacucuaaagagacaauauuuuuacaauaucaagaucaaauuaacaauauaagacuaauuuuaaaauggguaaauaauaaacagauacauagcuuuuaaucauuaaggacauguaaguugaaccgacaaaauaccauuuuuugaucauuaauuuggcgaaauuuaaaaagguaucagauaucagcacaaguuugagaaacugaauucucuccuguacugcugcgggcaugaauauuuacauuuuagaaaaaguaauuugaaagcuuccuaacaaaaauuacaaacugcuuaucccaacaacuuauuauauaaaaugucuaucucuagugaaaaaacaaggguucagcaauuuucuuugcaaauugauuauaauggcaauacauggaaacaagguaagucugucaaugggaaggaauaaauuaacaguauauauucacagaauacuagauaggcaccguaaguauuauaaauauguacuugggaaaaugcucccaguuuacauuuguuaggagaaaaaaaggcacacugaagacuaauaaucacuuuuaugagagaagagaacccucuuugugcaucgauuuguauaaauacagaaaaaaaaaccauaaaaguuauaaauaaaaggguaacagagacuaccucuggaggguggaacaggaggagggauagcagaaugauggugacuuucaauuuuacuuuauauaacuauacaguguuucuauuuguuaaaaugaguacauuauuacuuucauagucaaaaaacuaacuguagguuuaaaaguccaaaaauauaucuuaauaaacuauuuuaacuguuaaauuuucuuucuuggcucauaaagguaugaaaaucaucuucaaacucugucugcaugucaucuaaaagauguuuuuuaaaaacuauucuccacccauaaucuagcauucugaauuauuuuauguguauuuuaaauaugugucaaaacaaugucaguuaaggcauggagccuacaacauguaaaaccaguccucauaaauucauaagccaaacaauauuuaguuuucauucaaaaaagucugacuucaucuuuuaagugcugugcuuuugcuagauacucucuguccugccuuucaaauuaacccucuccgguuuuuuuuuuuuuuaagccaaauuuagcagcuggggguuguauaccaacuuuagugacacuaacguuaauaaguucugauaacccaugacacucaaaccagcucucugcuagguucuugaaaaguuuggcccaccaccagguuuuuacacccugcgguaaugcaacauacuuaccuuaggcuaggugagagauaagucuuguuccugaaaagggcaacagugaaggaaaaccuguagguagaauacccauacuuucuccagcaaaucgauuuuaggaaagaaugcaucuaaaagcuaaagauacagaaacugccugcaucguaacccuggaaauuucugcuggacucccagaaagcuccagucugaagaucaguagaggagcuuuuaccccugcugaaguauuaggaacaaaacaguaacuggugaccuuuacucccuggaucaccacaagggaggaguaauaucugauuggugaguuugaaagaagaaacugagcaugugugacucagcucauuugagccuugcuuauguguuuucuccacguggaccccagugaaggagggagaagugugcuuguucugucuagcuuugauuuuguggaacagguaaguaaguauaagagggagaggaggagugaaagcaaaggugaaacgugcaccagaaaaacguauuaucaaagcagcuauggcuacaaguguguauuaagucucucuacuucaggauuaggaauaacaaaaucaauauuuuaucuguaucguaucuguauagacagaaaaauccugggaaaggaaugcuuugggggagaaucaaaacagcaaaugaaguuuuagaauuuuggcucauccaugauggguuguucauuuugcuggaauuuuguacuuaccugguagcaggagcuaauuaugacugcuauuuaagcgggaggugggggggauuuggggguggagaauuuuuuuuaaaagaauaagaguuuuaauucagaaagcaggauuucauuuaagcccauauguccuagauguugaugggggugguagguuuggguaggucauaggguguggcugggucuuagauauguaaauuucucagggcuggcagagucagucagggguagcccuuuggcaagaguaauaugaguuuggauuaucgaacuucagaguuuaacccuaagagguaaguauuugcucguuucuaaauuuugaaguuuuaaagccggcguuuugauaaucugauauauuuuacuaacccucugaauucacugagaguagguagggcacuaauucagagguccuagggaaaccuucuggggggagauaccaaguuauggcuacaaaaugacccaacuuuacauggcacggagcucuaaaaguaagcagaauuagcaaguguggaucaacagauacaggauuuaagaggcaucauaaguuugcaggcgguagcugaaacuaacaaaugagguaaccagaggaaaaagguguaacuguguguguguguauacauacacacauacaccuacuauuuuacuauauauaauaaaauauauagauauuauacauauauaaagagaguuuauguauaugugugugugacagaauaucuaagggguaaaggaagaacaaaugaggcuucugaaaggcauaaucagaggaagacaaacaggagaaagcaacuccaaugggaaaaggaaggccagaucaacacugguaaaccucacaaaaguggugggcaucaauaagaacugaaaagagguaaauggauuuggcgugcuuugugaacugaaaagaaacaaaaaauaaaauuuaaaaaaaagaaggauuugucaguuaagaugccauugguuaccuccaccacaguuaguuuauuggagaaggaggucacaugguucagaccuaagauuuaauuuaaaauaguuaauaagacauagagauuauuauaagcauuaaaagaaaggcaaaauacuaaauuugagaaaaaguuccauuaggauagagcuacccugauuguaccucugccuugacugaagcuguagguaguggguaggaguuaguaaaacaguagaaauugaagauaaaggcauagggagaggugcuaauaacugauagaaaaucccagacagcauauggaaagaguaacuaaaccaugaagauucaaauacguccagaggcauaagaaaauaaaacuaaaaauucagucucacuuucuauauuuucucucacuuucucucauaagccuaaaucucauuuuacuucuuggagaacugcugucauguuuguuagugugugugggggagguuagaggcucugagaaaaagggucaaguuagacaggagaauggcgugaaccugggagacggagcuugcagugagccgagaucgcgccacugcacuccagccugggcaacagagcaagacuccgucucaaaaaaaauaaauaaauaaaaauaacuucacuguggaaugggaaagggcacuaacccaacugaugauuucuaauugagggcucaggaaacaaagugacacuugggaguuaggcuuuauaagauaagaauuuaaggacuuggggaaagccaguccagacuaaacaaauacugcagauuuagauauaugaaagugaaugggauaugugagaaguagcaaaccauagugaaagaugagccuggagaaauaagagagaagaccugaauguuuagaauuucccaugcaaucaacgaagaggcacugaggguuucugaggagaaaguaaggcaucccaccuguguauuaaaaaaauacgcgggcugggcacgguggcucacgccuguaaucccagcacuuugggaggccaaggugggcagaucacgaugucaagagaucaagaccauucuggccaauauggugaaaccccaucucuacuaaaaauacaaaaauuagcugggugugguggugcgcaccuguagucccagcuacucggcaggcugaggcaggagaaucgcuugaacccaggaggcggagguugcagugagccgagauugcgccauggcccuccagccuggcaauggagugagacuccgucuuuaaaaaaaaaaaaaaaaaaaaaaaagcgaaacuguaaaaguuacaccggagcagaaaaggaauacugaagacaaaagauaagagagagacacagauauguauacagguagacuuuuaagaagccaaaugcaaaauuuugggugagaagugaucacucagagaggaaguggauggaacagaaggcagacacagagacugccaaagcuaaauaaaaggugaugguagugaugaugauaauaaucaugaugacagugcugauacagcuaauauauagagggucuaauaugugccagauacuggucuaaguuaacucaccaaguuaauucauuuacuggauguaaagaaugggaggcaaaaauaauugagaaccuaaaaguagcaucaagauuucauuucucaauaaagaguaguaauaucaacagcagaaagagaucaagaaguuucaaaggaagguaggggaaagauccaacaaaaauuuucugguaacuugcuaugugcuaugcacgguucuaguuucaucaguaaaccggauaaaacaucccugucuucaaguuuacauuuaguugguuaggggaggguggauacagauaaauagaaugcauacauuauaguuuguuaaaaggugauaagugcaauguaaaaaaggggaaaagagcagcgagaugaaaaauguguguauggagacaaauggaggguuuugauuuuuaaauaggguaaucaguguaccccucaugagaugaaguuaagugaacaccugaaggacauaaaauauuucagccaaagagaaaagccaguacaaaagcucuaaguuagaacuggacccaguauauucaaguaagcuagcguggcuaagaacaguagcaaaugaguuucggggaacaguaucaggaggcuugaucaccuaaggccuugcagagcauuuuaaagacugucuuuuacugagagggaaagucauugucgggcucugaacagaagugugauaugauuugauuuagauaauugaagaggaucagggugcuacauaaacuacaagcaaugauggaaucagggagaccaguuaaaugacuaaugcagguaugagauuaaauuaauuguuugaaccauggugagaagugauuaagauuauauaucuauauuuugagagaaggucucacacuguugccuaagcuggaguacaguagcacaaucacagcucaccgcagugaccuccccaggcucaggugauccucccaccuccaccuccugaguagcuaauuuucaggcaaagguaacgggauuuuucaacgcgauggaguauagagagaaauuaaggaugauuucaagguuucuggccugagcaauaagaguuguggguuuggggugggcaaggaucaggaguucauauuuggacacaucaagugugagaugccuaauaagguauucaaauggacauguugaauagcuagcugaauacacgagacugaaguuuagcaaagaagucugggcuagagauacaaauuuggaaucaacugguguacauuuaaaguuagggggcaggauaagaccaccaguggauaaagaagaccauguaacaagucaaaaggcuuuucgcuaaaagguaggggagaagaggaggaaccagcaagaggacacaggaacauccagacagguaggaggaaaaaaagagccuguaguggcaugaaagccaagugaagagaguauaucaaauguuauuaguucaguaagauaaaagauggagaggagaaguaaccauuggauuuagcuauaugaaaguuacuggaaaccacaaaagcauaauuuuagugaguugugggaguugagagccagccugucaggaacagauucaggauaauggaagaaaaaauggaggugacugaaagcggcgguucagggaucuuuaccgcaaagggaggcagagaaaugggucuguagcuaaaagguugaggcaagaggguugaagucaaaagguuuucuguguuuaagauuggagaaauaaguguguaugcugaugagaaugauucaagagagggaaaaaaauaggagaaagaaaaggaauugcuacggacagugcuguugagaaggagaaaccauauaggaucugguacacaaugaagggacugguuaccaaaaauuuaucuaggcugggcaugauggcucacgccuguuauucccagcacuuugggaggccaaggcgggcagauugccugaggucaggaguucgagaccagccuggcuaacauggugaaacccagucucuaccaaaaauacaaaaauuaguagggcaugguggcccauaccuguaaucccagcuacuugggagggugaagcagaaggaucacuucaaccugugagguggaggucacagugagcugagaucgcaccacugcucugcagcaugggugacagagugaggcgcugucucaaaaaaaaaaaaaaacuuuaucuagucacugguaggaaguauauggguguagauauugguggguggauagauaggguaggcaaagucuuuggaaguuuucuuuugaugcuuccauuuucucauuaaagguaaagaagaggaggugcagguauuggugggcagauagaugguguagguaaagucuuugcaaguuuucuucugauaguucaauuuucucaggaugcaaggucaccuacugaaggugaaagagagguggugcuggaguuccuaggauaagggagaaaguaagaaacaguggucuaaaugaauggaagacuaaauuaaacuaaggaaaugcagcauuuuaacuacuggucagcauuaaagggcuagggaaaucuaguaaagcuacugucagcauaaaaggguucguugucacacauuucaaguaaaauuagucauaaagauuguuuuuucucgacacguuuaguuacugagguucaugugagaauaagaagaaaggaguaagaaacaaugaaaggguaguaugacauaaaugguucuuaccauuuauuggucggugguguuggcaggauuauuaaaaguagaauucuagagggaguaaaguugaaaagauagaaagcaauaaucagagaaugaaaugugugaaaccgagaaugggauagguuguguuugaaaaauauacuauuaccuagcucccuaaaaguuuaccaaaaaaaaaaaaaaaaaaaaaaaagguagaggaaaaaaacuaaaaugaagugaaggggguaaaaaaagguagaggaaaaaaacuaaaaugaagugaagggggugaaauaauuauaucaaaaauguaaguuuaaaauaucugcuagggauucuaacagccaagaacguaacuuaguuguuaauguucugagagcaagcaauuaacuguuaagaagauuccauaacuugaccagauggaacuacuucagagcagggacucuuccacuuaguaaaugcucaauaaauaaauguuuacuuaauaaguauuaaaaaaucugcuggccuuaacauaauggccacugaucucuuuuucuuuuguagagacugggucucacuacauuggccaggccggauuugaauuccugggcucagccucccgaguagcugggacuacaagcauguaccaccaugcccaguuuucugcagcaguuuuuauaaaccaaauuuuccaaauuagaaagacugaccaaagaagcacuuuuauacgaggaauaacuuacguauggagaaucucaacuuggaccagucaagaccaacuccagcgaugaagccagaauguaauauaucucaaaaggcuaaagaaguccauuuucccagauguaaauuauaauuaaaaaauagugagccaaacucuaauaucccaaugugauaaucuuucaaauaaaaauaugggcuguaguucaggaaaaaaguggcuucucuauaauuaaaaauuuuacauauguuccacguucacucaaaacuauacauaaaaguauauaaugcaugugcaggaaucaauuuagauagaauugauuaaugauuaagaauucuucauuagcuuuugguuuuaauauuauggaaaaauauacaacgauauuuaaaagaagcuucucuugacuucucuuaaaacuaaggcucuugaaaguauaaacauuaagguuaaauaacgcuggcaagaauacaaggaaaugacauugguguauugcuaaugguacuaggaaaguauucugcaaguaucuacuaaauuaaaaauacaguagugcccccuuauccaugaugaguaaguacauuccaagaucccugguagaugccugaaaccuuggauaguacuggacccuguauauauauguuuuuucaaagaaacccaugauaaaauuuaauuuauaaauuaggcacaaugaaagauaagcaacaauagcaauaaaauagaacaauuauaacaauaugccaguaacacuacucuugcacuuuggggccauuauuaaguaaaauuaggguuucuugaacacaagcacugugauaccucaacagucaaucugauaacugagggcuacuaaguggauacaccagacaaaaggaggauucaugucccaggugggacagaaaaggacggcgcaaaauuucaucacacuacucagaacggcaugcaacaugaaacuuaugaauuguuuauuucuggaauuuuccauuuaauauuuucagaccauagggaaagcaaaaccacaaauaaagggacuacuauauguugacccacaugaaggaacuuauuucauaaaaauaaaaggagcaaaauauuuaaaaaauauguauaaggguguuuauuacaauauuauuugucgugacaaaaaacuggaaacaaacuuauuauggacuauucugcaguuauuuaaaaucacuaucaaaugacaauauccaucaguuacuaagagaggggaaagcaaguauuagaguaauauguuugcaugauucuguuuuuuaaaaaaaguacaccaucacaaucagugugaacauuuauucauucaacaaauauuuauugagugccuacuauaugccagacacuauuuuauguucuaguaauagagacaaacaagauaauuaaguauuuugaaugaauacaauauuuagaauguugaaaagugaaaaauaaagcagagaagagcagaaaagugcuugugaagaggaaacuaaaacaugaggacaucuaagggacauucauggaagaugcugcugacagcacaaacaaaaagaggauggucaguauggauagagcaaggugacuaagagaaagaguaauaaaaaacaaggccagagagguuuaagaagugguguggguaggcagaucauuacaggaucuuaaaaggccuuauagguaauugcagagguaaagauuuuaaaacaaccauuaucacauuucuaacuucaguuaucuuaaaaugauggcagcuguucuugucuuuguuucacaguuuaaacugagcacacuguuauaauaaaaaaacaaaaauuuaaagaaucaaauauauauucuaucacacaaacuggcucaauuauacugccuuguauuuagcaggcauuaaauaaauguuagguagugaauauaaaaacaggucaaguaauaguuauaguggucauuauaucucuuaaugcacucauauucuuuuaacauuuuuaaauggccaaaacagcuacuuuuaauuugcucagaauauaaaccacaaauuuuuaaaaaugaagagcuuccaaaauaaaauacauuuuuucagaaaauaguauuuucaaauuuaaauuagaauaaaguacuucaaaugauucauauuaauguaggacaaaauguagaacuuaauaaagaaagcaaguauaguaaaaaagaauguagcuaacaagucaaaaaacgcauaugcauaauuaucacugcaucuccuuuauaaauuuaaauaguagauguuaaauuuuauagcauuuugaccuuuuuaaaaaaauuuuauuuauuuuuugagacggagucucacucuguugcccaggcuggagugcaguggcgugaucuuggcucacugcaaccuccgccucccagguucaagugauucuccugccucagccuccagaguaaaugggauuacaggcaugcaccaccacguccggcuaauuuucguauuuuugguagagacgguguuuugccauguuggccaggcuggucucaagcuccugaccucaggugaugugcccgccucggccucccaaagugcugggaauacaggcgugagcuacugcgcccagccacugaccuuuuuauaaaagaugagauauggcaguuccauaauauucaaugccaaaccaauuauuuuccuaugauuacuauucaguuaaguucuagaguacagaauuauaggggaaaauguggcagaaaagggaagugaagaagcuauaagacuguccaaacuauaugcuguuuugguguauuuuacuccccaugggaauagaugggaaugauguuguagucugccugaaagagaaaaguacaagagaagucacccauuuaaaaaguguacucauuugacauuccaagauuuguauuucacuaguugguuaugccuugguagugcauuugguacuugugauaaaccuguuggcaauaaauuacaaggucuaaaacaauaaauuauaagaucaaaaaacaacagaugugguugaggauuaagagaucauuagcugagauaagacuaaaauccagaacuagaagcuaaguuuucugacuuccagaucaauguaauuccuauaacaaaauuuuguuaguuacaaagaagcuuucaaugauguucaauguacucauaauucucuccacgauuugagccaaauguagaaagaaaucauguacguaauuuaaagcaaacaaaacaaaacaaaaagacggauuacaaaucaaaagaagagaaaacaagauggaaaaaaguggguaguuuucauguguaaagauuauuguuaccuuuuccaagucuaacuccucuaacaaaaugcuggcguuuuuguuugcuucagcagccugucuaucuuuggcuuguacuauugacuccauacaaagaugacacuucuucagcaucuccuauaaugaaaaauuaagauuuuuccaggcucacagaacaauucucacuuagagaaauuccuaaaaacacgaagaucuuuaguaagguacucaaaccuaagcaauaaagauccaugaaagggggaaaaaaggugugcaaauaaaaacguaauugacaugguauauuuaggaauauauacaaaugaagaaucaaagaguagcuuuugcuauucuucaaaauaauauccauuuagcaggcacuucagaaacuaaagucauuuauccucuaauuuaaauauaagaaauuguacagcaaacagaacuacaauaauuuauguuggcugguuaacaggcuaaaggaaauaaugucaacaaagaaaacagaugugaaaauuuuucaagaaauguccucaaauauuuaagcuuuguugcuccaauuuuguguacaauaaucauuuacaaaggaaucagauacauguacuuacauaauuuucucagugauuucauucucaagucacacuuuaggacaguaaaacacuacuuccuuauuuuuauaaaauuuuuauuuauuuaauuuuagagauaggggcuugccauguugcccaggcuuaaaugcaguggcuauuaacaggcauaaucauaguauacuguauccuuuaacuccuaggcucaagcaauccucucaccucagccucccaaguacaugagacuaaugcguaccugagacuacagcugugugccacugaaccagucuuauucuuaguauuauuaaaaauaauuuauuuuuaaucucccccucugccccuaaaaaccugugauauauaggaauguuaauugucauggacaagucuagagcuaggaaagacagugaccuagcuaguuuaaauuaaaacuuauagggaaaagcuguucacuaucauguaauagcaacuguguaaacgucauaagaagacauuuuuaagauuuguuguccucuuugguuuucagaggcauguguuaggaucuuauucaaguguuaguguaaacuccaaaucaaaauguaugucuccaggagaaggucucaauuaggaucucuaauaggauucaguuuuaucuuccauaaaauuuccugcaaaauuugcauuuccugcaaaauuccuagccaauucauucuaaaacuuaguuaaaacuaaaaguuaguuacccuaacuuuuacaucacgcucaagacuucuugcucaugauuaaaaguaguauguucauuuuacuaggaaauaaaaaucuauuggacucauuacuuucucaauauagguaucagucuggauaaacacacauauacagaggacagcccuaaugaauaauaacauguugcuuugaauuacuuaguguucacauaaaaauuaaauuagcucaagaauuuuuuuguuguuauuuuauuuuuugagacaagagucuugcuuugaugcccaggcuggaguacaauggcacacucuuggcucacugcaaccuccaccuuccggguucaagcgauuuucgugccucagccuuccaaguagcugggauuauaggcacaugccaacaugccaggcuaauuuuuguauuuuuguagagauggggucuccccauguugcccaagcuggucuugaacuccugggcucaugcaauccaccugccucggccucccaaacugcugggauuacaagggugagccacugcaccuggccucaaguauuauuuuuaaagauaagguaauccuauagcagaggauguuuuauugauucauuagguaaguaaauaaucugcaagaaucucuuaaaucgcauacuucauucccaaauacuagauaaaugaaaauggcuacauauuacacuuuacuacucaaacuaggaauucuuagaauggaagauauauuaaccgaauagagucccuugcucauauagugaacaacauauuaccuuaucagugaugguugcuauguaucucauacauucagaaucugauggaaacugauugacuucuuugacuaaguagcgcaccaccuucacaugacccuaaaaaauagauaucaaugucagauugaaaacagacucuaacaguucaguaaaucuaugccugaacuaacuuuaacaguuaagauuagggccacaaaguaaagacuaaauugcauauuuacacuauaaaugaaaaagagacaggcuuugguuccagugaguuaaauccacauugaucauucucauccuacccuccaaaaaaaguacauaauaauaugagcuaaaauucuaaacaacucugaauaaaaaaaacaauaaucccaaaaucaauacaaagaguaggggauaugucugaaggguggugggggguggggauucuuauuuuuuucuuugcuaacucccuaaauaugagagucuaguuucaauucuaaggauuaaaagggcaaaaauaauaauuuuguuuuuucauuccuucagauaaaaaacaaauguauaauacugucuuagguagugugaaagaauauauacuuucaugaagaauaagcuaugauuauucacugcaacacaaguuaguaucuaaguucaaaaucuuuagacuugcccuuuccuacuucuuaaacgccauucccacuuugucuagcccauacuguugcuuucugacacaacaucugaaguuagccagucgggauaaacagcuguuaaucuuuaguauauuuuuucuauugccucuaucucuuccuuuuagacugcauguuucuaaacuuuucucuaaaugaauagcucaaaugccacuugcaucauucccuaaggaucucucuaauacuucuacaguguuuaaacuauuuacaugggacaacucaaacaguuaccuaacuuuggguauggaucuuaccuuuccauauuguacccuauauaacauaguauauguuauauauacauauauagacaauauguauauacauauauagacaauguauauagacauauauacacaacauauacuauguugcacccuauauaauauaguacucuagcccacaguugcacauguuagguacucaagaaauaauggaacaaauacauaagaguauaaaagauaagcacugcucaacugaagucaauaagucuaucuggaaagauauaugcauguuagauacuagaguaauaacuaauaaaaauaacaacucuaauaguuagaguaauaacauauaaaaauauguauuucuccaaaugaaugauaaacacugucaaacuuguacgaccucuagagauuagagaucucgaugugaacucaaauaggaugaagaguuugguaggagagacuucaacuauaacuaaagaaugaguaacuuuggaaaaaugaagaaagacaugggcauucuaugagaugagaacaaaggugaugugagagauaggaacaaggaaaagaccaagcaagaagauaauucuccacauuaaggauucuaaugggagauaagaucuacaagcacuaaauugugguggcugugaauaccaaacuaagauuggauuucaaaugauuucagaaacuggggagacacagaaagguucuugaagagguucucuaauauaguagagugguuagaaagauuaacuugauaaugauaugcuagcuugcuuggagaagaggcagcuagccagugagaaggaauaaguuggauugcugagaaacaaaaauauagagagucaaaaauacagagucacugguaguccagauuaucuagggaagagguagaauaaagaacagcggucagagauaauaagagaaaaaggaagaaauagcuuauugugauuuauuuauuaaaaauuuucaacauuuuggcaucuacagggaauuuuaucuacauaucuccaaaugacaaaacucaaaauuauaaucccuguaacaguaaucugauauucccaauaacaaacuaaagcuggauuuaagagaucaauggauuaucaaacaaaccauuaaaucaaauuacuuacacacagcucugugcuauguacagaaagagaaaguuuguuuuacuuucacggaauuuguauuuuuaccuuuaaauguaauauacuugaaacuuaguaguuuaaaaugcugguaguggcauuuucauuauuuaauucauuuuuuuuccuaguaaagucaauaauugaaaugaaaacaaauuuuuuuugagacggggucguacucuugucacccgggcuggagugcgguggugcaaucucagcucacugcaaccuuugccucucaggcucaagccauccuccuaucucagccuccugaguagcugggacuauuagcacaugucaccacgcucggcuaauuuuuauaauuuuuguagaggcagggcuucgcuacaucugccugccuuggccucccaaagugcugagauuacaggcaugagccaccaugcguggcacaacccccgcccccagcaaaauaaccaguuuaagugauauuuuucucuguagugguaauacaagaaaacacucacuaagaguaacuaacuggagguacuuacuuaaguaucuuaacuggauuuacacuuugugaagauuaagacugcaacuagauuuugaacacauuacuuagaacagcuuuuuaaaaguuuacuuagcucugauguccaauaagguuaaaauuaauggcuuuucugaaaaaccuguauauaucuacauuuaauguugccauaagaguaauuauuugcauauuauugcuuucaucacagcugcaaaagcacaaaaugagucuuuagugaucacuaagccauguacuuccuaguguaaguaaaaaaacauccagguaaaugaggaugaaagacuuauaccuuucuaaaugcugccauaagaggaguuaucuugcgguuaucugcugcauccacaucugcaccugcuugcaccaguaacugaaccacaucgagguguccaccauuugcugcuagccacaauggaguguuccccuucuuguuacguacaucaauaugagcuccccuaaaaaccaaugacacagauagcauugucuuuuuuuuuuuuuuuuuuuuuuuugauacagggucuugcucugucacacaggcuggagugcaguggugagaucauggcucacugcagccuccaccuccaggggucauaugauucuccuaccucagccuccagaguagcugggacuacagucccaugccaccacgcucagcuaauuuuuaaauuucuuguggagauggagucuuccuauguuacccaggcuggucucgaacuccugggcucaaguaauccuccugccucaaccucucaaagugcuggaauuauaggcauugucaccacaccuagccuagcauugucuuaaauagaaugaaaugacacaguaacaaaaaucaacuaucaacaugugaaaauauucuguaaagauaaaaauuguuuucaauauucaaagauguaaauaugucuugcucucagaauuauacuacacaaacaauauccuaugaggcaacuguaaccguuucagauuauuuguauucauauacaauuugaccaucccuaaucugaaauccaguaucugaagucugaaaugcuccaaagagcauuuccuuugagugucauaacagggcucaaaaaguuccauacuuuggagcuuuuccaauuagggauacucaaucuguuuuuguaguuauguuaaagauaacaugcagguuuagcauucauucagugggcaugauguagaugggaagaaccaugguuaguaagaguuaacagcaguuacugccaaauacuacugcuuagaauaccaugcaaaggucuuugagagugcacgaaaacaaguuaaacagacaagcaucuuuggaaaacuagcaggcaacuucuacgugacugaaaguagaaaguaccuuggauccugucuguuuaucuuaaauagucccauaaccacaccuaaaagccuuaauuacugugaagaacaagaaaauggacaaugaagccuuagaucacugccagacuuuuaagacuugugugugggggauguaaguaugucugauaacagauggauguucaaauagcuuguuauuguagacguuaaaaguaauauagacaagaaugaaagaaaaacauuuuuagguuacacagaaacaaaucagacaauguagcauagcucuggaggguuggaaaacaauggguagguuugggggaaaaagcacuuguuuauaaaagaagaaauaaucacauuugauuuuuuaaauaguuuaauugccuagagagaaugauaaccacuaguaacacuuguguucauauaugaaggguaugguaacaacauaccugccaauaagaagcucacagaauuuguaaugcccuuuaucugcugcuaugguuaaagcuguaucucuugaggagggaacuggaggggcauuaacaucagcaccuuuauccaaaagaacucggcccaccuccgcauauccaccagaggcagcuuccauuaguggugugagaccagucuaaguuuaguguaaaauuaaaaguaaugacacguaagagacuggaaagaucuaaaauuguaaagaauaacaacuugaagaaggaauaugauacagcuguuaccaagauucacaacuaaauuuaaucacugacccuuauuagcuccuuugaguuagucugaucuauuaaaagaaaauaauucuaccuaaucucaacgguauugcaaaaaaaaaaaaaagaaagaaagaaaaaaaaaucuguuuaagaugcaagcacuuggcauauaacugguacucaauaaauguuccauucccuuccuuuucaaaauagucucucuuuuucagcugauaauccuacugucauuguugccuauaaaaauuuaucacucagguauuuucaagaguuaauguuugacugaguuauacagaaugauuucuaauuaaauauauacauaggagauaaauguuacuagaaagaacuaaaauuauaaucaacauguugcuacuauauaucuuaaauaucaaagcaauaaauucauguguaaaucucagacuuuuucuuaccuuagcucuguguucaacauuugcuuuucuaucaagcagaagacuaaccacuucaguucuuccuuggaagcaggcuaaaguaagggcaguguuccgauugguuucuaucugagcauuuaugucagagcccaugucuaacaggagcuuaacagcagcuguaugcccauucauagcugcuaacaucagaggagagaugcccaauuugcuaccaguucuaggggugcagguauggggaaaacaaauggaaaaauauauauuuuaaaugacagaaaaauuggagaugauauauaauucuaaucuaagauuauuuugaaggauuguuuaaaauauccauuuuucucaaccuuaguaagucucugagauacuaccaagacuccauuagaaauguuuuauuagaauauuuuuuguauuucacucaacauaaugacuuaggcuggaaggugauuaauaaguuauuaggauaaacuuucaaucuuaaagcauguauuagcuugcuuaauaaaagcuucuaagauguuuacauuuaguaucauaagaaacaguacucaauauuuuucaaacucuauaucaaguuuuaauuacuuaaauaaaguucaucucaaaaaucucuaacacuuugaaugccaaauuuguaauaaagggauuuacuaaauuuggcacuaaaaaauagguguucuacaaauaucuauaacagucuuacuaaauaaggggcuuacagaaagggaauacaacuugccuagaguuaaucucagcuccugcauuuaguaauauuuugaugauguucacauagccaccagaagcagccagacuuagagguguguaaucagaaacauuccugugcucuuuauuugccccucgagcuaacaauagcuccaccaccugaaaauaaaauagaaaaaaauauguuuucuuauggagagacaaauuaccaaaguguguauuuuuaaauuucuuuuucugguauacuguacaauaaaagaaggggaaaguucuuccuucaugcucugcauaaaaucagccucuaaugauagcaggaggucuuagaagccaacaaagagauaccuucucaaguaaaacccauguagaaauccacuaaaaugcuacaauguguucaugaaaggucuggacugaaaauuuugugacaugcuuuggaaauuaauauuuguuauuucaccacaaagcgguaaaauagaguaauaugggacaagauuuuuucguauuauacaugugaauguauuuaacauauuuuuaaaccuuuuaaucaguaaguauuuuaaaagcaugguauaaaagguccuauauuuucacaagauuaugaaaauuuucuaagauaacauuaaaaaaccuuauauacauucacuaccuagauuuuaggucccaccuacuggcagaauuucuggguguaugguuuuguaagaaauugccaggcuauucuuaaagugguuguacuauguacacucccuucaauaaugcaugaguucuaguagcaugagucuuggcaacaucuguuauugccagucgucaauuuuagccauucuaguggauguguaguuguaucccacuggaucuuaauugcauuuccugaaaccuaaaaauauuuagcauuuauuuaaguacugaugggccauucacagaucauuguccacuaugccauuuaaugccuaaacaauccuuugacacaauauucauucucauuuuauaaauaagauauagagaagucaagacuggcucaagaucauagcucuuaccccugcucuuacuauuaauaauauauccuaaaauacuaacuggcaaauaauaaauguuaaugaauagugguuuaucuugcaucucagcaaagcuauguccaauuuuagauaucacauucuuuccaucacuuuuugcuuucagagcgagugacaagguuauaaaaacaagaaaaaauauagcguuaggcuauuuuauaaacaguauaguagaaaacucuaaucaaauuucucaaguuuucucaaugccauuauauuucucaauucuuucagagaacucuucugcucccaaaacauccaauauacaacaaaaauguaugauuuuuauaguaaaaugacuuuccaacauuuuauuaaucacuucaaaauacuuaccucuucuauugacaccaaauuaaaguaacaaaguguuuauaggcaaaauuguuacccuaacauacuucaacaauuguuauaaccuaaucuguuauauuuuaacaaaaauacauaauucauaaaaauuacagugcccuauuggcuuuaauacuacuuuuaaauaaagaaaaucaacuaauaucuucuugacucaauauugaaaaaaucuguucuuauauaaagcaaguauuuuuucaagcuaaauaaugauugaaaggcaauaugauugaaaggcaaaauuuugcuuuccgggauuuauggggauuuuuacuuuuucuggaauaguagaaauaauuuaucaaauuaagugguucauuuuucacuaucuuaauauuuggcuuauaauacuuuuaaccuaucuauugccccuacuaugaauuauagaagaaaaaagugacacaaguagaagaaacaaaacaguagggacaggccaggcuccuugucucuuguguggaguauucuaguaauaaguguaucuaacuauccauucauauaauaucuauuccaaauauaagggaacaaaaauuauggaaaaaaaugccuauauuaucacuguuaauagauuucaguucuuuuuaauuuacaaaaugaaggaugaccaagcccuacccuuacugcacuuacauaauuuuauuagauuucccauucuuuuguauaggaauuauuauaucuauuaaaauuguuuauuuauuaguuuauuuuaaaaaucuaguggguuuaacuaacuagagcucaauauaaccuuaugugcuaugacuggggggaaguggggggaaaagcuaguuuaagaugcucaaaugggagguaacaguuccccaguucacucgucagaauaccuuuacauauaauauuuuaagaaggauacugacauaaagggugaaacagucacgaugaugaagggauuggaaaagguauucuuaggcuaacaaccgaaacaagacuuguuucacacaaagaauaggugacuucaggaaaaaaaaaaucugaagauagaaaagguuaaaccucuuucuauuuguuuaaagaacaaaacuaagaacuguggggaaacaaaaaaggcauacuucaggccugauaaauaggaaaaccuuauaaaagaauaagagaaaaaagauuuuaaagcuaagacacugaucugaaugaccuaaggugcuuuccaaaucuaagauucaauaauuccuugauagagaagggaaucuauggagacaacacaucugguuuauauccccuguacaaaggacugaauuugaaaaaaaaaaaaagguuaucuagcugauuauaaaaugccacaagauacauaagugaguguaaagcuacauuuucuugagccuagcuaaucucuaucaguuguucuaguuuccuuaaaaaaacaaaaggucauauaaucuuaccaucuuaucugagaaccuuuccuccagaguugagaaaggguggggaaaaaucaaagcaagacaagaguucucaaaacacauaaaaauugaauauucuuaauucccuacuaaucuuacagacagcaacagagacugugauuaaguaccuucuaugccauguacuauagggcaggcaaagaugagugaauauaggcccuguacauuaggaacuuacugauuugacuuggaauagucuuucuccuaccguaaaugcauggcauuccuacuuuuagaugagcaggauucuaaacaaugugugauuuuucuggcaagauagcuuaugcuaacaaugauacucaucuuuuuguuaauagauaauaguuucaguuauugugagaaaucuaaacgucaaagcauuguucugauagaaaaaauaauauaagugaaaguacacauuugcuaaacagagaaaggaaaacaauuacacuaaggggaaacauuaccuccugucuucccccagaacaagccaaggagagugguguguccuugguucuuucagacugggcuucaaugucugcaccauuguccagcaauauuuccacaacaccaacaugaccagcuguggcagccaagaugaguggaguaaaaccuggagaaaaauaaugaucuucucacuacaugcuaaggcaaaagaacaaaauaucugaccuucaaaauaggacuaaaaaauaauguuccuaaauaaauuuuuugaccaguauuccaaaaaauaaaacaaaaguaggcccuaccuuucuugucucggugcucuauacuagcuccucucucuagcaguguuuguaccaguuccucguggccaccagcacaggcaaguguuagugccgugucaugauuacucucagucuauaagaaauuauuuuuugguuaguuuauuaaauaacuuaagauguuaauaucaaauacauaauaugcaaacauaucaaauacacacaaauacauauguaccacucuacaauaucaagcauuugaaaagcaagguuuauggacgggcgugguggcucacgccuguaaucccagcacuuugagaggccgaggugggcagaucacgaggucaagagauugagaccauccuggccaacauggugaaaccccaucuugacugaaaauauaaaaauuagccgggugugguggugcgugccuguagucccagcuucuucggaggcugaggcagaagaaucgcuugaaccugggaggcagagguuacagugaaccaagaucacgccacugcacuccagccugggugacaaagcgagacuccgucucaaaaaaaaaaaaaaaaagaaaagaaaagaaaagcaagguuuacuuguuuccauauuagcagccaacuugcgaguuuuuuaaaaaggcuacaaacaucaagaaaaauaaaguaugacuuucaaucacgugauugaaagaaauacuguggauuaacuuuugcuuucagccauuaauggagaaacauagaucagauuuauuuuccuauuucaaauaacuaaaaaagaaaaaaaaccucuuugaaacgaugguguuuagacaggcagugcagaagagugaucucugaagacagaaaugauuagcccaacuuacugccuggagaguuuccaggcuauagugcaaggagcaaguauccaaacaaccuggcagucuccccaacuugagaagacagaauuuggagagaucaagguggcuagaauucauggagcagauuauugaagaggagaguacugcagaaaggguacucuggagaugugcagaggauuccccucaaaucuucagcugaguuuugaucaguccaugugcaugaggaaauuaucccaggccaggaaaggaccaccagagagagucaggcugaauaauacccagggcucacacggagccaggaauaguuugguucccaccagccagaguagaaagaccucaaaacacacaggaugucaaguagaauccucaguaguagggccaaauuagcaguuguggacccaccuaacaaacugagaaguaggccuugaaauuuaaaaaaaaaaaauuguuuccaaguaacuuagcuguauuugagaacaaagccccaaaauacuuaaaggaaccaaauauccaaaauauacuguguauuuugaaaaacaaagacuauuauaaugagacaugacacuaucuacauaugguuugcuucugccuucugcuaaugauaaugaccaacauauuagauuuaccaguguucauacucuguuauaguuucaaugcuaaccuagcaaacuaucuaauuucucauacuuuuauuauuuauuuuauuuuuuauuuuugagauggagucucgcugucacccaggcuggagugcaguggcgcgaucuuggcugucugcaaucucugccuccuggguucacgcaacgcucccugccucagcuuccugaguagcuggguuuacaggcgucugccaccacgcccagcuagauaccuuuuaguacucuacaagcaacaugugacuauuagcauuugaaauaugguuaguguaacagaggaacugaauuuuaaauuguauuuaacuuuaauuuaaauguaauaacugauauucaauuugguuacuggaaaauuuaggaugucucaaacaauuugaguaaaugaaucuacuuuucgacugcacauuuaauuaaaucuagauacaaauugaguauuuccaaugaaauccaaauucagauauacuuuaaguagggugacaaaucugggacugaggggguuucugggaugagggacuucuggugcuaaaacaggaaagucccaggaaaaccaaaaugauuugaucacuccagcuguaagucuaacaugcccaaguuuugaagacuuuuaguaugaaauaaaaauguaaauuaucucagcaauugugguguauugauugcaugacauguuaaaacaauauuuggauauauuaaauuaaauuaaauauauuuuaaaauucaucccauuuguuucuuuucacauuuuuuaaugcgacuacuagagaauuuaaaauuacaaucucaucauauuuuucaacugaacaguguugcucuaagcauuucccucacuuucacauauguaucucuauuauaguacuuaucaccaaucugccuuauauguuuaucacccacagagacuauaaauuccugggagguaaggaacaugucuuauccauguuuguauuuucuaccuguagugauaaauuacuuaggaaauaauaaaugauaguuaaguaaaaugaauggcaauagcugcaaaaggucauagauucaaaaacuguuacuaauaaacauaauaagcaagggacuauauauguagcauugauuacauuuacacauuguauuuguagaauguacauaauaauuauaaaaaggaaaagcauauucucccagaauguaaauaacucuacagaccaaauuccauuauaagaaaugaaaaacaaaagacaaaaggcaaaaucaguaagaguuaagaaaaaagaaaaagccuacuagucagugaugaagagggagacggcaaaagcugcucugcagaagaggcuggcagagagcagagcuacugacugcagagaucagggauggccacaagggagagaugcaccaacuacaacaauggagaaggacaugaaacuuaaaugagugacagcucugacuguguuauacuauuugaucuucauuucagguuuauaggaagaaauuauaucugauuucagagaaaaggagauaaaggcucugauaaauaacuuuccgauggccacauaagcuaacaacugguagauaugugcuuuaaaaaacccaagaagaucuugauaacaaaauccugcucuccccacuauaucacagaggggcccuaaggcaaagcagauugugcugaauauaauguuaaguguaugugucuuauguccacucuacguuggugcauaugcaaucagcagaagaaucaauuuuaugaugaaguuuauaagguuucuaaaauucuuccaggguuuaaagaguaauuuaggaaagcuuaaauagaaaaugaagagauguacauaaaauuugcaaaagauaagcacggaaaauuuuaguggaucaguaaaauguuuuuuccaauauuauaaaacauaaauucaacugacauuuauuaagcaccuuuuauauucaaagcacucuacuaagugcucgaggguugacaaagauaauacaggacucaaagaagcuuacugauuacuacacagggcaaauucagguucaaacuaggagacaagcauaauaauauauuaugagauuucaagaaacaaacauuuaaagcuaagaaaacagcuuuaaauuccuuguggaaaugaaguuaaaagugggcaacuccauuguauuucugcauuaagagaaacuaaaccaacuaacaugacagaaauaucacucuauuucugaauacaucaauaaacaaaugaacugaaauagaaauuuggguuaauauuaauaaugacaaaguaaagaaaaaaacagguguuucaaauacugcuaaucauggaaauaauuauaauacagcugacuauuuuguagaaggcaaaguaccaauuaaaggaagaauccuuagauucaaauuauauugcacaaaguuacauuagucaagaaguuauauuccuugucacagaucuaagagaaagucccgaaccugaaaaaggagauagauguccagagcuuuaagagcucauucagguuucuauucuaaagaaaauuucaguuagcccaugaugccauaauauauacaccauucuauaccauuaauagagguuguuaugaugaauucuggcuuauaaaaaaugauaaaaaauauauuuaaugcaaaaauauucuguaaguuaucaacaugacuauucaauuuuauaauggugguacagaaugaaaaacaagaaauaguaacacagauggcaauacugaaggaaagacaacuuuuaaugagcugaaauucaggugaaaaagcacugaacugugugaagugucuuuaaaaaaggaaauacgcuggguacaauggcucaugccuguaaucccaacacuuugggaggcugaggcaggaggaucacuugaggccagaaguuugagaacagcugggcaacauggcaagaccccaucucugcaaaaaauuagccagaaguggugugcaaugccuguacucauagcuacucaugaguuuggggcaggaggaucauuugagcccaggaguucauggcugcagcaagcugugauggugccacugcacuccaaccuggcugacaagagugagacccugucucaacaacaacaacaacaacaacaaaaaaguacaucuauuaauuacuuuuuuuuuuuuuuuuuuugagagagagagucuugcucugucgccaaggcuagagugcaguggcucacucagcucacugcaagcuccgucucccagguuugcgccauucuccugccucagccucccgaguagcugggacuacaggugccugccaccacgccuggcuaauuuuuuuuuguauuuuuaguagagacaagguuucacgguguuagccaggauggucucgaacuccugaccucaugauccucccaccuuggccucccaaagugcugggauuacaggugugagccacugcacucugccuauuaauuacucuuaacauaauuaaauuaccuugaaaacuacuaggacuuaaagagcugaacuuuuuuuacacuuccacaaccuucaaaauccuuaauaucucauucucuaacccacucagguuacauguaagcuuaaaaagugggauagcacuucaagguauucaauaaaugagaauaaucaguaaaauaaauaaccuauuaaaagcaguucauaugaacaaguagaaugcauguauuuuaaagcagaaugcuuuaaugguagcauauuauauauguaucacuguuaacuaauuuuugcuggccucucuaauuucucauguuaaaucacugugauuaaacuguucuuuauauugcaaaaccaauaagaauagagaaaaauauucauauaauacuuauaccauuaaagguaaaauauaauuuuacauacuuaacaauuucagucuugauacgucacaagugaaauuugaugucuacccuucuuuaaaauaaugaauauauguuaauuauuaaaaagugaaagaaagcaaaauucuauaaagaucuauuuuuuuuuuuucaguuuugagauguacuagaauaagguacuccaaguucaagaaaagacuucagcggccucagaauaaaaacaacaagcaguuuaggaauauagggaggacaugugacaaaaaagaggcuggaacaaguuuuuauagcccaagaacaaaacaacugguucuuucucauugguaguggcuccuagaaucgaucauauuuuacacaauaaaauacaaaaaauauuuaauuaacuugugguauucaguucuaaccuucaagucagaauuauuguuccacauaaagccugugguuuuaaaaaaucucuacauaauuccucauuucuguauguacagaacccacaaauaaguuugguuauaccaaacuuaagcaaaauaaacucaacuuaaacucaagcaaaauaaacacaaaggucagagcaaugcuaucaaaagguguaauaaaaauagucccaaauaauuccuucaaacuauuauuuauugguuuccuaaaacagauuuugauagcagcaaaguaugugguauucaucuuaaaaguuuugaaaauaccuagacaaauuugauucaguaaaacuggagaguuggaaagucuguggcacacccuuggcaagugaguucuaguuguguagcagagaguugaagccccuuaugaagaaugcaaacucuucagcauuugucaaggaucagaaauaaaacauaugauuccugcuaauccuuguuaaaaauauuagcuccugucuaaaauguucaacuaaagcaguuaaaggucugaccauuuuccagaaucauuagcauuuuaaaaggaguuauacuuugaggcuuuaaaagauuaacauuuccuuuguucuuccuuauauuuugauguuaaguaugcaaagaugaaagacaaaugaucucuuaccaucuaggcaguggacacguuucugugaucccacuuaccaggcuaauacaacauaauucaaauucaagguuaacacacuuaaguuaaaaauaaaaaaacaauguaacauagugcagugguuaauaaaagaaaagagucuagagccagagugucugaguucaaaaguaggcuccaccacuaauuagcuguugggcaagguaguuaauaucuuuaugucuuauauuccucaaauggaaaauguaauaauaauaguaccuacuucaugggacuguuacaaagauuaaguuaaagaaguuaauaucugcaaggcauuaagccuguauguuaggguuuguuacauaaacagaugaaagaucuaaguauuaaagaauguuuaaucuuucagaauagcaaucuugguauuaauuucuucauuauauuauuugucacagcacaguauuaucacacauaaucaaaguacccacuauguaagagcccacaaaauuuuuauuuucuuaucaaaacaaaaacuuugagcuuuuguuugauugaguauaaaaggaucuucauuuuuaaucacuuaaauuaccugcuugauauaaaaacuaguuguuuuuuuuuuuuuugagacagaguuucacucugucgcccaggcuggagugcagugguaugaucuuggcucacuggccaacacucugccuucuggguucaagugcuucuccugccucagccucccaaauaggugggauuacaggugugugucaccaugcccggcuaauuuuuguauuuuuaguagagacaggguuucaucauguuggccaggcuggucucgaacuccuaaccucaggugauccauccaccucggccucccagagcgcuggcauuacaggcgugagccaccacaccuggucaaaacuaguaaauuuuaaaaacaaacaucaaaaauuaaaggagaaaaauggugaacaauuauuuuugaacaguauuuuuuuccaagguaggaacuuuuuaaucucuaacuaaacacauaugguaaaacuccacagagaguaguuuaacucaggucuggcuaacccaacaaaugacaaaucuugaugugagaucagauaaaaaaaguagauuuuuaaggagucauagucaaauuuuucuauaaaagcaugucuacuauguuuaaaauguaaguuuaaaaauaauuuuaauuaaaaaauuacauguaacuucucagaacuaaguuauaacauggugauaguuggugagugguacagcccagaaaaaucauuucaccaucacuacaguaauuucauauucaguaaaaucaaugacuggacaaacuuuucugugccuguuuaaaaacauuuuuauaaagaagucuuuuuacauuuuggugaaguacuuauuuuugcuaauggaucaauucuugggcccacaaaaaucagaaaacuaccucuugcuaaacauaauagucucagcugugugcgguggcacacgccuguaaucccagcacuuuggguggcuaaugcaggcagaucaccugaggucaacgaguuugaaaccagccuggccaacauggugaaaccccaucucuacuaaaaauacaaaaaaauuggccaggcgugauggugggcgccuguaaucccagcuacucaggaggcugaggcaggagaaucgcuugaaccugggaggcggaggcuacaguuagccaagauugccacugcacuccagccugggugacagagcgagacuccgucucaaaauaaaaaaaaaauaaaaagccucaaagcaaaaaagacuggggaaaaauaaugcaaauucaaugccaaguucaaaccaauucuacaaugcuaucaauauuaaauguaaacaacuauggcucaucaaaugaaugucucguguuuuuuuuuuuuuuuuuugagacagaguuucgcucuuguugcccaggcuggagugcaguggcaugaucucggcucacugcaaccuccaucucccggauuaaagugauucuccugccucagccucccgaguagcugggauuacaggcaugcgccacaaugcccagcuaauuuuuuuuguauuuuuaguagagaugggguuucaccauguuggccaggcuggucucaaacuccugaccucaggugauccgcccgccucagccucccaaagugcugggauuacaggcgugagccaccacgcccggccaucucguauuuuuuuuuaaaaggcuauguagaugguaguuaagagugucuuugggggaugguggcacaccuguaauuccagcuacucaggaggcugagacaggaguuugagaccagcuugggcagcauggcaagaacccauuacaaaagaaaaaaagaauggugucuuugaagucaugcugaaugauucccagcccugccgcuucuuagccuaaaugaagugacuaaacaaaaugcuuaaccucucucuuagcuacaaugucuucuucagggagauggauauuaagaguagcuacaucauguauguggucugaggauuagaugagacaauuccuuaaaauagucccuggcaauuuuaaguacucaacaacaacaaaagucaguacauaaaaaacaacagacauuuggccaacaaguaagagcagaaauaaaauuccuuuuucauaguguuacugaggaucauuuuaauaaaaaggaaacuuuauuuuuaauagguuaagaguacaugcccuuaaugguccauccaacacaaacacacauacacucacuccucucucuuucuccccacguuaccccugcuaaaauucaggcuuuauuauaaagaaauaaucauauauaaaauuaaaaguuuuauaauguacacaccccagguaccaucaaaauacaaaaacuaaguaaacugcaaacauuucuuaguccugauggccauguacucuugaccuuauucagcagucuucuaaacuagaccucuuaacuuuucuucaggauaaaacacgcacuauucucuccaaucucaccuugcccugagauuucauggucaacuacuuuuuaauaaaaaauuauacuuaauagcucucaaacuuucuaaagcuuaacuuaaacaguguccuccccccacuccauguuauuucuucaaaaagugccuggaaucccguacagcuaaauuuuacaaauacagacacagacucaccacauauuucaaucaguaagaugagaauuuucaaagaugauauaugauaucaaucauguguaugacauacaaaaauauaauuuuauguuagaaccuuuuuucuuuuacaugcaauccauuauauauuucaaaccauaucuucuauuaauuuauuauuagaagaaguuaugcacuaaucuuaaauaaauuauuuuucuuuuauauccucuugugaacuaaaguuaaaaaaaagguuaccugaugaccuuggaaaccagaccaucacauaauuaucacuaauaaucuauauuuagcauuuuauuuuuuaaaugugaacuuuaauuaauuuaaaacuggcucaagacuuugccuagagacaaagcagucuuucaugguuuaaaucucugaaaguuaauguuuuuaauuauggcauaauuccaaugaaaaaaccaucucucuuaaguuugggacuuaccugugcaucaauaucaauggcaggguagauaggaagcauggcugaaggagagaugauaggacuuggaguuggagucugagguugggaaauggaugcagcaauacuguggguaggaguguuugacauugcagaugcucuuccacugacugcuguugaacaaaauaacugcacuuaauaaggaugaaacauuguuaaguaauacuaagacauauucacucaaaaauauuuaaagacuucuuaaaacaauaugucuacaggaagacuacuauagcacuaauaacuaauuuuccugguuauuauucacugaugacaguguaaaauuguaauguauacugaguaacucauuuucuaaauaauaauccaacugaaaaacaaauuccccuguuauaagcagucguaaaaccuuaauucaaaauaacccugaaaacaaaaauguuuauguauuaaauauaaaugcaaauggaaacuuguccauuauauccuaauuagaaaggggaucaaagguaaaauagucaagaucagaagggggaauaugugguuuuuacuugccaauuucacaccuuauauucuagaacuaguaaaauuaauaucacugucggggagggagaaaucucacuaugcaaucauuuaaaacaccgccauacuguuuuacuaacugcagacugggauauaguaauauucugcauuguagcccucuggaaugacaggauauucaaauauaaaaauuuauccucacacagaaguguaguugcucaugugaagaauuauucugagggagcuaaaaugcucaccaaugaauccagcaaucacacugacuuaaggacaaaauuaaaagauuaggguagaaauaaauguaugcacacaaacauucuucaaauauggauuacuauuauucuaaguaugauguugcugugauauuauuuucaccaaaauaugcaacuuaagaaaaggcuauucugaucaguacuugaggugggaggacuccaaauaugcuggcauaggauauacuguagauucagcugaggguacuuuauucucucauugccuuauuucuggaguugauaggugaacaucaucucccccaaccccauuaaaaaugcuauaguauuaaaguaugggcauuuaucuuugacuggucaacaguacuguggauguguauuaccaaaguaguuaucaacuacaucagacagaaaacaaucaugauucacaacuggaucugaaaccaggcaaaagagauuaugauccugucaagaauaaaacugaaauugaucuuauuauaacaauuauaaacauaauuaugaauuaagaaaucuauuuuacaugaaauccuuaguucaggcacaaacauacacuauacauuauagcaacacacauucuauaauuauacauuuuuaaguccacuuaaaagccaaaggaaaaacgaaggagaaaacaaaacaaaacaaaacaaaacacuguuugaauccuuagggauccagaccaauagaaaagggcauauacuaauauauuaaauugauaaucuagcgaucuggauauuguuacuccauauugauaguuuuguauguuacgaaaagaucaagauaauuuaaauguacauauuguugauauacauuucaaaaucauauaaaaucuagagcucuuuaaauugauuccauaucuccuuugauuggauuuucacaauaaaacugcuaaauacaaaaaguagcuuaaacaggaugaacaccagucuguccgaaucacuaaauuuuauuucauaauacuaaacagguuaaaaaaaaucuaaguuuuauuguuaaaugacuaaauuauaauuuacauuucaacuggaauauuuucuuuuaaagaaccuaccaaaauuacagaguuuuuuuuuuuuuuuuuuuuaagucaaauugguuguucuuaucaccucaucuaaaaggagacaggaaaaaucaauuaucucaucauuuccuucgggguaccuauaaaauugguuuacuaaaauuaggugacugucaaucacacauccauucucuacaacuaaaagaaacaaauguaaaauauguagguaccugaaggaacucugguaaaaaucuuuacauguggggcuucauuuuaguguuagauuuagagagggagaaccacacaucagaaaaguuuuaaugucagcauagaaaaaagggaacuugaaaugauagcaaaggcaagguguugagacagguuaaacagggagcugauucugguuuggcaagugugaagaacaggaaagacagacgauuuuggucagcaaauuuuaugguagaagucuaauaaaugaagccuaagaaauaaagagcagggacugugcuagagggaggaaaagaagacgaugagacuaaugaggcuguaauauacuuuaaaccccuaagaaagaaguggaaaucaucauuaagcaacugaaaggauacauccuaccacagaaauuuaagauugaggcugcaaaagucagugcaugaguauaugugcaugugugugaaugugcacaugccuguugucagggaugaguugcagguaaguagccaaauguuuucaauccuacucuuccuccuucuggcuauguuucucuccccauagaaaugagcauaauaaaaaaguaaaauauuuuuguauuaugacaagcaucugucauauuuccuaaaaaguuauaugcacuuaaaauuuuuuuauacagaacacugagaauacacagaauuguuuuuguuucauguaugaaucaaaagaaaagauacuuuacaaacuucugauaauucugaucagcauacaaaacuguacaacuagcaaaucauuguugacaacuaugcaugcccaagcacaucagguaaacucugauauuauauaaaaaaaauuuuuuuaaacaaccauuacuguguaauaccuauucuucauuaaaguggauacguaauauuuaacucuauacauccuuuaguaguuucacaugauagagcacuauuaugaucugaauucauauggacauaguaucaaauuuaggguuaaugguuacugugcuccaacuuucacaggauauuuaauaauuuuaaaaguuuacucucaauuauuauaaucagcuagucaugauuaguagugacuuucaaaucuauagaaaaauuuugcacucaucaauaagagucguacaauucuuacuaguaauuauuacuagcauuuuuccaaugugguuauuuaacccuuaagacuagcagaaauuuucauuccacauguuauaacuacugaggugcuauuaaaggcggacuagcaaacuuuacagauauuuuuaaguauaaaaucuaucucagcuggauucuuagugucugaacguuaccuaaauaucuaaacacuauacaguuuaguuuccuauuauccauuuaaaagaugaaacuuaaaaaaaaauaagcucaucauauuuaaugcuacugaaacaguuuuuaaauuagaaaaagucaaucauccucuaaguacagaugaaugaauaaaaaaggggaagagaucagauggaagucaccaaaauuccacuguuuauuccuuucauuuuucuguuuuccuuccuuuucaaauuuucuuuuuuuaaugaagcaaauuauccuucucaguacagcauucuuaugguucacaacccuauaaaaccucaucccauuacuuuguuacaaaacacaaaaaauaaguaccaaaaacuagaagcauaaaaacagucuucuaaaguguaucuucuugucaaugaaacuaguuauaaucgaauaaaauuuaucuggcuacacaucuaaaaauauaucauuuaugauacuuucaggggggccacaccuucucaugauacaguuagaaagagacuacacauuaacauucacaggggacaaaaucacuuacauacaguauaauuaaacccuauuugguuuugaacuuuauuaauuuuguaaaaguguuuuuuuuuuuaaauauccaucagguuugaagucugauccauuaggauauaaaguauuucuguucauaaauaagcuuccugauguguccuacuaguuuugcacuucaacuucuaucaauuucccaguuuauuggugugaauacagaagcaaaaugccaaaauucaaucucaguauucugaacuuaaaggaaaaaaaugaaaacaaaaacaaaaaucaaacaucaaccccacuacugaaaaaccuagauucucaagcuaccaagcuaagccagaaagcuucagucauuuguacugaaugagcuaaucuuuaauuugaccuguauccaucugagaacuucugagauugaacuaauacuucuaaagcuagacaugagucaguccaaaaauaguucucaaguuggguaacggcaaaaaauuuggguacauucuuacucgccuuaagcaaaucauauuugauaccugcucauaacaauauaaacccaccugccaugaugucauccagcgugucauugagggucugagcagggcuggcuaccauuaacccuuguuguguuucugucagaauuccuugccccagcccugccaacugugcuuggcccaguacuggcuguccaacuaucacuccuugcaguucuguaagauuugcgauggacccuggaggcaagggaccugccgccagaggcaaagcuugaggcaucgccagaggcuggauuggcgcaaaacccaucugagcagcagucugcugggguucaucuuuaaguaaaacaggauccacuugcuguaaccgugcauagucucccucagaaagcugcucuccaacuccaacaggaguuaguaaucccagguguuggcaagacuguugcugcuguugcugaaguugaauucuuugagcuuuaaccucuagauacugcuuuuuuagcugcugcugaguuuucaguuguaacucucguucuacuuucuguaguuccuccaaaaucuuuuguuucuucugaauuuguuccucccuuguuuuguugagcuccucgaucuucuccuugguaaguuggucagcaugagccaguuccaaggacugcagcugugcauucuuuucuauggcuucuuuuauccucuguuccaguucuguuaacuuucccugagccucuucuacaaugcucucuggagacugauuggugauguaacccuguacauccuggcuguuugcuggcaaauggcugcuggacuuuuguuuagaagcagcugugugaaaaagaaacccccucagaagugcacaugaauggcauccucauuacagaguuacuguugggagguuuagugccaacaguuaugcacuaaguaaucauauccauaacaggugaaaaugcacuguuaaaaaauuaaaaacaaauccaccuucuuuuucacaaauauaaaauguauguauuuuaugugcaaaaucuuuguaaauuaauuucagaaucuuaaaaauagcacauggcuuaaauuagacaauagaggaaugcagguuugugauaucuaagugugcaauuaaaguaacaucuaaggcuauguguagauauuuuauauggucauaaagauguuaaaacucaucauaagaacagaacaauaaugcuaaauuauuagggugaagaggaaacagaccucuaagucagguuuuuucacauuucauagucugugccuuuuaaacacacacacauacacacaaaaaguacccaaaccacuaagaaguaacaagaaauuaaaaucugaguaaaauauaugucuuuguuggggccuaccaucuucaagacuaauagaggcaagauauaaauucacauauucacacagcuaucuggccaguagagaauugggauucaguuucccuggaagaaaagaugcuggacuaugccauccacuguaucuucugacagccaggugaacagacagaucuggcuauagguauagcaaucaauuguuugcuauaccaacugaaaaaggugccaaggcucuagguugauaguagugacugaaaagagcuggugaaaauacuuagcauucuuguucauaaaagaguauacguagccaaaaaccaaaaaauaaaaacugcacuguuucuucagguaaaacuuuuaaaaagaaaaacugauucaaaccgguagguauaaaauguuuggggacauuacuuaagaacacacaugguguaacauacacaagucaaauauggaccucagaauucuagagaaauaaacaagcauaucucaaguaacugaauuauugguugagaaaagguaucccagaucagauauaaaaucuauauuaagccagucauucuaaaauaaauuucuaauauuugauacaucuuguuaauuuaugccuuuauaacugcagagauuuagguaaguaauuuauaaaaauauugcucaacuauacccagcuuaacauuuuacaugaauaaaaauuacuauuaaaggaaaucauggauaaucagaacugcaucaaagaugagcaucugaauuucucaugcuaaaacuucuaauuguagcacaaauuagugcuauuaacuauuuuuuucucccaauaacaugcuuuuaucauggguuaaaaauuuaguaaugccaacuuaguaaacuucuuuguuuguagaaaugucuauuuuuugguaaucuuauuuuuaccuggacaccaaguaagaaacagucuuuagaaguauaacugaccuuuauuccugaugggaagagugguggcaacauuggcaggugguuugucaggcuccugagguggaacaaccaugggcagugcuugaacugguacacgaggagccuaagacaaaggacacuaagugacuauuaguguccuacacaauccauuaaguaauaugcucuaaauaaagaauaaauuagagauuuuuugacaauauuuuuaauaugucaucuuagacaaugacauauuuacuuaaaauauguuggcaccaaauuguuuaccacgacauuuuuuaguaggcuuugaauucaaguugugaccuuuaaaagcuaaagcauaaucauaucaucuaggaucugaauauuguaccagauguucauuaacuguaucaaguacauauuuacaaacagaacuacauauuagaacaaaaaaaaacccuaauuuaaacagaaacuguaagugaaagaauuaggauaaagaagacauaccauaaaaugcuuuaauuuuuaaaaucuuacccuauuuaaaucgugggaugggggaguuaacugagugacaucugguggaggggcugaaagcaaguuauuaggauaauccaagagauagcaaacaacacuuguauggccaccuuuugcugcuucuaucaacauaguugagccauccuaaaagagugaauauggaaggggaaaaaaagugaagaaaaauaaguuaguuuacagaaucacuuaggaagauaaagccaacaggucccagacgcauuaaaaucauagguuugguaaagaacgcuucaagugaaaaaggagaaaauuuacacuuagaaugccauuaugaauggaacuuguacaugauauguuguaacaaugaccaagagagaaauacuaauucacaauucugcacaaacauuugaguuacauacuuucaaacggugaguaggaucugccccaugagccaaaaguaguuccaccacugccagaugacccccugcacaagccagggacaguacaguauggucauuauuagcugugguucuauucacauucgcuccuaaaacagaaaaggcauggaaaaucauauuaguagaaugguuuuucuuaaaauuaugguaaauuuaaaaaucaugaagaguagagaaaauaguauuaugaggcuccacauacccauuaccgagcuuuaaugauuauaaacacaaggccaaucucauuucacaaauauccuacauuaauucuccucucccaucuuggauuauucuaaaguaaauaaaucccagacaaacacgauauaauuugaaaagguuugaguaugcaccaguaaaagauaccaaaguacccauuacuccuaauguaauaacuguauuaaaaguaaaauaugaaguuuuauuuguauuuuaaguucuucaguagaaaagaugacugaauaaaaauaaacuauacugcccucuaugggcuuuauguagagaauaaacacuaaauagaaagaauaguaccauuuuuuuucccauuaguaaauuccugacaaggaaaauagauaauucaccccuauucccaaauaggaauguaucccuaauuuauucguuuguuguuuucguagaaauggggucuugccaugcauguuaccuaggcuagucucaaacuccuaggcucaagugauccucccaccuuggccugccaaaaugcugaaauuacaggcaugagccauugcaccugaccucuaucccuaauuuggauuacugugcuagguaaugugagaaauggaaauaaaacagcagaaagaaacugaaaucaaacucauuaaaauuaaccaaugagaggggacagcgauuauguacauaaugcuauauauucauaacaguauucuaaagcauaucaccagugcaugggaaaauguugaaaguaauuucgccaguaaguuauuucaaauuuucuuuaccuauaaacaauuauaaacuugagauuucguuacuauuauuauaaugugaagaaaaugguauauuauugccuuuuaaaauuguauauggccuacaucuuuuuuuuguuuugagacagguucucacucugucacccuggcuggagugcaguggcacaaucauagcucacuauaaucuugaacuccugagcccaagugcuucuccuaccucagccucccaacuagcuggcacuacaggugcaagccaccaugcccagcuaauuuuuuaauuuuuuguagagacagaaucucacuguguuguccaggcuagucuugaacuacaagacugaaaggacccuccugacucgaggucccaaagagcugagauuacaagggugagccaccacaccuggcuuccucuuucuuuuaucaaugcagaaucaaaaauaaaaucuguaaucucuuauacuuaagaauaugaugaacucugaauugaaaacugucucaacuagaacuuuccuaguaagcacguuaagaaacaauuuaaagaaaguaauaauauacucccuuuuauuuuauuuggucauuaaggucuuugguauucaaacuaaaauuucugaucaugaaugaaaauccucaugcaauuugcuauauuugucacauuucuauugugaacauuuuuuguacuauauuuauaaccagcucccuguauuuuauaaaaaaggaaacauagaagcagggaaauaguagaaauguuacuugccacaaacuuuuuuaguggcagaaacaucauaaaauuccagguuucaagaaagugcuauaguacaugaacacagcagaguuuguuaccuaaauccucaguuuuuacacagagaaauuucccuuuccuuuauacguuucacaacaagugugcuacuugguaugacaauuauuucuaguuugaagcuggucugugcauggcaggauguuuaucaacuauccacucaaucauuaaaugucaguagcaucccuccucauaugauacccucuugccuucaaaagaccuuuacccuuaaaucucuaaaugaaggcagggguagauaccuuucaaaaaaagacaacuguuuuauacaaaccuaccuuuacuaauuaagaacugaacaguacaaacaugaccagcucuugcagcuuucauuaaaggaguucuuccaccuucagauucauguuccuguuuaaaaaaaaaaaaaaagacuugacauuuaauugccagugaacaaguauucuuuuucauggaaaucaaaaggaaaauaauuggacugauuucugaaucuaaauauuuaaauauaaugcuuugaagcaaauuaagaaauauacuuuuaaauuuaaaaaaaaucucaaaucauaaacauguucuauggaaauaauuuuaguauaugugcugccaaagugagcacuggaaauaauuuuaaauuugaaguuauagucacgugaucaugaugcccucaucuaaacgcaucugaguaauuuguccuucucucuacacaaugaauugcgguacuugaauaugcauguaugguacucuagcauggccuucuccgaacaaucaauauaaugagcauuauccucauccacuccaaguuauuuuccucuuaugaguguaucccaucucuaugaauuuuaguaaguacaucauuaccaucucuuuacagacuuccuauuaucucuaguuucccuuauacaaaaaugauaacaaacuuuucuaaaaccaucaacucuaagauguuacaagagcuuucugggucccaaaaggauggagacucuacugcauacuuaugauuacuaaguaaucaagaacacuacuggugaaauuuucaaucuuaaaaaaauaaagauuugagaaaaaguaucuuuuguauggcauuuuuuauuucuuuuuuuaaaaagccuucacaucugaugaacaauuucugauuuuucucuuaagccauauccuagguuuuucuaauugccaucaacuaaccaaguacuaaagauuucacugcuguauguuucagagccauuguggcaaacacuaggaauacaguucuuacacugaagaagcucuaagucuaacaagcucgaagcacuuauuauauacguucuauucuaguuaguugugugcuuaugucucccuuguuagacuuagugcuaacacuaaguggccccagcaauaaucuaauucaacauucucuucucauaaaugacaaaagaaagauuaaauuauaaauuauuaaguuuauaaaauuaauuacugaaggggggcuuguugcugccugcacaugaauuugucauaaacugugaaggaaagagcacaguugcuuauuaaucuuagaaucucggggccauaaauauaugggugcuuacauuuuaacuaaaaugggccuuuggaugucuuauuccuuuuaccccgcaggcuagacuggaagaccaccuauucuacccacacacaguugcuucaugcuuucuuaccccucaggcuucacucauaacauuuuuuccaauugaaauaucucuuuagccacaacacugccauaucuaucuuucuaaacuuuagccauccccaaaauaauacaucagaugacugcuuuaccuucugaucuucuuuacucugcauuuucacuacaacaucucuuauaauaaccucaguauuugucaccuauuauuuuuucugaaauuauaaaguacuugagggaaaaguuuauuauuuauguuuuaaacucuuuuauuauuuaauaauguucugaauauuguaggcauaauuuauuuccuaagcaauacugaaauuccucuaagccacauuugccuuuuuauaucaaaucagaaaagcuucuaaaaauaguuaauaucuaagggaaaaccagucugcauuaauaucuguaacacaaaaauuuccuuuuucuauggaaaaugagggauaaugcagugaauaacccuauuaaggauggacacuaaacaguguggaaaaaaaugugacuaagugagagaaagaauggcaaaaaaauaaaaauaaaaaaaacaauaaaacugaagguaaagaaauaccuuuugucuagacucuccauaauuuaaaauuaauuucuuauuguuaaauauuaagauuuaaaaaguaacauagcuuaccagaucugcgccugccugaaguaagacaucugcuacaucaguaugaccauuuucacaggcauauguuagugcuguauccccuguugcuguuguugcaugaacguuagcuccuguaguagucaacaaauaauacauagacuuaauaaaggagccauaagacauauaugacgaaaauaaaaacuucuucuagauaagucauaccuccucaaguuaaacaaauucaaacuucacucauuuccagaaacagagaauauuguaggcauuaaaaaaauuacaaacaaaacugguugaaauuaaagcugcagauacuucaaacagcaguaagguaaacuguucagaauacauacaaagguauaucacacguuuuuuuaaacucacacauucaguguaucauagcaucauaaaaauauuugcauuaugacauuuuuacuuaaacaaaucauguaaaaaacuucucccaaaugcaaaaaugccuaccugcagcuaauaaguauuuaacuaacuccaaaugacccucuugagcagcuuccauuaaagggguagaacacccuaguucuauaucggcuccugccuuaauuagaaagucugccacuuccagaaagccuccacagcaagccagagucaaggcaguuucuugaguuucuucugucugugcauugauauuugcuccuaaaauaaagauucuaauuauuuaaagaaagucauuaacuuauuccagagauaugaaaaacaugauuguuucuuaauaaacugaaucuuuaaaaugaacauuuauauuacuauaauaaauaagaaagugccucucuccuaacuccuaaggcaguuaaaacuaaaaauaaauaaaacuauuaaaaucacacccagauuugauguaccacagcuggaguaauauuuacucagccagaagguacaagucgggugauaaaagaacucaaaaaaauaagcuacauccucucauuauagugauucaaaaaugauaaagauacuggugauaaugaugaugaugaugauaauaaaaaucuuaacauucaauaagcucuauuucccaggcaauaucaaagcauuuuacaacuuauuuagguauuauuauuauuauuauuaguuccauuuuacagcuaaggaaacugagguuauuuaacuuauacaaggucacaacauuauugucaucaauacuaccaccaucacuauagcuagcacuuaacaggcacuacaugacaagcacuguucuauuagcuuuauacacacguauuaacuaucacaacaacccuacacgagaaaacugaggcacagaagguuagaaacuugccuaaaguuacaaaauuggcaagcaguggaguuaugauucaaccuaagaagucugcuccaaaaccuacgcuuuaaaaaucauagucaacauuacuucuaaauaaaaacaaaaguuuuuuuuaaaagugucauuccucuuaaauuuguccagacaaaaacuuuacuacugaaagaaaaauaaaaucacacuacaaauacagagaugggagauuacuucuaaacugaagauaucuuaacauauugaaguaauuguuucacuuuucccaaaaaagaaguuuauguacugagccccuuggcagcuucuaauaugugcgcauucuugcacucucagcaaguuagucuuuacugcgugguuucccauacuguuuuuuaaaacauuagaucuauuaaauacuuauuaguagguauuccgcccccaaaggaauacauucucuugaucuauuaccuuuagaaauguuggcucuuauauuccccuauuuaacucacaagccuugccaacaccaguucuguuuuucguucacauauagcacaugaugucucugaaagcucuauaugaaagaaguuucuuugauuuuguuuuaacacaguaugggagccauuuucacaguaaauacuuuaucacugguuuguguaauagcucauugcaacucuacuagaaaggugaaauacuaaaauccaauuuuauaaaauuauacucuuagguuuuacacauuuauacuuuagugucuugauagauacgguuaccuugaccaagaaguaaugccaccauuucuucauguccuucucgagcugcuuccaucaaugguguauaaccuucaucauugaccucuuccaggcuagcuccucuuucaauaaguaaagccgcaaguuccacaugcccaccacaugcagccaaaguuaauggugacucaaaugaaucagcaggcauguucacuugggcaccgcugucaagaaguaaccuagcuacuucaacauggccauccuaaugauaauacaauuuaaaaaauuaaaucagcaccauuaaaaaaaucuugaaaaauuugaagacuucucaauuacuauacaaugaaguuuaucuaucuccacucaaaaaggaauagagcuacauuuaacaguugaguaaaucaguauuuauuaugcacugccuauauucuguuaacauagaagagggaaauagagauugaaaauauaaaauaaguagaaacaugauaccuucaaucaagaagcuuauuaaccauuagaaaaaaaaacaguaaguaugugaaauaagagacuauagugagacaucaacacuauaugguacaaacuuaaauguuaaaaggauaaaguuuagagaggaaaagaagaauuuucauaagaaucuuuaaggauaagcaaacuuuugauuaguuagaaaaaaauggaacccuuuuuggagaagugggggaaggauacaugcuguguuaggggaacacaaaugcguacaugguacuuucuauauuguucaucguccaaguaccagugaaauuaagaaaagggccaggugugguggcucacgccuguaaucucaggacuuuggguggcugaggagagaggauugcuugagcccaggaguuugagccaggccugggcaaaauggugagaucccauuucuacaaaaaauacaaaaauuagccaggcgugguggugugcacuucgucccagcuacucaagaggcugaggagggaggaucauuugagcucaggaaguugaggcuauagugagcuaugaucaugcgacugcacuccagccugggaacagagugagacccugucucaaaaaugaauuaaaaaagaaaagaaaauucuauauucugucuucuggucacuuuuucccacugcuuuccuaauuacuggcaacuucaaggcccucuuuucccuucuuuuuguccuucaguaauuuuuuuccaucuauauguuaucucccagacauauucuuucaaacaugccaugccuauuuuugccucuaugcuugucacauuacacaauuuuaauggcuuacuacuuuuuuuucuauuucaauuuguagagaagacucuaaugucuuauuaguuugauuacuuugcuauuucuucagugcugaaucuucuuccucgauagcgaacucccacauuuccuuuaaauccuaguuuaaaaacucaguauuauagcaagucuuucaaaugucuggccccuacuaauaucuuucacuuauaauauuuacuuccagugcauguuggcuagaccuacagauuauuccauuuuaauuucuuaaucuacacacaggccauuuccucaguaggggguggcaagaauguuuaaauuuccuuaucauggggaacuuuuaaaacuguuacuguuaauacuauuaauguguuuuaugcccauuaucucauuuaauccucacaacuccagagaaagauauuuuccucauuuuacagaugaagaacucaaaagcuuagaaaaacuuuuauuuguuaaaaaaaaauaauuugcuaaagcaaacacuaagauggcaauaaggaaaacaacagauaacucaagucuuaaauggcuaccucauauuuuaaaaaauaguaaauaaaauuuaacauccuuucaauaauuacucucugaagggaagaugagacaagaaacuucagauucuuugggggcccuuucuaccgcuggccuguucuccucauaaauuuuucuaugauauuuuggcccauuucugugucauaaauaaacaaagauacaaagguuuaagaguacuguuaugagccauucccgaauacaaacucuaaaaugcagcucuucaaaagacaaucuagggcucagaaaagaccucgagagaggggaaauuauguaacauaaauuaggcccuacuuuuaaauuuuuguuuagucaauuuauugguuugagguauguuaugcuuauuaauaauguacauacucugaauuauauuuccuuuuuucuuuuuuuaacauuuuuuuaaauagagagggggucuugguauguuggccaggcuggucuugaacugcuggcauccauuuuaauuuguuaauccaauccucccaccuuggucucccaaaaugccgagauuacagucauaagccaccaugccuggccauauuuuccuauuucauauccucaaccaaucuuuacaagagugacuuugguauaguuauaugagacuaagaaaaugcagguagcauuguaaagcuucagaaaguaacuuuaauagaaguuaauguuguacaacugauucaauaagguucugacaaacagaaucauagcacccauuggaaaggcauucauuguauacuacucugucucucccugguuaauauauaaacauauuugacauauuucaccaaucuuaccaugcaagccuccaucagagcagugugcauuucaucuguuuuaugcucuugauccgcgccugcuuccaaaagaaaucgcaccaucucuaaguguccuaaaccaaaaguguacaagauuacuugaaaauauuuuauuauuccaaaauauuuuuuaaaauuauaauauuuugaaaaguuauauuuaacuuacagcauuaaauuuauaagcauaauaaagucaacuagaagccacccucaauuguagaacacaaauuauacaagugaucuugcuguucuaccccuuacccuacugcccuauaaacugcugcuucuagagucccugcuagaggugaacaaagaugccauuaaaauccaacacccaaaauguucccucuacaaccuuuuaagagcccaggcauguuauauaguuauguuauauaugcuacggaauaaaucaguuuucaugaacuaguagccugagauaaugaucagucaaguuauuucugugagaaaauguauuuaaaguuccaauaccuaacucagaaacacuuuaggaaaaaccugcuuauaaacugggaacuguauguauaaaaauauucuucaaaccacaccauuuaauuuauauuuauauauuuaauuauaauauaaacauguacacacauuaaugcaguuucaaauaaaccauaugcuucaguucauuuaaagauacaagugguuaaaaagcagacgacaaauuauaauuuaaaaaagacuucagauccuaugcaaaaaacaauagaaaaauuauuuaauuuuuuccagcuuuauuuggaaugagcuacaaucaauucuuauucaacugggaggcgggagaaggacagauaguggagucacagguaaacaauuaaacaaaauuuacuuccauaaguaaguguaguaucugccgcgucuuauauuugucaacuaccuaccaucccuuuuccucucugucauucuccccuccccaaaauccacauuagugcucagucucagccugacuugucucucuucccuaacuccuccuugucagucuauauccuacaaaaccucaccagaaggagaggaagggaaggggguccauggauaccuggaaguagcagagauguucuccaccagcucaguuugcuauccagcuucuaauuaaagccugcaagccccaaccucagaucccccuuuuggauagcaggguggggcuacaagcaaaggcgagagggcagaguaguuacaagcagccccaucucaaagcucucuagccagcagggacucaguagugaaaugcagccaguacuggguucaaaaguauuugugagaaggggagagagccacccaaucaacccacuccaaggcuuaccuccucuccucccagugaagaucagccucugccuaauuauaaacaggauuggggaagggaacuaagggaccucagcugugcucccuaucugaaaaucuauuaacaucagauaaucaaaagcacuuuauaaauaaaccauauuuuucaaauuuaaguuaaauuuuagucaauuaauccaaauauauaaggauuauuuucauguuuauaaaugaaauuauuccaaaaggcaucauacaaccuuggcuacucuuauauagaacaaaacaacaccagggccagaacuagggugaggaaaucaaagugcugggugcaaaauuuaaggagccacucacauguaagcuugugcaagugaaagguuagucacugagaaugagugccuccuuaaauuuuuuacuagguuuugcaaaagcuuuuucuugaugccuaggggucaagaauuuaugacguaaauaauaugggacaacuauauagacagaugacauaaaacacagaaaugaguggcuaaacacaaaauuguaugacuuuuuuuaauaaaaaacuuccuuaauaaaaaauuuucuuaauuuacuuucuuaaaaaguaaaacaccuuacuuuacagccauuuaucugucauacauguggagucuaaaaaauguucagcucuguggcuguguuuuaacaaucuagaauauagaacauuaauuaucuacagacaaaauaucuuucuaggcaauuguccggucugccaaaggagggcauuuucuguacuaucaauauuuucagguucauugacaucauuuaaaauaccauguaccccuucauaccaagcaaaaucuucccaacaugcaaagcuauuauacaguucauauuaaaagaacuguuucugauaaaacaauuagaucaauuaauacucauuuuucagugacaauauuuauaguuaaaucuauauuuuaaaaauuuaaauaguaaacaaacugcaacacugcaaacacuuauuuaaccuuuaauuacauacuauauacuaucauuguuuuauuuuuuaacuuagaaacaagauuacauaaaauaauuauaauuucacauauuuaaaaacuuuguuuuaagaaagguuuauacuguaccuuuguaacaagcuaagguaagggcacucucuuuaaauucauuagaaugcguauuaaugccagccccauuuucuagcagcaaucuggcuacuuccacauguccagcacuuccagcuuccauaagagggguaugaccauuuucauuaugguccucaauacuagcaccggauuccaagagcaccuuuacaacaucuacauagccuccagcacaagcauauguaagugcuguauugccuauuuuaauuaggaaaaauaaaaagacauuaacauaaaauaccaaaauaaauuaaagugcuaauuuacauuaagaaaauggaaacagaagacuacaaccauaauaaauauuaaauuacauauacauauauguaaauauauaucuauauauaaaauuccuuuccuacugcauuuuaucuuucugaaaucaacucccuauucuccuuuuccauuuaaaaccaaagucaaauacauguggaaaaucauauacacuuauccagacuggggaguuguaaaagaacugggcaacucugccccagagcuaaguuuuaccuuaagaugagaaaaaaguuguuuuaauguuuaucagagaaaugcuucacaagcuuuuuuuuaauuuuaauguuucuaaccuaaaauuacucaucauauacauacuuuauacuauaccuuuuaaucauauauguuuucauuacaacuucaaauaccaguuaacugaucaaauucaaauuucuaaauuugaauuugaauucaauaauuucuaaaacauucuuuucugcugauaaaaauuucccauguuacaagaaaaaucaaccuucuggguaaaauaagaauuucuaaaaaucccuucaaaucagaacaugaccuuaaaaaacauuuaauaacgggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcauaguggcaggcgccuguagucccagcuacuugggaggcugaggcaggagaauggcgugaacccgggaggcggagcuugcagugagccgagaucccgccacugcacuccagccugggugacagagcgagacuccgucucaaaaaaaaaaaaaaaaaauuuaauaaauuugaaaaaucugaaugaaggaaaugcacaaaauauuuccaugaaauuuuagaauuuuuacacaaaucuaucuaggcccaaauuugaaaaaaauauauauuuuagacuaaaguuaugcucuucuucaggacacaauguuuucacaauauuuuuuucugugggccacaauuuaguaacaguaggaaacaaugaacuauccuuuuguuccacaauuguuuggucucccuaucuucccauuccucuccuaaaaaacuggaaacauggauuugagcacuacggcccacaccucucaauuuccaagagagugguccaucuaacugggucaguguuuuacuuuuaucuuaaagaaucuuaaaaggccaauugcccucauaaacaaaacaggaagaauaucauuugaaauauauucuauauacuucaaaacucauacacagaugugugagaauauguagcacuucuaauaagagaacugaaaaauuagcacuaaacaucacuuucaugcaaaaucauuauuaccaaaugauguuacuauguaguaaaacugaaaaagaaauaggcaugaccuguugaagacugugcauuaacaucugcuuuaugagcuagcagcaacuucacaauuuugacauguccuccauuagcagcagccauuaaagguguaaugucaccuuugauuccccuaucuuccacauuugcaugcauugccaacaaaaccuuaugagagaaaaauaguuuaaaaagauauuaggaaauaaucgucaaaaaauuuugaacacguauuuauauaacgucuaccuagucauaguaaaagagcuauaagcacacaaaauuuaucuaacaaaacuauuuguugaaauaauccuaaugguuggaaggauuuauuuuauuauuuccuuaguaagcaagccaguuuuuaaaaaaacaacaaauaagcuuuauuuugauaauacgaaccugugcaagcucauaguauccagcagaacaagcuaaacaaaggaggcucuccccuuccucuguguguucauuuacacuucgcccuucaaugaguaacuuucgcacagcauuuacaucuccuucugaacaggcuucugccaaacugcggcuauuacggaaagaauaucacaauaccagaauauaagaauauuaaaaaauugcacagcauaaauauuguuuuugauuguuuuguuuuuuguuguuuagaaacggagucuugcucugucacccaggaggggguacagugaugcaaucagcucacugcagccuuaaacuccuggccucaagcaauccuccugcuucagacucucaaagcacuaggauuacagaugugaacaaccacacccagccagaguauuggauuuuuaugucaaaucuugacaguuaauaugguuuggcucuguguccccacccaaaucucauguuaaauuguaaucaccgguguuggggaagggaccuggugggagaugauuagaucauggggguggauuucucccuugcuguucucaugauaaugagugaguucucaugauaucuguuuguuuaaaaguguguagcacuacccacuuugcucucucucucucuccuacugcgccaugguaagacaugcuugcuuccccucucucucuccugcugugccaugguaagacaugcuugcuuccccuuugccuuccaccaugauuguaaguuuucugagaccuccucgcuaugcuuccuguacagccuguggaacugugagucaauuaaaccucuuuucuucauaaauuauccagucucagguaguucuuuauagcagagugagaacagacuaaugcuaacauuagugcucaacaaggaugauuauuucaauaugauucauaacaaaaaggcaaaaaugauugaauucauugaguuuuuuacaaucuacauauuaauggcacugaauuaaaauuaucaauauuccaaaauguuuucaguuaugcaacugaaggauaaagucuaauuuacugguaaguggagaaagaacauaaaauuuuaaaacauaaaaguuuauagaaaucacauacaaauaacaggucauaauuauacuucuuuuguucggucaguagaaaauuuuuuauaaaauuuaauuaaaaaguauaaaaugugcaaaacuuccacuaauuauaaagaucuaugugaguccuuccaucaaguaaagggaaaucagacggaaaagaugggagaauguaauauuaauaaaugaauaacugaugagccuuuuuugguuuugguuuugaaaguauuuacuuauacaaucaaauuuggggggaaguuucaaauccaggcaaagaaaaagcuaaacucaagcaaaaugagaguggaaaaaguggaguaacaaaaaauuaaacugagagaaaaguguaugccccauaaacuucccaaaacaauuccaauuguagacauuucuaaagauucucacuuucguauaaaauaauccuaaaacuaaauccagggcuauuaauauucuuuuuauuucaaauauaacucaauuauuuuauuauccucuuaaaauauggcccuuucauuucagauacuaaaggcaccuacagauaaucacuuuucuauagcccuguuauuaccaucagccagauuuaagaccaacaucuuugucucagauauggcaaagccuccuaaccagucuccuugccuucacacuacuugcucuccuucaggcucuuuucaacaaggcaaccagagagaucuuuuuaaaagaaaaguagaacacguccgccgggcacaguggcucacgccuguaaucccagcacuuugggaggccgaggcgggcggaucaugaggucaggagaucgagaccauccuggcuaacacggugaaacccugucucuacuaaaaauacaaaaaaaaauuagccgggcauggcagcguggccuauagucccagcuacuugggaggcugaggcaggagaaucacuugaacccaggagguggagguugcagugagccaggaucacaccacugcacuccagucugugugacagagugagacuccaucuugaaggaaagaaaggaaggaaagaaggagagaaagaaagaaggagaaagaaagaaaggaagaaaaagaaagaaagaaagaaagaaagaaagaaagaaagagagagaaagaaagaaagaaaaguagaacaugucauuccucuacucagaacccuccacuggccuauaaucucacucacaguaaaagcugaaauccuuacaagaucugccuaguggcaggauaccauauuccucuucccuuuuacuucucuggcuuuaucuccuacccucucacccuuauuccuuccacuuuggccacauuggucuucuugcuguucaucaaauaugcuaaauaagcuccaaccuccaaauauuugcauuugcuguuccugugccaagacagcuccucucucagacauggcucacucccuucccuauuucaggucuuuccuagaaagccaccauuuuaagugaggacuucucugaccacgcuauuaaaaaauguaauaugaccucugcuaugguuugcauauuuguccucuccaaaacucaugugaaauuuaaccccaaauguggcaauacugauagguaaggccuuuaagaggugacugagucaugggggcuuugucuucaugaaucgguuaauccauucaugaauuaauggauuaauggguaaaugaacuauuacuuaucauggagugagacuggguaggcuuuauaaaaggaagagaaaccugaacuagcacacuuagccuacuugccaugugauggccugugcugccucagggcucugcacagagucccugccagcaagaaggcucucaccagaugcagccccuugaccauggacuucucagccuccauaauuguaagaaauaaauuccuuuucuugcccaguuucaggaauccuguuacacgcaacagaaaaugaaccaagaugaccuccaacccaaacacugucuuagcacuucccuuucaauuuuucccauaguuauauuauuaugugcaauacuauauauuuuauuuacauguuaauuguauuguccccuuaccaaagugaaagucucgaccaguacuaaauaaauuugucuuuuaaacaucucuucugauuucccauuucacaggacacugacagucccuagacucaaugcuaucauuuuuaagcauguuuagaacaaauccuucccauaagacauuuccuguauaagagcauaccuuuucucucuuucaaaguagucucucucugucucuuucacuucuuuaugcauauacccuaauuuacauuaucauuugaauuuuucauucaauuuccauguguguauaccagcuugaaaacaaccuuacaggaucuacucuagcaacagcugaacuuaagaacuugugggcgaagggcauauuaagccuggcacauggcacuguccuuaacuaauauaaaaauguggcacauaguacucacugcacuuaaguccaccaucuuucucaaacuuuguugaauaaauauaauucucacaaauauguucuauuuuuuuugcuguuaaauuccaguauuuucaaugcaaaaucauuugugacuuuauuuuucuauucuauuuccugcuugaacugguuuuaguauacccuucaagguguuuuaauucuuucucuugccaaucuuaguaggcaccacauuaaaaaauauuuggagauuaccaaugauauuguaggcuaguaaaacugaacauuuacuauggaauagaaaccgagguuaacuaaagaagggagucagucaaccuaugagaagaaugguaaagcaaguuaauacaaacacaaaaaucuagaugaaugaacacuaauaaagagccaagagaaacagcaaauucaugaccuuguuaauacuaucuaaccucucuuuuaugcucuuaaaaauguuguaugaaaacaccauuagacaacaaagaauucuuaaaugcuauaauuuacucucuaaacccaaauagaauauucagauguucucaauuguuuuaaggcaauugcuaaaauaaauaaaauggcuucauuuuauuagaggaggcaaaaagaagccaccaacgguugaaaaugguaacauguauuaaugauucuuuucuaguugcuuccuugaaguaucuauccauuuuucuuaucacuuuuuuuuuuuuuuuuuuuuuuuuugagauggaguuucgcucuuguugcccaggcuaaagugcaauggcgcaaucucggcucacugcaaccucugccucccagguucaagcgauucucccgccucagccucccgaguagcggggauugcaggcgugcgccaccacacccggcuaauuuuuguguucuuaguagagacaggguuucuccauguugcucaggcuggucuugaacuccugaccucaggugauccgcccgccucggccuccaaagugcugagauuacaggcgugagcuaccaugccuggcuuccauuuuucaauauacauccauaauuguguuuauauaugagauggugugauuuuuauuggauaacaucaucagaacagcuuaaaaugccaugucacaaaacauuuacugaguccuuacuaacuguaaagugcuaucuauauacaaggaauuauaggauauaaaaaaauaaagucccuggacucacauucaaguuauaggaacuagaucuauaacuucuuuuaagacuucagaaagcaaauaaauaaauaaaaagccuuacucuuuaaaauggucagaacuacgcaaaugaacuguaaaauggccuaauuguaaaacauuuacuucuuugucaccaauacauuuuuaaaaaaaaucuaaauaagcaaaaagucuuuuauaacauauugacuaggccaucagccuugcagucggaaagacacuggugcucugccacuuauuaucuauuugaucuugauuaaguuacucaucucucuuuaacuuuucaucuguaaaaugggaguaaaaacaaaaucuauaccuuauaaaguuuuugugaaucuaaauaagacaucacauguuaagugguuagcacagugccagccaggcacaaaauaaaugcucaguaaauguuagcuauuuguuauuauuuuuaagaaaaugauuucauacugauggcagcaaaaauguacuuacuuguccgacugcccugcauuugcugugcuuucagcucucauacggguaagugcagcagcagcuucauccaacgcacaacuaacagacgaugucaaccuccgaaguacuucaggaucugcaaaggcuuuaccaucagccguggacaauuuuccuauuccuauuauauuauuuucacaccaauauggacacacccaaaaggagaaacaaagcaaaauucaaguuacuuaaagcuauacuguguauguuaacaaauaaccuccaaaugguagaguagacauauauauuggcugcccagcaucuuuugagaaaucacucuucuccaguuuucuaauaaucuuauucauuccaugugguucauagguacuugauccugugacccucuggugccagaaacgggucuuuggccuaugaugggacaauuagacucugucauaucucugaaagaacguauauucaaagguugcuaaauugguaagaugugagucauaagcuauuuagccacuuuugucaccacauacagaaaaagacugcccaaaauaaagucaacauagaggagaacagagacacagaaagagaaggggacagaguccugauaaaauuauuuuuaacucauugacgccaguagugccagaagcuagcaccaucucuaugauuugggaaaugucuacauuuuauuuuuuuuaauuuauauauauuucuuuucgagacagggucuuauucugucacccaagcuggaguacgguggcaugaucauagcucacugcagucaugaacucuugggcucaagugauccgcccaacucagccucccaguagcuggaauuauaggcucacaccaccacacuaggcugauuuuucucucucucuuuuuuuuuuuuuuuagacagggucuugcucuguuacccaggcugggugcaugccacgauuacaguuuacugcagccucagcguccuggguucaaaaucuuccugccucaggcucccaaguagcugggacuacaggugugcacuaccaugcuuggcuaauuauuuuacuuuuuggaggaaucagggucccacuacauugcccaggcuggucucgaacuccugggcauaaggaauccuccggccucagcaugccaaaguacugggauuauaggugugagccaccgcagcaggacacccagcuaauuuuuaaacuuucuuguagagguagagucucauuuauguuguguaggguaguuuagaucuccuagucucaagugauccucccacuucagccucccaaagugcucccaauuacagguguaaacuacuucaucgggccaaugucuauuuuugcuuaagaauguuuacugggcuaucaucugugaacaaaauauggccuaaaaaggcauucuagacuauauauaaaagauaagcuauaaaugaguuaugucuacaacuuaucacauauacuuaaaaucaucugaaaguacuaaucugaaaaccauucagaacugcaaaauuaaaaaaaaaauucaaaagcagagaugguuaguaaccaucuauaugaaaccuaacuguugcucuuucagauaucccuauaaagcaugcagcauucuuaccccuaaccuuuauuauuuuaauucaguggugcuuaauccaagcugcccaucagcaucacuuguggugcuuuuuuguuuuguuuuuguuuuuguuuuuguuuuaagauaggaucucaccugguugcccaagcugaaguacaguggcaugaucaugguucacugcagccucgaccucccgggcucaagugaucccccacuuuggccucuuaagcaccugcgaccacaggcgcaugucaccaugccuggcuaauugcuuuuuuuuuuuuuuuuguuagagacagggucucacuauguugcccaagcuggucuugaacuccuaguuuaagugauccacaugccuuggccucccaaagggcuagguuuacacgugugauccagcccccuguagugguuuucaaauauauagaugcugagguuuucuacaucuggggauccaauucaguaaguagaaagcagggccuggcaccuacauauuuuaaaggcucuaaggcaauucugauaaacagcuaggauuaaaaaccuuuaccucuaauguuaugauggauauuacagaacccugcuauccaacaugugguccacugaauagaagcacugcuaucgcuugggagcuugucagaaaugcagaaucucaggcccuacgauguacugauccaaaaccugcauuuuaaaaaagauccccauaugauuccaaugcacauuaaagaaaggcuauuauagguuuuacaacaaacuaguuaacuaagaaacaaaaaggaccacucacuugguaauaaauauaucugcacagauaaguauguaacagugaaagguguucaauaauaucacauaaguuucauguuuaaaguuuugaaaguguauacuuuuacagugcacuuuauaauaaaauaggcagccuagauuaagcaccgaguuagaauaaaaagguuagggguaagcaugcuuuauagcgauaucugcaaaagcaacaauuagguuucauacaggugguuauuaaccaucucugccuuuaaaauauuuuuuuucuguugccguccugaaugauuuuuagauuaguacuuuuagauauauuuuuaugcuuuucuuuaauaaaaaaacuaacauagcaaauguuauaucucacaaaaccaaaaauaaaucugccaagaagccuuuaugauuauagccauaaaaaaauguucagaguagucaaauuucauaucugcuacaguuaagauguauaaagaauaaaaacugucuuggucugauaagacugauaccuacuguauaauuuaugucacuaauauuaaaagucauacuauauucugaaucuacuacaauauuuaauagaucaucuuucgguuaaauauaugaaggcacuauugagaucaacaucacagaagaauuuccacaugaaaaaaauuagcuccaauuuuucagccaucugagaucacuauauaacaaauauuugucagugauagcaacagcaacuaggcaagaggacagaucuggcucaguaaaaacuaaccacuguuuuaaaaaaaucucacuuuaaaucuuuaugaacuucuuguaucuucauaaguaaagauaacuauuuuaauaaauguaacuaggaagaaaccaaagacauagaugguaaccuuucaaauuaauuagcaguaaucaaaaauuaauuuauucuagcuacccugaauuauggugauucuuuuuuuucuggucuuauccagcuauugaauauuaaagugaagaucgaaaaacagaaaagagcugggugugguggcuuacgccuguaauccuacuacuuggcggguggauuuccugagcucaggaguuggagaucagccugggcaacauggugaaaccccgucucuacuaaaaauacacaaaauuagcuggacaugguggcaugcgccuauagucccagcuacuugggaggcugaggcaggagaaucacuugaacccgggaggugaagguugcagugagccaagauugugccacugcacuccaggcugggcgacaaaaugagacucucuccaaaggaaaaaaaaaaaaagaacaaaaugaccagauuauuauuuccaaaugcucucauuuaaucaauugaacaacaaaaccauagaaauucagauagagggcacauuaaaauauuauuuauauuauuauuuuauaauaaaauuauuaauauuacuaacacuauuaaacuuauuaaauauuaucugauuuuaagauaauugaaugcguaauuauguuccucucagaacuuacucagagggcuaaaaugcaagagaaauuccaucuaugguaaaacuaggaaaaaucuguauauaagcugaauauauaagcuaaaauguauaaagacaaaguaaaccagagaacuaacuaacuuauagaacagaauaaacugaaacaccacuaucaaaagagaaacagaccauuagcccaacaggagucagguaugagauguaccagauacaggggugaggcuuugguuagaaaaaagggagaccagcugaacacuugugaggaguaaucagacacaaguuuucauugccaaacuaaacagccaggugauuauucucuaaagaaaccaaacuagaaaggcccuggacuaggagacaucagguauacaggaggaugacaugaaguacuacauaaaagcauuaagugaaaguuuacaugauaaguagugaaauccucagccccauucccacugucagcucccacugucagaauuaugguagcuggguuaauuauucagaagacaaacacuggcaggugugugucuaauaaaaugauccuaagguuacccgucccugauguacacauccuacaaccuugggacugugaauuugacagauuuuacucccaaaauuaaguuacguuauauagcauuguugaccuaaagacagcgagguuauccuggugggccugacccaaucaaaugagcuugugaaaggcagagauuucuuuggcugguuggagauaaggaagucagagauuaaaagcacaagaaggauucuacuugccacugcugacuuaaagauggagggugccacaugucaaagaaugugggcaaccuuauggagaugacagcccauaaaaaaaaucaggaucuugguucuacaauugcaaggaacuaaauucugcuaccaauaacaauaaauuuggaaguaaauguucacccacagccuacagauaaggaacauaggauagcugauaucagccuugagaccauaagcaagagaauccagccacacuguccccagaugucuggcucacagaaauuuaagagauaauaagugggcguuguuucacaccacuauauuuauaguaaauuguuaugcugcaauagaaaacuaauccaugcuguacagugaaaugaaccaacaaaacaugcauccagacuuuccaauuuagcuuuuuauggcauugcuauagacuaaaaacagaacccaaggaucaccagacaucugaagaaaaucuuaaauaugaaaagccaaccaaaguauugaaaaugagacugaaauuuuauaaugccaaaauuauaaagcuuuggggaaggagaauagggacaagugguacagagacaggguaagucauaaauaaguuuggcaacaccagaaguuuaguaacuuuaaaggucugagagugguuuuuuaaacuggaacucuauaccuagcuaaacuaucaaguaugaggauaguaagaaaggcauuuucagacagucuaaaaaauuuuaccucucaagcauccuuucucaagaaauauauuggauaccuaaaccuuguucaaucucaacaucacaaaaagagaagcaaccagacagugccuaugugauacauaaggaaacacacagcauuaugaaugacuauucuugucaaaaucagaauaaaucugaaucugaucaaguaucuggaucuaaaauaggaaauacaacacacagaagcacaacuggcaaaauccauaaagugagagaaaugacuauuucuucaacaaauaaauagaaaaaaaaaaaagaggaacuguuaugauuaaacuuaaaacaauuuuuuuuaauuuuuaauuucauggguacauaguauguguauauauuuaagaaaaauaauuaacauuaaaacuauguaaaccugguuuggauccugauuuaaaccaacuguaaaaagacagaaaauaauugaagaaaucucaacauugacaggauacuggcaauauuaaggaauuacuuuuuuuuccuuuaaaucugaaauaguauuauggcuauauuucuuuuuaaacacucuuaauuuacagauacauacuaaaauauuuauauauaugaaaugguauggugcuuagauuugcuuuaaauuaacauagguggcaaugucagcaaggugguaauaggcagauaugaaaaaagacugccuguacacugaaggcugcugaagcuggaugauggauaaacauacacagguuucauuacgcuauucucuuagauuuguaugugagaauuuccauuuaaaaagggaaggaaauaaaggagugagggagaggaaaagugaaagagagguggagaaagaaagaaagggaaguagggggaaggcuagcuuguuagcuaccauaaagaaaauauaaaaaauagaaauaauuacacaacuuagaaaaaugaagcaacuauuugcaucguaugaaaagguaucuuaucuccaaaaaucagcuuuuauguaaaaucuacuuccguguaacaucuuugaaucuucuugugccucuuggggccacagaaaacaaaucuauaugacagucucuuaagcauuugaagaacacuuuauucaaccugagucuucuugucuucaggagaaacauucccugcuccucugagguauauuuuuaaauaauuucauaaucugcauuucucucucauaaacuucuagagcaaugucaaauugccggaaaaugcuaaauuaggucucuacucuucuguacaaauaguuuucuuuacuccaagacaggaccgugcacaugcccugauuauguuuccaagucuauuugguuaagauccuuuuaauaauccauucuagaauuuuaccuuggauggaaaucaaguuuaaccaugaauccuucaaauauuuaaauaccgguugggcacaguggcucaagucuguaaucccagcacuuugggaggcugagguggguggaucacgaggucaggagaucgacaccauccuggcuaacgcagcgaaaccccgucuguacuaaaaauacaaaaaauuagccaggcaugguggcagacgccuguagucccagcuacagcaggaggcugaagcaggagaaugccaugaacccgggaggcggagcuugcagugagccaagaucccaccacuguacuccagccugggggagagugagacuccgucucaaaaaaaaauuaaaaaaaaaaaauuuacuguauuacaagauguuuacugaaagcauuauugaacaguauuaggucaguuuuaugcuauaauaaaguagcaguuuacaugcauugcauguauaauagguagugcacugggguucuuaaaccaugaacaauuaguguucauaguguauuuaugucuacuuuacaaaaccuaagaaaacaucaugucuuuaaaaugauuauagagauuucauuaucacugccuuauauuuaagauaugauauauagugcuaaauauuugauuguguguguguauauauauauacacuccucaauuaaaacauuguuccuauggggauaauauaaugauccacuucacaaaaauaccacgaugauucacaugagguuucagccuacagucucuaacaaacaaguggggaaaauuauauauugucaauucucauuauucaguuauucacaguaguuauguuaagucgcuagaaacacggaauuagcaaauacuacacucaaccacugcuccugggagaaauauagcguuagccagccccuggccacagcauugucauuaaugcacauaacccuguuuuacguguguuucuguuuaaauguacguuuuuuguguguguccuuccaacuuuuauuuuagguacagcggguauacaugcaaguugguuauguggguaaacugcauguuguggggguucaggguacagauuauuucaucaccgagguaaugagcauaguaucugauaaguaacuuuucaauccucaccuuccucccauucucaaguaggcccuggugccuauuguucccuucuuaguguccauguguacucaauguucagcucccacuuauaaguaauaacguggcauuuguuuuuuuguuccugcguuaauucacuuaggauaaugggcuccagcugcauccauguugcugcaaaggacaugauuuuauucuuuuuuauggcugcaugguauuccaugauguaaaauauaacuuauuuaauauauguuguugauucauuaacauugaacucacagccaacagcaguaaaacucaugccugaaccuaaaacauguuuuucccaaaaggcacaucacagcauucucacacuuaggaacacuagacagcacuaugcuugggcgccauuuuaaacagugagugggagggacuguacaucaugguuugagugccagcuaagacacaguacaauagaauaucagacagauuucuaagguuuuugaccucagucccuggcucccagauggcaucucuagaccaacucagggccuaggggaacuagccacccugaagggaaaaaaaaaagucuggcuggcuucaccacugagauagauggaguaagauggcugaaaagggggcucuagugaucuccccaccccuccccaaguuuggcaacuaucuacacaaagugagcaucuucauaagaacccaaaaucaggugagcacacacagugccugguuuugacuucgcauugcugaaauaggcauuaaagaggguagaaaagacaguuuugaauugccaaugacaccccucccuaauccccuagcagcuccccacauggugcaaagaacugugcaacuguaagacggagagcauagcaacugugagccuuugcauugaacucagugcugcccggucacagcggagagcagaaacaggcugaacucagcugaugccugcucguggagggagcuuuuggaccaggcauagccgcaaggaaauuguccaucccagcaguccaaauuugacuuccagcaagcccugucaacacgggcugcaguguucuggggcccuaagugaagcugaggggcagucuaagucacaggacugcaauuccuaggcaaguccuagugccaagauggacuuggagucacuggacuggggauggggagcaggcaacuuccugagccaccacuuggguggcuaagggagugcuugagucaccccucucccaacuucaggcagcacagcuuaaggcuccaaaagagaccccuuccuucugcuugagagaaaagagcagagacaacuuggucuugcaucuuggauacaagcuuagccacaguaggauagggcaccagucagauucgugaggccccccauuccagacccuagcuccuggacaaucuuucuacacacacccugugccagaagggaaccugcucccuugaagaaaagaacccaccccuggaaggauccaucaccuacugacuaaagagcccuugggcccugaagaaccagcagcgacacccaaguaguaugccaccugccuugguugagauucugagaugugcuggcuucaugugagaaccagcacauucccagcuaugguggcaacagugacagcacaguuggggucggggggcggggggcuguuaaguagaaaguggacucucggggucuccuauuccaaggcuuggcacuuagaugacauuucuggagcuguccugggagagagggggcccacuguucugaagggugagucucaggccuggcagcuuucaucacaagcugacugaagagcccuugggcuuuaacugcacauuggcgguagccuggcaguacucccugugggccucugguggugacggccaugggcugagacuccuuaccuguggaaagaggaagagugggaaggacuguauaucgugguuugagugccagcaaagauacaguacaauagacccucauuagauagauuucuaagguuuuugaccucaguuccuggcucccagauggcaucuaugaaucagcucagggccuaggggaaccugccauccugaaggggaaaaaaacaagucuggcuggcuuugccaccugcugacuauagagcccuagggccuucagcaaacauaggugguagccagguagcagucacaacgggcauugagugagacccagugcucugcuggcuucaagucucaccuaguacagucccagugguggugaccacagggguacuugugucaccccaaccccagcuccacauggcucagaggggggagagagagagagagagagagagagagagagagagagagagagacugagacuccauuuguuugggagaaagaaaagagaagaagagucucuacuugguaauccagauaauucuucuagaucuuaaauaaaaccaccaaggugguaccucuaugaauccauaaaaaaucauagcgauacugggauuggggugcaccccaaugcagacauggcuuagaucacaauacccaagucccuucgacuacuuagaaagccuuccaaagaaggacagguacaaacaagugcagacugugaagacuauaauaaauaccuaauucuucaaugcccagacaccaacaaacaucugcaaggaucacgaccaucagaaaacaugaccucaccaaaugaacuauauaaggcaccagggaccaauucuggagaaacacagauaugugaccuuucagaaagaaaaaucaaaacaguauugaggacacucaaagaaauuaaagauaacacagagaaggaauucagaauucuaucagauaaauuuaacgaagagacugaaauaacugaaaagaaucaagcagcaauauuggagcugaaaaaugcaacagacacagugaagaaugcaucagagucucuuaauagcagaauugaucaagcggaagaaagaauuagugagcuugcagacaggcuauuugaaaauacacaguugaaggagacaaagaaaagaauaaaaaagaaugaagcaugccuacaagauccagaaaacagccucaaaauggcaaaucuaaaaguuauuggccuuaaagaggagguaaagaaagugauagggguagaaaguuuauaagguaaagguauaguaacagagaacuucccaaaccuagagaaagauaccaauauuuaaguacaagaagguuacagaacaccaagcagauuuaacccaaagaagacuaccccaaggcacuuaauaaucaaacuuccaaaggucaaggagguaaggauccuaaaagcagcaagacaaaaagacacaaauaaaauacaauggggcuccaauacaucuagcagcagacuuuucaguggaaaccuuacagcccaggagagaguggcaugacauaaaguacugaaggcaaaaaaauuuuauccuauaauaguacaucuggcaaauauaucccuuaaacaugaaggagaaagagggacuuucccagacaaaagcugagagauuucaucaucgccacuucuguccuacaagaaacacuaaagagauuucuuuaaucagaaagaaaagaauguuaaugagcaaaaagaaaucaucugaagguaccaaacugacugauaauauuaacuacagagaauauuauaacacuguaccugugguguguuaacgcuuaccuuaaguagaagcacugaaagauuaacaaaucaaaaauaauaacuacaacaacuuuucaagacauaugcagcacaguaagauauaaacagaaaugacaaaaaguuaaaaaguagcagacaaacuuaaggugucgagucauugguuuucuuuuaccuuguuaaauuuguuuauggaagugguguuaagcuguuaucagcuuaaaauaauggguuauaagauaguauuugcaagccucaugguaaccucaaaucaaaaaacauacaauagauacaaaaaauaaaaagcaagaaauuaaaacauaucaccagagaaaaucacuuucacugaaaggcaggaaggaaagaaggaaguuaacaauacaaaacaacuugaaaacaaauaaccaaaugacaggaguaagucuucacuuaucaguaacaacacugaauguaaauggacuuaaaggacuacaaccaaaacacaugcagaggcugaauggauaaaaaacaagacccaaugaccugcugccuacaagaaacacacuuuaccuauaaagaugcacacagagugaaaauaaagggauugaaaaagauauuccaggccacuggaaaccaaaaaagcgcaagaguagcuauacuuacauugcacaaaauagauuucaacacaaaaauaugagacaagaucauuauauaauuauaaaggggucaauuaagcaacaggauauaacaauuuuaaauacauaugcaccuaacacuggagcacaaagcuauauaaauacuagagcuaaagguaaagauagaaccccaauauaaaaauagcuguagacuuuaacauuccacuuucagcauuggacagaucuuccacagagaaaaucaacaaagaaacauuggacuuagaaagaaagauggcagagaggagaggagacagggcuaaugugcagcucccacuuggaugggcagaauagcauguggagacucacaccacaaacuccggcucuaagaaccacugcaggaacauuaccaggaaaaccaaaauaauucacagauucucugaaagaagugacacaucgcugcaaauucugcaagacagucaaauaacugugaguucccaaaguacaagagcaggaaaaccugucuccaaacacacauguccacuggggaaucugaaaauccagaucacaggagaaggauuuaaccucaccuauaacaaaaaugaauacagggagccacaugaaauauaaagguagaagcagcagugggaagagccuuguaagcacacccagucuccagcucgagcccagggaagccaucccugacugcaucugauagggcccucagggaaggcagcuagcagaauuagggaggggucacagggugaaaaaagcuuccaacugaauuucauaauaauuucaacugggcauaaacuuucuucagcagaacccacaggguaaaugggaauccucccuaaaucauucuaugaagccaguaucacccuaauaccaaaaccaagaaaggagaggaggggaggggaggggaagggagaaggaaggcgagggaagggaggggagaaggaaggaaggaaggaaggaaggaaggaaggaaggaaggaaggaagaaaacuacagaucccugaugaacauagaugcaaaaauccucaacaaaauacuagcuaacagaauccaacagcauagcaaaaagauaauauaccuugaucaaauggguuucacaccaggaaugcagagaugguuuaacacaugcaagucaauaaaugugauacaucacauaaaaggaauuaaaaacaaaaauugcaugaucaucucaaugaugcagaaaaaacauuugaugaaauccagccaucccuuuaucauuaaaaccuuuagcaaaacuggcagagaagggacauaucucaagguaauaaaagccaucuaugacaaaccaacagccaacauuacacuaaaugggaaaauguugaaagcauccccccaagaacuggaacaagaucuggaugcccacuuucacuauuucuauucaacacaguacugcaaguccuagccagagcaaucagacaagagaaacagacaaccaaacugauaaggaagaagucaaauuauccuugcuugcagauaauauaaucuuauauuuggaaaaaccuaaagacuucagcaaaaaaacuauuaaaacugauaaauucagcaaaguugcaggaaacaaaucaacauacaaaacucaguaccaugucuauaugccaagaacuaacaaucugaaaaacaaaucaagaaacuaaugccauuuacaauagcuacaaauaaaauaaaauaccuaggaaggaacuuaaucaaagaagugaaagaucucuacaagggaaacuauaaaacacuguugcaaaaaauugaagacgacacaagaaaaaugggaaaauauuccauguucauggguuggaagaaucaauacuguuaaaauguacauacuaccccaagcaacuuacagagucaaugcaauuccuaucaaaauacuaaugacauuauuuacagaaguagaaaaagcaaucuauauuggucuguuuucacauugcuauaaauaaccgagacaggguaauuuaucaagaaaagagguuuaauugaccuacaguuccacauggcugcgaggccuaaggaaacuuacaaucauggcagaaggugaagaggaaucaaggaccuucuucacauggcagcaggagagagaagugugaggagcggaaggggaagagccccuuauaaaaccaucagaucuugugagaacccauucacuauuacaagaacagcaugggggaaacuguccccaugauccaaucaccucccacugggcuccucccuugacacauggggauaauggggauuacaauucaagguaagauuuugguggggacacagagccaaaccauaucacaauccuaaaauuuacaaggaaccucaaaagauccagaauagccaaagauauccugagcaaaaagaacaagacuagaaagaaucacauuaccugauuucaaauuauacuacagaguuauaguaaccaaaauggcaugauugucacauaaaaguacacauauagaccacuagaauacaauagaaaacccaggaauaaauccauacaucuacagccaacucauuuuugacaaaguugccaagaacauccaguggggaaagaacagucucuucaauaaauggugcugggaaagcuggauauccauaugcagaagaaugaaacuagaccccgaucucucaccauauacaaaaauagaaucaaaauggauucaagacuuaaacauaagaccucuacuaugaaacuacuaaaaggaaacauuggggaaacucuccaggacauuagaaugggcaaagauuucuugaguaauaccauaaaagcaugggcuccuaaagcaaauaaggacaaaugggaucacaucaaguuaaaaagcuucugcacaggaaaaaaaaaaaaaucaacaaacugaagugacaaccacagaaugggagaaaauauuugcaaacuacccagcugacaaugaauugauaaccagaauauauaaggagcucaaacaauaggaaaaaaaaucuaauaaucugauccaaaaaugggucaaagauuugaacagcauuucucaaaagaagacauauaaauggcaaauacacauaugaaaagguaucaacaucacugaucaucagaaaaacgcaaaucaaaacuauaaugagacaucauuucacaccaguuaaaaugacuuauccaaaagacaggcaaugacaaaugcuggagaggauguggagauaagggaauccucauauacuauuggugagaauguaaauuaauacaaccauauggagaacaguuuggaagucccucccaaaaguaaaaauagagcuaccacaugacccagcaaucccacuccuagguguacacccaaaagaaaggaaaucaguauauugaagagguaucugcauucccauguuaauuagagcacuauucacaauagccaagauagaguagaaggaugaauaccagaggcuggggaggguaguuggggcaguggggaugguuaaugaguaucaaaaaaaaaaaguuagaaaaaaugaauaagaccuaguaugugcuagcacaacagaguggcuauggucaaaaauaauuuaauuguacacuuaaaaauaacuaaaaaaguauaacuggguuguuuguaacacaagggauaaaugcuuuaggugauggauagcccauuuacccugaugugauuauuaugcauugcaugccuguaucaaaauaucucauguaucccauaaauacuuacaccuacuauguacccacaaaaauuaaaaauuaaaaaauuaacaccaacaaaaaucacaaaaauguguaaaaccuggcauuaaauaggccacaaaaggacacuuauuuauagcaggagagcugaaacaagaauguagagcaucacuuuguucgacuucuacugggagcaugcauguagggugauucaaauguuccaccacuuuauacaugccuaugaaagaccgcuaguacugauuuugaaguuaaaaugcauuuuugcagguaggcaaauucacaaauacauaauucacgaauaaucaaacucaacugaaaaaucucucuuuguaaggucaacuguagcacauggacuuuacucugguaaugaaaauuacaauaugcuuuaguaaaacgcuccauguaauucagcagaaaguaaucaauuaaccuuuauuaauaguaucauucuaaauacccaauaucauucauuuuuaacaagagcuuuuauuagauugaugugcaacuuuacauaacaagguagacuuauuacuauguagaguacauaccugcagcuucuaguaaagcuuccagucuagccuguguuucuggaucuacuguccugaggucugcaccaucagcaguaccugauaagagcaacuuggaagcuguuuccagcauuggauuuuccaaaucauccugauccaaaaugaaagacuccaccuauaaaacaaaugcaaaaagagggaggaagggagaaaugaacagcgaaaggaaaagaggggagagaaauaaaaagaaagcaggggagggaaaaaauauguuaacauaauuaacaaugguaaacacagugcaacccuaaaaaguucaacaugacaucuaagccuguugauuaacaaaagaagaaauuuuuuuguggaagaauucaaaacuuuauuucucauaugcagccuaauuuucuuuacuaauauucuuuucuacuuuaauuugguuauuagguauauguaggguugagugugaugcuuagguugugaaaacuuuaacugugaauagaagaccuaacuaaaucagcaguuuuuaaauguuuugcuuucaggacucaaugaaguacugaacucccaaggacuuuauauaaacccuguauuucuugauauuuaccauacuggaaauuaaguaacaaauaucacuaucaaaaaaucacauucauuaauaucaccacugauuucauccaaaaagucuuuaaguacuggaaagcugucaagccuaggcaaacaaguuccaaaauucuaauuuuugcuucaaagcuuaacuuuaucauuggcaacaaguauuguuguuuuccuuaaagugacagacucacuucaaacauuuuuagaggagcauuugccaaauauccaaguuugauaacuauaguuuuucguuuguacuuuaccauaaaaaugacauuucaugggggaaaaaaggcuaauucaccucacaucuaaaaaaauugcaguuauuuuuccuccagacaaacacuauacuuuuuauaugcagcaaaagugcuuuauguguacuucccauuuuguuacacacacuaauauugaaagaacaugcauucaaaaggggaguuuucauaaaaugaauaauuuuaucgcuucaucaagaauauucuuaaacuagcauuuaauuuuuuuuuuuuaacuucaagcacgugguagugaagaauacaaucauaucaguacaguuuguuuccauggccuucggguccauaaguuuuacccaccacuguuuuugcaccaucaucguaaaugucaacauaguaaaaaagucaaguaacaucucaauauuaugauaaaaauaguuuugaccucauggacaccuugaaauggucucugggcccugaggggucuauuuacuguguuaagaaacacugauauaagucuagccgauucaaguaaauuuaaagaauuagaaaauaacaaacuccuaagacagggguaaaguuuuguuuugauauucccuaucacagugcuacuuacaaauagguacuaaaacauauucuuuucugcuuagugauaaaaauugguaauuauuauauaaaauaucacuaaaaugaucaguuuauuucacaaaucuaagguacuacuaacacugcaauaaccaaaauagauguaaaaauaacuaauaagcuagaauacaaucacgcucaugccuaguauccagaaggucaacaauaaaaaagacaacuuaaggaauaaauccuuaaccaucauaaccucagaaacgauacuguuccaucuugaaaagucaacuaucaaguaaccaggaauacugcuauaauuaaucaaaacauuuaauacuaaauuuuaaaucugggaagaaauaauauguuucucuacaaaguuccauuaaacuaaagcaguuuaacguggaauaacauuugagauuucaaauauuuuauacacaaacacaacauucuaaaaauauucuguaaauauuuuuuaaauuucauaaaauuuuguucuacauuaacuuuaauuaaucuauaacuccuuauggcaaggagauaaaaaauacaaaaacaauuuuuuaaaauuauauauauuuuaaauuauauauauaugugugugcauauauguguguguguauauauaucuguguauauauguauauauguguguguguguguguguguguauauauauauauauauauauauauauauauuuuuuuuuuuuuuuuuaaagagacauggauagucucacuguguugcccaagcuggccucaaacuccugggaucaaguaauccuccugccuuggccucccaaguagcugggauuacaggcacacaccacgccuggcugauuuuuuauuuuuguagcaacaggauguggaauuccugggcucaagugauccucccacuuuggccucccaaaggacgggauuauaggcaugcacuaccaggccuggcuaauuuuaaguuaucuuuaaagguaguaguaaaaguaugagaaaggaagaauuuuaaaggcugacuaaaguauuauacuuuaggaagcaaauuuuugggcacagcaaagagugauucaaaauuauagcaguaaaaaaauuuguuuuauugucaaagguccagaagaugagucuuucuaaagaaaaagcuguuuccuaaugaaauuuucuaauaucugaaauuuauuaaaauauuuacaauuauuucaauuuaauaagaaaagauaaaagcaaauaaacaaauguaugaaauugaacagguaaaaugaauagaugaaauaccauaauacaauauuuuaaaugaacauuuuagaaaguagaagacaucaaaaagcaguauauaguuaacugauuaaucaaagguagagaucagaggugcuaaagauguucaaaggagacacugcaugcauaaagaauaauauaaaaggauuuugaccaaaaaaauuaauuuguauaaaagaagagaaagaaggaacauggacuggcaaguaaaaaauuucuaugugauagaacacaggguuuuacacaggguuuuacuguagguuugaaaagauagguuagaaguuagaucacagaagauaucaaauuucaaucagaagcgacugucuuacacaaaguccccuaugccacagauauccuaacuagccuggugaaaacuuacuaggaaaauugcauuuccaucucuugaugagauauaauaaacacagaaacauuuacuuucuacugacuuuaagcuucuccacaaaaguucuuauguuauucuuaggcccacuauucucacuauaugcaaaacuugguaacuuaaaaaacuguaaauucaaaugacuaugaaauucuuauagacagcuuuagaaaagagaggggcuaucaaaaugacagaaaagaacaggaaugaauauuuauuauuuccucccuaucccucauuuaugauuaaugaaggagcuacuuucaaggacacugcuaaaauaugaaggccuaaguaccagaauugcuuuagcuguuaccuaugugaccuaaccaagucucucucucagccaucuauaacuuuagacccccaauucugcuuaauuuuuucauagauuuaucacacaugaauauuauacauacagucuuucuaagcucuguaaaaacaaacacuuuuuuugguuuagucauguacacccagcaauuagaaaugugucuaacucacugucaggauucaagcaacuauugaauaagucagaaucuguaaagaaggugaaauuuaccagaugauuuugguauucuucccuuucagauucuaaaaggcucuaguguauuuggagaacaaagggguaaucacaauaaauacaucuaaagguauauuuuauagaucuuagaggagauacagaaucuuacauuagguaguagguggugcaaaaugcuaucuucauugauuuauuacacacacauuuauugcaaacauucuauguguaaaaaauacuguuuaauacuaugggagauaaagaaaugcaugauaccagccuugcuauguaggacccuacuucuuuaaugaguguguguaaaaaugaaccauaauacaggauagaaagugcauaagguaaugagaaagaaaaagagguauaaaaguucagcgaggaaaaagagaacuuccuccuuuaauuccaguuccucuuuuuccaacuagaaagagcucgcguuacauuacaaaacaagugaagagagacuggcauaaagagaugcaaucuuauaaacauacaaaaauaaguauuccuuuauuaaauuaugggcauacaccucucugccauaccacauccccagcugagacaguucagauuaaaaacuaaaaugaauuuucccucugaaaccuaucgcauuuuuauuauauuauucuacagaaaaaaaaucauuuugaaucacaaccaacuucuggaacauaacaaacauuaaaaaugguccaaauaagaaauuaaaauaaguauuugagcugggcacgguggcucacgccuguaaccccagcacuuugggaggccgaggcgggugcauugccugggguugggaguucgagaccagccuggccaacauggugaaacccugucucuacuaaaaauacaaaaauuagccaggcaugguggugcacuccuauaaucccagcuacuuggaaggcugaggcaggagaaucacuuaaacccgggaggugaagguugcagugagccgagaucgagccacugcacuccagccugggcgacagagcaagacuccguccccaccaaaaaaaaaaaaaaaaaaaaaaaaaaaaaaaaaaaaaaaaauuuaaaagaaaguauucgaaaauauuuuauuugaaugaaauauauaaauaacuuccaugaagagagaagacaaaggaaagaaauguccuuacuaaauguauucucuaaggggggaaaaaaguuaucaaaguuacaacuggccuuuuuuaaaaguuguauuuaaagugguuugaauguguuguuuugaccagcuggauauuuuaugaaaugauguuuaggcauaaagaaccaucaaaaugcaagaggcguagaaaucaccagguucaauucaguguuuacacaugaaaaaaccagacacaaggaccuuuauuuaaauaggagauuucuaaauaccuagcaccaagagaccaguuauccaauuaacuagcucaauauacuuuccaccagcaaauacaaugcuggaauaauaagggguugaacuuucacacugcucugggaaaggugacuuuaaauuuuacauuuagggaucaggcuguuaacuaccugaacccauuguuuaauuacuaaaagugggacaaacaaaccuaacaugcccccgauuuaugcaacauaaaauacacagcaccuccuauaaagaauucuuguccccccaauaaacaauaaucuacuagaacuuuuagacguguaaauaacuuccaguacaugaaaauuaguaaagcaaauacaggaauaagauaaaucaauguuucucaauguaaaagcacuauuaacauuuuggaccagauaauucuuuguuguuuggggcugucuuguguaauuuaggauguuuaacagcaacccuggccuauacucacuaaaugccaguuagcaacacuccuucagguuguaacaaccaaaaaugucuccagacauugcuaaauguucccuuagaagagaaaauuaaaaacaacaacaacaaaaaucaugaaggagaaagagguugagaaucacuggguuaaauauaagccaaaaaggaaagucuaaaauguggaacauuuugcagcaaaacugaccauuuccuucaaguaaguagaaugggagcaaaaaaucuuuuuugaauagaguaagaacuguucugaauuacagagacucgagagauauaaccagcaaaauaauaggucuuacuuaaauccuauucaaacaggacaacuguaaaaacaguauuuuugagacaagaaaucugaaugugaacuggguauuagauaauauaaaggaauuacuuugguuauguaagaaaauauccuuguuuuucagacaugcauacugaaguaugaaggaauagugucggaaauuugucaucaaauacuuaaagaaaacaaagcuucauggcaaauucuugaaaauguugcaucugagaaauagauauauagaggguuuuuuuguuuuguuuuguuuuuuuugagacagggucucacucugucacgcaggcuggagugcaguggcagaaucucgguucacugcagccucuggccuccuggguucaagcgauucucccaccucagccuccuucucuuccuucagccuccggaguagcuggaaauacaggcgcaugauaccaggcccaccuagauuuuuguguauuuugguagagaugaguuuucaccaaaacacaaguuuuguguauuuugguagaggugaguuucggccucucaaaagugcugggauuacaggcgugagccacuuuuacccggucuauagaguuuuuuuuuauacgagucucuguacuuuuguucaugcuaaguccuuuuaauuuugaaagacuaaaggugaugacauuucacuguagaaguugcuuuuauuuaaacagaaaaacuauuauuuaacaguaauauuacuuagauuucuaagauaauuagaauucuuuuucacuuucuccccaaauuaagucugacuuaauacaaauauuuaauaaugaaaaccaaggucuuuuaacaauggucagagcugaaugaauuuguuugucauuaacgguaauucaaauccuucuacacucaaaacacaaagucacauggaaauuugguaaugcggggucauuuggaccaacugucaucguuagcauuacauuucaaacuacuccucaaguuagaaauauuacugccauacuagagaagaaugguucguucuguaguuuaauaaacucguauuuauuccaaaggauaagaaaauuaguauauuuuggccgggugcgguggcucacgccuaaucccagcauuuugggaggccaaggcgggcagaucaccugaggucaggaguucgagaccagccuggccaacauggugaaagccuauugcuauuuaaaauacaaaaauuagccagguguuguggcaggugccuguaauccuagcuacucaggaggcugagacaggagaaucacuugaaucugggaggcagagguugcugugagccaagauagcgccauugcacccagccugagggacaagagcuagacuuccucucaaaaaaaaaaaaaaaaaaaaaaaaagaaaagaaaacuaguauauuuuaauuaacugauaccauacauacaaacuccaacuuaacaaauaacuacaaauuacauacuaagugcaaagcaguaggcuacucauuggauuauacaaacacaaaaauaauuuuguuauaaucaauaccuuccauaaauacacaauaaagaaaggcaacucuaugugcaaauaacuaucaaacaaguuugaaagaaguacuaaacagauacuaauacagugauugugcagagaaaugagaaaacaauuaugaaugagagugcuaaaagcaaugaugcuucaggaagauggcgccuuucaauacugugcugcguucagaauuuauauuaaguuacugaaggauuuaagcauuaaggcaaauaacugguaaaauaaagauaauuagagaccauguuaaagaucauuuuagacagcugugacaccagagacaaaacaaccaauuacgaacuuaaguaaaacaaaugcauuaugugaggugaagauggaaaaaagggccagucucuaagcauaaacauacuuuauaaaaguaaaaugcuggcaaccgcaaaauuuagacuucuuuacauucaacacuaaccccaucccccaucugauguuuuccgaagaaaaaauaauaauaaauaaaaaauauuuaaaaaauaaauaaaaaauauuuauuauuguuuuuguuguucuggaaaauacccuauuuaucaaugaaucucaaaagcugguaauaaauaaaaauauuuauuauuguuuuuguuguucuggaaaauacucuauuuaucacugaaucucaaaagcugguaaucugaauuuuaaaccaguaaucuacauuucagaaaagguguucuaaauuuugacuauauuauaaaagcauuuuaaaacaaauaauccccacacuuauuccaggaaaagaaguuaucuucagucaaaaauuuaccauacuuaaaauuuuaagaucucuuaauaaauccagucaaugcagaaaaaucccuccaaaaagauuuuauauuuuuucuaaauuuuucuuuuaguaagugucaaugauugauuuuuaggaccaauuuagacauuucaguaacauaaaauggguuuacagacauaaauccauaacuaacaccacuuuggcuacaaaaaauaaaaguucauuagaaaugacuuacggcuaucauuaugggaugaauuauauaacucauacauauaaaacauauucacugauauucaaagcacaggcuaugugaacauaauugaaggcaacaacagucuuaauuuugguuuuaucaauaugaaauacauuuuacauaugaauacauauuuuaaaaacugaauauuaaaaagugaauagaaaaauuaagaaacuugaguuuaugaucauuuuaugacagugacugaauaaauucuuaauuuauuaagaaauuauaauaauuucuggcucucaaguaagccuggaaaaauauggcuaucugcucuuauaguucuuugaauacugauaagcagauuuacacauaaaauaagaaauaagaaguauucauaauuguaaagucaucacaauuuagucucuucugaacaugacccagaaauaauuccuuuugucuguauuuuuuauagucuuaaauaaggguaaacuuugauaaaauaccacaauucuuaaugggguaaauuauuccaaaauuaauacaauucaaauauuuuuucuauacauacaaagacaaaaucuucaguaaugucacagaacacuaauccaaguauaagacugaaauuugaaaaguugaaagaaaauaaaaacccacuuaaagaaauaaaaucuuucuuguaaaaagaauggucaaugauucauuaugguauucugagauuauaguaaauaaaacuaaagugaaccucauuaaagauaauuuaccuuucaaaaagucuauuuacagaauaaaccacugaucuauucuuauauuuuuucauucauacuugucuaucaauuugacaaauauuaagcagcuacuauaaucuaggaaucagugauauaacaguuaacacagcuuuguucuauagcacuuucguaaaacgugacuucuuaugcuucaaacugcuauuugccugcaacaauugaguaugacauuacuaacaauucaauauaaaauuuuuaacauaaacuuuacaaaguggacaaauuaugaauauuucaaauaagacaaaguucuauggaauucucaaaucuagaguuucuaagugguuuuucuguaacagaauuaaaguuauaugguuugucaaaaauucucccaaaauuacuuaucaauaguaggaugcaauucaauuaugaauuuagccugcuccaggaauuaucauuuaucaauuauuguaaaagcagcugcagaauauaaauauucuuauaagauggcuuuacaacacacacagauacacacacacacauauauacacaccacaaaaccuguagucauaagccuggugacauuucaaacuucuaaggauauaaagucuagaaaacuuccaggaugguagcaguggggaccuguuaggggucagacugacaucagacuuccuaaauacagcaccagaugcuagaagauaucugugcaauuaaaaguucugaugaacaguuugaaaguaaaauuccaaacuguauaaugaaauuuuuuuagguauguaaacacuaugaaauuuaaaagccacaaacauuuucugaauuuagagaaaauauuacuucaagaagaaaaacccauccaagaaaggggcagccuuggaauugcaagacuaagcagcuagaaaagaaaccaguauaauacaacguauuuuuaauaucucagguaauucuuaauauaugauucacuaaaguuauaaaaguggaagugagacaggaaaauggggucuguuggcagggaacauaaggccgagucacauuucggcuguaacaggaaauauccucucuguuagaguauaugccauaaaugacuuuguaacuuuacuucaucuccuccauuuacauaggacauacugaaguaaccaauggaauccucuagaggggacuuaaacucucaaaaauucuguaaggaggccuuugagcaccaaugcuugggccugcucccacacuguugaguguacuuccauuuucaauaaaucccgucauuccuuccuugcuuuguuuguguguuuuguccaauucuuuguuccagaugccaagaaccuggacauccuccacuguuaacagaaguauauaacauaaauauaucacaaagauuucugauuauuuugaaaauaugaaagccaggauucaaaugaaauaaugccaaaagccuauguucuagggcagugcuccccaaccuuuuugacaccagagaccaguuucauggaagaccauuuuuccaggggcaggauaaagaggauuuagaaauagaaguaauuaacuguaauacuuauauuucauagugaacuagaacuuaguauaucacaaacagagaaaagucuuuaaaaacaaaaaccugaucauaucuuaagcaaaacagaaaaucucaacacauuucaaaaugaagaaauuauacaagggcacauucuugguccauaaaguugaaagaaacuaaaacuuagcuauaagaugacgacacuacuuuaaaauuuaaaaagaaaaggaaaaaaaaagccuacuauuaacucucagaauacagaguaaaugaaaaauaaaauuauaagcauauuauuucauaugggauuuagccauagcgaucuuuaaagaaaaauuuaggccagguaugguggcucacaccuguaaucccagcauuuugggaggccaagguaggcggaucaugaggucagggguucgagaccagccuggccaauauggugacuccucaucucuacuaaaaauauaaaaauuagccgggcauggugguaugcgccuguaguccccgcuacucaggaggcugaggcagaagaauugcuugaacccgggaggcagaggcugcagugagccgagauugugccacugcacuccagccugggcgacagagugagacuccgucuaaaaaaaacaaaaaagaaaagaaaaauuuagagcuugaaauguauuaaauucauuagaaccugagauuuaaaauaaauaaaugaaaagcuucaaaauagaauacaaaucaaaaugcaucaacauaauuuauaaugaaaaaacaaaaaugagaaaauugagaagagguaaaaguuucauuaauaaaaccaaacacaguuucuuggguaaagucuagaaagaggauauaagccuuuggcgagaaugauuaugaaaaaugagagacagagaaaaauauaaggaguuauuaaagucagaaaguugagcacaucuaugaaucaauaaaucuaaaagucuuaaacaaaauggaugguuuucuagaaagaaagauaaucaaaauuaacucaagaaaugguagacaaccuaaguagaauauguccacugaagcaacgucaaugacagauaaaucuaacccuucaaaacggcaccuaaacccaaaugaauuuagaggcaacuucuaucaaaauuacauagcauuauuauaacauuuaaggaauagagcacuacuuuuuuauuuacaaggcccagaaaacagauggaaaaacucucuaguucauuauagauagccaauuaacaaaccuaaacgagauaacaacaacaacaacaaaaacccaauagcaaauuaaauuuaguaguaguauaaaagacaacuacaagaaaggggauaauagagaacacuaagaaauauaauccuuucuuuuuucuguuucucugucacaaaucucacacacacacaaauaaaauuaaucauacauauacggugauauuccucugccuggaauguuuuuuuuuuuuuuuuuuuugaaacggagucccacucuguuggagugcaguggcgccaucuugguucacugcaaccuccauuuccuggguucaagcuauuuucccaccucagccuccugagcagcugggacuacaggcggucaccaccaugccuggcuaccauuccgcccccucagccacccaaagugcuggcauuacaggcgugagccaucgcacucagcugucuggaaugcuuuucccaacccuuucguucuucaggucuuagcuuauguuuuacuuacucagaugauacuaucaacggaguuucucuccuuaucuuucuaccacaccauccucuuuauuuccuccauaauacuaccacagccugaaauuaucuuguucuuggauacuugcuuauuauuucuucuccauaaaaaaaaaugaaccuuucagacuuagugcuaacaccagugugugacauaguuccugacacaaugcaauaaccaaacagguaucugcugaauaaauauuaaaaauagaacacauuaugacuaacauuaaugcaaucaccacauugagguauuacagguaaaaaagaauauguaucaucucaacaaaaguacgugauuaaagacaauauccauuuucauuaaaauacuuauuaagccaaaaagaaaacuuuuauucuuuauaaaguauucuggggcugggcgcgguggcuuacaccuguaauccuagcauguugggaggcugaggcuggcagaucaccugaggucaggaguucgagaccagccuggcuaacauggcgaaaucuugucucuacuaagaguacaaaaaucagacaggugugguggcaugugccuguaaucccagcuacuugggaggcugaggcaggagaaucacuugaacccgggaggcagaggcugcagugagcugagauugcgccacugcaccccagccugggugaugggaugagauuccgucucaauaaauaaauaaauaaauauucuacuagaaaucuaagauauauauuauuguagaaguuuaaaacuuagaagcaucccauuuaaaucggggacaagauacccaaaucaaaacuaguaaugaacuauucuggaaaccuaaccaauguaguaagaccagaaaaacaaaacaaauguccuccaaaaaaaaaaacaaaacaaaaaaaaaacaaaaaaaaccuguaaggguguaaacacauacagaaaaaggaaaaggaaaugacaaaaugcuaucauuugcagaaaauacagccauccuucuagaaacuucaagagaagcaacugaaaacuaaguaaaugguaagaucaacauaaaaaucaauagccuuccuacauaccagcaauaacccaugagaaaauaaaauguaaaauggaagaaaaaaauguaauucacaacaacaaaaacaaaaaaaauccaggaauacaccuaacaagaaaaguguaagaccuacaggaaaaaaacuguaaaacuuuacuaaaggacaaaacaaaaacaaaaacaaaaaaaacaccugaagaaauggagaggcauaccauguuccuggaugggaagauucaauaguguaaagaugucaauuuuccccaaauuaaucuguaaauucaaugcacuuccaaucaaaaucccaaagggauuuuuaauggaacuugacauguugauucuaaaguuuaucuggaagagaaaauacacaagaauugccaaaaaaauuuguugaaaaagacaauggggagggaugcccuaccagaugucaaauauaauauaaaaugacaauaaccaaaacaguggaguauugaauccagaacauauauauaugggacuuauaaagugugauaaagguaagauuucaagucaguaggaaaaagacauacugcucaacaaacuauuuugggagaacagcuaugaagcuggaaaaaauaggccccuaccaaaaaauauauauguguguguguguguguguguguguguguguguguguguguguguaucuccagauguaaaggaaaaucuacuagaaacauaaauaaaacuaaguaguagaagaaaauauaagagauuauguuguugcuauaauuuuguagacaagaaagcuuuucuggaaagacacaaaaccuagaaacuaggaaacaaaagacuaauaaauguggacaguaugagaauaaaaauucaaagaugccauaaaauaaaaaaacugacaggcuaggagaaaauauuacaaauauaauguacauauuaaaaagaggauuauaaagaaauuuuuaaauuuuaguaagaaaaagacaaacaccacaaugggcaaaauauuacagaguaggcaauucauaggauaaauacgaaugcccaguuucacugggaaucaggcaauauaaauuaaaauaaaauauuuuucauccauugacagauaauaucuaauguuuucaaggauaauuuuucagaaucuaaaaucaacauuuaaaaauacaauuuucuuucuagaaauuuaguauaaaaauacuugcacauguaagcaaccaacuacguauauggaaguucuuuuuauuuuaacaggaaagacuauaaauaacccauauauccaucaauacuaugguuaaauaaauuauauauggaauaauagcuaccuuaagaauaaagcagauuuacacauaaaggccuaaaccacaacuaucugugcugcucauuuugucccaucaccucucaucucuuuugccuacauuauuuaucuucaugaacuuauuaauagugacauuuccccccaauuuauugucuuccucucacuugaauauaaguucacuuggacaaagaaccuauuuuguuccuugcucuauccccuguaucuagaauagugccuuaaacauuaacuacuuaaaaaauauuuaccaaauggauacauuaauauugaugcagaaugaucuucacauuguuagguggaaaaaagcagccugaagcaaaaaaaacaaaaacaaaaacaaaaacaugguauguaccuauuuaaguugacuuaaaaagcaaaauaaagcauauacacaugugcaagaauguacacaaaaaauuucaagauggguaaacccaaguuauuaacagugguaaucaaagaaugaaaucaaagagagaauuguaccuuuuuacuuacuccauacccuucuauauugcuuaccuuaaaaaaaaaaugcaguuuucuaccgugauuuuuagcaaacaauuaaugagaaaaaacaacuucuuuagacuuucaaacaaaaauauaaagaaucacccaaccauuuacauauuucuagaauaaauucugaaagagcuaucauaacaauuuguauugucuugagauauauaggauuaacuugcugguacauguaacucaucugaaaguaugcauaugcaaccucauucuuuuuaaaugaaagaaaaaguuuuggcaacaaaauaaaauauuguaagaauuaguuaaagcaacugcucguuuucucaagauaaguaaaaucaggaacauauuauguucucuucuuuuaauucuuuuucuuuuaauucuuuuuccuuccuuuugaaaaucagguuuauugaaguauacuuuagaguaaaauucacccuuuuuucgugguacaaaucuacgaauuuugaaaaauauauaaucuacaauuaagauacacaguauuuuaacacucaaaaauuuguccuguccauuuguaggcaaucauguaccacuaccuuuugccucuaacaaucaugacuuuucuguuacuuucauuuuuuccuuuccagaaugaauggaaucacagguuucugaauguagcuucuuucucaaacacauaaugcuugugagauucauaaauguuguagcaugcaucaguucauuucuuuuuaauggugaacaguacuucaucauauggauguaucacaauuuguuugguuauucaccagcuaaugaacauuuaaauacacuacuuuaugcaggcaugguuucacuucucuuaaauacguacauaagaggaggacaggucauaugagaaguguauguuuaaauuuauaaaauacugccagacuuuuacgugacaccacuauacauuccuaccugcaauauaugaaaguuccaguugcuacauauucucacuagcuuuugguaucuucuggcuuuuccccccuuuguaguuuuacucugcuuuucccuaauggcuaauuaaugguguugaacaccuuuaucuuguguuuauuugccaucagcaaaucuucaauaaaguaucuguuaaaaccuuuuccuggcugggucccugaggcucacaucugcaauuggagcacuuugggaggucaaggugggcugauugcuugagccuaggaguucugcaacagcccuggucaacguggcaaaaucccaucuccacaaaaaauacaaaaacuagccaggcgugguggugcacaccuguggucccaaguacucggggcuggggcaggaggauccuuugagcccaggagguugaggcugcagugacccaugauugcgacacugcacucuagccugggugacagagugaaaccuugucucaaaaacaacaacaaaaaaaucaucuuuuuauuggguuuucucaauauugauuugugagaauucuuaauauauaccaaacaaguccuuuaucaaacacauggcuugcaaauauuuucugcaagccaguaguuugucuuuuuauuuucuuuuuaguaucuucugaagaacaaaaguuuuuaauuucaaugaaauccaaauuaucggggguuauuuuauguuugugguuuuuugccauauauaaaauacuucuaucuaacccaaagucacagauuuucuauguucucuucuagaaguugcauuguuuacauugaggcauaugauuaaugucaggauaauuuuugcacauagugccaaggaauagguugaaguuccaaaacauagguugacagucaaacguuucagcaucauuuguugagaagacuacauuuucucuauugaauugccuuggcaucucugucaaguauuauguaucuucccuagacuauucugauccauuaauauaugugccacacuguuuugauuagcuuuauaauaaaucuuuaaauucuccaacuuaguucuugcuuuucaaaaccguuuugguuauuauagggccuuuucuauauagauacuaaaaagcuuguaaauuaaaaaaaggagaggaucuggugggauuuugauugggauugcauugauacucuuguuuucgggggaauuuacauuuaacaguauugacuuuuaaaaauacauggaaauauauauacuauacauuguaguauauaucauauacuguaauacagcugaaacaucuggcuaucaaccuauugcuugggacuuuaaccuacuccuuccaccauaggcaaaaauuaaccugaaauaaaucauaagccuagauacuacauauuuuuucauguauuuaggucauuuuuuauuucucucauuaacuguuuuuuuuaguuuucagcacaaaaacuacauacauacuuuauuagauauaugccuaaguguuucauguuuuuuggugcaauuagaauuggugcguuuuuaaaauuucauuuuccaaauguucauuucuaauauauaggaauggaaaacguugcuaaacucacugauuaauuauuguaacucucuuauauuccuaguuugcuaagaauuuuuuguuaucaguggaugaugaauuuugucaaguuccuuuucuguaucuacugugauuauaauuuuuuuucuugagugugcugauagugaauuacauugauggaucaguaaacguuaaacaauuuaaaccaacuuuauauuccuaggauacacaccauuuggugaugagcuaucuuguuuacauauuguuggacuguuugcuaauauucuauuaggauuuuuuaucuauguucaugauauauauugguuuuaauuuucuuuucuuauaauaucuuugcuuggucuugguaucaggguaaugcuggucucauaaugugaguggaaauguaaucccucaucauauauuuucuguaaaaguuugugaagaauuaguauuauuuuuaccuuuaacauaucauguaauaugugcacgaagucauguagacuuaagaguuuucuuugcugaagauuuuuuuuuucuuugagacagagucucacucugucaccaggcuggcgugcagugguacaaucucggcucacugcaaccucugccucccggguucaagcuauucuccugcuucagccucccgaguagcugagacuacaggcgcauaccaccacacccagcuaauuuuugcauuuuuaguagacaggggguuucaccauguuggccaggauggucucaauccccugaccucgugaucugcccaccuuggccucccaaagugcugggauuacaggcaugagccaccgugcccagccugcugaagaauuuuucaugugaaauacaauuucucuaacagauauuagucccuguuagccuuuuaguguauaugggugggaugggaggcaacauuacauuuuuucacugccaguguuaauaauuuguauguucucucccucuguuaguaugauuagagcuuuagcagauuuaaugauucuuucgaagaaccauguuucuuuuuuuuuuuuuuuuuuuugagauggagucucacucuguagcccaggcuagagugcaguggcaaucucagcucacuacagccucugccucccagagugauucuucugccucagucucccgaguagcugggauuacuggugccugccaccaugcccagcuuauuuuuguauuuuuaguagagaugguuuugccaugaugguuaggcuggucucaaacuccugaccucacgugaccugcccaccucggccucccgaaguguugggauuacaggcaugagccacugcaccuggccuuaguuucuguugcuuuuaauuucauugauuuucuuaucuuauucuuucuuccauucugccugcuuugguucaauuugcucuucuaguuucuuaaguuggaaauuauuauaucgcugauuugaaaacuuucuucuuuucugaccuaagcuuuaaucguguaccacaaauucugauauauuucauuuaauucaaauauguaccauauauacacguauguguauguuuauauacauauauacguuuauauuuacacacacacacaaacauauacuuaugucugauuuuaagugagcaaggaucuaguguucuaauguuacuucuguuuaccauuguuugucaagcuaagaguauucuuuucuguuggaucucauccaaauagugaaaguuauccauucagcaacuauuuuauugagcaccuacaguguuauuggaugcugaguuacauaaguaacucauaaguaaauagauaauaauguuugcuaucuuagcuuauuguaaaaacuagcuuuugauuuaagugaaaugggagccaauggacaguuuugaacaaaagaauuauaaaaucugauuuacauuuuaaagggaauuggaauacuuaagaaaucugauuuuauuauuugagcuuuauuaaguuuuagggaauauauacacauguauguguauguguauguguguguauauguauauguauauaauuaagacaaaaucccauaauuuauuugguuaaugauagucugcuagucauucagaacccaggacacauucugauuaggaccucugagccaccaacucccuaccaaucacucuaaaaugagcagcucugaaacagcuguuagaucuugugggugcacuccccagcuacaagaggggcucuuguaguagaaggugaaaaaggaguuacuaugcaaacaccacugaagucuuauauuccuacagccauauagagaauacugucugcauuaugaaaaucaaggcuuaugugauguuuacagcaauacagauaacugugcuaucaugcaauaaaugcaaugugauaaaccucccaaucuguaaaacaccacauuaaaauaauauaguuuagggagaaaacagagcuggggacauucuacucaauacuuacgcaacucuguagucagaacucugagagaaagaaacagcaauuguaauacaaauacuagcacacuuaagacauauuaaauuccaagucuucacuuuuaaaagaagagaauccuguaaaaagcacuuucaaggccaggugccauggcucaugucuguaaucccugcacuuugggaagcugagguggaaggauaaacuugaggccagaaguuugagacuagcuugagcaacauagcaagacccaucucuauuaaaaaaauuuuuuuuuuaaucagccgggcauacgagcaugcuccuauagucccagcuacucaggggacugugcccaggaguuugaggcugcaaugagcugugaucaaccacugcacucgagguugggcaacagagcaagagccuaucucaaaaaaacaaaaacgaaaacguacuuucaagagagaacauugagcuaaacugaagaaauucagguaaaugaacauuguauuaaauauauguuuuuggcuuguauucaacuauguuaguauacuuuauauucaguugauuucauuuggugcuacaaaacuuauaaauauucaggaaaacuauguauaaaugauuguaacuucagauuuaaaccaccaucauuccucuaacuuuagagucuccauacauacaaucuaaaaacuuuuuaaaaaaauuaugccaggaaaauagguauauacuagaauugucccaaacaaauuaaaacauguggcuacuccaucuaccugcuaauugucugcaaguauucacauuauagaagcauuaaauacagaauaguuuuacuaaaauaucacugacuuugacccauuaccuagugauaaaauaaucaucauuuaauuggcaauauaaauauuuaagacuauauaaugagacuuuuaaauuauccaaacaaauuuaguuucucaacgaaaaugaaaaauuugguauacugcaaaguauacuuaacaaauuuguauacccaauggcucuguguuucacuugauaaagaauuagguuauauaaggauaggucuacuugacacucaaaaaucuccaagaaauuuggguaacuugucuauaugguaugcuggcaaaaugaaugaaauauguauaugcaaaauuucauccaaaacccauaauuuuguaaaaggagaaagaaaaauuaaauguuauuagucaugacucaacauuacuauuucaagaauucuuaguauaaacagucuaguaugagagcaaaaagaaaaaaauuaaaagauaacuuacucuuacuauacuacagcuuugcccaaagucacaaaggagauuaaaucaaaauuauaaauauuccuuucacuggacaucuggcccccaccacagaucccaacaaaaucaaagcuauccuuucccuuaaugauacucaaagacauucucccaugaauuguaugauaaauuagaugagcccaaacaaaauaaacuacaaaugucaggaauugugaagguuaaauauucuggguaaggaaggugacguaaaacuuguaacacauaaaaagauauucaagaguuugaagaguauagcaucaaaaacuuaaacuacucuuugggaacaaauucaagagaaaacuucuauaguaugcuaaaauucuaaauuuucccacucuucccaauacauuucauucuagucaugggcucaaauuauaccucaagauuaugaagacaagacaucagcaaucauguuacuguuauaaaagucaucuccaugagugcccugagccuuucuucauggcuaaucagaacugcuacccuaacaggcugcgaaaacauacaguuuggcuguguguguguguguguguguguguguguguguguguugggaggagggaaggggaaaacaaggaaaguaaaagaacaaaaaaggagggaaaaaaagccagccagaaagacaaagagaaaggcgagaugccaagcaccuuucauucaucaaccucccagcaagaauuuagcugagaaaaacauugucucaauuucccauuacuuuauauagaguaccccuauuaauuucaucuucucucaauugccuucaaaacaucaacuguagaggcauaccucagaaauuuaacaauuacaguuccuucuaccuggaauucaugaagaucuucaaauggcuagcugcuucucaacauucaggucuuugcuuaaaugugucacuccuaaguccuuaugaauaccuccuccccucagucacggucugccccauuauccuggcuuuauuauuuaguaguacuaaugacuauauaaaacuguaguauuuauuuucuuauccaaguauuguaguugucagucuuuccaacgacaacgaaagcucaauaugaguaauaacuucaucugucuuuuuguuguaguuugaaccaagaacagugcaggacaccuagagggcagucaauaaacauuuguuaaaugaauauuacauuaguauauguccuuucugaaacuagaaagacauuaaaugcuaaaagugcucuuauucuaacagagauuuucuuauauuuuuuauccagcucaaauuucaugugaauucuguuuuacagauacaagcaaaaaaggaaacacagaagagcuuuugucucuauaaacacugauuauggaacaaaauggauuuagauuacaaaauaaaauuauacaggaggaaacauuuugucuaaauuucuuaaauauugaaaaagucuaccaugacagaccauaaaucuccccaucugaaauuuuuuauaaaguaccaggcaauucaaaugucugcuuccauucaguauuuaguaaauaaaucuuuacucucuuggagaguuuucaggcacauugcuuuaaauccucuuugucucagaacagugguucucuacuuuagcugcacacuagaauuaucaauaaauaaauaaaaauugucaucgggguacauacuuacaguccaagguacuuggaagguuaaggcaggaggaucauuuaagcccaaaaguguaagacgagccugaguaacauaguaagauccugucucuuuaaaacaacaacaacaaaacuaagccugggccacguucucagauacuaugauuuaauaguuuuggggaguggccugggcauagggauuuuuuauagcuccccaggugauacuaauaccaggugaagguuaaaccacugcuuaaaagauuaaaauuaauaacuccauuaugaaaguaguuuauuauauaaagauuauaauaaccuaucuugacugaaaggcauuuagucauucuaaaugccauuaguuuuuguugauauucaaaaacugccaauuuauaagucacauaaaaaaucagaauucuucuuucccauccuuucugucaguuauuaaacaaaugcuuaucaaaaaaccuguaauuucucaauacugugcuaggcacugaagaaccagaucccuguacucuuguaaucagucauuucccuccaccuuucagaugccuccaccucaaucaccacuauguucacucucuccuuuccaacaaaggcugaacuuagauacccagaauaaaaaagguauagcuuuaugaauuaaucaccugcuuaaacaguaugggcggggggggggggagauucuuaaucucaucacaauacugcauguauuacaauauaaauuuuaaaauaaauucuagcaagacuaaauaaaaugccauauagaguaauauuaccugaauuacaggagaacaaaagacauaaaaagucacaaagaauaagaaaagacacauuuauuuaaaauguaugcaaaaaauaucccaaaccaaaaaauguaaauaacagucagaaaaaaaauguuuaucacacuugacaaagauucacaucaauauacaaaaauucucuagaaaaauaaagucacaucucauuagcaaaauggcuaaaggguaucuauaaacuuuuuuuacuauagggaaauuggaaauaacccaguuaugcaacaacacaaaugcacaguaaguuauauucccaagcuagaauauuauacaaucaccaaaauaaugauuuucagaaaaauuaauaaaauagaaaaaaaaacuacaggaaaauguaaacagugcgugaggaaaaaaagcaagaaacaaauauuuuuaaauaauacagucccaauauauuaaaaauguguauauaucuguauuugcacagagaaugaacugaaaggaaauguaucaaaauauaacaccauuaauuuuucuaacacaggcuuauaauucucuuugaaccuuuuuauguuuuccaaguuuucuaugagauuuuguaauuaaguuuuccaugucauuccuaaagagcuaauaauauaguaauugccauuaggaauaaccugaaacaguuuauuuuaaauugcuuuaaaauguauucacuuuucuaaacauaagcugcuuggagcaauuuucaggcuuucucacuaaaaauguuuagguuuccuuaagacauacugugaaacauaaacauauuagaugcugcuauacaaacauggacacuaucuggcagucaucuguggcaaaagcaucuacaauggcacugcacugacacuauuucuauugaguacauauuacacaaaaugaaaugacuucacaacuaaacagaaagggcuacaaagacuaagauguggcacuuuauuagccaugaaagauuuuucacugcaaauuugccacagcacaguaggucuacuuuagcauaauucucuccaccaaucaguaguucaaauacaguacgauguggcuuauaggcacaacagagcaauugggacuuggaaagacuucccaccucuuuucagacaaugaacaggcauaaaagaguaugacccacugaaaagaaacgaugaagucaguccuacuccuucccaucuuucugucaaaccuagcaguauuuaccaaacccaaggcaggaacaggauuaaaaaaaaaaaaaaaaaaaaaaaaaaaaaggcacagaacugaagucuuacuuaguucaggagaaaaagaucagaguuuagagaaauuaaugcagcuaaaacgugggggcagaaaacuagggagaauugggaaaagaacuauugaggagcuguaaacuaaacaauuauagaaacuccaaaagauugguggagaaauaucaaaaucuaaccagccagaggagagagauuucauugaacacauagguauuuagcagaaaauccagaaaggcuacacauaccaguagggcuauucuaacuuuagaguacagacuacuagaaagaugaucuaacaaugcuucaaaacaagccuuaaaaggauaaagcugauuuucaaguaaccuuacagccaaauauaaauacucuuuaaaagaggacaauacaauccagacauucaacaauauaauaucacaacauccagcaucuaauaaaaaucaguagacuugcaaaggagcaagaaaaggugucucauaauuaggagggaaaaagguaaacagaaacagauguagaauuagcaaacaauaacuuuaagacaguccuuuugcaagugcucaaugauuuaaagaaaaugugaaacaaugagagaaaugaagucuauaaaacugaaagaucaaauagaauuucuagagcugaaaaauacaauauuugaaauaaaaauucacuggaugaucugucacaguuaauuuagacauugcacaaaaaaagaucagugaacaucaagauagcaguagaauuuauaauagcaaauauaaauagcaaaacuauaggcuuauuuccucugguugguuagaucuugauguuucucaaccaacccugugggaguuucuauguuuguuuaguuuacagcuccccaacacuucuuuucccaguuuucccuuucccaguuuucugccccuacuuuuuaguagaaaaugccucaguuucuccaaacccucaucuuugugucuugaacuaaauuauaauaacaaauggcaaaacuaaacaauaaagagaaaaacagcugaaaaaagauguacagaggcaauguuauuuuuaggacaauaucaaaauaucuaaaaacguguaacuggaauuccagaaagagagaaggaggguagaaaaaacauuuaaagaaauaaugugggcugggcgcgauggcucacaccuguaaucccagcacuuugggaggcccaggcgggcggaucacgaggucaggagaucgagaccauccuggcuaacauggugaaaccccgucucuacuaaaaauacgaaaaaauuagccgggcuugguggcugaugccuguagucccagcuacucgggaggcugaggcagggagaauggugugaacccaggaggcggagcuugcagugagucgagaucacgccacugcacuccagccugggcgacagagcgagacuccgucucaaaaaaaaaaaaaaaaaaaaagaaaaagaaauaaugucugaaaauucucaaaauuggauagaaaaauauaaccuuacaaauccaauacguuccacagucuucaagaaaaacacgaagaaaagugcaccaaggcacaucacaaugaaacuacuaaaaaucaacaacaaugaaaaaacucuuaaaaacagccaugggggggaaaaaaccaucaugugcacagaaaggaagauaagaaugacugcugacuucuuauucaaaagaaggaaaaccagaaaucacaugaaaaagaccuuuaaagugcuaaaagauaaacaaucuuguacgggcgcgguggcucacgccuguaauaccagcacuuugggaggcacaggcgggcgaucacgaggucaggucacugagaccauccugguaacacagugaaaacccgucucuacuaaaaauacaaaaacaaaauuagccaggcgugguggcgggcuccuguagucccagcuacucaagaggcugaggcgggagaauggcgugaacccgagaggcggagcuugcagugagccgagaucacgucauugcaguccagccugggcgacaaagugagacuccgucaaaaaaaaaaaaaaaaaaaaagaaaagaaaagaaaagaaaaacaaucuuucuuucaacaaaguuuucaauaugcaguaaaaauaugcuucaaaaauaagggaaaauagauauucucaaacaaaaucugaaggaauuuguugccagcagacaagcacuauaaaaaauuuuuuuaaaguaaauucuucaaguggauagaaaaugauaccuaauaaaacuggauccacccaaaguaauaaagagcacuagaaauggcauaaaauggauaucuucuuuuuccucauuuaagaaaauaucuuuaaauaauaagaaucuauucuggcgauucacaacauagguagaaauaagauacaugacaauauucagaccagagacauaagagaaggaaugaaauauacugucguaagguucuuaauauuuucgggaagugguauuauaugugacaacaauuauuagcuaacacauauauauuacaagcacuagaacaaucacaaauaaaauaauaaaaacagguaauacaccaauaaaagggacaaaaaggaauacuaaaaauacucacaaaauacuuuuuuugugaguaaaaauacucacaaaagaauggccaaaccaaucuucagcaaaaaguacaaagcugaaugcaucacacuaccugauuucaaaauauacuacaaagcagcccaggcaggguggcucaugcuuguaaucccagcacuuugggaggucaaggugggaggauagcuugaagcuaggaguuaaagaccagcaugggcaagaaagcaagacaccaccucuacaauaaaaaaauuuaaagaauuaaaauuuagccaagugugguggcacacagccuauaguugcagcuacucagaaggcugaggugagaggaucgcuugugcccaggcuacagugagccauggucaugccacugcacuccagccugggugacagaguaagaccauuucuaaaaaaaauuuuuuagcaaaauaaaaaauuuaaaaaacaaagcaguaauaaccaaaacugcaugacacuagcaaaaaaacacagaccaauggaacagaauaaagaacccagaaaucaaucuacccauuuuauggucaauugauuuuugacaaagaugccaagaacacaaugugaaaagaacaguaauuucaauaaguagugcugggagaacuagauacugacaugcaaaaaaaugcaauuacauccuaucucacaacaaauacaaaacucaacucacaauggauuaaagacuuaaacauaagcacugaaacugcaaaacuacuagaagaaaauacaggggaaaagcuccaugacacugguugggcaaugaauuuuuggauaugacuccaaaagcucaaauaacaaaaguaaaaauagaugaaugggauuacaucaagcuaacaagcuuuuauacagccaaggaaacaaucaacagagugaggagauaaaucuaugaaaugggagaaaauauuuuuaaacauauaucugauuagggguuaaugccaaaaacacauaaaaaucuuaguggcaagaaaacaaccugauuuuuuuaaaaaaaugggcuaaggaccugaauagacauuucuccaaagaaaacauacacauggccaauggauguggaaaaaaugcucaacaucacuaauaauuagagaaaugcaaauuaaaaccacagugagacacuaccauucagggguuugaacagcuaugaagaaaaagacaaaagauagcaaggauugguaaggauguggagaaaaggaaacaccuguacacuauuaguaggaagguaaauuaauauagccauuauggaaaacaguacagagguuccucaaaaaauugaaaacagaacuaccauaugauccagcaaucccacuucuggacacauauucaaagaaaaugaaaucagucauacugaaggaauaucugcacucccacccauguucacggcaccauuguucacaaccaccaagauacggaauaaaccggaguauccaucaauggaugaauggauaagaaaaauguggccuauauacacaauagaacagaaagaaagagagagagagaaagaaagugagagagagagagagagagagagagagagauaaagagaaagggaggcaggcagggagggagggaaagauagaaagaaaucuugucucuugcaacaacauggaggaaccuggagaacacugugcucaaugaaacaagccaggcacagaaaugcaagcacugcaugaugucacuuauauguagaaucuaaaaaagcugaauucauagaagcagugaguaaaauggugguuaccagggauugacagggaaggugaggggucaggaggguggaccagaaagauguuggucaaaggacagaaauuuucaguuaagaagaagaagaaguucaagagaucuauuuacagcaugguaacuagaguuaauaacaauguacuguacacuugaaauuugcuaagagaauagauuuuuuuuucccccaagacagaguuucacucuuacccccaggcuggagugaaggggcgugaucucggcugacugcaaccuccaccccacgggguucaagugauucuccagccucagccucccgaauagcugggauuacaggagccugccaccaagccuggcuaauuuuuguauuuuuaguggagacaggguuucgccauguuggccaggcuuauuuugaacuccugaccucaggcgauccacccaccucagccucccaaagugcuaggauuacaggcaugagccaccgugcccagccaagagaguagauuuuuaagugaucucaccacaaauaaacauaaguauaugagguaauacauauguuaauuagcucaauguagccauuucacaauguauacauauuucaaauaucauguuguacaccaaaaauauauauaauauuugucaauuuaaauaaaaguaaagucagauuaaagauauaugaaaaacaaauaaaaaacucaaccuaauaaaaggcaugaacaaagggaaaaaagaagccauaacaaaugggagaagugggaaacaauuagcaagaugguggaaugaaauauaaaauauugcuaauuauacuaagugaaaauggauuaaauauacuaauuaaagggcagauauugacaguuuguauaaaaaggcaagagcuaucgacaugcugucuacaagaaacauacuuuaaauauaaagacagagauagguuaaaagaauggagaaagauauaccaugcaaacauuaaucauagaaaugcugguagagcuauuaucaauuucacauacuguacacuucagcaaaacaacaaauauuaacaaagccaaagagaaauauuuugaaacaauaaaaggauuaauucagcaagaagacauaguaacucuaaauguguauguaccucaugaggaagcuccaaaauacaugaagcaaaaacugacaaaucggaaaggaagaaugggacucucuacaauuauauuuuggagauuucaacauuccucucucagauuuggcaaaacaaguagacagaaaaaucaguaaggguauuaaaaaaacuugaggccgggcacaguggcucacgccuguaaucccagcacuuugggaggccgaggcagguggaucacgaggucaggagaucgagaccauccuggcuaacacggugaaaccccguuuccacuaaaaauacaaaaaaauucuccaggcgugguggugggcgccuguagucccagcuacuccggaggcugaggcaggagaauggcgugagcccgggaggcggagcuugcagugagcagagaucgggccacugcacuccagccugggcgacacagcgagacuccgucucaaaaaaaaaaaaaaaaaaaaaaaacuugaacauuauuaacuuauuggucauuuauggaacauucaacacaacaacuucagagaacauauucuuuucuaaugcccauaaaaaacucauucaacaaaauaaaccauauucuggggcauaaaacaagcuucaauacauuuuuaaaaacuaaaauuaagaguacaguacauucucugaccacacauaauuaaaugggaagccuauaauaugccaacauauuuagaaaugaaauaaccaacuuuuaaauaacccacauagccuuuccccaaaaggguuccuuauaugaaccauggauggccaaaaauaauuugagugacuacuuucucaguucuccuaaaaauguuauauaaauaguaccauaauacagcacaagcacaggagagaauagagugacuaacagccuuaggcauuagagaucaauccuccaaggaaaccccaguuaagacaggcagaaugagucaaagaaauccaggggaaauuagaaaacauuuagaacuaaaugcuaauaaaaauaaaagauaucaacauuuguaguauacagcuaaugcagugcauagagggaaacuuauaguguuuaauauuaguaguagaaaagaagaaagauuacaaauaauaaccuaagcuuccacauaaaacuagaaagagggacaaacugaauucaaaaaagggaaaaaauaagagcagaaaucaauuaaacaaaaaaugaacaaaauaggcugggcgcgguggcucaugccugcaaucccagcacuuccgggggugggcagaucaccuaaggucaggaguucgaaaccagcauggucaacauggcgaaacuccccucuacuaaaaaauacaaaaauuagcugggcaugguggugcgugccuauaaucccagcuacucaggaggcugaggcaggagaauuauuugaacccagaagguggagguuguagugagccaagaucgugccacugcacuccagucugggugacagaacgagacucugggucaaaaacaaaaaacaaaacaaaacaaagaaaaacaaaauagaaaauaaucagugacacaaaaugaaaaucaacugaaaauuuauugaaaagagaaaaugugaauugccagugaaagaggaaacacuaucacaaauccugucauuaucuaaacaguauaggacuauuacgaacaacucugucaauuaauucaacaccacagacugaaauugacaaaguccuugcaaaucacaauuuaucaaaucugacagaaaaaaaaucuaaacagcccuauaucuacuaaagaaauucaauguuuaauugaaaacauucccaaaaacaaaacccuaggugcagauagcuucacuggucaaugcaaucgacccaaacuuucggaaaacagaaaagaaggauauacucccaauuuuuuuuacgaggcuugcauuucccuuacgcaaaaaagaucaaauauauuacaagaaaaauaaagagcacuaugccuuaaaauccuuaacaagauauuaguaagucaaaugcugccauauacaaaaggagucacacauugugaccaaguggaguuuaucccaagaauacaaaguugguuuaaaaugcaaaagucaauuaauauaauucauacaauaacagaacaguggaaaaucacaggaucaccuaaaaagaugcagauuaaagcaccugacaaaauucaauacccuuugaugauaaaaauccuuagcaaacuaggaauaaaagggaacauccucaaccagauaaaggaaucaagaaaaaaacuacagguaacagaauacuuaauggugaaagacugaauacuuaucucccuaaaaucagaaacaaggcaaagaagcccauagucaccaguucuauuuaacauuuuauggaggcccuacuuaaggcaauaagguagaauauugaaaauaagagaauuaaaaggcauaaccaugggagaugaagguagaaacugacuuuauuuguacauaugauccaaguagauagaaaauccuaagaucuaccaaaaaaacaaacaaauaaaaaaaacccuaguagaacuaagugaauuuaagcccacaaauauccacuguauuccuacauaugaacaacaaacaauugcaaaauaaaaagaauuagcaguuacaauaauaucaaaaaccuaaaacaccuaggaacaaauuucaugaaauauuuauaagaccugaacagugaaaacuauacaacagugcugagagaaauuaaagaaaauauaaauaaaugaguguguguguauaugugucaugcucacugugugggccaauguuauaugaacuacacaaaacacaguucuaagucugauauggccaagaagccacaaguuuggaaccuuugcccuagauguucuaaauuuuauuguugaaacaaacaagaccaucagaaaaccuaguacuuacacuacauuauuguuuucaaccaaauugcauuuuauuagcaaaucuuuaguuuauacucuguauaaacaaugugaaggguauauuuuagaaaugcugaaaaaguuaucuacuaccuggaguaucuccauuaugagggcccaaaagaaauuuuuucucagaucucaauuucagaaaauaugaguccuccaaaucaucuaguauaccuaugaagcuauggacuaugcaaaucucaaaauucaucaaguuuccaaauuuggcucugguugcuaguuaacugaaucuaaguuuaauaacuguauauuacauacauuuuucuguauaauccauuuuccuuuggucuuaauuuacuaauucuaccuuuguauuuuuauuuuuuuagaguauauacucuaaacuacuucaaaucauuuugggggaugaaauaucuuuuaccuaaauacauagaugacuuuuuuuuaacuuaaagagucagggucgcuaaaaauuaaccauauagucaagcacauaauacagaccauaaaauauuuuaaauguauauggucucacauuacuuuuacagagcagaaaauaguaggagcuaaagaaugugaaaagaagacuagggugggaaaacccuagagaagagguaggaucuagguggagcucugaauaaugaagauaaagaggguagcagguagacaacauggguaauaacaggguauuaggauacaauguaaaggcaaacgguugagauuaaguguuguaaagauaaaguugaguggauagaaugaagucauauaauguauaguucaaagccaaacugagcuuuaguuugauucuuaaauguaaaauaacacaguaaaacagguuacaaaggcuuugacauauauaggagauacacacuaucaucucaaacuuuuuguuuaguaguuauuggagccacuaccuuaagaaaucuaauugucggccaggugugguggcucaugccuguaaucucagcacuuugggaggccgaggcagguggaucaccugaggucaggaguucgagacuagucuggccaacauggugaaaccccaucucuacuaaaaauacaaaaauuagcugggcgugguggcaggugccuguaaucccagcuacgugggaggcugaggcaggagaaucacuugaacccgggaggcagaggucgcagugagcugagauggugccauuguacuccaaccuaggcaacaagagcaaaacucugucucaaaaaaaaaaaaaaaaaaaaaucuaauuguaagcuuucauaagcagaaggggucuuaagagaaacuauaugguacaacuaaauuuuagagauuaaaaaacacaggaauaaagaaaaauguauaguauuucaaaugauguacaaagcuuauuauccuuaaaaucccaaccuacugaucaccuggauugaucugaguuaauaugaauuacuuuuaguucuucuuuauacaauauauacaccuaaccaaagccaaggagagucuaaacacacucccaagguguggguugggcagagggaaagaggguggcgauucuuucacuguacaagaauaacucaaaaugaaaaaccagcauuuacuauguucuaaguacaauguugagucacugaagauaccaacaacaaagcuauucacagaaaaucagacuauaacacuaaaagcucaagacaaugaaaaaggaaacccauuaaaugucuagaaauacuuaaaaucacugucaacauaauucagcauuuccauuuaccuaacacuuuauaaaagauauauucuuccauaauucauaaaacauuuacgaaacgauccaccugccaagauuauuuuuuaaaugauauauguagggcuuaaucuuaacauucugguugucuaaugaaaguuuucagaagagagcauauuucuaucuagagcuaucucccuugacuuuauuucauggagaaaacuaaaaaauaauagaacagagaaacugagaaagauauuaaaaaaaaaaaguacuugugcagaugugauacaaaaucuuaaaaacgaaaacuuucugauaugugugaacauuuaaacccaccacauguuuuuggaaaaucuuaacuaguuauuucuuugugaaauauaagaauuuaggccagcacaguggcucacgccuguaauaccggcacuuugggaggccaaggcacggggaucaccuaagaucaggaguucgagaccagccuggccaacauugugaaaccccgucucuacuaaaaaaauacaaaaaaaaaaaaaauuagcgcagagugguggugugugccuguaauuccagcuacucgggaggcggagacaggagaaaugcuugaaccugggagguggagguugcagugagccaagaucacaccacugcacuccagcuugggagacaaagcaagacuccguuucaggggaaaaaaaaaaaaaaaagaaauauaagaauuuagaagcugaguggauagaaucaagucaaauaauauauaauucaaagccaaauugagguuuaguuucucaaacuuaagcaugucacacaaauauauguuggucuuaugaugacagugcauaaauuacaaaugcugaacauaugacaaggacuaggcaaguggcaacaggacagauucaagguuagaaccagguaaggauaaacacuaguuagaugaauaaggucaagaagugagaaggucugugugaaaucaaagaguuaggcuggcagcaauauucaaacacugaguucaggauaaauaucuggacaaccugcagcaagaaaaagaaaucaugauuaaguaggcaguauuaccaaaacugagagaaagagguuaaaugacaaaagcucaggacagcaaagaauccagacagcacagaacaccaaaaacacuuuuaacacugaaccuaacacuguauuucucaccucaagcaguuccucaaaauuuuaugguggugggaagauauggaauuugagaaugagaaagacagagauguacagauguuacugaccuuucucuuucccagugaaaacauuauuuguuccaaagcuaauaucaaaaauaaauuguugcaaaaauaugguauauauaaacauugauauuuauauaaacaaaagaaggugagaaguaaaucuuaaaugacucaauuuuaccucuauaugaagaaauuugaaaaaccuuaguuuuuaaauagaggaagaucuacauuaucugaauuuuauuuuucauuuucauagacuauauaaaauaagagaaagaacuucucuugaccagaugaaaaccaaagugauaccugugaaagaagggaaggauaggaaagacacuuuauagccuucaaaaaaaauacucaaauuugacaaauauuucauauaucuguuucacuuaccacuuaauauuacuccacaagcaaaauauuuuucuacuuauuucuauuaauagcuucucuuugcauucacuacuuccuucaggaauccucaaacuccugacuuccugaaauucugaaugacuaaucuuggacugauaauuuuaaagcaauauucaaauucccacacagauuuccacacaagguuuuucuccggcucuuuaaaauugcuauauuguaguuaaaggauagagugaccuacagggugugucaaagagacuggagaaguugguacuaugugauuaauuaauaaauuuuauaaaauaguaaagaauacauuugaaucaagcagacuugucuaaaucuuacuuuuacucccuuaaugaguguaaacuuguaaacugggcaauauacuguaaaacagcaguugugcaagugugguccaugggaucuaugagaaucuccaagacucuuaaagagucugugaggucaaaauuauuuuuaaacaacuaagaugguuauuugccuguugcacuguguugacacuugcacugaugacacaaaagcaaugguggguaaaccugcuaguuucuuaacaucgaucaaggccaugauaccaaucuguacuaguuaguaguuaucauauucuucucugcaugcacucacaauuuuguauuaaaaaaaaaagagagaaaaagaaaaacccaguuuccuucaugaagcaguagaaaauaucauucuuaaacauuuucaaucuuaggccaggugcagucgcucacgccuguaaugcuagcgcuuuaggagccugagacuccuaaaacaggacugcuugaagccaggaguucaagaccaaccuggccaacagagugagauuucgucucuauuaaaaaaaaaaaaaaaaaaaaagcaagaaagaaaagaaaaagaaauuuuuucagucuugaauauauuacuuuaauauucugugugauaaaacagaaagcacuucuauuacauacccaaaguacgguagcugucucaagaaaaacacuugugcaaacugcaaaugguagccaacuuuuuuucauagaauaccaucuuuucuuaagacauacuauaauuauucacuaauuuggcagacauuuucucaagaacgaaugauaugagccugucauuucaagaaaaacaauucaaaugauuugucaucaauaauaaaauucaaacuuccaagcaaaauuagaauuuuggagaucuuauaucugacacgugacagcuucccaguuuuugacuuuucugagaacacugaugcuguuagaaaaugugauuuuuuuuuuuuugagauggagucuugcucugucgccaggcuugaguucaguggugcuaucucggcucacugcaaccuccgccucgcggguucaagugauucuccugccucagccugccgaguagcugggacuacaggcgcaugccacuacacccagcuaauuuuuguauuuuuaguagagacaggguuucaccauguuggccaggaugguuuugaucucuugaccuugugauccacccaucucagccucccaaagugcugggauuauaggugugggccacugcgccuggcugaaaaugugauuuuuaaaaauauugcagaauaaaagaaaccaguauuuuacuaugaccaauauuauaaaaaucauacaugguuuugauaaauucaaagugcacaauaagccagugaguuuuaaucuaacaaaguucagaaaguucaccgguaauuguuucagauuccacacugcaacuaaccuuuaagaaacuaccacuuguggaguuuaggaaugguuuuaaagaagauuauccacaauuaucugaaagggcuaugaaaauaguuuuuguuuuuuuauccuccuaacaaugugacacuaaauuucuuuagagacuucgaccaaauaauguaucacaauagacugaauaugacagcagauaugaugggcaugguggcuggcaccuguagucucagcuacucaggaggcugaggcagaaugacugcucagcccaggaguucaaggcuaaagugcauuaugacuguaccugugaacagccacugcacuccagccugggcaacguaaugagaccucaacucuaaaauaaaaguuaaauuaaauuaauaaagaagauaugagagucuaguuaucuuccauuaagucagauguuaaagauauuuauaaaaauguaaaacaaugccacucucacaaauuuuuucuuuuggaaaauaauuauuuuuuuauaaaagcauguuaacaugcaaugguuuaucauuuuuuuaaaugaauaaauauguaaauguuuuuaaauuuuucuuucaacuuuaauuuuaauuuucuuuaaacuauaauuucuaauauaguaaauagugauagauauaacucucagaaacaaaaaacuuuugaguucucaauaauuuuuaacagugaaaaagagaccuaagaccaaaagaauuuaaaacuauugcucuaauaaucccugacgcucaaauuuuccugucaaauggcgggggugacagcauaaggauagaagaugaggguuaaaaaaggguuaacaguuaaggguuaacuauguaacuaaaugcugugcuaaauguuuaugcagauuacuucauuuauuccuuauaagcugcuuaugaaguggguaccuaccuccucacagaaucauucagaggauuaaauaaaacaaugcuuauguaguaccuggcacacucccucucuauauauaauuuaaauacucaauaaaggguagcuaaugugccaauuacuguugccaccauaaaacuaugugcuauccuacuuacaacacauauccaacuaguuagaguucugauuccauccaagacuaaauuauuaauggccaguauuaauccaaccacacaugaaaguuaucaccucauaggcauuuaacaauuauaaacaccuugugaaaagccauugguuuggcaaauuuggaagauauauacuaaaccaaaccaaugguuaacaagacugugcugcucaccaacuuuguagugaucaagugacuucauaucagaaugagcuguuaucaagugucaaaacaaaggccucucacaauucagaaccaguaaagggccaauguuguugccucuauaaauggauaauauaugauguagaccuuuucuaauuaaugcuccauaacaugcacuaauuaccagacuacgauggaucagugggaaacuagugguucauuggacaaccgugccuuuacuuucauauaagaguaauacauugauucacauacuucuaguuauacuaccuuuccacaagcuauuuggagccuccauauuccacuaaaauaucauucuucuuuacagggauuaacuaacauaaguguaucuuauacuacuuccccauuaauucucccaaaauuggcauaugaaagcaauguuauaacaucaaccccacccuuacaugaaaaauuggacuuccaaauaagaguauccucacugcaaaauauacagguugaucaucccuaaucugaaaauucaaaaucugaaaugcuccaaaauccaaaacuuuuuuuuuuuaauuuuuacuuuuuuguagacauagggucucacuauguugcuuaggcuggucuugaacuccugggcucaagcgauccucuugcuucagccucccgaauugcugugauuacaggcacgagccacucacugcaccuagccaaagaucaguaauuuuuugagcacugacauaaugccacaagugaaaacuucugcauuugaccucgugugacagaucaaucaaaacuuuguuuucaugcacgaaacuacuaaaaaaaauugcauaaaacuacauucggacuauguguauaagguauauauaaaacauaaguaaaucucaugugggucccauccccaaguuaucuuuacauauacgcaaauauuccaaaaccugaaaaaauccaaacuccaaacacuucuggucccaaacauuuuagauaagaaauauuccaccuaaagcagaacaugaguguaugaguauguguguguauguuuguguguguguggaguauauguaaguauaaaugugaauauauguauuguagguauguguauacacacgcguaugcugguuuauagguaaaaaugagaaccaguggauguucuugucagcaccacauucauaaauacauauaacaaaaagauuugcauaaaagugacaacauaaagguguccagauaaagaaaaauaucugcuuacugaaaaauucagaaugcauaagggauauccgcuuuuuaaguccacugcugaaaacaugaguuucaaacuauucagauggaaucaaugaaguaaaauacuaguauuaaaauauguaucuaugcauccuaaauucaagacuguuuaagauaccaauggcagaggccggcugcaguggcucaagccauuacugagcacuuugggaggccgaggcaggcagaucaccugagaucaggaguuagugaccagccuggccaacauggagaaaccccaucucuacuaaaaacacaaaaaauugccaggcaugguggcgcaugccuguaaucccagcuacuccagaggcugagacaagagaaucgcuucaaccccugagggggagguugcagugagccaaggucaugccacugcacucuagccugggugacagagugagacucugucucaaaaaaaaaaaaaaaaaaaaagauaccaauggcagacauuucuucuucaucuucuucuacuucugcacuuccaccucugugagacaaaauuagcuggacuaaccucauugaauuucaagugccucacacugaagguacucaauaaaugcaguggcucacgccuguaaucccacacuuugagaggcugaggcaugcggaucacgaggucaagagauugagaccauccuggccaacauagugaaaccccgucucuacuaacaauacaaaaauuagcugggugugguggcaugcaccuguaaucccagcuacucgggaggcugaggcaggagaaucacuugaacccaggaggcagagguugcagugagcugagauaagagucacugcacuccagccuggcaacacagcaagauuccgucucaaacaaacaaaccaaacccauaucuguccaacauuucucaacuugauuccaaaacuucuugaugaauggaaaauauuacuuuuaucaacucuuaaugauuuacauauuuaucuaaacuuuucagucacuagaccaauuuagguucuaagaguuacuacaacuuuuccuagugaaaaaugucaccaugguuacuuuagaaaucuaugaaagacuuacugguauaguauagaaaugaugugcauuacauauaacaaugugccuuacagaauaaaaagaaauauaacacguaucugucaaaaaaagucuaccacauggagauuugauaucauuaccaaaaauaauuuuuaugguaaauagcaaguggauuucccuuguuugaccuagaauucacuauuuaccauuaguccacaaucuuggcaaucaaaaggaaaugaugccuuccuugagacucuuucaauuuuauuuaaaaaacaaaaacagcuaagauaaauacagagcaagaaaagcuuccauaauaaaccuacuuacuuugcuuaaaucugaaccuuaauucaguuccaaccuaaaggguucagucaaauccucaacccacuguccauagacagaaccauagagaguuggcacuuuuauuuuauauaccacaaccuauaacaucaaguacagaugaagcuggacauccuggcuuuagaugacaaaagaauaagaacggguaugagaguuauuauuacacuuaacaauauaaacauuuuuauuuucauaaaauuuccuacuuucuuaaagcaaaaauauaucaaauacuauacccagaacaaucugaacuuaaucaaaauuaaaggauggaaauaucugugaagauuucuuauuacuaagacuccuaaaacuggcucaauuauaaauaauaacacuaaauauacaguaaccaaguuucugaaaugaucucucaguuguuucauguuuucauauaaaaaagccaacauauaaaccacagguuuauauacacagcccuuggccauguaaauuugggauauaaaauuggaagacauuuuuccucuuauugaucauucuaaguaguacaaucuauuguuacacauaauuuuacaggaaggucaucaaaauucuaaaauuauaaucaugucucaggaaaacauaaacagaacaagaaaagagguauuuauaugagcugucagcccuuuuucugccaucuguauauggcuacuuuccugaguauuaguuccuuuuacagaagguaggcagaaggaacggaaauacuuugaugccuuugguuuggagaagaaaauuacugccuggauuauuugaauaaaugaaauagccaagacacucuauuuaaucccuuaccuuggacuguugaaaagcaaugauguaaguugaaauccaccuuuucuaauuuuauuauacauuuuagagaguauuuuacuuaagauuuuaaaggucuaaauagucaacuuaaauauaugugggcauauauaaucaguaaucacaguuuaaaagguaagccauaguauuaugagaaaucauuuguguuauguucacuaaugauauugacuuuuguuaacuaauauucaauaagaguaccuuuaagaaguuuaugauucaaaagaucaaguuacaaagacaggaaaaaaagagucuaauauuuauucaaugcaaauaagcauaaucuacauaaaauuccguauguucaauaaauaaaaucacaaaggugaaaauuacgguaaugaacuucaaguagcucaauauuaaguacaauaauaaaacugucacugugguauacagaugaacuucauuauccauuacuggacauuuauucaaggaguuaucccugugggggguagagggcuagggaauauauuuuucuggaaagcucauuauguaauaaauaucuguuuacuugcaauaugaggugcuuuagaaaaugguacauuuaucugcaaaguuagcaaauuuauucuuugcacucuguauuuuuagcacugugucauuaugaguacuuauaacuuuggauaaggcucuuuuauuacuacuuagaaaauguuaccaagauugacaaauauuuaagucaaaugauauuuuaaauaaagagaaaaagcuacuuauuuaguaugauaggaugcaacagguacauagaaacuaaauuaagauaaauugagaauuaggaaaacuaaaauugcagagguuguuuuaauaacuagcaacauugaauaaauaagguaacaugaaaucuuaacaugguauuaaacaauugagauaauaaaaagccaguuguucagguagcauuaaaaaaaccuaugcauaaagcacaaaacagugcucaaguaggauuuccucagaacauaaauaagacuucuaaaaucuguuauaugcugaaguuuuaaauggcuaagaaaaauugucaaauagauuuaucaaaaucuccaaagcacacuucuuuaaaauccaaaccaaaaaauuuuaaaagcaaauuaaaauguaacacuagaacucuguaaucuaauuaggcuuauuuaaacugaaccacuaaaaagucauguggccacuuguaauuacuaaacuccuuugaugaaaguuuauacuacuauuucuaaguagauaauuuuaccacacauuuuuaaggaaacucacuaauagaaacaaaguaaaaaauaaaagagaaaagaauaaaaauuaaccacaauucaacuuagaccuaacagcuuuuaggaaaggggaaaagagcacauuggcaggugucugcaaggagguagguaauaaauggaaucaguuuucauucugcagaacaaccaugagacuugcugcaaugucagcuccaagcacacacugagggacuccagaaaauacucauugaucaugcagcacuuuauaaugcgcauaggcuuuuuucuccugcuaaccccgccuagcuucccuuugcagcuucuucucccaagcccucuccccacaguaaaauaaucuuccugaagaugugaaauaguuaauaaauuaucucaacagucuaaguauuaggaauaccacucaccaccauaaagccucuuuaucugaauuacccagguuuuaucuaaugaggaaaaaaaagaaaaacccuacacaaucccacagauaagaauaugagauuuaaauaccuauaccuauaaauacaaauuucuaauaguauacuacauucaaugccaaaagcaauuauaguuucacuuugacauguauuuccuuggacugauuuauacucaaauaggaucuuauaaaauuuuuacaaccagaaaagagaaaauauaauuuaaaauguucaugauucaaauuauaguaauuuuguauugaugucucucuagcaucagugcccuaaauuucaggguuuuaauauuuuuaauuuaauaauuuguuuuauaauaaucaaagucacaugaaaaaucuaggaccagaguauaccagcuaaauuaagcaaucagauugauauaaacaugcuuaguuuaaagcuaaaauaaccguuuuuaauaguuaacugcagcaaagcuuuaggcuuagauauguaaaugaauucuaagacauaugauacuaaaccuuacucaaagcugcuuugcagaccccaccuucuaaugaguuaaucuaaaggucaccaccagcacaaggcuuuuuauuaagccugagucuccccuuuuucccuaacaaacauauaucuacaauuuaugaaacaugaaguuuaaacaaaauaauuauagacgucuauaguaaucaugugaaccagucugaaacauucucacacggaauaggucugaccgugucuugcuuuuaugcucugcuucucuuugcucucuccucuaaucuauucaucuguaaaauaauuccggcagauaagauuucuuuguucagauuucaacuuucauuucacuuacaaaccuagcccuaccucaagaaugucuucuagaacauaugcuuccauuucagccgcugucuccaccauguuuuaucaaacugccauguuucuuacugcacuaugauuagaucauugccagcaggaacacuccucugugucagcaagggaacaggaaauggaauguucuauuacaugccuaaagcagcuuagcuguucacuagccaggcaucuaccaaaagagcagggggugacucacuguguauuuuuuaaagauacagaagcucuauuccaaagcaaacuucugucaaguaauuuuaacagacaaaauaaagucucuuauuuuaccacuucaauuuuuaaaauccuaaaauuucaaaaaagaaauaacauauuuuuuaaaaagcuauuuaacacgucuggcuuccugguugaacaaaagagguugaaguggguuacgcagcaauuuauccuuaguaaagccuuguagugagauuaaugguuguauuaaagacgcaaagaaggaggcaugauaaugccaaguuagaaauuugcuacaucaggcaaauguauuauauaacauacauauuacaguugacuucaggguuucaaaaauaauuauccuaauguagauuuuuuaauaguaaauugguuuuuauaaacuaaucugcuuguaaauacuuaugagaaccagguuaacauucaacuaauuuacaguuacugaagcaagcuauaauauuugauauaugcauuuucuaguagugccuuuaacuucauuuacuaaccaaagaaauggccuuuuucucuuacaauaaauacucuaagagacuaaaauauccuagauaaaugaaauuuagagacaccaaaucuggaucaucaaacagcaaauaaagugagugagugacaguggagccaauauauauuauauucauuccuguaauugaucuuccauuuaguaaaacuuguuagauugucaaauuucuuccuuauacaacuuugaauaugaaaaaaugcacugaaaaaggaacaaugggccgagcgcaguggcucacaccuguaaucccagcacuuggggaggcugaggcgagcagaucauuugaggccaggaguucgaucaagaccagccuggccaacauggugaaaccccgucucuacuaaaaauacaaaaauuagcugggcgugguagugcaugccuguaaucccagcuacucagguggcugcaugagaaucacgugaacccgggagguggauguugccauugugccacuggcacccuagccugggcaacagagcgagacugucuccaaaaacaaaaaggaacaauguuuuaugcucuaaacugagaaaagugaugugaugaugugcaugacauugcugguacuaucuccucaaagugaugucauguuuuaguggugauuuuggaguacucuugggccucaauuuauuaaucaugaaaugggauaauauucauucaacuugaaauaucagaaacugcucuaggugcagucaacuagacagauuaugguuucuuaacaguuuauaugaagauuaaaugauauaaaguaccuacuacacgguuucugguauuuaagaaauacccauacugugucaagcaauauaugauuucuuuuuuuaaaaaaauaaacauauuauuuauccucauaacaacccagcuaugucauauuuuuaaacuacauuuugcuuacuauaugccauuuuaaaugcuuuuuauauauuaacucauuuaauuuucacaguaauccuaaaacauauuauuauuauccccauuuuacguauguggaaaugggacaaaaagagguuaagcaacuugcccaauuauuucaagcuaagcuaauuaaguugaagaguugagaucugaauucaggcaguuugcaccagacuggaguccauauccagaaucaucaacuauacuucuucccugugauaaucucauuuuacgaauaagggaaccaaguaucagacagggcacacaguuauaugcagagucaaauccagaugcaaauccagaacugauugcaaaggguauguggaauuaauggcaaacaaaugacacuauguuuuaccucauaccauaccuaguguuuacauuuagguauggguaugccuggcauuuaaaggcugcucaaaguaauuuacauuguugagaccuggcuuaaacagaaacuacaaacuggcuuuuguuauuuccugccucccaggucaauucuuucuaugcuucaaauaaacugcuccaucuuuagacuuaaaacaagucgucaacaaaguuucccuuccucaaauuuuccucuaaugcuaucaagcaaugauagguuugaguucaaggaacguaugcuggaacacucuccuuuuccauaaaccaagaauaggccuuccaaauccuuuaucugacaagaaaugggggccccuaagacuaaaguuaauaaaaccuuucacucuccccuucucuuccauucuaggauuauggggugcuucuguuuucugacauuuacuguuguuuuuaacaauacauaugugauuauggcuuucucacagaauuauggcuaucauuuauuaucugucucccuuaaagacuagaaaaaagcaggcaacacuguugaaagcaggcaauacuuuggccaggcgcgguggcucaugccuguccuguaaucccagcacucugggaggcccaggcgggcagaucaccugaggucaggaguucgagaagagucugacuaacauggugaaacccugucucuacuaaaaauacaaaaacaauaaguuggcuguaguggugggcgccuguaaucccagcuacuugggaggcugaggcaggagaaucgcuugaacccgggagguggagguugcagugagucgagaucacgccacugcacuccagcuugggcaacagggcaagacucugucucaaaaaaaaaaaaaaaaaaaaaaaagaaagaaaagaaaaaagaaauuaggcaacacuuuauucaccaaugcauaccuagagccagcacucuggcauagagcaggcucuuaagcuuuuuuuuuuuuuuuuuuuugaggcggagucucgcucuguugcccagguuggagugcacuggcacaaucucggcucacagcaaccuccgucucccagguucaagcaauucuccugccucagcuucccgaguagcugggacuacaggcgcgugccaccacgcccaucuaacuuuuaguauuuuuaguagaaacgggguuucaccguguuagccaggauggucuccaucuccugaccuagugaucugccugccucagccacccaaagugcugggauaacaggcgugagccaccgcgcccgccagcauuuuuugauuaaaugaacaaauucacagauaagagaauugucugauauccacuacaguauccuaauaccuuuuaaauuauugcuacuaauaguaauaauuucuuuucuucuguuuuuuuuuuuuuuuuuuuuuuugagacggagucucgcacugucgccugggguggagugcaguggugcaaccccggcucacugcaaccuccgccucuggauucaagcaauucuccugccucagccaccagagcggcugggauuacaggcgccugccaccaugcccagcuaauuucucguauuuuuaguagagacgggguuucaccauguugaccaggcuggucuugaauuccugaccucguaauucacccgccucagacucccaaagugcugggauuacaggcgugagccaccgcaccuggcccaauaguaguaauuucuuuauucuuucuuuuucuuuuuugagguggagucucgcucugucgcccaggcuggaaugcaguggcgcaaucucggcuaacuugcaaccuccaccuccugggcucaagugauucuccugccucagccuccccaguagcugggacuacaggcacgugccacaauuucuaacaaaagcauuuguucuuuuacucuaucuuuaggucacuggaucacugaaauaagauauuagaaguauugaauauaaacagaaucuaaauuucagauuuucugcaguuauuuguuacauagcaaaauaauguauccccuuuaauucuguuuuccaguccuuuucaucaauaugauuaccuaugucacugcaggauaccaugggcaaaaggauauaaagagaaauuuauacauauuugucuaaaaccugucauccuaaaaacaagccaccuuccaguucaaccuaauuuuauuuuugagacggagucuugcuuugcacuccagguuggagugcaguggcgcaguuucagcucacugcaaccucugccucccggguucaagugauucuccugccucagccucccgaguagcugggauuacaggcgcccaccaccacgccuggcucauuuuugcauuuuuaguagagacgggguuucaucauguuggccagggugcucucgaacuccugaccucaagugaccgccugccuuggccucccaaagugcugggauuacaggugugagccaccgcacccagccucaaccuaauuuuauaggcaagaaaauugucuucccauuuaucuaaaauggauuucaauggcacaagacuuuucauuauuuugccaacagaaguauuaaaguguaaauagcaauuaacauauuaagcuaugcaaacaaauguaaacauauaaaaauaauuuaaaauaauaaaagaaaauauugacugaaaauguucaaauauccaaaaugaagagugaaaccucucauaaaaagaagguaaaggacaaaaaagcucaguaaauaccuagauugaaugaaagaaucuuccaaaauugacaauuuuauuuaggaccagcauugguuuccuugaagaaggaaaaagaaaaucaaaacaaaaaaauauguagaaaugugcugacaagcaagcaacucuguuuugcaugacuuaacacuuuguuguuuguucccuucauguaaaacuuuaauagaaaacuccuuguaaaggaguuucauuccuaucaauuuuuuaacuuagggaauggugaggcuucaaaaucuauauauucaaacaaaacaaggacugacaacuggugguaggaaaaauuuaaugauuuugcccacucacauaaacuacuagaaaaaaaacuaaaacaauucuaccucuuaaaauuauuaaauuuaaucauuacuuuauaguaucucucuuuuucucuuuucuacuguguaaauuauaguaaagcauaaguaugaaacccaagugugaaagagccuaaaccaaguauaagugaaagauauuaaaacagaauuuaaguuaaaaggcuaauacgauuugguaagauuucugaaaguccauacauuauuaaaacaacacauucucaugauuuuaccuuuuauuucuccuaaacuacucaugcuauaaaaugacugaggaaucuagauauaugucuaauguagcacaaaauaaagaauaaaaaguaauauucuuuuuauuaccacuauaguuuauuuucuucuuuauuaacuaugauuuuuauguaaaaguaauacauguacauggaaagcauucacgguuuaagagaaaagcaaaccuaccucuuaccaagccauccuaagagacacaaccaguuauuguauccuuccagaaauaaccuacauauuucaagcacaucuuaggguaacauuauuuuuuauacagauggauacuauuaugcauacuuucuguaucccaauuuuaauauuuaauacuccauaauuguuucagauuaguacauaaauauuuaucuuugauuuuugacagcugcucaaauuuucauugcagaacugcauaauguauuuaaccaguccagcaggcauuuaucuuguuucuaacguucauacccaaaggauuauaaaucaugcugcuauaaaggcacaugcacacguauguuuacugcagcacuauucacaacagcaaagacuuggaaccaacccaaauguccaacaaugauagacuggauuaagaaaauguggcacguauacaccauggaauacuaugcagccauaaaaaaggaugaguucauguccuuuguagggacacggaugaagcuggaaaccaucauucucagcaaacuaucgcaagaacaaaaaaccgaacacugcauguucucacucauaggugggaauugaacaaugagaacacuuggacacaggaaggggaacaucacacaccagggccuguugugggguagggggagggaggagggaaagcauuaggagauauaccuaauguaaaugacgaguuaaugggugcagcacaccaacauggcacauguauacauauguaacaaaccugcacguugugcacauguacccuagaacuuaaaguauaauaaaauaaaauaaaaguuuagauguuacccaauuaacugccuucuaaaaaaguugaacuaauuuauacugacagugagugagacugccugcuucccuacaaauauaaaguguuacugacacaagucuacuaaaaauccagaucugaaaucaauauuaguuuuaaaucauguauccagauuuauucuuaguucaucauuucuacuuuucaagaaucacaaaucaaaguuacaccuccucucaucuaacuucaaaaaaaauuuaaaaaauccuuaucaaaaaaaacacauaaauucuccaacaaauuaagaacuucaauugauuauuuaaaaaaaaaaaacccaaccacaaugcagagucuauauauauauauacagcugauauacagguggagaagagagaagaauggggaguccaaugaucuacccuuuaaaaaaaaaucuccuucugauaaaauacaaauuccccccaauauuuaauggguuuuuuaaccugguaguaaguugugaaaagaugcuucugccagaauuuaguauuuuaaagacccagaauuguuugggaaauauuuggguauauucucacuaaauaaaauacugcuggauacauuuauuucuuugccuucuacauuuauguucaaauuacucuuuuuaaagcaugaaauucuaaaguaauccaucauauuaaaaaaaucuaauguacaagaauacagggccacacauaaacaauuuuuaugaacauaaaaagcacuaaacaguuucuaucucaguuucuuggcauagauuccaggucuaauuuugaugauuacauuuaaaaauaagaaugauuaagccuucaccagaacugccaaaauaagacaguugaacaugcuucgagaaauguagaagaauaucuaaaggauauauguaagaaaggacuaaguuaaagauacauaaaauuguaacauuauaaauaaaauaaugcaacauaguauccaguaguauauucuaaauauaaggaaugguagggaggguauguacuacuuuguaauauucaaauaauuaaagauuuuuuuuuugcuuaaacauuuuucucaaggcucauacuauaaaaagccccaguacaauuguuuuguaagaucaucauuagcauuuugaucauucauuuaaacaaacauuuacugaguacuuacuagguggcaggguuuauacuauauacacuggagacagaauggcaaauaaaauuaguccaccuccaagaggcuauaaucuagaacacaauccugauucuugacaauguuuaauacuaaaaacuucaaugauuuuuuucucuaauugguccccuucccauucuucucuaauccaacuaauaaaugaaaucugaaauucaaccuagaaaaguacagaagagaauuauauuagauacaaaacgcuucauccagauguguccuauguacagaaugaaauacaagcauagucuugucccaacguaaguaauguacuaaacaaaguaagaaacaaagcaaugcugccucuuuucacauccccaguaauaguugugucuguuggacacucgcauuuguugucucuacccauggugggucacaccaugaauucauucuuuuuccagcauuucacaauagguucuauguacacaaaacugauaaaauauuuauuguuuacaaucaacccucccauuugucugaauuguacauuuucaaaugaaaauaaaaacaagugcauacauaacagaaauuacuuauuucaauguuuuugauuuuaaauagguuaaaucuauugaugauacagcacuuucaaccucgucagcaacacauuuguccuccacuugaaagcaaauaucuaccaacagaaagaaauacacaccacacacacacagacacaaaauggaggucuaggggaccuggggauaaaaauuuaaauuacaagaaaaagcuuaaaucuaaagacaauuuucuugagucaccgguuucuaccacucugggggaaugaagaaacaguuccaaguaacucaagauagcaucaagggcauggaaaauaaucaggaaguaaaaacuacccaaguaaccauggaaucucauugcuaucacuggcucuccucugguuccuuaauggucuggggucccugacaagcuccaaucagucuggucucaagauaucuguuaccacucugcgcucugcuauuuccagccuaaucuauucauaacaaaccuugaaugguuugccugcaagcaauuauuuaaagauguaacuuuugcaagcaauuauuuaaaguaccaaaagacugccugugauaucaugaaauauacauuuggucucuggucuuagaccaguuuccuggcauacacuccuauaauccuuagaaucuucaaagugguuauguggcuuccuauaugcuaagauuugacugaagacugacaggcccuagguagcuucagaauaaggguugguuuuagcagaaagaccaggggaagauuaaaugguugggauuuucagccccaacucccauacuccaaaaaggggagaauaaaagugaaaucgauccccaacggcugauaguuuaaucaaucaugccuauguaauaaagucuccauaaacgccuauaaggacagggcgugaagggcuuucagagaacagaacacaguggaaguuacuggaggguggcacgcccagagagggcagaauuuccaugccccuugucccauaccuuacccuaugcaucucuucagcuguauccuuuguaauaucuuuuacaauaaaauguauuaaacauaaguguuucccugaguucugugagcugcucaguaaauuaaucaaacucaagaaggggaucaugagaacccugauuuauaggccaugggacacacaauggguccucagcaaagaugagagggcuaaguauauaagaucagccacgucuuuagaaggaagggggagaaaaaggcaauuucuauuuccaccuuccuucuucuagcucuuccaggagacauaccuugccuccaguaguuguagcucuccuugaucacaugacuuccaccuuaaggacaaacuaguuucuauacuugguccuuaguccaucggauaaaaugucaucuuauuuagaggcacuggaaggaaguaggccucagaauuuuccaauuuuuuguacuuccgaauuuuucacaauaaacauuuguuuuuuaaaaagaguuuccugucaaauuucauggaaagggaucagaaauuaacacucaaaaucgagcauguaagccagucaagaaagaauuaggcaucuuacauuaaaagagucacauuuguauucuacacaacuuucuaauuuccuagaauuaaucccugugucuucuauuuguaccucagacaauuuccgaaaaucacuuggcccgagaacauauuuacuucauaaagagcaguauuaaacaacuagguagaggccaccacaugucugcaauacccccccuuuuuauuuuuugagacagagccucacucucuugcccaggcuacaguucagugauaugaucucaacucccugaaaccuccaccucccagguucaagcaauucuccugccucggccucccaaguagcugggauuacaggcgcagcuaccacgcccagcuaauuuuuguauuuuuaguagagacaggauuucaccauguuggccaggcuggucucgaacuccuaaccucaagugauccacccgccuuggccucccaaagugcugggauuauaagcaugagccucugugcccagccuugcaaucuuuuuaacauuauaaaugugaugcauccacuuaggguuuuuaagaaauucaaaggcuacaaaggcacaagacgaaccauaagucuuguuacccuccugcaucaaaauggcaaaauacauguuacaucauuaauagacuucuagcacaguuaccaguuuaacuuuaaugccauuuugcuuucauaucuugauucaccaaauuuuauaugcuuguuaucuacugacuguccaccgaaaaaacgagcacugaccccuucguuuguugcccuccaucuccuaaauuuauagauauuauuuuuauauuauaaagguuuauaaagcauucuacuccauaacuauaauuaagcccauuuuauacauuuucuagguugauucuaaaacagaaaaucaauaaaguguacuuacaaugugauuauauaaauacuagucacuaaaggaaauuuaauuuuauguuguuuagacauuacuacuugaagaaauguucauguauuccagacuaauagaacuugaauuuccuucuagcuuucuucaguucuuuuugaaggcccaagauugccacagcagcuauuucuucccacucacccucccauccccccacuaccaccauauccucuaccuugggauuauuuuuuucucugugcuacuguaucucaaauauguucauacaaagugcaucguuuuuucccaguauagaaaaugcaauuguccucacaugauaaaauagaggggcuggguagagaaaacauaggucaaaaucuauugucucucaaacagugaagucacuguuccacugccuucaagcauucaacacagcugcuaagaacuuaguuauuugauuuuccguauuuuuucccucucucuggcaauaauuuugggaucuucuuguccuuaagaguucuaaaauuguggaucuuuuuccauucauuuugguuacuagaugggcucuuucaaucugaaaauucauuacguuucuacagcucaggaaauuuucuucaauuauuucuuucauuauucuauccuucccaugguuccuaaaucucuugcucugagaacucauacuuauggaugugaaaaacugugauauauuuuccaugcuucuuuaauuuucccucaaguuuuuccagauuauuuucucuuuugauuuacauaugcagacaguuccuccucuuaauuccaaaaucaacaauugagucuugauucaugcugaaauuuuaucucuucaauuaaaauuuuuauaauuuucaaaaccuuuucuaguucuaugcccccuuuuaaaugcaacuaugauuaaacauuacguauucuuaaauuuuaaauaaaauacuaauuacacuuugaaguauucuucugaauuauagcugagguugguuguucuuuuauucauuuuaaucuucuuucauccucuugauuguccucaauugucugauuaucccugucuguuuauauuugcaaaugaaagauuacuuuagaguauauagaguguaagagcuuucccugagguuauuuggguuuguuuuccuaaguggcuucuccuuuaaauggaagaacaguacaauuuaagcagguagggcacgcguauacgcagguaccccaaaaagguaccuggauaggaagucaaguuggcugggaacagacaaaacuguuuuucuccugggguagcacagugccuccacuucucucucagguucuaacaccuaaguagaugcccauacuaaacugcugaccuacuuucuuaagagaaugauucugaaacuucaggccuaagagugggcaucauaguuguuuaggcuggagaaaggguaggagggaagcccaacugaccuagcacuguggaaaagaagucuuaagaaaauucuuaaguauuacccaacugcccacuacuacugauugguguuuguugacuccaaguuuggagccauuccaagguuucccugggaaaaccugagcuuaccucuguuaucuuggguuccaguuuccucugggauuuugcugucaauccgauuccaugaacuuucuaucuucuucaaaauuucuugguccucugaugguaccuguaguggacugugaacuguaauuuuacuguucaacauguuuucucccugaccccuuuugcuaacaacaucaucccucuuuuuuauggggaauguauucaugugcuuuggguagaggugagccuucccagucaccacaggaguggccacuauaccuaggucuggcuagaauaucccauucccaucuccuuugagugacagucaucuuuggcugaaaauaaagcugauacagaaggaaacgcagaccaaaaauguugagacaguaacaggguugcagccauacuacuaacacuauucaaguuuagauccaucuaugcaccuaaguuguaguuucuuaccucucuccccacauacacccaaguacacauuaaaguuauagagcuaaugagguccuuuuguuccucuuaaggguaguuugacuaauauaauaacaucuguucccgcuuuucagaauuaugacuuaauucaaucuuuaaacaauaucagugggacacugaaaagaaauuaaaggaauguacuaaauccaccauuuuuuaaaaauuucagucaauaacuaaaauaagcccggauaaauagaguuauacuuuuaaaauuuguuaaacauacaauaaggaaauagcuauaaacuuuauuuaguacaucuuaucuuuccacccucagagggaaaaaaggcagauauaaaaaccaauuaucucuuuacuaguuuucuucuaagucaggauuccaauaguuucagaaagaaaaagaaggaagaagggaagguucguaaugauuuaaaauuuuuucuuuuuuuuuuugguuuuaauagagacagggucucacuauguuucccaggcugguuucgaacuccugagcucaugcaauccucuugccucagccucccaaaguacugggauuacaggcaugagccaccacgcccaaccauaauuuaaaauuuucuagcaaauuauuauuuuuuaaagcucucuuauaugacagaaaccuuucaaagaaaaauucuguagcuacuguugugauuacuggggacagaguagggaaaaaggauggucaauaacuccucaauggauaaaaaacaaaauccaguacuccuuuuucagacaggguuucacuccaucaccuagacuggagugcagugguuccaucauugccacuguaaccuuaaauuccugggcuuaagcaauccuacugccucagccucccaaguagcuaggacuaccaguacgugccaccacacccaccuaauuuuuaaauuuuuguagagaugguuacugcuauguugaccaggagagucucaaacucccagccucaagcaauccuccuggccucccaaagggcugucauuacagaugugagucacugcaaccagccugaaauccaguccucuugagcuaagguucauauuguaugguucacaccucaaauaccuaugccucaaaaacucuauaucccagaaacaacuggcaaaauguuguaugauguauuuaaguaaauguuggaggagaauaggucuacauuuuucauuauaaucuaacuaaaguccaugaccuaaaaaagguaaagaaaauugauccugacugggaaaaaaaaaaugacaacuucauuccaaaauaguauauaagaauuaaauccaguaaaaugucaaaauaaguaauaaauuaccuccaacacagaagguaguauagugugcuaaauaauguagauuaccuccauucuuuagaaaaacucuguuaaaaauaaaucauuagcccuaagguagaugaagacaacaagguuaaguaguaacuguccccaaaucacacaguguuaaagcaggauucaaaagcaaguggcucaacuugauuucaaacucuuuccauaucaugcuuuuuuccuggagaaauaguguaagaaaagaaauacaaaggcauuggguuauuucagaauuaaauguaauuuuugucaagcacagaaacugugaaguauucauaugccugugguuuaaugaaacuggaaucuggcccuucuuccuacuugcucucugaucaaaguuuucagaaaaacuucugcuuaugguagugaggucaggaagaccuucguauuugauuaagauauaugaaucuuaacauucuagguugccuaagccaaugaauggguacccuggccaagcaaagcuguucuucugggaucccugggauacaaaacaaaacugcucaugcauagaagacaaaaagcuguaauaccaagccuguguuuuuuauguguuagcauaaaagacaaaaggaucuggugauuaagcuaaaguagguuaagaacucccucauaugaaaagacaucucacauacuaaggcauauucacaacuuaaaucauauuacaguccuucgaucuggccaagagaagccagguacugaaguuuagguggcagccagaaagcuggacugagugguagagaggaucuuggacugugagguggggaucuggaugcagaguaagaaaaggaagaaaagguacaagugaaaggaguccacaaagugaguuagagauacauucuaaagguccugagauuuagaaaacagcaugaucaaaucuuugccuucauacuuuucauuuuaucuagaacccuaguauuaucugcuaagccuauagcagagacgccauaggcauaugguuugcuuucauauucccagaaaaggacuuaagagucagaaaaggaugugcauuucccauaacccuuaucucucccucuuuauuaacaguaugauaaaguacuacaaauuuuuaaguucucaaggaauuuaagaacauauucuacauaaauucuaaaaacuuaacaaauucagaauacaaccauuauuuugugaacuguucauuacagaaucccaaccccuuaaccuaucuacuaucagcuccaccuaaaacaauuaaccaaaauguacaauuagaacugaaaauauuuacuagcaaucuauaaauucaauaagauaaccaaauuuaauagaauuagaaauuuaaaauaagggauucuccuaaauuaaaaaaaaaaaaaaccaaccaucucaguagucagaauuuucauaagacucucuauuuuuauucauacuucaguuuuaacaauuaauuuaugaaaauccuuauaggucacaaauauuuucacaaacauuaggucaccuaaccucccucaaaagaaaguauuaccaggccccuuuuaugagagacugagauauuuaauuuuuacaugucacacuuaccuaacagcaugaauuaagagguauaggagggucuaaaacagcauucuucccacuucacauuuugagcacuuacuguaagagguaaucuacaagguauguauuuugauuugauguuucagaaauauugaagagugacauucccauuuauuccaccuaugaaauccaucccaagauuaauccaugaauguucccaagacaggaguuagggaaacaagaugaaauaaaacagagcaguauuaacuagcuacauucagguaaaguguuuuggaguaaggaggucuuccauaacccuccuuacuccaucauuucucucugguuauccuacuuggggauaggucacuauacauaaauuugaguaagacgguauucauacagaucuguaaagaggacuuagaagcaagaugaaauggcuagugaacucuacaaugcauacaaaacauauuucuugagcaauuacuagggaggccauaaaaggaugguaagaaggcaguacaauaugagaguuaagaaagcagacuuucaugugagacuacccauguuuauauuccauuuccaucacuuacugugaccuugaacaaguuacuuauucuuuaccuugauuuuuucaacuacaaaguguagauacuauguaccucuuagaacugggaagauuaaaugauauacagcaguguaauacacauaaaccaauuagaauuguggcuggcacacaguaagcacucacuaaacuauuacugggguuaaaauuauucaauguucuagguguuauaaacaccuucaggaaagaggugauauaugaucuggcccuuuuauggauaaaguagucaacagagagggauauccagaaagaacagagaugaacagggcuugaaagcugauguuugaccuaucagauccuauaccacuacaaaaucacuaguuuuuaaaauacagugcugacacacaauaaaaugucaguuacagaaauagauucccauaccuuuggucuagcaguuuuaccucuggaauauaucuuaccacaauacagaaacaauaucaaaaaguccacuucaguauuguuuguaacagcagaacuuuggauacaaccaaaauuuccauaaacuggaaagcaauuaaguccugauaccugacaagggaauacucacagccauuuaaaggacuaagauaacuauauguguauuaacgugaaaaucuaugauggaauauuaauuuaaaaagaaaguuucaaacaauauuuuuauaaugaucucauuuaugcaaaacaaaauuacauagauauaucuguauaugugugaaaaugcacagaaaaaggcauaggauuacauacacuuacaauuuacaccuagggauauaaaaaaucuucaacucuuacucuguaucuuccucuacuguuuaaauuuucaguucacaguuacuauaugauuuaauaaaaguggaaaaagauacugcaauuuuaagauuccuccaauauaaaaaaaucaaauggauaaauaaaaagaaaacauuacucacaguuuaacauuuggugaaaacuuuagacaaguuugguuuaaaggauauuacccccucaauagaauuaaauuuaucuacauuguaucuuaaaaggauauuacccccucaauagaauuaaauuuaucuacauuguaucuuauacaagcucuucuuuuuugacauuuucugaacagcaacuauguaaguuuuaaauuacuccuaguucauuugaaauagauaaaauaaacagugaaacaguucuucaaagaacauuggaaagauagugcaagagaacuacacaacagucauaguuuauagguccugcaauaauaauguauagagauuuucaaguucaaagacaaccuaagggcaucaucaaaucaguaagaacacuauauagaugcuggcauugcuuauauuuucuucauaaaaguacuucuguacuagaaucuguaagggagggaaagagaaaagaaaaaaaaaugucaagccuguuuagagguuuaagcaauaaaagaagaaaaauugcuucaaaagaucacugacuuggcugggcacaugggcucaugccuggaauacuagcacuuugagaggccaaggcaggaggaucaccugagcccaggaguucuagaauaacuugggcaacacagcaagacuaucucuacaaaaaaaaaaaaaaaaauuagcuaggcaugguggcaugcaccuguagucccagauacuugggaggcugaggugggaggaacacuugagcccaggauuucgaggcggcagugagcuaugaucaugccacugcccuccagccuaugcaacagagcaagacccugugccuaaaaaaauuagaauuuaaaaaaacacauaacugacuugauuaaguggaaaacaucuaaaauuccuuuaaccauaaaaccccacacagauguuagcuacuuaacaaacacaggaaacugcuuaguacaaguagccaauuuuaguauucaggccuucagcuuauauaaauucaguacuuauucuuuuuuuuuuuuuuuuuuuuggagaugagucuugcucugacacccagguuggcgugcaguggcacaaucucggcucacugcaaccuccgccucccggguucaagcaauucuccugccucagccucccgaguagcugggacuacaggagcaugccaccacacccagcuaauuuuuuuuguauuuuaauagagacgggguuucaccauguuccccaggcuggucuugaacuccugagcucaggcaacccgcccaccucggcuucccaaagugcuaggauuacagaugugagccaccgugcccggcccaaauucaguacuuauaaagauguauauacugagcagauauuugguuuauuguuguauuguggaaauacauaaaauaaaggcauuauucaaauaaugaggacagacuaugaaacagauaagucaacugauuaacuauuuggaaauacaagauuaaguuccuauuccccucaaugaacccauauaaauuugaaauaaaugaauaaaauguaaaaguuaagaggcacacuagccaagagauggaagcaacccaaacgguccauuaacuaaugaauggauaaauaaaaugugaucuauacauacaauggaauauuuaaaaggaaauccagucacaugcuacaacauaaaugaaccucgagaauaguauauuaacuaacuaguaaguuauuauuuuuaaaaagagguauguacuaaauuacuuaaagccacuuuuuaaaaaauuacuaaacuauaaaaagaucaaauaaaccacuuacucuaacuucuuucuaacauuucaguggccaauaagguuaaaaacacaacauauaagacuaaaaggaaaaaggaugcacauaaacugaaucuguaaaaugaguaucuuuacaaaacugauguaaggaaaaaauauuuacaguuucuucaaauaaauuugaaaaacuaacaugaauaaucuucauagaaaauauaaauuaaaauauuaaugaaacuaaaccaacagugcauuaaaauaauucaucauaccaaguauucaaaacacaauuaaaauuaggaaaucuuuuauuacaauucaccauauggacauacugaaggggcagaaaaagaacugaccauuucaaaagaugccaaaaaugcauuugauaaaauuuaguacauuauuucuaauaaaacuuaaguaauuuaagaaaaagugauguacccuaaauugauaaaagauaucugcauuauacuuaguaguaaaacaacagcacuuccauuaaaaauaagagaaagacaaguauaaccucuguuaccacugacauucaacauuuugggggugguucaaaacucacgcaauaagagaacaaaaacaaacacaagggacaaauacuggaaaugagagaaaaaauaauuuacuggaaucaauaugacauuugagucagaaaauucaacagaauaaacugaauacaagaauucaguuuaguggccauauacaagauuaaaauaugccaaucaauagcuuccuauauuccaacaauaacuaauuaagaaaguauaauggaauaaaauauaccauacaugauagcaggaagaacuauaaaauaaucugaaauaaauuccacaagaaauguguaaaaucuauacaaaaacuaaaauuuuauuaaagacagaugaagggccugaaaauacauaaguaugccauguuuccgaaugggaauauucaguauuauacauauauuucucuccaaaauuaacacaaauuucaauguauaaucugagaauauuucauggucacguacaaaagaugauucuaaagcaugucugacauguuaaaugaacaauauccaaaacucuugagaaagaagcucaaugagugagaacugccuucuaagauaccaaaccaugcuaacauauuaggcugaaucauaugaaaccagauauucaaugacuuguggcuuauaaaaauaauuucgccaagguucaacugugaaauucacucaaagucucccaccccacuuccacccacaaacuucuuuccacguaguaagaaacagacauaagaguuuacuaaauauuuaauacuaauaaagcuuggugaaaaaccaacagggcucuuuccuauguuucacuacagugcaacuuacucaguuaaggcaaaaaacuaaaagggagguaaaagaagaagugguguaaggggagaaaguucccucuaacaauacuggacgaagaaggauaucuaagcugaaaacuaaaggaugagaaaaaacaaagaaccaggggaacaccacacuaggaagaaaguaaaaagacccuagcuagaaagucugcauguuucaaaacaaggagggucagugcuacuagacgacagucaaggaacuagaagggcuggaacaacaaggagcagccauacaaaguucuguggggcaaguuaggaguuuggauuuuauucuaaaagcaaugagaaaucaaauaacaaugacauuucagaaagauuagccuaaugcuacgugaagaaugaaugaagaauggggauucaggagaaaaagccaggagaucaaauuaggaggcuacuaugaaguucaaguaagaaaauagccaggguuaaggcgaugguaguggagaaggagagaaggagaaaaauucaagacauauuuuggagguagaauggaccucuccuagucuaccuccuacauaggguggagaaacaugaccuaguccuaaacaaagcaucuuuuuccuuagugauaguggcugguucaagaauggacacaugaccaaagcuuggcccacaagauuauuucaggaaccaggaaugacuuucauucuuguuuugguagucauaaggacaauauaaucauagaauuguaucaauauaaaacauuaauuacccuccaauauccacaguccccuucuuuuagcaaaagacuacuucuccacaaguuuuaccuggguacauggccacucagcaagagcugagucuuagauauggcugcguaagaaauuucuggucaaugggauauaauggaaaaugacguuggcaacuuguuggucaauuccucaaaaggaaguuaccuaugcugaccuuucuguuucuuauuucuccaguauuaguuuacuagcgcuaccauaacaaaauaccauagacuggguaguuuaaacaacagauauuuauuuucucacaguucuggagacuguaaguccaagaucugggugucugcagauuuguuucuccugaggccucucuccuuggcuuacagaugaccaccuucuugcuguauccccacauggccuuuucucugugggcauguaucuccgguguccuguguucaaauguccucuuuuuauaaguacaucagucagauggauuaaggcccacucauaugaccugauugaaccuuaauuacauuuuuaaaggacuuaucuccaaguacaaucacauucugaaauacuugggguuagggcuucaaaauauuaauauuaauguuggggacacacaguucagcccauaacaggcugaaacauggacaugaugcuagugagccacaguagaucuuguagaugaacacuccaaagcagagcuguccaauaaaacuuucugugauggaaauauucuacauaugcacucuccaauaugguagccacuagcuacauguaauauuuaaauuaaaaauuaaaaaaaauuuaacucaaauccuuagaugcgcuagccacauuucaagagcucagcagcaaccuguggcuaguggcuacaguauuggacagcacugauuaagggaugguguaucaagugcaagacagcagauacuuagaugugugaauaaccugaaggucuaccucuggaguagcacauaaaagaauaacaaacuucuaucuugccugauguguucuggagucucuuuguucaaaugauccauccuauaccuuaacuaauacaguuaauuggaaaugacacgcugcucuaacaaacuccuaaaaucucugguaaggcuuagagaacagguagcaaggaaacaucucaggcuggagaucuaaugaucugugcuauacaguugcagaacauuuaguaaaacucuugccugcaauaauuggaagggcacaucauaugccuacuaaguuuguaguucuaagaaaagcaguuagaaaaacucgaaauaugguguguuggcuauuuaaagaucaacaagaaagaucaauucaccuauaaagcaguuugcaagcagagacagacaugaaaacagugcuacuaaaaagaagcuuucucaguggcaaacuccgaccuacaagaguccaguaauuuggggccucccaggauggaaaaggcagcugcuucugugcucuaaauaccaggaaauaacuuugugaguucaaggguucucugucagguaguagcaaagaucaaguuaagaguguugcuuuuccaccuguaaugguuucuucuuagaaagaagacaggacagcagacauuuuguagcacaaauaccuucucucaauuauucagucaaaugcuaaucuagguacugcugugaggggauuuugcagauguaauugaaguuccuaaucaacugacuuuaagccagggugaucauccucagugagccugaccuagucaggugagcucuuaaaagagaucagguucuuccgagcaaaugagacuccaaacagcagcugagucuacaauuguucucucuucgcuguaucuucccuuccugacugccuauggagaacagcuucagccuaagcccauggauuccaccuugcccacaaucuucucccacuaacugccugccguacagauuucacacuugcuuagccagcccucacaaucauguaagccaaauuccuuguaauaaaucucuuaauacauaacaaucauauauaaaucuacuugcucugcuucucugguuaaacccuuacugauacaucauccaagacuauuauuucagauccucucgagguagccaggaaaccuaagggagagaggagcuagccuagcacagagaccaguaaauaagagaaucagcugguuuccaaaacuuaggacuaagagauauuuugcuauaguuauuguuacauagucccgaucuaagaaaaacagaaaagaaaucuauuauguuuuugaaagaguuuuaccaacaaacuacauuacuggccuaaaaaucuuacacuugaacuuuaaguaacccuaccggcccugcaucuauaccaacagguagggggcuacaaaaguuguacacuuccuagggaugucacacccuccaaugccuacuacuucaaauguggcuaaggaagauaacaaacaagaaagaaucaucuaaagaacuaagcaaaggaaacagacagcagugaaaagagcauuccucucauagaggaaaaucaguauaaccaagaaaauuacucaguagccagagcaaaguugucacaacuccucccccgaaggauuucauuauuaauauguaccaaugacugcuguguacuuccuauucuucccuucucuagaagaguuuucauuaugauuauccuauuccuacucacuacuacacaauggguugggugaaaagagggagagauaguuguuuauugcuuuauagaucacuagaauucucugaauuaggaggaaaagcauuuuguauauaucuuucacuuggagcuguauguaguaacuggaugggacuuugaauugauucucuugaggaaagaaacaauuagguguuggaagaaagguuugcacaaaugguagguggccagaagggugagcccaauucucaaaaaaaacaaagguuuagguuggagcuguaaaccugauagucacugguauauagauauguaacgacacaauaguuaaaaucaucuaaaugagaccagacacaaaacagaaaaggguccaaugagguaaauaaucaaaguauguuugcugugcgggguaaaaggaagcaagaugaccaacaaaaaacagugagguacaaacaggagaaggugguauuacaugaggaagagaggauuacauuuuaagaagcaagaaucagucaacugcuauaaaaaggaguaaauaagaaacagacacaagaauuaaauacuauauccaaaaagagauccauguaucuuugaaaaacaaaguacaaagaaaaauuucuaagaauuguuaaauacuggagugaggaaguucuccagaagucauaaaagaauaauacauuuuacuaaacaauaaauuuuuccauguugugaaaacaaugucaagggagaauacuguaacacauaacacuaugaaaaauuaauacuauaaauacuaucaacaaaucaauaagaaaacaacaagacaauccuaauagaaaaauagguaaaggauaaaccaggaaauuuucaagacauccaaaugaaaaacaaagauuaaaaaacuuauacucaauguugacaguaaucagaaaaaugaaaacaaaacaccauuuuuuguuuaacagauuuuuaaaacuaaguaaauuaaccacaucuaggaacauucucauacacugcugaugcaagcaaaacuugagaguauuuaucaaauuuaacaugugcauacucuagcccaacaauuccauuuccaggaauccaucccaaagaaauaguuucauacucaaaaauaacuguacaaggauguucacuucacuaauagcaauguagugaaaacaaucuaaaugucuaccaaaauaaaagaucaaauaaauuaugaacauuuauauuauggaacauucauaaguaaaugagaauaauguggcaaauauuaacauacucuaacacacacacacacgcacucagucucaagaaagaaacaaacauuugauauacaccaacuguuagcagcauuuacucuaagaauggaauaaaaagcccuauauacuagaagacauuuuuguaaguauaaauaccgucauuaguuuuuauuuuuaaauauauaaaaaucauaaucugaagacucaucucuucaauugauauauuugaagaaagcucaucaauaaaaauuucagcaagcaaaauuucuaagugguaccucugcucuuugugauaauuucacuacaacauaacaaggaaaaagaaugaaaagacguauuucagguaaugauuaauucugaagacagaauaauaggugauuuuucuauucuuuagaucuuuuugaguuugucaaguuuucugcaaauauguguuucuacaaauagguauaaauuaaugaauaacauuuaauuauauguaacgcuauauuuaaaaucuuaagaauuuucauccuacacugucuuguaauucaaucuucauauuuuaacauaucuccaccugcaucaaucacaaguauauuaauauagauacucuccuuucuuacuauaaaaccuucaagguaaaauuagaauggaugacucuuuaguauaaucuaguugucaaggacacucuagaaaaaucguacauacagaccucaucuuaagaacaaacaaaauaucaaaaaucacugaguauuccaggagacacucauaaaagauauaaagucuacccuacuaguauucaaaaaccaaaacaaaaugaucccuaugaucauaaggcacacaguuacaccaaaaaugaacauagaugccccaaaaaaguauaggauuuauacggggcuaaaaucaucuucacaguuuuaaauuauuacuaguuuuaucucaacaaaauuuaaauuuuaugaaucuagaaauaauguccccauuucuucaaaacccuuauaauaccuagguaauuuugcuagauguuaauaaugcuucuuaaauaaauuuaguucagagaguauacuaauagugauaaaacuauuagcuaauaaucauagcuaauaagauuagauaauagcuaauaaucacguggaaaacugaauucuaucauugugcuaaguuucaauguauguaaguuuuacuaacuacaauauguacaaauuaacuuauucauauuuaacauauacagcuauaauuuuaaauauaauuuuuuuucauauucacugggaaggaaauaguucagauuagacaaugaaaacagccacacauaggagauaauaaauguuugucagguaaaagaauuaacuccuguaggaguuaauucuaguaugugcuauacuagaggcuuugaaacaagacuguuuucauuauuaaugccauuaaaaaaauaaacauggcacagagaaagaaagagacaacaauggggucaaaggcauuucuaacacuaacuguaacacaaacaggugggcuuccuuuucuugucaaucuucacauuuagguugacaggaaaagagggaaaggaaaauagaucucuaugguaacauauauuuauucuaaauuccaaacuaauggaaccaaccuuuccauagauacuuccaaaauagguuucaaucaaauguuuuuaagcuaauuaagagaugauccauaaagaaacccagaccaagaaauaacuuuagagcagguucuuauuucuucacuuucguauuuuucuuuucuauuccuuucuuuugugggggaagauggggauaaaaaaagugaaagguuaaauuaggcaagcuaauaguauuuuugggaaaaggaaagggggaggcaaaauucccugcaagagaggcacagccauaaagcaguuccauaaaugugccauuucuacaauguacuuucaaauaaucucaagaaauaaaaaaugaauuuauuuucuaaacugaaauagcacuaucugguacacauuaugauuuucucuaccuuauaagucaguuugaguaugaaguaauaagcaauaagaauauacuuaaguaaaaucggccgggugcuguggcucacgccuauaaucccagcacuuuggaaggccgaggggggcggauccaaggucaggaguucgagaccagccugacuaacauggugaaacuucgucucuacuaaaaauacaaaaauuagccgggcgugguggcgccggcgccuguagccccagcuaccugggaggcugaggcagaagaaucacuugaaucuggaaugcggagguugcagugagacggcauggcgccacugcacuccagccugggagacagagcgagacuucgucucaaaaaaaauaaaauaaaauaaaaauaaauuaaaaagaaagaauauaguuaaguaaaaucuacaguccuccucaaucauggauuccaucucuagcccuaccaucauuuuuaaacuaucccucucuagaccucguuuuagucaucauuuucaugguacagcagccaaaaauauacauaaucuauuuugugcagauguagcauagcauuauuuaaaaugagaauuaugauucugguuaucgccaacgccuuaacuucacccuacauuauacuaagcuuuuaccaaaaaagcaugcuguauuucagaucauuuacucaaaacacauuuuuuuuacccuugacgcauaaaaaccuauuuaauauuuuucaauuuauucccaauaaucuuguuucccauucuuaucagcauaauucacuaugaucagcaagcuuugagaaauuucaccauauaucaaaauuguuuauaaaggcugcgcacaguagcucacaucugcaagcccagcacuuugggggccaaggcgggcggaucacuuggagccgggaguuugcgaccagccgggcaaacauggugaaacccuaacucuaauaaaaauacaaaacaauuagccaggcgcaguggcucacgcugcaacuccagauacucaggaaggugagaugagaauugcuugaacccgggagguggagguugcagugagccgagagcacgccacugcacuccagcauagaugaccuugucucaaaaaaaaaaaaaaaaaaaaaaaaaacagaaaaaaagaguuguuuuuaaagacacuaauaauggcuccaauaggaauuccucaaguacuguaacgguuuuuguuguuguuguuguuguuguuguuguuguugcuugagacagagucucacucugucgcccagacuggagugcaagggcgcgaucucugcucacugcaaccucugccucccagguuaaagcaauucuccugccucagccucccaaguagcugggacuuacuggcgggagccacuacgcccgacuaauuuuucuauuuuuagcacucugauguuucaaauguaaaaucuuuacauuuccuucuccccacucucuuuuaucucuagucucacucagaaguaaacuuaaaaacuaaccccaggcuggaugcaguagcucacgccuauaaucccacagcauuuugggagccugcggcaggaggaucacuugaagccaggaguucaagaccagccugggcaacaaagugagacgccaucucuacacacacacaaaaaguugacuccuuuaaaagaucauguaauguuuaugaguuucacaggacagaaggcagucuaaguuaugcuuucaauaauuagagcuauauuauuugaaguuucauagcaugcuuggggaaaauaacaguuaacauuucccuuuucaauaacugaaaccccaaauuauaaaucauuauaaaaaugauaccuauauugucccacaacucuacaucccuucaggaaugaauaauaauaauuucuaaagacaaaaaaauguuaagaagugaagcacuguuaagucagaaaggguauuuugcuucuggguaagaaguggauggacauaacuguaccagauagguaagauucaagggacuagaaggguauucguauuuacccaccaccuucaauucccuaaugacuuacuuuuuuuuuuuuuugaaaagaugaaagcugaaaaaaguuagguuugguguagguuacaccauggauguuggugccuccuacugguccuaacaaaaauauaagugguaccagcaggcacuacuucgcauaccaaugugaaguaaaaauucccuuucaucuguggucaaguauggaaaaauuaugaagguccucauuaaauccacauuuuuuaacccauuaaauuauccuuauaaaaauucagauaaacuacugucauaaaugcaacugcacugccucaaggaccuaaaaacuguuuuccuaaucaacuagauggcauaaucagguaacagcagaaacagauagucuagugaauuuccgagagucaaaauaugcuacuuugaugcuuauuaaacacugaaaacuuucacaauacuaacuccaguuaaguuggugagguuaaaaaugacuaaacuaaaaauaaugguucaauuaaaacaucccacagggaucuacuguaaauaauagcugcaaccaaguucuguuaccucaagacuugaagucccaaagauuucccacaguagguggcuaauaaagaaauauuuaugaguuauucuuacuacagagaugggacuucaugagaaccuagcagagauacaaagacuuacauaagacacaugguacuguauagcaggagauauacagaugaguaagacaaggcuuuugcuuucagauaugacaguccacagcacacaauguaaacugcuucauuaauuaaagggcaaaacaugaagauauaagagaaaagagaguaggcauaaggcugguuuaccagaaagaugugaucaaucuuggacccacuauuucacaaauaagccuucuuuguuaccacaucaucugcuuaguuagaagcaguuuccaaacucuuaauaauccaaauaaaugaccaaauuccccacuaaaucuguagugagaauguuucaaaguaacaagguaggagggagagggugggggucacagaacucuuugaggaucuaaugaaaauccugcacauauggggcuagagcagaaaggaagaaaaauaaagccuuauaagcaccuucaacaaaaucuuuuguuuaauaucagaggauucacagccuagccagaccccaaguuaacaaucucuauuuaaaagaaacauuuuuuuuuucaaauuaauaaggagagauuaccuugaaaaguaaauauuuugaaaggcaaggaauaagugguaaaucgccucuagaaagggugguuuuucaguaugaaguuuucaucuuguuaacaacuuaauucuagguggugggaauauggauuauuuuucuauacuuuucuguauuucuugcuuucuuuuucuuuagugaguuuuucagaagaacuggaaagaaaacuuggggugaccaacuugucuucaauggccguccaacugcaaaaaagcgucuccccuuauacaagccgaaugugccaauaucugaaauaugguacucaacaccauacagcauaacagagcaugugaaugagugagagaauaaaugaaugaaugaggaggcguagaaucuaacagucccagguucaaucccauucugacauuuauuagcuaugugacccugaugagguugccuaaaauccuucuaugccaguauguuuaccuguaaaaugaaugcucccugccaacauuuguauacuuugaaacucacacauuauucaagauguacauuuaaccacuuaagcucacucucacaccuccccaaacuuauaauauuuauucauugguguauuuuuaaaucaaggugacuuacaaguuuuguucaccauugcucacgcaguacagcacaauaccuagcacauaguaggaacuccaaacauuuauugaauaaugaaagaaauauagcagcaccuacuucauaggguuauggcaagaauaaaaugagaauacgagaaaauuguauuaacucauuuaacucucauaacaauguuauaagguagaaucuacuaucauuaccauuuauaccauuuacaugaggaaauugcaguagagauuuaaaaacucggccaaggucacaaugcuaguaaaugauggaucaaggauuuaaauccaagcuccaaaauccauacuuuuaaccuuuaccuagacuucacaaacaguagguacugaauaaguauucauuuuuauuuacucuuuaaaaauuuuaggaggcuuaagguacuuaccaggcauucaucaauuccuauuaguuuaacuggcucuccccuuaauacuuagagaagaucaucaucacuacgaaaaggaauuaagaaauuggaaaauguugaaaucugaacuucagcuauucagaagcccuggauccaagaagggaagaauuuccauuccuucucuucuuucccuaaaugaaugcugaauccucccuaaguacuaguuauucacuaaaaauguuuuguuuuuuucuaguacugugcuuaagcaggagagaagacaagauaaauuauaauuaagacagacuacugcuucaaagaucuuaaaaucuaguuuacaaauacugcuacaucaauuaagagaugaaacaagcaagcuucucugggcuaaucuaggauucuaagcauuacaaaaaaggaauuuagauagcacuuuuccaauaaaaaacaaacaagaauauuuccaaaugaagcugaacacagccuaauucugaaauauuuuuucuuucucccucauuuucaacucucuuuuucugucuguaaacagauccucccuggccuugcaaauccuuucaauacuaagucaguacuaauuuauuuaccggcucccuuugucuaaaauuucuucacuagguuuaucucuugauuuagucacagguuacuuacaaaaacagaugaaauucugaucaacuccuacuguauuuauacuuuaagcaucuucaacaaaaauguuucucccccuuugaauucugccuuagaaaauacuaagauugcagugcgcaguguggcucagaccuguaaucucagcacucugggaggcugaggccaguggaucaccugaggucaggaguucaagacuacccuggccaacauggugaaacccugucucuaauaaaaauacaaaaauuagccaggccugguggcggaugccuguaauuccagcuacucgggaagcugaggcaggaaaaucauuugaacccgggagguggaaguugcagugagccgagaucagacuguugcacuccagccugggcaacaagagcgaaacuccgucuccaaaaaaaaaaaaagaaagaaaaaauacuaagaucauucagucauauucaaaaaugcauucaauagaaugcaauguuauuucuaaaauaaaguaucaacucuugaaauuauaagauuuuuuucuuguaauagucaaaagcaauuuaauuaauuuuguccacuaauuugaaagagcaucauggcuuuuauguuagaaaauauauuuguauuuuccauauuggucagucacucacugaaaaccaagaaaauuaugcauuuucaauuuuaaauguaagauuuugugucaaauagauggggagagggaggcaaguagcucuuggucuuauuuguuuccagguauacccgaaguuaugcaaauuaucuaagacgugauuacccuauucugaaauacuuuaaaguaaaauccuauucucaauaaccuacuccaaugucuagaaauuauauucuuauuguucaacaauuaaaugaagcucuuauuugaauugauucucguuuccuuccauuuuuccucuuuuggcagauacagagauuauucagauagcauuucuuuauagcaaagcuauguauuuuuguuaaauuaaaguuauccuuucagguuaaauaccacaaaaccauaaccuuucacauuccuuuuuaaucuuuugaugauuuuuacuggaaggauaauuuuaaagaucauuuuaucuacuuuuuuuuauuguguagccuauaacagaaugaauuagagaaaagacaacacugugauuuuagccacaagacuuccuagcuccagaaaguuaggcuucugcugacaugucaguaaaaugguaauuaagagaaaaacauuacacaacucacccauuuagcuuacaguuuuauuugucuuuacuuugaucaaaagaugaagauggggcagagacaaucuguacuccuuuuugucugcucaucccucaucuguauagauuuuuuaaauggguacacuuuuuuuuuuuugagacagagucucguucuuguugcccaggcuggacugcaauggugcaaucucagcucacugcaaccuccaccucccggguucaagcaauucuccugccucagccucccaaguagcugagauuacaggcaucugccaccacacucggcuaauuuuuuuguauuuuuaguagagaugggguuucaccauguuggccaggcuggucucaaacuccugaccucaggugauccgcccgccucggucucccaaagugcugggauuacaggcgugagcuaccacgcccggccaaugggcacacuuucuuacacguauuucuccugacucaucuucauaaaugacaaacccauuguuuaacaccauguaaaagacaggauaagguauguuaaaaacauagaaauacuaccauaguuggugaaagucaacauaaccauuccuauauuacaaaaggaaaacaaaccugacccacaaaauaaacauaccuacaaacuuacagccauucuucaugauuuaaggaauuacuaaaaguucugcuuauuaggccgcauuccaauggacaaaacuaccuagguauguuaaguuugcagcagaauaucccaguaaguacugcauucaacuaucauaaccuugcucuaaaccagagcuuaauaguuucacgagaauuuaaaauuuuaaguaaugguauuuugccuauagcugcaugauuguguuaccuugcuauucaguaacuauuuuucugaaugauaucaggagggugauaaaaggaaauaaauuauuauuaaaaaguguacaggucugagacauuagaaaacuuugauuuguacuuuugcuacuacccaccacaaccacuuuccucuaaaccuuguuuuccuccuuuuuaaaauaaagggcugaauuaccuguaaaauguuucucaccuuugagaagaaucauacaauugaaugauucuaaguaccauaacaaauuuuauuagggauaaggaccccauuacaucuuucucuuccuuguuucaaaugccgccagagcaacacacuauccuaaacauccaaguaggccaauauaagucuaucaauacaaaccuauucucagaauccaacaggcuaaaagggaauaaaaacaaggacuggcauauuuuugucauacauacuucagcacuuaauaucucuaccuauacaacuucauccagucugagauaaaagagaaucuggucuucuacaaauagacaugugucaaauccuuuaaaagguacuucucuauuucaacagagaccaggauucaauaauuccaauuuucggaaaaccagacuugcaucaaaauaaguuccauguuuguggaagagaauaaauaguaagugguacuuuuagaugaaucacuuggucuccucuuagaacuaaguuuaaaaucagccuuuaaagcuguuuucccucugcugauaaagauuucccucuccaaauaaagauuuuucuagauucuauuucaggaaggagacaagagagugguaaaacagcuaauaacuaguaaagcuaacucucaguugguugucaguaugguauguuuuacugagccuuuggguuguaagggcuucugugaggaauaagguccugcaacgccgccugucuguggacccaggaaaaauuauaaaguuauuaugaaaccagaucacuaggacaaaccgagaggccuuccuauuccaacucaccacaaccaggccuggcuccaaagccuacccuuuggcugucccauauuacgggacaacagguccuagcuuaauucuaacucacuaaggaaacauucgaaggcauguauguauguacguguaaggaucaaauauauuuuucauccacuuacaaauguauauggucauuuguaauuauuuaaaguuacugauaaauuuauacaaauacagcaucaguucaucgaaaaucccugggagaucgaggaaaugaaguuacuucagcagccaggauaguuacgaaaaacccugcagaacaguauggaaaaguacagcuucucacgugucccucacauacacaaacacuuagcucugaguccauuacaaccuuacguccccccucaaacugcuccccuccaccucacaacugggagaaguugaucaaccuccuaguugguccccaagagacucauuuacccauuauuuuacuccucccgcuuugaucccgaucccgccucagacuaagguggcccuacuggccccaggcagaccacccccccaccccccggcgugcaaacagggaaucuaaccaauucccuccauccuuaaccaagugagccaucccaugauaacaggcuguucaccaacucugugaacuccgugguccucccacccccacgugucagcuacccucccccacauucccacaccucacgauuuaggccgagggaagaaagggggcagucgaaagccuggccccuaagagaucaacccacuggaaucugucccacuccaaauccccucccaccuucggccccuaucccuuacagucccuuccucccuccuuccuuugaaaccaggcccuugccucagaaaccuccucuuccucgucgucgucguccucuucuuccucgcuguuguuacugcuggugccgccgccgccaccuccgccuccaccgccgccuccaccgccgccgcuguugucgcugucgcugcugcuuucgcugcugcuggggggucggcaaguccgguuacgcuuggccuuguggugcugcugcugcggcggcuucuucuucaggagcaggucgcagacucgcaccaucccacgaggagacgaggccgagcgagcucugcugcugccgccaacgccgccgccgaccuccgccgccgcgggggggcccgccacagccgccaccgccggggggcucccuucuccuucugcagccgucgccgccgccaccggaaccgucgccuucuccauccccagggaaagagggagggcgcggacgggggaggggcguggggcuacgcucuaccgcgacuucggccgcacuggggccgacacagcaaucggugccgccuccgccgccaccgccuc

SEQ ID NO: 191483 - RNA, 41046 nt, Homo sapiens
uauuuggcauuagaaaccuuuuauugagacaagguaaacagugggcugaaaauauuacaggcugaaggaaggcugaggaaaccaguaugaaggcagcucaaaugaugaacuaaauauauuccaaagguacuauuuauacuuaaggcaguuuuaaaagugaggucuuaaccaaaaagccuuuacauggcauucaaaacaaaaacaaaaacaaaaaaaacacgggggggggggggucacuuaaaucucuuggauugacuaaaagagcuaaauuauguacccaaaaucuguacagcaggggccuguuuucagcaggaaagccuauguacaaguaagaaccucuuacucuuguaacauuguccuguuuuguuuugucuuauaagaauauauaacuccuauccucacagaguuaguccauaaggccucagugaccucacagaaauauggaguuaaccucuacuacagaacuauuuacacugcacuguaaauacacauauguguguccacccucacagcuaagcugucaaugccuugagugaagggguuacagcucauucguuuugcaucuacagugacaaugaauaggcacucaauacauacuuuuuuuugcaugaaugauaaaugaaaugauuuuacauuaccaccacuauuuacauuaacauuccuaccauuagccgucuccaaaauaaaaacacaaaauugcugccacauguucagcaguuuucacaauacagugugucuggacuuuuuaauguaaacaaacaugcuugauuuaccaauuuucagagcaaggacacaaacuuagcauucuucuaggaauggaaaacuugccaggaaguuacuucauucuuuuucucuuuuucaaaagugcaucucguagugccaacuguaagauaaaaaaguauugaaacaugauaacucuuggguacccuauuauacgaauuugguuacaugaaaguuuacuaaaaaggaaucaccaagucaauacaccauccugaaaaacuauaaaugauaaaauauuccaaaacagaucacaucugaaucgaggauggggcauauuacugcuaggaaauaugcaaaacucuugacugcuguucccaacucauggaggcauaagcucaaaacaggagcagcuauggaaugcagagacuacuauuuauuaucccugucuccagggauaauaaauaauacuuauuuggucuauguggcucuuaauauuuuggaguuguggauggaauacauugucuaaauuaaaaguaacaggaaaacagauuuuucuucauaaucaaucaccuuucccaauaucacauauauuccacuaaauauggcauguauggaucacucaaagauuuuauaauggcauucagcacuuguguagauuuaugauaacucuaucaauauaaaaucugaaacaaagaaaagugauaccuuacuaagaaaauguucuaaguauaugcuaacacuaacccuuuauaauggcucaaacaugaagauauuaacucagaaauugaagcccugacaauuguagcuuauggcaaaauauuuauucuaguuaauacaggcucuaauuuuuaacuuguuuaauuauuuuguguuggaaguauguaaagugaacaugaagaaugaaagcagugaauuguauaucauaaugagacucagucuaggcuuucaucuccuggaguuugucucuaaccagaggcuggguucuucaagauccccaggguagaacuggaaggugaagaauuuaacaucuagagaaaaagaagacugaaggaucagugucugacgcaaaccuacaaaagcccuuauaaaguuuuacaugucaaaagaaagcaaacauaguauuaaagaugaucaaaaauaaaccaaaauuaaaguuaaccaagaccaauguauacaucuuaaguuugugauggauacuauuccauuaauucccaaguacuauucuuuguccuagaaacuuuuaaaaaucucuagcuuuuauuuaauuuuuauuuuaaaauucuagcuuaaauuuuaacaagauacaccuaaaacaguuucgggguagaaguuaccuggcucuacauacaaauguucaaacuuuuuggauuuuaugauuuccaguugacucuuugccuuuaacucacaccugggucuugguaugucuuugcagaaaagcagaagagcugggauacuuaaggcagaacaaaaaucuguaaguucauuucaacuuaauuuggcuaaggagguauuuuccagauucaucuaauucuaucuuauuuuccucaucugcaaaauugguuuaaucacaguaacugcacauacuguuguauacugauuaaacaaguuaauaaauggaaagcccuggaauagugaagucucaugcuaagaacuaaauguguuagcuaauguugguuaugggaauuuacuuccacucauuaagcuuuguagcaaagcacagccuacucucacacauauuucaguuccuuccccuucaaaugccaccaauuaaagaaaaggaacagguauaucccccuuuucuucuuuuaucuuucuacaggcuuuacugcaagauccuccucuccuucccuaucguaugcuuuacuucccucuucuagucucaucccagucaccucuucauauucuaacaauuuacaguaagaccucauguacacuuucaagccagguaagauuccuuuauuuaagacacugaaauaucaccaaaggguaggggggugugugaagugugaugcuccuuucucacagggcccuuggggucacagggcaguuuuggggaugcucuguaacuguuguguccaauaggguagccacuaacuacaugugacuacugagcauuugaaauguggcuaguccaaauugagaugugcugcaguguuaacgacaugcugauuucaauuagcucagaaacaaaaauguacaauauuucacucauaauuuuuauauguugaacuacauguugaaacaauacuauuuuagauauacuggguuaaauaagauauauuguuacaauuuccucuuuuuuuacuuguuuauuuuuaagugauauaugugguucauauuauauuucuauugaacaguacuggucuaaaggggagaacagagaaaaucaggaacuuaaaaguuuauguuuauaaugaagagaucuugaagaaaauacagggcaaagggacacacauagaaauucugauuaauaucagguuccaaaugacaagaaaauuggagaacaagaaaaaacauucuugaaccaacaagugcauauguccaaugaaaucuuaauuuacucucaaaaagauucuucaaucuuugagaguuauuuuaugacucgaggugcuugaaaggaacaaagcugggcuuucccuucaugccagaaaaggcaugcuaaaaaacaaaggaaguagggguggggggagcccuaacuaaaauauaacaagcucacagaaaccuuauaaugaaacaaggccuaccaacaggguaauuaauacuuccucaacccugaaauguuaguuaagggccagugaaggacagacuaauggauuuaagucaauccuauuauaauuuuaggagaauguggcaaaauuuagaguacuuaaaauccuaaguggcaccuuuccuuucaccucaguuucaacagcuucuauuaaaaaugccgucauuauuuaaaugauguuguugaacacaguuuagaacuagaaagagucaacagggagagcuaaaugguaccuuaauucagugaauacugacuuggaacccacagacacagcacugcccuagagggcuggccguuacauucagugcuggcaggcugauccuuggcuagcuauuuaggaacacugauucacaauaugagacuguuuaacccagagcugauauccuggcaauucuucagaaugauauuuagauacacugcuacaccacaaggagagaaagauacaaaagcauaaacuuguuuuaucacaaugaauaacugaaauaaaugagcugccuaaguagcaugggauuaccauucaaaggccaugaauggauaaaauguaaucccaaagccuguaaacaucagggcuuucaaaagggcacauacaggaaggaucaugccaacacacuauuuauuuugcauugcuuuucugaaacuguuucugagauaucaccacacaaaauuauuggguuuugaaaaguacccacgccuggggccaggcgcgguaguagcucacgccuguaaucccagcacuuugggagaccgaggcaggcagaucacgaggucaggagaucaagaccauccuggcuaacacggugaaacuccgucucuacuaaaaauacaaaaaaauuagccaggcgugguggcgggcaccuguagucccagcuacuugggagguggaggcaggagaaugccgugaacccgggaggcagagcuugcagugagcugagauugcgccacugcacuccagccugggugacagagcgagacucugucucaaaaaaaaaaaaaagagaaaaguacccacaccuauaauccuagcgcuaugggaggcugagguggacagacugcuugaguccagcaguuugaaaccagacugggcaacauggcaaaaccccaucucuacaaaaaauacaaaaauuagccgggugugguggcagacgccuguagucccagcuacuuggagggcugaggugggaggaucacuuguagggagacccccugaaucuauugcuacagaauaaaagaugaaaugcuccucauuauuguaaauacaaaauugcaugcaagauuguguaaaaacaaugccagguugggcugccagaaugagccaacagcacaugaugugcuucccccugcagagagccuaugaacggacgugcagucagggagguuucacaucaccaagauuccuaucccagaaaagcagauguucauagcucugggaauggaaugugacccuuguggagagccuauaaauggaugcaugaggggcgccuguccauauggauaagauaggguuauaaacgcccuuaucuugccacggcucuuguaggucucuucaagaguaaggcauacuaccuucugagaauuuguggucuaaccaguugucuagcuucacguccuguuucuauugauuguuuacaaccaguuuuugcugcaacuguuacugcugauuaauaucuugcuaaacguagguuauggauagacuguguuucuguuuuaaggcucuguuagaaauugcugaugcacacacuauauuguaaauucuuaucucuguauacuguacuucugcauaccaauguuauguuaaagaauuacuucauccccaugugaccaucucaccucauaaucaaacgacccuaaaucccucacuaaccuacgcccacucucacuaaacuuaauaauaaauggugguauauccagugcauuggcagcaucgcaggaccagaaggcggugaccccccuggacccaacuuucacuaucuugugugugucuuuuauuucuccaccugccuuuccacuugggaacaaagaaagagccccguugcauugcgggcugcuggccagaucccgcaauaaucacuggagccugggaggucgaggcugcagugagccaugaggcugcagugaguugugacugcaccacugcacuccagccuggauagcagagugagacccugucucagaaaaccaggcauaaaauuggcacuaaaaaguuauucaauuaauuuugauauuauauuucacagaucaaaugucagagaauuuuagcaugggaaggaaccucauggaugaucuagcuugcauuccuuuacuuauacuggaggaaaauggauuccccucuggucccacagcugagucucaaucaagucaggucugggauuuacauacccugaauccuucucaccucuccaugcucuccagcaaugcucccauuaaugggaacucuccaacaaugcucuccaacaaugcucccaagacacacacaauaaugcccagucuucagaaggcgcaaguccgucucaaauguaaagcugucuuggaauuacagugcuguucuugccacccaagcuucaaguggaacucaccuguuuuucucggaaggaacgcuuauuuuuugaccggacauucuggcuauaccgcaucaucauaaaguucuucuguuuuuucuucucuuuauuugucgaacuggaaaauggauuuguuuugguuuucuuccucacaaauucuuuucggucugucuuuccagccuaccagaacaaaaaguuugauauuucuucuucaacaacauacuuuaggagucaucuaaucaacauuaaugucuccucugugucagaagcucuacuaggugccaagggcacagaauggacaggacacagucuuugcuccuugggaccaagaaauggccauacaguauuauaacagagcaaggggagcucgguggaagaaaagucauaauuuagccuggugaggucaggggaacuuccuagaaagggagacagguagacuguuuuuuuuuuguuuuuuuuuuuuuugcaggaugaaggcauucaugguaagggaaaggaggggaaagacagagcauuuccggaagaagggacagugcacacaaagguguggaggagaaaggacacauggaagacagaggaugagguggaacuaggaggggacagugucucaaacaaguggagauacagaaaaugauguuggaaauguaggcaggacacagacaugagcagccacagcacuagccacaggcagacuccaacuggcucuggcuuuucacuggugacuguaaacacauuccuacuuuucucuuagcuuugauaaauauaguggcuuccugacaauacagacauguaauacugccuuccugugcucucuaccuuguuuugaguggugguuacauggcuauauacaguugucaaaacucaucuaacuggcugggcgcaauggcucaugccuauacucccagcacuuugggaggcugaggcggguggaucgcaugaggccaggaguuugagaccagccuggccaacauggcgaaaccuugacucuacuaaaaauacaaaaauuagcugggcgugguagcagacaccuguuaccccagcuacuuaggaggcugaagcaggagaaucgcuugaaccuaggaggcagagguugcagugagcugagauugugccacugcacuacagccugggugacagagagagacugucgcaaaaaacaaacaaacaaacauacuaacaaaagcaaacccaaacaaaaccccucaucuaacugaacaucuaauaucugugcauuuuaauuucuguguuaauuauaccuuuauuuaaaacauuuuuaaaaauugccauucuguggcuauacaaguucuggcuuauguuucauuuuauuugcuuucuguuuaaaaaacuaggaaugauaugcucacucaccauugcaguugcuagucuugucucuuugucagacuuuggcuuuuuaugaaggcguucaaugucccgaagagaaaguaauucaccccuggggugagggaaaaauaacacaugaaacaagaauggaauucuguuuccugaugcuuucauuaccacaugagcugacugaaguacuaaaguggaugugccauuuuaccugggcucuucaucacugucuauuucaauguauuuccucuucugggauuucccgggggcagcaucaaguucuuuucucauuugggccaugcggauuuucuggaagucuuccugaguuaaaacucggcuagugcugauggcugcagcuuuggccuuccgcuccuccaugggcaugcuguucagcuucuuggacuugaaaccacacaagggcuuaaauggcuaccagcucaagugagagcucagccauuuaaauuguagccucccaacaaggcccagaauaaauuacgucuuaauaaacaccagguuauaagaugaaauuuucagacuuacgauuucuugcuguucuucaucggaagaguguugcacaucaauccauucaccaucagcauccuccuccucacugagacugguacuuucccauccaucugcgugaaaaaagcaaacccacuacugccauuuuauguugcacauucaacauaaaguugagaugaagcaagcaacagaaaaguaaugaaccuugaacagauacauuauuaaccaagaacugagcaauauuuauuguuaaauaaacaaugugccuuuaguuaaucuaaggaauaggaaauaggcacugaucaaguaucuaccaugagucaaaaccuuacaaucacucucucuaacccucauaacuccaaagaaaaggaacagaugcucagaguuuaguaaugugccccaagccacaccgcuaaaaaggcauccuacacugaaaucaugaaaaucaugucuaccuuuagggucauguucuuucaacuaaaccaacuguguccaucaaaacugcacuuguacauuuauccuggccacgcagcaggcaucuaauuuguccuaugcguguuacccacguaugagaaucuaguuagucauucagacaacugagguagaauauuugggauguuaaagaauccugaagacaccucaauaaaaagguaucaggcuucuuaauggagccaccacaguuuaaauuuucuaaaucacagacacugcaaucuuuccaugacucccuaugaucuuuaagagaacgugccagcucuuuugucuggcauauacauaaccaaguaugaaaaggucaccaaacucuaucucaagccuccugucuuucuauguuccaucuuguauccuacauucuaauaguuaguucccuaaauccuucaagacuuugcucacacuuugccuggaaagucucugcuauucuagcauuccuugccaaauaccuggcucaucagucaccaucucuccaaagcccuuuaaaaaaaaaaaaaaaaaggccgggugcaguggcucacgccuguaaucccagcccuuugggaggcugaggcgggcggaucacaaggucaggagauugagaccauccuagcuaaaacggugaaaccccgucucuacuaaaaaauacaaaaaauuagcuaggugugguggcgggcgccuguagucccagcuauucgggaggcugagguaggagaauggcgugaacccaggagguggagcuugccgugagccgagaucacgccacuguacuccagccugggcgacacagcaagacucugucucaaaaaaaaaaaaaaaaaaaaaaaaaaaaaaaccuaaaaaaaaacuuccgagguggaccugacugcucuccugcccuuaugcccccacccacuccaaucauaaauccuguuaacacuucauucuucagcccuuuggaagcccucuagagcagaaauaauaccauucaucuuugcauuggcaguggcuggcucacaacaaaugcuuaagagggcuuugaucaaauaggcugggugcacuggcucacgccuguaaucccagcacuuugggaggccaaaaugggaggaucaccugagguuagggguucaagaccagccuggccaacauggugaaacccuaucucuacuaaaaauaaaaaaauaagucaggcauggcugcacacgccuguaaucccagcuacucaagaugccgaggcaggaggaucgcuugaaccugggagauggagguugcagugagcugagaucguaccacugcacuccagccugggcaagagcgagacuccaacgugaggaaaaaaaaaaaagauuugcugaauaaugaaugaauggacaggaagaauacacgacucuggaaauuagaauggaguuccucgaguauuugcccacaaauucaacaugcauucuccuucaacaaggagaauuuugggggauuccucuaagggcuaacccccguaauuuuuucuaggcaacaaacacaagaucauugucuuucucaagcaccaaacagcaugcccuuggaugagcggcagccaccccgaaggucaugaaaaggcauuuccuaugcuagaacauaaguuccgcaagaggaggaaccaugcucaauugaucccccauacuucuaacagugcguggcacauagucauugcucaauaaauaucugcugaaugaauguucaaauaguauacaauuuaaaggucugcacagauacugcaggaguguuuugcccaaaauaagggugaaauaaaaaucaaccuucaucauuuucagcauucucuucuuucucaacuuccagaacuucugcuccuggaauguaaucuuuagcaucuaauucuccauauucuuguacucuugcuucuauggaggccucuguaggcuuacccuaaaggaaaagaaauuguuuguaauaaguugcuuagaucauaaaaccuuaaucaugaaagguagucucugaaauuaugaauuuauuuuauuuauuuauuugaagacagggucuugcucuguugcccagacuggagugcagugguacaaucucagcucacuacaaccuccgccuccugggcucaagggauccacccaccucagccucccuaguaguugggacuacaggcacgcaccaccacacccagcuaacaaaauuaugaauuuaaaagggagcacuauaaaaaaugcugguaaccaaaugacagcaacaguuugcuuaugucucaggucaaaauaaauccccagccagcaaucuguccacuauuuucuuguuguguuuugaucuagaucaagacacugguaguuauuagagaguaacugcucuaauuuuuuaagucuugaaaaacgucaucucucuuucuguuacauacaugcaucccuccucccuuccaacuugaaagagguaguaucuggcugugcaauagccuguucacaaaacuggcaucagcuacugacugaucuuugagauuccgaucuguuaauaacauuaaaagcuuucaagcugaaacagccugauaggucuucaagacacagucaucaucaaugaauaugugccaacuauaaaauauucagggccaugguauuugauuccaagcuuaaagaauacaaccgugugcaucauaaccauguaaucauaacagaagcaucauaaguacuaaaauccuaauuguaggaaauuucucucaguuugugagaccauaaccuuuagaccaacauaagugugcuuuaccuacccggaauuucuucugcagcaucugaggauucaguguucggaagaggugaaucaaaguucuagcagacaucauuacaucuguaaaauaauacuuuuaauuagaaauucuggcccauagaguacaaugagguaaaaaggagucacacuguacucuuugguguguagagaguaacaugcagcuuacucuuauccuuguguguuuuauacugagccaggucuuggagaaguucuucagucauggccagaggacaucgagcuguuaucuccuuuauagcauugauucuagaaaaagaaaaacaaaguuuaaaagagcccgaauagcaauuuuuucaugauucaacacaggaagacuuccuaaaaagauuaacucaaaaggaaaacacguugaguuuuauauagcuuaggucuccaaaacugcagcauguuagagaaugucagguaggcagccuuagagggcuuuuauuccaguuacugccauuuccucuacugguggaauaaggaacaguguccggcacacuaaaucagagaagcauuuacuugccaacucuaagaagagaugggacuagcucaaauaagaaagguuaaagucuuuagggcuauuauccugcaauauuuuccaaggaaaauaaaaagcugcuguucagcauaucacuuacuuaucaggacagauuagacaauccuuaaaccagugauuauacucauuaaguguuuuuuaaucaaccaaaagggcuacuaaauugcccuaggaaaaaagagugcuucaauaauaaaucacucguuccaggguucuaugguuugaauguucccucuaaaacucaugucgaaacuuaauugccacuguaaugguuuaaagaggagagacuuuuuuuucacuguuuuauuauuauuaugcuuuaaguuauaggguacaugugcacaacgugcagguuuguuacauauguauacaugugucauguuggugugcugcacccauuaacucgucauuaacauuggguauaucuccuaaugcuaucccuccccacuaccgccaccccacgacaggccccggugugugauguuccccauccuguguccaaguguucucauuguucaauucccaccugugagugagaacaugugguguuugguuuucuguccuugcgauaguuugcuaagaaugaugguuuccagcuucauccaugucccugcaaaggacaugaacucauccuuuuuuauggcugcauaguauuccauagcguauaugugccacauuuucuuaauccagucuaucauuguuggacauuuggguugguuccaagucuuugcuauugugaauagugcugcaauaaacauaugugugcaugugucuuuacaucagcaugauuuauaauccuucggguauauacccaguuaugggauggcugggucaaaugguauuucuaguucuagauccuugaggaauagccacacugucuuccacaaugguugaacuaguuuacagucccaucaacaguguaaaaguguuccuauuucuccacauccucuccagcaccuaucguuuccugacuuuuuaaugaucgccauucuaacugguaugagaugguaucucauugugguuuugauuugcauuucucugauggccagugaugauaagcauuuuuuaaugugccuuuaggcuacauaaaugucuucuuuugagaagcaucuguucauauccuuugcccacuuguugaugggguuuuuuucuuguaaauuuguuuaaggucuuuguagauucuggauauuagcccuuugucagauggguagauugcaaaaauuuucucccauucuguagguugccuguucacucugaugguaguuucuuuugcugugcagaagcucuuuaguuuaacuagaucccaccugucaauuuuggcuuuuguugccauugcuuuugguguuuuagauaugaaguccuuguccaugccuauguccugaaugguauugccuagguuuucuucuaggguuuuuaugguuuuaggccuaacauuuaagucuuuaauccaucuugaauuaauuuuuguauaaggugucaggaagggauccaguuucagcuuucugcauaugcuagccaguuuucccagcaccauuuauuaaauagggaauccuuucccuauuucuuguuuuugucagguuugucaaagaacagaugguuauagaugugugguauuauaucugagggcucuguucuguuccauuggucucuaucucuguuuugguaccaguaccaugcuguuuugguuacuguagccuuguaguauaguuugaagucagguagcgugacuccagcuuuguucuuuuggcuuaggauugucuuggcaaugugggcucuuuuuugguuccauaugaacuuuaaaguaguuuuuuccaauucugugaagaaagccacugguagcuugauggggauggcauugaaucuauaaauuaccuugggcaguauggccauuuucaugauauugauucuuccuauccaugagcauggaauguucuuccauuuguugguauccucuuuuauuuuguugagcagugguuuguaguucaaagaggagagacucuuaagaagugauuaggccuaauguuguuaucuugggagaaggucccuuaucaccagugaguuauaaaaaagugaguuuggcccucuguuggcucuugugcucucuuccccuugugccuucugccaaugaugcagcaacgaggcccccaccaggugccagacagacaccaaugccaugcccuuggacuucccagcuccagaacuaggagccaaauauuuauuuuauuagcaguacaaaguuuacggugggagaucagaagaaaagcacuuaguuugcuaaucaauuauucaucuguaaaaguaaaacugcuaaaaaacaaaaaugcuaauuagaaggaaaaguaucuuuucucuggcucccuucucaaaauucugaccaauaaaaaaauuaucaagccucccaaaaagacugaaauauauuuuaaaccaauuuuauagaggugauacuaccagcuacaaucuuacaucuugguaacuuauagcaaaucuaguccauuaaacaauguaucuucugccuccaaccagauucuacauacccuacugucaugacuucuccagaguucuugucgguaacaaaauuguuugccacagucauaagcaaugauugaauaaucugaauuggaaacaaaaaagagaugggugcugauuaaaugucugcauacacaaacacauaagaaugaaaggacaauagauuauucauaguggaaaacccagccuuccaccuucaguuuaggaauuggaaguaaucaagauuaaggaagacagaagaaaacacuccacuuaggaauucaguguuuuucuuggcuauccucagacuaaaucaaagaaaggaauuacucuauaaauuuacuaauauucuugaccuccccuaguuauacaaaauuugcuuauuaaagaaaaucagaauucuaaacaacuugucugaaagaaacuucuuuuuaugagacguacaacugaacuucuguguagauccccuuaagaguuagugucucuucuaucuauuaaaagaagaaaacggugagggaaggggggacaguaacccuugugggaaaaaugacccuuguugugggaagucagagaccccgaauggaggaaccagcugaagccauggcagaagaacauaaauugugaagauuucauggacauuuauuaguucccaaaauuaauaauuucuuaugccugucuuugcugcaaucucugaacauaaauugugaagauuucauagacauguaucauuuccccaaucaauacucuugugauuuccuaugccugucuuuaaucucuuaaucccgucaucuucauaaacugaggauguauguagccucaggacccugugaugauuguguuaacugcacaaauuguuuaaacaauaugaaaucuugaaaaaagaacaggguaacagcgauguucagggaacaagggagauaaccauuaggucuggcugccugagagccaggcagaacagagccauauuucucuucuuucaaaagcaaauaggagaaauauugcugaauucuuuuucuaagcaaggaacagcccugagaaagagaauguguuccuagagguaggucucugaaauggccgcucuagggacaucugucuuuuaagguuguagauaagggaugaaauaagccccggucucccguggcacucccaggcuuauuaggaugaggaaauucccgccuaauaaauuuuggucagacuggcugucugcucucaaacccugucuccugauaagauguuaucaaugacaaugcgugcccgaaacuucauuagcaauuuuaauuucgcccugguccugugaucucguccugccuccauuugccuuguaauauuuuauuaccuugugaagcaugugaucucugugacccacacucuauucuuacacucccuccccuuucgaaaaucacuaauaaaaccuugcugguuuggagcuuguggggcaucacagaaccugccgacaugugaugucuccccuggacgcccagcuuuaaaauuucucucuuuuguacucuuucccuucauuucucagaccaucugacaagaaauagaaaaaaacccacguugaauuaucgggggcagguucccccgauagacccugaaguaccuaacaguaacacugucauccaugcccuagguccagaagucagguuacagguucucaccucuggggguacuaggugaugagaugcuugugcagcaaacagaaggaucuugguuacuucugaaaacauaagagaacagaaaggucauggucaguguaucacccugccucugaggaccacagcaaacauggcaagcucauucuggucuaaaugguauugcugcguauuccaccuggaacacucaauccccagauaucugcuuggcuuacccccucacuuucuucaggucccuacucaauagcugccuuaucaaaaagucucuccugaccacacaauguaaaacagaacccgucccgacacucccuauuguccuuauccugcuuccuuuuccuucaaaacacuuaucuuuaccuggacauauuauauauagcacaucuacaucugccuccagauguaagccaugaggguaaggaccuuguuuuacguuuacuguggaauucguacugucuuaaugcagugccuggcauaaaaaucauuaaauaaauacuugcugaaugaaugcauacacacacacacacacacacacacacacacacacacacacacacacugucucuuuucaaaggggcagcauagcauagguaacaaacaaggccacuggcaaaagaagugaggugaauccugauuuuccauuuauuugcugagugacucuagucuuuuuuuucccucucuuuguauaccucacaagauuaaugugaggauuagacaaaaugacguauguaaggcacuuagcacagugcuugguccauguuagauacugaauaaauguuaguuuccuuccuacuuugguucagguucaaagacaagaacaaucaucucuucuuuccugcuuuuguguuguuuuucauugagaaugcaugcaaggucaaugugagcagugagaucaaaucuuaauaucuauuaugaagaugcaauaaaacgucaauuuuuuaaaaaagaauuuuccaugaguauuuacaguauuacaagaagacuugcuuugagaaaccaauuuguuguuguuguuuucuuuucuuuucuuuuugagacagaguuuugcucugucacccaggcuggagugcaagggcacaaucucggcucacagcaaccuucgccuccuggguucaagcgauucugucucagccuccugaguagcugggauuacaggugcccgacaccacauccggcuaauuuuuguauuuuuaguacagaugaaguuucaccauguuggccaggcuggucuugaacuccugaccucagguaauccacccaucuuggccucccaaagugcugggauuacaggccugagccacugugcccggcaguuguuguuguuuuaaaaaaacaauaguuucuuaaaguugaggguaacgacaaacccauagcaaacucuagaaagaaaacaagggcuucucuucacaucucuaauguagagcacacugcacuccugucuuuagugauuccagaacaaaagacuuugcauguuuauucuauuaccaaggccaccaaagaaacauggcaaguggcagcuuaccucuuugguggggcugcagaaaccuuugcaaaaagggauagaaauugaagaggaaaagcuguggagagaaaaccgacuuuaauacugaugcagcugacacuauggaguuccauuucuucucaaugcaaacauaucaccaagcucaacuaauugcagaacacuuuuguuuuuuucucaguaagcaaucaugcccuaggaugauucaauaugcuauauuaaccaaggcuaggaauucucucaaaugaggcuaugcugcuauccuuauuauguaaaggaggaagcaaguauaugcagaaugaacuagaggaaggaaagguaaacaaaauguaacauucuucuacucuuaaaacugguguggcugcagaaacuaacuuuuuaguguucuaaggagaggggauuauaggaaggaacagcauugauaccaaggcuccaaaacaacagacaagaucggaauucaaaucugaauagcaccgaguauaauuuaaucagcaaagcucacuccugguuauauucuuguauaccaguccaaccacguggaaggaguuggguccaaccacauggaaggaguuacucugugcaccauaauucagagggaaaacguuaacacucugaaguccaccuaaacaaaggugaccaggguuauuaaggaaaugguaauguuuaauuucaagaagagaaacuggaaauaaacuggucuuuuucaagguauaucaguuaggugggaauaaacuaauuuuuucuauuuuagccacagagcaaaaguaggaugggccacugagaaguugcagggaagacuuugguugaacauaaugauggauguucaauuguagucaguugugaaacuccaguaucauuucccucaaaccacgcuuaaaucacaaaucacuuuuucuuuccuguagagcucaaacucagucugaaugaaauugcugcacaaauguaacaagaauugauccuacacugggacuacagccauggagaaaaagcaauguagucagcaaaauguuaacagguuuuucucagagaaagggaacaauuacuuucacucauguguacuuucauuuucaacgugauauaugucuauauuguuugaaaaguguuuuucuuuucuuuucuuuugguuuuuuuaaauggauguucagagcagcaccagucacgagaucaaaaugauaaggaaaaaccuuaauggucauuucuucauggcuuaaauuucuggguaucucuuuuucuacaauggcaucuagucuaacaguauguguaaaguucccauauauauaccacugagaaacucuugcaacuaacauuuguaaacaugacaauuuccuacuagagggaucuggaagucaggaaagccaagaagaguuaaacaaacagugagauguaguaagucaauuaaaauaugugcauuauauuggcucaagaaaauguguaugcguaacaaagugaacaaaaagaaaguaaaaaagcagaacaggccaggugcgguggcucaugccuauaaucccagcacuuugggaggccaagguggucagaucaugaggucaggaguuugagaccagccuggccaauauggugaaaccccgucucuacuaaaaauacaaaaaaacuagccaggugugguggcaugcgccugugucccagcuacuugggaggcugaggcaggagacucacuugaacccaggagguggagguugcagugagccgagauugcgccacugcacuccagccugggcaauagagggagacucugucucaaaaaaaaaaaaaaaaaaaaaaaaagcagagaauaaaauagccuguccauaaauggaauauauguacaaauuaacauccacauuacugcaaagaaaaugaagugauaaaaauaguuauuuucagagauguuacucuucuguaaauuuuauguguuuaaauguaugagggauaaaauuaagccacugcucuaccuaauggcuuuucuuuuaccaugguaaauucuacuucaaauauucaccaagagaaacauaauauaauucaaaccucaugaauucccaccaaucuggagauaagguucaugagcaucaucuucacuucaaaccucuccuuacagcacucaagcugcuuuaguaguuuuuccgcaaaaucuggcaaggagaggaugaaagaaguacauugugagucuauggucuaugugacauuuauguaacaggcguaggaaaagacaauaguuagaucagugaauagacugacaaacaggugaauaugucaauauauguaauggugcccaaaguuaagucuuaauaauucccaaguuuuuuagcaucaacaucuagagugacuguuugacaggugcucgcuucacuuaauagcucucuagauccuugcuucuuaaagggguaguccacagacccagcagcugcugguccaccggggaggcucauuggaaaugcagaagcucaggccccaccuccccaggugaucuguaucuacaugcaaguuugagaaacacugaucuagagcaggggucagcaaaucuugccauacauuagaguacugagagccccaacgcccagcuacaccccauaccaacuaaauuagauucucuggagauaacaggacccaagcaucaguacaguuuuuauaaauucgccaggugagaccaauguguggccuaguuugagaacuaguguucucgaacaagguuucccagauuuuugguuuccacagacuagguuuuuuuuuuuuuuuuaaaaaaggaccaacaaaagacugccaguuuauuuggucaaguacaaugcccuauuacaauuguguuguuaaaaacaugaaucucagaaacauccguuuuuccauauuuuucuuguucugcgauagacugggaaucacugcuuuagaugacaauuuuguagguuacaaccaacuaguaacaacuaagcauuuauugacuaucuacuaaaugccagggaucuuauauucccugaaaaccccaaaggcaggaaauaaaauaggcagagauaaggccaacaaggaacucggacgucauaauaacguaccuuggggaucaugaaucaagugaauggcugaaaaguuaaacaccucugguuuuuucuucuuuuuuuguuucugaaagggagaggaaaaacauuuucagucugaguuacagugaugaugcucuuagaacuuaaugugcuaauaaggcuguuauaaguccauuagacucuuuaaaaagaaaaaaaacuuuguucuaaaaaccuuuucaacuagaagaauuaaaguugguuuuugccuuuuaagauuaaauguggggaauguguuccaaccauuagcaccuaugagacuuacaggaauuuggaaaugcaaacauuaauaauaugguuuggcucuguguccccacccaaauuucaucucgaacuguaaucccugcaugucgagggaaggaccuggagggagggaccucgugggaaguuauuggcucauaggggcaguuuuccccaugcuauucucgugauagugaguucucacaagaucugaugguuuaaaaguguuuggcagaucuccuguagugcucucuccugccaccauguaagacaugccuugccuccccuuugccuuuccccaugauuuuaaguuuccugaggccucccccaccaugcagaacugugugucaaugaaaucucuuuccuuuauaaauuacccagccucagguuguucuuuauagcagugugaaaacaaacuaauacaauuaauaaacacacaagggccaaauuaaugacuuucaaaauaaucauuacaaaaauaugaaauguacugcauuuauguacucuucugacaaaacaugucuagcaaagauaccauaauacaagccaccuugaucagaacaaguaaaaagugaauuuaauuaaacuaauuuauccaagucacugauuuugcuagagcugaauacauuuauucaucuaaaauauuagugcuuaaaaauuuaucuaacauuucuaaguauucugaaaaugguacucugauuuuaaauucuuaaaagcucuggcuaacgacaacauauucuucacucuaaucacuccuaucucauuuuccagauacaagucccaccuugagcacuuucauugccuuuuccaacuuuuucuuguuuuuggaacuuuucuucccuguagcauauuguacuagcaggucucuugcuguugguccaucauccuaaagaagaaauuacuuuguaaaauuguaaacaaggaaaaucugcauagaaugaaagaguaaaccuuucagccacuucuucguucuuauacucuuugcacacagcuauuaaaaaugaauacuacuuuuagacugggcgcaguggcucacgucuguaaucccagcgcuuugggaggccaagguggguagaucacuugaggccaggagcuugagaccagccuggccaacauagcaaaacugugucucuacuaaaaauacaaauacuuagcugggcuugguggugcacaccuguaaucccagcuacucaggaggcugaggcaggagcaucacuugagcccagaagggggaaguuacagugagcugagaucacgccacugcacuccagccugucucaaaaaacaggaaaaaagaaaauuagguggaaaaaauaugcccacaugugcacaaacagguacauacaaagauuuucacuguagcacuauuuuuuuuuuuuuuuuugagauggagucucauucuggcacccaggcuggagaguuauggcacaaucucagcucacuacaaccuccaccuuccagguuaaagugauacucccaccucagccucccaaguagcugggauuacaggcacacgccaccaugucuggcuaauucuuguauuuuuaguagagacggguuuugccauguuggacaggaugguuuugaacuacugaccucaagugaucugcccgccuuggccucccaaagugcugggauuacaggugugagccauugcacccagcccucauuuuuccuuuaaaaacuguuguugacaacccgcuugggucccuuuccaugcuguggaagcuuuguucuuucauucuucacaguaaaccuugcuacugcucacucuuuagguccgugccaucuuuaagagcuguaauacucacagugaagguccgcggcuccaaaaaaaaaaaaaacacacaaacaaagacuguugucuuccuuuacaaauauguacauaguuuacuauggcauauguauucccacugcccuauucugaaauaaguaucauuugcuuuuagagaguuucucucuuuuuguuauuuagguugccauuuacaauaaaauguauuagucauauacuguuuaaaagacguuaucacauauuccaguacuuugguuaccaaaacacuaaaauggggaaggauaauuuuuuuuuuuuuuuagaaauucuuauuuuaauauuuuaugccaucaugaaucuugauuuuuuuuuuuuccucaaaaacaugcuggugauggccagguacgguggcucacgucuguuaucccagcacuuugggaggccgaggcggguggaucgugaggucaggagaucaagaccauccuggcuaacacggugaaaccccaucucuaccaaaaauacaaaaaauuagccaggcgugguggcgggugccuguagucccagcuacucgggaggcugaggcaggagaacggcaugaacccgggaggcagagcuugcagugagcugagaccacaccacugcccuccagccugggcaacagagcgagacuccgucuuaaaaaaaaaaauguuggugacaauuuucauccuaaauuuacauagugagauauagguauaacuuuagaacuaagaucaagguugaauaaaucuguuuuauuaauuauauaaccaagauaaucuuacugaauacaagugacaaauuccaaguagaguaaaauagcauggcagaauucaauaacagggcaaaggugucaucuaaguuucuuucuaacuucagcagucauagacuuuacaauguguacucagagcaauaauaaaagguaagauucagaagcagcuaugauuaaacuaaccucagauucggagucacuguccuguuuuucaucuucaucuuucccaagaaagaaugucaaagcggcaacuaauaucuaaacaccaaugagaaaaaagucagcuacuugauucagcuuaaaauaaagaauaaauccuuuugaguaugcuuuauacaugugcaugaacuaagaucugaagaacaaauucaaagaguggugggauuuuuguucauuuuuucuuaauuaaaaguuguuuuauguuauuucucuaauaaauaauuuuaaaaacuagauaaaaacugcuaggcucuauauaguuauccuucaagacugucgagaauuucuacauccccuauaagaaaagugacauugcaguucuucuaacagacaaaagucaaacauugaccuuaaauuucuuuuagcagugccgaagcccaacggaagucaagaaucacaggagaaaacaguaaaaaaccacugaggcuaucauuuauuacauagcaauuuaaaaacucauaauucuauugacucuuuuaaaguucagaugacccaggaaagcaguauaggaacaaagaaagcaucacuuaacauaaacugcaugccugcacaucacugcaugccuggugugcaggcaugcaguuuaugcugagugaugcuuacuucuaacugcaugccuggugugcaggcaugcaguuuaugcugagugaugcuuucuucuaacugcaugcagaagcagaccauccacagacagagcuuacacacagcccuauaggugcucaccuuggugaccuuagagaaacaugcaguugugauaacauugacaguuuuugcaucauuccugggggaagacaaugaaugcuuugaaguaaauuuucauucuacuguauuucauagcacagacaauggcacaaaauaaaugauauaacaaauguuugugacguacuagaauucccaguuguaauauuuuaaaaagauacgaguugcuaaauuacuuaaccacagguaaaacauuucaucagauuuuagcccagacuuacgacaaaauuugcagccauuaagacagacuauuuaaagaauuuuuaaugacguaggaagcuagucaagugcaaaaaaaaaaaaaaaaaacaacaacugagaagaucggggacaguggcucauuccuguaaucccagcacuuuggagggccaaggcaggcagaucacuggaggccaagaguuccgguccagccugaucaacauagugaaaccccaucucuacacaaaauacaaaaaauuagcugggcaugugccuguaauuccagcuacuugggaggcugaggcacgagaacugcuugaacccaggaggcggagguugcagugagccaagaucacaccauugcacuccagccugggcaacagagcaagacuuugucucaaaaaaacaaacaaacaaaaauaaucgagaauuuaaaaacuauaauauauaggccgggcgcaguggcucacgccuguaaucccagcacuuugggaggccgaagcggguggaucacgaugucaggagauugagaccauccuggccaacauggugaaaccccgucucuacuaaaauacaaaaaaaauuagccgagcaugguggugcaugccuguagucccagcuacucgggaggcugaggcaggggaaucgcuggaacccaggagacagagguugcagugagccaagaucaugccacugcacuccagccuggugacagagcaagacuuucucaaaaaaaauuaauaaauaaauaaaaauuaaaaaaaauaaaaacuguaauacagaaaaauuucaaccauauuuaaaaauucacauuaaacaaaaaagacuggguggaaauaccauaaauacuaacaguaauugauuaaaaccacuuuuuaaauuucuccaaauuuucugcuguaaugaauauuacuuuuauaguaaaaaaauguuagucaauaagaaaagcaaaagaaaugaguuagggacacuguaucaacaaacugaaguguacgaagcaugauauuuuauauaaauaggaugaauugacuugaaaaucuucagagcggcagaagagagagcacagauuuuggagucaguuagaucugggucugaauuucagcucugccucuuaauagcuaaacuuuuacuaacucuaagaacuuccaugucauuacuuauaaaauggggauaauuccagauaagcuacaucuucuguucucaaguuguucuaagugaggucaugucaaagugcccgaccucaguagcugcucaagaaaugauaaccaaugucauuagucauuugaauugccucuauuuuuacuuccaacuuaaaucuaugacauaaguauauuaaagagcucaagcucaagaaaaguauuuguauaugugcucuguauuaauuacaaaugaaaaaagagucuacuucucaagagacaaauauauauacacuaccagauguuccuucuguagaguucaaucauuacaucuaaagacaucuuggcugcgguugcauugcuaucucuuaacaugguguacaugaaauuuugcaauaccugcagaaaaggaggagaaagaagacuuaaugcacugaugguacaaugcugcaaacauggaagacagaagaguacuuacuacauucacuuuauuguucuuguguuuugcauuuauauucuugauaucagucacaauauguguguauaaagucugaggaaaagaaacaaaaauauauacauuaaaccuaaccaacauuuuuaaccuugcuaaauuuggagaacaguaugaauguacaggaugacuuaauuuuaccuauuuuucauucuaucccaaaagaaacccaaaccaagcaaacaaacaaaaaagcaacuacaaagcaaagcaaaguuguccucaagaaguuaaacauggaguuuaauguaauacggcacaauucuccuagguauauauccuagaaaaugaaaacaucaguguucacacaaacauucauagcagccuuauucauaguggccaaaaaguggaaauaacuuaaauuuccacuaacugaugaauggauaaacaaaaugugguauauccauacaauggaauauuauuuggcaacaaaaaggaauaaaguacugauacgugcuacaacaugaaugaaucuuggaaacauuaugcuaagugaaagaaucuagucacuaaagaccacauauuguuaugauuccacuuauauaaaauuuccaaaacacacaaaucuauagugacccaaaguagacuggugauuaccuagagcuaaaagggaugaggaacaggauuaacuacuaauuggaauagaguuucuuuugggggugacaaaauguucaaaaauuguuugcagugaugguuguaccacgcugugaauacacuaaaaaacacugaauuguacacuuuaaguggaugaauuuuacauaaauuauaucucaauaaaaguguuauuaaaaaaaaaaugcuccaauuuaccaagcaccuaacugcaugcaggaaaauacugugaaugcauauaucacuggugcccacaccaugcucccauggaccacuuuuauuccacaaauuagaccaagaaguacaauugcuaaaaucaaacagugguagucucuuaauacuuugaaaaaaauuuuaaauuaaugaauguaaacuuaaauuuuucuuuccuuuuuuucuuuaaauacagcaguggucuugcuguguugcccaggcuggucucaaacuccuggacucaagugauccucccaccucagccucccaaaaugcugguauuguaggugugagccacaguguccagccaaguuucuccaucuuaaauuucuuucauaaaucuucagcuucuagucuuauauaagcaaaugcaaaaucaugggaaaauguuaauaacaacaaaaaaguuuuuugugggggagugggucaguuauagcugugaguaccaauguccugauuuagccagccaguauggugcaguaguaaaaggcuuggguucuggaaccagagccugggcuuauauccaaucccaccacuaagaagcagugugagagugggcaaguuacucuaucucucuuuaaccucagcccuuucaucugcaaaguaagaauaauaauaaugaggaucccucucucauagggcuuugugaguaaaugaguaaauacacaaagcucugagaauggugccuggcacaaaguaugcacucaauaaauauggcuauuaacaccauauagcaugcacacaaugguugcuuuuuccuguuaaaguuauuauuaacaauguaaagcaucgauaauucaagagacaacaaaauuuuaugucgccucaaggaagaugcagggaaauauuuguuuugcccuuuaccuuucgcagaaguuuaucauggcaacgaaaaaguucaaagaagaguucuagcaggcuugauggauugaugagauucuuauuucucagcaagaucaaagcuuugcaaaaugucucgggaaggaaaaaaacauaccauaagacaaugguaaaguuaacaaggugagaaaauacagcguauaugucccaagaccuuaaugucuuuuacuaacuagacacuauuguaggauucagaauagucagucucugccuucauggagcuuacacuggggauagagcagaacggaggacagacaagccaaguaagcauauaaaaaggaggaucuaagaaaauaagugucaugaaggaaguaaaacaggguuauguaauugaucaacagugacugagggagggccacagggaggucaaguaaggucucuuuguagugucaucauacggcaaaacccugaauccauaaagacaggugggauaacaacauaauacacuaaauuggaauaaucaaugagaguuuaugaccuuacgaggcauucuucugaaguaccaucagcacuaagaauggcucaacagcaguuguugcaugccugccccccgccuuuuuuuuuuuuuuuuuuugagacgggucucgcuauauugccuaggcuagucuugaacucuugagcucaagugauccugcuucagccuccugauuagccaggacuguagguacccagcuauuuuuuuuuuuuuuucuauuuuuaagagauagagucucauuauguugccuaggcugguuucaagcuccuggaaacuucucaaaugaugcuccuacuucagccuccuaaguagcugggauuacaggcaugagcugaugcgccuagcagcuguggcacucuugcuuaccaccaacucuuacauguagcccuaucacccaaauuuuguguuacccuucauuagaugaaauacaauccuugaagaauaguugauuccaagucuuggggcaggaaaaacgguaagaaugaauuuggaacuauuucugccagaauucaaggaugcuuucaaaaacaagggcaaggcugggcaugguggcccacacccauaaucucagcacuuugggaggcugaggugggagaaucacuugaggccaggaguucaagaccagccugggcaauguagugagaccuugucucuacacaaaaaaaaaaaaaauuagcugggugugguggcacacaccuugugguccuagcuacuuggcacgcugaggugggaggacugcuugagcccagaagcuugaggcugcggugagcuaagaucguaccacuguacuccagccugggcagcugagugacagacccugucucagaaaaaaaaaaaaaaaaaaaaaaaaaaaaauucagggaaauugcuaaaaggacuaagaagcuuccccuggcaagguggugacaaucugaacauaaaguaauuaaaauaauaauacuaaaaaaaaguuuuaaaguacauaaaaagguaguuauaaugucaaugaaauacauauaacuugacuuuuauugauuugacuaaguagguaagaauuacuauauauggauauuuuauuucuuccaaaaaaaauacaauguuucuaucuguguaagcaggacagagugaacaaaaucuugggaaugauucaaaaagucuuggaaaaauagcaaauacaccagguagaaagauagcccaguggcugauaagaauuguugguuaucccaauaaccaauuaaaaagagcuucuuccaguguguucaaugcuuccucuaaagagcaaugcuaacuauacagacgcaauccuuuaucuccuaguaaaggaaaucucuauuauuauuauuauuuuuuuuuuuugagacagaggcuggagugcaauggcgcgaucucggcucacugcaaccuccgccucccagguucaagcaauucuccugacugagccucccaaguagcugggauuacaggcacgcaccaccaugcccggcuuauuuuguauuuuuaguagagacaggguuucuccauguaggucaggcuggucucgaacucccgaccucaggugauccuccugccucggccucccaaagugcugggauuacaggcgugagccaccgcgccuggcggaaaucuuuauuauuuuuuaaaaaccuacuaaucaucauaaagcacuauaaagaaauauacauacacauuuuuuuccauuuaaaaaaaaauuuagaggugggaucuugcuauguugccuaggcugcaguguaguggcuauucacaggcaugcucauaccacaccucagccucaaacuccugaccucaagcaauccuccugccucagccucccaagaagccgggacuacaggugcaccuggcauauauauuaauuuaauaaugcccacagaccaguuuggugggguacugccaggaaaauaaaacuuaaagaaauccuaauuacuuggaaagccauuaagucucuauacucaaaauaucaaaucucuaugaccuacaaggacuucaagaguaacaugacauagguaaaagccuuuagacuagggguucaaguuuggagucccuugggcuauacugccaggucccauguaccagcugaguaucaaucaguugacaacccagggccugaaaccuuggcuugucugagacaguauucuuuuucuuuuuggccuaaucaaauuacuaaaauccuaaaguaguauaaaaaugauagaaauacaaaaaaccugagaaagucuaaaagaaaacaaauauucaucuaaagacuuggcauuucuacaaguugugcuauaggauauuaguacguuuugugaucauauuugcguacuuaucugcuguaaagagguuugaaaagcagauguauuaaauuuggaaaugucuuagucccuagaagcagagacugauuuauuacaagugauuuguuggggguaugaucucagaaaggaagugaaggaaggaggauagugcagagacacgcaaagcaaagcaaggaugugcccuugacuggagacuagcuuuagucccaacacaggaaaacacuggagcacauccugcauuggagucagagccacccugagguaaugggcugggcuuuuguaccacaugauaaugggcugugggcuacuaggguaggaggacaccucccaggcacuaggacuccgauuuagcugaggacaauguugcagagaaagggcagcugagggccaccagcagcugacauucacaacaaguggggcaaacagguacaccggccucgugaagggaaugucagccaggacucaaccccaaccacuaaaaggacaaugaugaaaugcucaaacugacugucuaauggguaaguuuacuaauuuaaggcauuauaaaaaugacaaguugugauuaggauucuacaugcauaugagauuugaaugacuagaagaaaucaucucaaaagguuaaagagcauccuguaggguuagugugcuggaagaauagaaagaucacaguguagcugaaaacaauaugauaucagaaacacaggcuggaagcagaucaugcaggcacuuuugagccagguuauuaaguuuccguuuuacucuaaguauaaaugagaagccauagaaggauuuuuaggaaaggauaauacauuauaauuuacguuuucugaagauaauuagcuuagaggcuguucucauuuaaauauauaugaacgcagcacacaugaacacagcacaauuuauucauccaacuacugguccuaccauucgcagaucuggauccaauacgguaugauugcaggagagaagaucuuucaccucuugaggaaaauuacuuagguacucuggguagcagugacuaaucuguaacaaagcaaaggcucuucugaaguugcucucuuucucuccuauaauucagaugcauacauuuaggauguucugcaaaacgagaguaaaaggcuauguuucauagaaguagaugguuccaaacaaccuucuuuuccuucuacauguuaauuucuccaacauuuaucaugguuucucuagucuuaguaauauuuauggcaugauuuaguaccugcuuuuaugaugaauuugaagaaaaaaaauagucuuaaaguuuuguccugguuaguuaugcaaaaagaucuagugacauucucuaacucaugauagggagaaaauaaaauuugcaaaaagggaaaguuagaaaaauauuuuaauuaaguucccauuccagaguggaauaagguugaguauuagugaaaaaacauucagcaaacuguguguuaauacuggucuuuauuuaagcaauuauauucuuaccugugccauaaacaucaccagcucugcuaguucuuugcuggguuuauuugguugcaauuugaaaaucuccacauuggauuuguagugauuauacugcuguagaaacugcagaaaaauaaaauuuaaguuugucacauuguauuacaugacuuucucaguacagacauucaguagagaaauucuuaguagaaacuguugacgaucacauggagaaaaagauaaugcaaaaguauauaaaaacacuccuuuugccuuaucugcauucuucaaagugcgcuuuuuaaagaccugagcacaucacagauaaucuaaagaacuuuuccuuggaauuaucacuacaaguuuaggcagcaugguguaagaacagagaagcaugaaucccaaauucagauuguagcccuguucugccaguuacuaucuaaaugaucccgacugcuggguguaguggcucacacuuguaaucccagcacuuugggaggccaaagugggaggaucacuugagcccaggaguucgagaccaaacuggguaacacagggagaccuugucucuacaaaaaauacaaaaauuagcagggugugguggcgugcaccuguaauuccagcuacucaacaggcugaaaugggaugaucacuugagcccagggagguugagacugcagugagcuaugaucaugccacugcacuccagccuaggcaacacggaggcccugucucacaaaauaaaaauaaaaauaaaugaccccuacuaccauauccauguaugcagagcacucaaaucagcagaaaaauaacagggcagaaauauaaauuauaucucaaguacaugaagcucuccagucaaaaucccacccccccacugccaccccuuuuuaaaaauuauacuuuuaaguucugguauacaugugcagaaugugcagguuuguuacacagguauacaugugccauggugguuugcugcacccaucaaccugucauccacauuagguauuucuccuaaugcuaucccuccccuagccccccaccccaacaggccccaaugugugauguuccccuuccuguauccauguguccucacuguucaacucccacuuaugagugagaacaugcgguguuugguuuucuguccuugugauaguuuucugaaaaugaugguuuccagcuucauccaugucccugcaaggacaugaacucauccuuuuuuauggcugcauaguauuccaugguauauaugugccauauuuucuuuaucuagucuaucauugaugggcauuuggguugguucaaagucuuugcuauugugaauagugcugcaauaaacauauguguacauguguauuuacaguagaaugauuuauaauccuuuggguauauacccaguaaugggauggcugggucaaaugguauuucugguucuagauccuugaggaauugccacacugucuuccacaaugguuaaacuaauuuacacucccaccaacaguguaaaagaguuccuauuucuccacauccucuccagcaucugcuguuuccugacuuuuuaaugauugccauucuaacuggcgugagaugguaucucauuguaguuuugauuugcauuucucuaaugaccagugcugaugagcuuuuuuucacuguuuguuggccgcauaaaugucuucuuuugagaaaugucuguucauauccuuugcccacuuuuugaugggguuuuuuuuuucuuguaaauuuguuuaaguuccuuguagauucuggcuauuagcccuuugucagauggauagauugcaaaaauuuucucccauucuguagguugcuuauucacucugauaauaguuucuuuugcugugcagaagcucuuuaguuuaauuagaucccauuugucaauuuuggcuuuuguugccauugcuuuugguguuuuagucauuaagucuugcccgggccuauguccugaaugguauugccuagguuuucuucuaggguuuuuaugguuuuaggacucuuguuuaagucuuuaauccaucuugauuuaauuuuuguacaagguguaaggaagggguccaguuucagcuuucugcauauggcuagccaguuuucccaacacguuuuauuaaauagggaauccuuuccccauugcuuguuuuugucagguuugucaaagaucaggugguuguagauguguggcguuauuucugaagccucuguucuauucuauuggucuauguaucuguuuugguaccuuaaaaaaaaaaaaaaaagacuaggucucccucugucacccaagcuggacugcaguggcacaaucauagcucacugccaccucaaacuccugggcucaagagguccuccugccucagccuccuaaguagcugggaccacagacguucaccaccauacccagcugauuuuucauuuuuauuuuuuguagagacgggaucucuuuauguugcccaggcuggacucaaacgccuggccucaagugauccucucacccuggccucccaaagugcugggauuacaggugugagccauagcaccuggcuccccucuuuuuuuaccucuucuuuuaagugucaguaacuuuaugcuagagcucuaggcaggauguguuaacagccaauagcaguagacacauggaaauaauaauagcuuccacuuauucagcacuuguuauguacuaagcuccuuaugcacaucaacucacuuacuuauguuuaguuguaacagccaccugauaaucaaauguuggaauucaccaggccucaauuccacaguuccaugccuuacagcuaacuacucuccacccauacauagucuaugucuuuaaauuaugugacauacacacacacacacaaacacacacacacacacacacacacacacacacacucuuucucaucaucccuaccugguccagugaacucccaauucacauauccagucaccugucugacaucucuguuuaggugucuaaacagacaucauaaacuuagcauggucaaaaaacacaacuugauuuccucaacaaaacugccaggcuuuuucuaagaacagaagucaagucccuacaugcuucagauagaaccacuucucucuugacccgacaccuccacugaauaggagugaggagagggcuacacaacucuuuaugcuacugacaaaauccucaccccauuucuucccccaccccacccauggcccagcuaacacuauuuacccgccuugagaugaucaggacuaaucucauuacacccuuuaugugcaucagucaccacaagagcccaguauucccuggccaucccucauccuccucacuguaauccucauuccacuacaauccugaaacucuugggguggggccaaggcaucuaaaucaaacagcccagucauucagaugcucuaugggaacagugguuuucuccugacacacugcuacgucguuucuuucucccagcauggaugagucaguaggcauccuccuuuuucaucaaugcuacuuccagagcacucauaucccuccagauuaauauccuuucuccucaacuguccucacccccagcuuugaaucuuaugccacaagacccacuauuccuccuuguagucaucuaaagacuagaguuauccucacauuccuucaacauuucagcucuuugcucacugucuucucacccucuaucucaauuccuguuauaauacuuggugauuucguauccacauggagggucuucccaauacucuggccccucauuacccugacuucuccuccucuaaucaucuugaacuuacuguaucuuagcacucacuuccauggucacacccuaaauguugucauuaccaauaacuauauuacaacuccauaaucucaacuagagguauauuccucuccaaccacaucucuuauuuuccaaacuccaacgauccuucaaucucaucagaauccacaguccacuaagccuacuaccuuuccacugcaccuaaguaacccccacgccaacuucccuucucauccagcuucaauuccaugaucaaucauuauaaucaccuccaugcguauacuucaacucacuugcccauuucucuuaucauuauacccauuugguaaaaugcccacccugugcuuuccuucucuacagcuauacucccagagcugaacaugguuggagaaaaucggcuaauuggugucauuuuauuuuuuucauuuuaauuuuuuuuagagccaagguccugcucugucgcccagguuuccgugcaguggugcuaucauggcucacugcagcaucaaacuccuggguuuaaucaauccaacugcccuagccucccaauuagcugggacuauaggcacaaauucauaacuacaaaccucaauuaagcccugcguguacuccagcaaucucauuacauuucucuagucccuucacuuucccacuuuucuggacaaccauuucauacuuugcaaucuguccuccaaccucacuuuuucccuguccccauucucagcagaugaucuuaucuccaauuucacuaggaauauaagcaaucugaggauaauuuccauuuaaccaccuaucuucuccugugcccauauacuuuaccuucucuccuacuacaaaagcuaucaggccaccaucuaaggcuagccccuccaguuaugcauuagauucuaaacccuguaaugucacucaaucaaggucuuugcuucacuaguccccaccucccauuuccugccucaacagguucugccccaucaguauauagacaugcuguucuuucugccaucuuaaaaacaaaacaaaacaaaacaaaacaaaaaacaccuuucuugguugggcaugguggcucaugccuguaauuccagcacuuugggaggcugaggcagaaagauugcaugguuucagcuuggagaccagccugggcaacuagcaagaccucaucucuacaaaaaaaucaacugggaauggugguugcacacuuguggucccagcuacccuggaggcugaggcgggaggauugcuugagcccaggagguugaggcugcagugagccgugaucacaccacugaacucuggccugggcaacagagcaagacugugucuuaaaaaaaaaaauccuuucuugauuccacuuuacucuguaccuucuacucuauuucucucuucagaaaaaguccuuuaaagaguuguccauauguuaccuaauugcccuccuuuuucaaaaaauccuuuaaauugagauauaauucauauaccauaaaauuuacccuuugaaaguauacaauucgguucuucaguauauucaccaaguuguacaaccauagguuuuucaucaucaccaaaagaaaccccaauccauuagcaguuauuuccuauaccccuuacccucagcucuggcaaacacuagucuacuuuccauccauauagaugcaccuauucuggacauauucuauucauauacauuucauauacauagaaucauacuccaauuguuuuuaaaccuucuguaaucagauuuuugcacccauuccucuucccaaacugcucaaugaaucaggguagccaaugacauccaugucgcuaauuuuuuuuuguuuuguuuuucugagauggaguuucaucuuguugcccaggcuagggugcaguggcgcgaucucggcucacugcaaccuccgccucccagguucaagcaauucuccugccucagccucuggaguagcugggaucacaggugcccgccaccacaccuggcuaauuuuuguauuuuuaguagagaugggguuucaccauguuggucaggcuggucuugaacuccugaccucaggugauucacccaccuuggccucccaaagugcugagacuacaggugugagccaccgugcccgaccccauguugcuaaauuuaaugguggucaacuuuugguauucaucuuauuugacucaucagcaucugaugugcuuggguucucccucccuugggaacaucuucuauacuuggcuuccagaacaccuccugguuuuccucgaaacuucacuggcugcuuucucagucccuuuuuccaguuacuuagaaacucacuggccuuuaaauguugggaauccccagggcuuucucuaccuacccaauccaggaucuaaucacccuucuuacuacuuccuguuaccauccuagcaccacucaacccagcaucaucucuugcuguggauaauuccaauagcuucuuauguggugucucugcuucuaucuuugcccuccuacauacagucuauccucaaguaacggugaucuuguucucauauagggugguucauguauucuucugcucaaaacccuguaaaggcuuccaucucauugggagguagaaucccaaauucacccccuuuccucauucccuauuuggagccacacuggccuuuauguuccugaaaucuaccaggcauaccuaccccaaggucuuuauaccuucuguuccuucugccuagaucauucuuccuaaacauaugcacagcucucccucauguccuucagguuuucacucaaagauuacuaucucaagaagaccuucccuaacuauccaauuuaaaacugcaauacccaucucacccccaacauacauaaguacuuuccuauugucuuuuuuucacagcacuuuucauuauuuaacauacuauauuauuuguuacuguauaucacccccuacuagaaugucauuuaaugagcauagaauuuuuaucgguacagcucaauauuauguagucccagggcccagcauugugccuuacauauagcagguaaucaacaguauuugucaaaugaacgaacuucaggaaauggcacuaucaucuaccuagacauauaaauaaaaaaccugggugauccuucauuccuucuuuuuuccuuaucccccacauccacuccaccagaaaucccaaggcucuacuagcucuaccuccacguagaacagcacgaaucuuugcccauaauuccaaugacaccacaaucccuugcuugguuauucugagauccauuauauuaguuacccugcuuccaguguugcuccucuacaagccauuccacauguaacuuccagaguaaauucuuaaaaaaaauaugucagaucaugucacucuccugcuuaaaacucuucaaucacuccccgaggcacucagagugaaaucuaaacucguuaacagggccuaagaggcucugaauaagcugaccccugccugcauuuccuacaucaucuuccacugcccucuucuaugcugacuacacuuuagcuacacuggcuucuucucugcuuuuuuuccaccaguagcuucugcacuuucuauuccuuguaccuaaaaugauguuuaccugccuggcucaauaucaucauugcagagccaccuucccuguuuacggggucuaaaucagaagccuccaauucuaaccuauucccauccaguuuuauuuucuucauaaucucuaccauaauaagucuacacucacuugaauguaaguccaagagaagaaugcuuucuuaucugucuuauucauuacuguaccccaacgccuaccuagaauaacaacacacaguaguuauaugugauuuugcauauauacuuaagugaauuaaagaaguaguuauuacccccuucuuacauauuaaaauacccacauaggcucagcgauuaaccugcuucgguuacacaacugguuaacaacagucagcagcaggaguuaucuaacggaauuauauagacucucaacuuaccacuuucuuugcgaauggcuauacaaugcuuuaagcaucucaaagccuugccuauguuacuuaacuucuuguacuuguuuccuacucuuuauuuccacuaccuugauccuuggagaggcuuucucuacuggugaccuaagccacugagauugccauguguuaaaaagcacucauaaaauacauauaugugaaaauuuaggggaggagggaagugagaagggcaaugaaaaaauaaguaauuguguuagccacugaacaaaucacaaucugguagaagcacaaacauguaauugcagcaaaugccuagcagagauaccuguuuaaugcccgucugauaaaugagugucugaaggaagcaccugucagauuaauauaucaaaaaccacuuucguuuugucgguacuugguucaaacaccccuaauguucacaacuuacaugaggucaguacacaaagcccaucacaaugagggccuaauuuuucaaccuaaucuuuucccgaagcaaauucugacauccgagucaugccagucuccgguaaguuugaauccuggcuuaacuaaauauacuaagcucccgagucuguccguugugcuugagaaacccccccccccccuuuccuggcacaguccaggguacacagccugcucucagaaacggacgucaaucgaaagcauucuaacauacgauucaucaaagguuaccgacuaauucaaguuugggauuucugaaaagaggcugagaaauccgcguggaaguuggugguugggugcggcccauuucucucuccacuuccgugcggacgaagaaaaauaucuuaaaacaaaaugagguuuuaaagguguuucagcggcagcagggcagguagaaaauccaaaggggcaacagauuuucaagagguggggaacgaacccuaaggcaugucccguccccaaccccuucucuccucuggagggaccccugaaccuaacagaagaauaggcggcgagccuggaucccagccccacuccaugcuuucccgcaccggcgucucaaccauccacuauccggccucuagcgucugccgcgccgcacucccaccuccucgauguaggccggcgggucucgcuugauuagauucuguaacugcggcagguugcugggaagcuuguuguuguuucuguuggacauuuuggcugcagacagacuucgcggcgagcaguuuuaaaaaaacucagacggccggcaccccgcaaucccugccagcugcagcuuggacucguguuuccggguaugaccggaaauagcgc

SEQ ID NO: 191484 - RNA, 55161 nt, Homo sapiens
gcagucgccggcgguugccucgcgggguugcggcgagcccggcccgcgaacgucacgucccugcgcgcucccugcacucucccgagcugcgcuaggcgggcgccacggcugcccggcgaaggaaaccgaaaccgaguccgggcccgucccuccgcggccccauccgcccggugcacccggggccgcgcucgccaggccgcggagcccagagcugcgcgcacgaaccgugcgccgggagggcgugggcguggcgccgaagggucccgggucuucgacgccucugcggcggcuccucccuccuugcaguuggaucccuggcgggugcggcccggcccggcccgugagcggcgcacagaaugggccgaugcugcuucuacacggcggggacguugucccugcuccugcuggugaccagcgucacgcugcugguggcccgggucuuccagaaggcuguagaccagaguaucgagaaggugaggcggggcgggcuguguguguguuguggagucguccagcucacccucccaucccugcugcuacaucuuguaugggaaagaccagcacucaggcagacccuccgcgcuagagcucuucuugcgucccugucuuccagggcuugguaggcgaggguuaaagaaggaugaggaaggauggagccgacucuguucccuuuacagugauaaguaaggcuauggauccugacuuuuaaaaaggccuucgguuguguucugucguuugcaucucuccccacuccuuccgucuacaccccaaucucaggugggcccaaacuuguuuccuucccacuucaugaagaaacagaacugaaugaaagacaccgcagaagaggcagguuauguugucugcuugcuguagccuuugaaguggugugcgccuggggaugagacgugggugugcggucuauuguguucuugcccucuugggcugggcaggggcaguugguagcugggccaguccuuuaggcugggugacaauucauccaucagucuuugcugaacgcugacuuaguggcuuuguaucuuguaccaacagucuguguugcuuugucucaccaugaauucuuguuuuucucaaacggccauaauuuucaggcacagaugcauuuagauacccuacaagaaucugaacuugucucuuccucuagaugauugggcuggagagccaguccuuuaagaagacuucaucuuuugauuucacuggucauuucaucugcccuuucccccacauccaccaagcugugucaaaagaggaacaaaagagaauuacugggaucauuuuuuccuuaaaaaagaaaaauaaucacuggagcagcagccuuucuuguuagcauccauaacugcacgcuucauuucucccacuggucugcacuugcugcggccagauaaaaaagcccaggccuagucuacuuugaaucacugcacucuccagucaguaaagcuauuuuauuccagguggcaauggauaucuuccuuuaacugaguuuccaaaaguaauuaagugaguaccugaaaucuggcaguuaaaggcaguuuuucaaaaagcaccauggcaaagcauaauguaauuuuuaaaguucacauugccaagggaagacaaggcccacugucugagcgucucgagggucaguuuccuuugagcaaucauguucaaggaaaaaagaaacugaauccuuucuccacuccuguccauguccaaauccauggugagcuguguuugaggauguaaacucuugcuuugggugacuagaguaaagcaauccaauuauaguaaauaugugaguuuucuuauauggccuugaaaggcuguuucaaggagcccuauaggaugagugaucuuccccgugguucccauauagccagcccuuagauucucugugugucuccauuucucugggugaggggguggcuguaaggcaacuuggcuggggccugaguuuguguugauauuuccaaguguuuuucuccaugaggaauggacucuguucugauaaguaauaguacagggaaguggacuuucagagcugcucaaucccagcuaaggaggacugcacgguguauuguaugaaacuaaaggacagggcuaguuucagugggcagguguggaaauacuguugucauuagagguaagucacacaucgcuauucugcuuuuuccuggauuaccuguagggugguagguagcaugggacagugggaaagauugaggauguuacacuccugggcaugaaaccuagcuuccacuaugucccagcucggugaccgugggcuguuuaaucuuacuugauucauguuuuccccaucuguaaauagggauaauaaggacuaacgaucacaucugcuuugucaaauaauucuuauaaccuuaaggugugaucuuucugggauauaguuagugcuuaauaggugauagcaacuuuauuuuuauuagaagccacacaaagaaaauacgugagauuuggagucagauuccauauguucaaauccuauccuugccaguauaagcuuuaugacuuacgucaaauaacuuacuugguccucaauuucauugcuuguaaaacuggggauaugagcuguuagcuaacuugggcacagugaugcauuuaccaugaaacucgcaaaguuaagcuuugggucucucacuugcacagacccuugcgaagcccuguaccucauucuauaucccaaauuuucuuuuuucuuaagaaggacccuucaaauuguauaagcuucaggacccacaaaaccuggauuugucucugcauguguauuauuguaggaccaaguauaaagcacuuagcauaguaucaggcacagaauagguaaucaauauguggcagucaucuuuauugccacuaguauuacuaugggagaauucauucauaacuugauucuaauguaguuauaauauaaucuacucugauauuuccaguucuuuguuuuuucauuugaagauugucuaugccccgacuugucuaugucaaaaagggaagagggaaaagggaugaaauucaaaugaguaggugugggaagcuuaguaagagaauuccuauccaaaaaguugucucaaaugauaauuguccuugaacccugcagugaccagagguaacugaagagagacuuuuaauuuuggccagugaauaucguggaaggaaccaagacaauuuuguuucauuuuuggccucaguggugacugccucguauugggcaaggccuguaauuguuucugcuucaauuuucucauuugcaagagaggcauaauaguacuucucuuuuucccacacccucuuccuaggggauauugugagcauuaauaaggcauuuccuuacaagcguuugggccuucaugaagagagagcuuugcagagacccagcaguuccuuuuccucccuuaggccuggaaaggcaggaguuuacguuacauuucaucugguaucccagugaacugccuugacaccuagcacagugccugagauacauauuaaaugccucuucacucgccugugaucauuuuaauagaaagaagaguguccugagaaucagcagaacugaaucaaacauuuuuuuucugucccuaaggauuucuuggacuaagcugaacaagcacaguggcaaguuauuuaaucccucaaauccuaaggauccucauuuugaaaauaggaacaauaaggauaagaauacuuaacucagaguugucacaagaaugaaauaauaugauaucuauaaagcacccagcacaaugccucgcacaaugccugaacguuaacaguuguuaugucuuuagcuauauuugucaucugugaauugaaacuuauuauacaagcuaugguuccucuuagcuccaaacuucugagaucccaugaccuuuaagagcagcuaugcaguucagaauauuaaguuugcgcuccuaaucucugcagacgugcuggcagguugacugucucccaguaauagggaugcagaacuggccacagucagggcuggccaacaagggaugggauggcaagggaaccagugggagacuguuuacaccuuugacuuccucuucacaggucaaggcaggacuguagcauuaggucucagagaugcaaugaacaggacaaauacacuuccccuucaucuggaccugaggcucugggcaagucaguaccagcugguuucuuuugggagccauagaaacucuggagcuguucuaccgauuccucaagaaguaaaauauaggccaggcgugguggcucacgccuguuauccuaacacuuugggaggcugaaucggguggaucacaaggucgggaguucgagaccagccuggccaauauggugaaacccugucucuacuaaaaauacagaaauuagcuaggcaugguggcaggugccuguagucccagcuacucgggaggcugaggcaggagaaucgcuugaauccgggaggcggagguugcagugagccaagauggcucccuugaacuccagccugggcgacagagcaagacucugucucaaaaaaaauaaaaauaaaaauaaaaaaagaaguaaaauguaaucacugauaaccagauugcuuugauuggugacuaugggaucuuguuuuuuaaagucaaaucagcaaaacaucuuuauugauguguauguaaaggcauucagcuauauaucauuuuaaaaggcuccuucuugcauaucuaccucaucuccugaguugccucuauucaaagaagacuuaucuuagucugagauuuuucuugaucagaaaaaaaccuguaaagauaucuuaaaucuguuaucuuacggucaaggaaauugaggcucuuggaauagaagugacuuaucuaaagucaaauggagagggaaggagagagcgugccagcuagccuucugauccugaacccacuuuucccaucucaaggaugaccauacaucccauuugccuggaauaguccuacaugguuucuguguaccuguugugcugguguaaucacuaacacccccuuuccuccaaaagauuucugcuuuggacaauaaauucuauggccaucccucaccucucaugcuacauuguccuuacagaccacaauguaucccgcuucuuggcucucuuaaggaguugaggccuacucaaacuagcucuggcaagagaggauucuuuuuuuuguuucuguaaaucuggaaggggaagcucauagaaaucaaagggcaagaaccacggcacaguaaggccuccugagaggacaaccgaaaguggaaagucagcaggaagcaggcacacucugccucccacuuuuuccucugcuuucuccaccaacaggcuuccucuguuuacucagccuggcucuguacucauccgggcuugcucagccccgccucagugugacuuuccagcuguugaccucucauagacaugcuucaucuccuaguuucucuuuuccaaguuuauaacggagcaaugugauuggcucagcacaggaagaaacuauagcacuguaaacggaggcagugucguuaauuuccuugcaagauucucuaacuccuaagcaaaauuauccaaauucuuuccuggcuuuuagaaacacgaucuugugauaucaaaaucauauuaaguuuauuuuagugucuuacuaauucauguugacuaugagugcauuccuuauuaaugauuaagacaauauaguaggcuaacaguugucagcauagccccuagacucuaggagaugcaucuaaaucacuuacaaagauuuagaaaauaccagaccccaucccagacuugcugaaucagacucauuaggaacagaacucagguuaaagugcuuaucauaaaauccauuacuggaggcagguugcugugggaucguaaucugcaauuuugggaauaugcauuuuuaaaaaagguguuuauauuuguauagugauuauuuuagaccaugucuucauuccuuaagaugguaauucugacugaggagauuacuacuuauaauuacuauuaaucugcaaguuuacauuaaaggaaauauuauuuggugaggaggggaagauuccugccuguggaaacuacuuugcuuuauuguuaaauaaauccaagauuucauucugucaggccacagcagaggggccaucuguucugccagacauuugcuuauuucccaggaagaaucaggagguggaauuauaagcucauugaugaaaacauaggauguuggccaaguuacuagacauuccuggccauaucaucaagauaugcacuaucuauacacuauacacuaaggaagggaccauuuuuaauccaagcugguaacuggaaaaaacaaccaaggaaaaauaaagaccacuuuagguguuugcuuucuauaucuaaaugcacuuuuggguacaugcuuuggcagucauucuuucauuugacaaauauuuacugaguguguaccauuugcaaggcagugugcuaagagcuauggauauaacacuaaacaagaggcagucucuacccuugcagauuuuauaauccaauuuaaacuccugggccccucauauucuuaaaaauuauugaggaccccaaagaacuuauguuuccauaccuauugauaguuacaauauuagaaauugaaacugauauguauuuuugagaaauguuuaaaacagaagacuacacaagcacauauuccaauaugacaucauuauauaucacguaaccucuggaagacuccacucuacacucagagaaauaauagaauuaaaaacgcaaaugauaccuuaguauuaaaauaguuuugaccuugugggcgccuccuaagaaggucuucgggcuccccagggguccugagaucacacuuugagaacuguugaucuaguuuucauuuaauuauuuuuuuagaauauuuuuaaaaauacauaauaucccuguuuuauauuccuguaaggccaguuuggaagcuaucuuguuaauguuuucaaacaaccaggauuuugcuuggugugucuuugauuuacuguguccuuuuggcuuuccugugaguccaguguuaaaaauaggaguuugggccaucaguaauuccaguuccacaaucucuugucuuuccccgagugcugaucaaaguagacaagagcauucauaucuccauaauugaauuacucaguaauucccuucuggccucagcccugcggggauuuucaacccauaugacguaauuugguauuuuaaucuaguaugaaagcucucuuugaagguagauguccugucguauuuaguuuugugucuuuucuuacugccaaaugcaaugucuuauucaaaauagauggucaguaaguguuacuuggaugaauagagaaaauaauuucuuuggaaaugauuuuguuugcauuuuguuguuuagucucacauuuugccucacucuguaggccaguggucacauguuugucucaugaaugauuuauaccuuuaaaaucuggaaacuucacguauugguccagauuuccagcuucucuugaaacauguggauguucuuugguacucgucauaccaaguucugugugguagcugucucggcagaaaagaggcugacccuuagaagagaccugccuucccuguuucccacugucuuaguccauucaggcugcugucacaaaauagcauagacuggguggcuuauaaacaacagaaauuuauuucuuacaguucuggaggcuaggaaguccaagaucaaggccccggcagauuugggguauggugaggguccacugccucauagauuauggucuucucacucuaaccucacauggcaaaugagcucucugggguaccuuuuaugagaacuaaucccauucgagaggguucuacgcucgugaccuaaucaccuccaaaggccccaccuccuaaucucaccaccuuggggguaaggauaucaacaaaggaguuuugaggggacauaaacauucagaccacagcacccaccguccuuugcgcccuuauuggcucccaaggcccagugaagguauccguuguugugcaugugcuguuguguuucuuagaguagagaaauguuucucuauaucugacacuccuuaccaaaagaaggaaaaugaaagauagcuugagaggaucauguguuuaacagaaaugggggagggcauguuucucuguagaaaugaauauugcugcugggguuugacaugcaaacaaauguacaaacccauggccugugucacucauuugcccuagccaucuggccccuucagcaucugaauuuuacacacuuuccagagacagugugaggcagagugccauuguuacacuaauguaaucacucaucacaagucccauuuuuuaaaauucauuuuuuaauugacaagucaaaauuguacauauuuagggcaugcaacaugauguuuugagagagauauacauauagauauacauagugaaauggcuaaaucaagcuguuuaacauacaccuuaccucaauuacuuaucuuuguuuugugguaagaacacaaaaucuaaucucagcauuuuucaaauauacaauauuuugggguuuuauuuuauuuuauuuuuguuuuuguuuuuguuuuuguuuugagauagggcuucucucugucacccaggcuggaguacagugccacuaccauggcucacugcagccuugaccuccuggguucaagccauccuccugccuuaaacucuaaaguugcuggaacuacaggugugcaccaugccaggcuaauuuuuaaauauuuuuuuguagagauggggucuugcuguguugcccaggcuggucucaaauuccugagcuuaagcaauccucccaccuuugccuccuaaagugcugggauuacaggcgugagccacugugccuggcccaauauauuguuauccacugugaucaccaugauguacauuagaucucuugaauuuguuuauaucaaacugaaauuuuguguccuuugacuaacaucucaccaguccucccagcgcccacaauucccauuuuaaggauauuuucuuuuaacacuguacuucugauaaucaacaguaguggaagaggagacauagaaauagguagguaaugaaaauauuacuuauuucaauuuugagagauauaaucacaaccaaacagguugcaaaauaaugagacuggcugugcaaguuacacacagaaugugggccuuguuuccguggccuuauuucuuauuuauucacaucugaaacuccucuuucucacccgccuccccacuccccauauauguauauauauauuccccucccgcucccaauuuucaccugguucuauguuuaaguuucuaucgguagcugcuuuuuuucccuuuaggucaucaguucucaaacuuggcuguacauuuguaaucaccuagaaacuuucaaaaauaaguuaguggguauuuuguagcaggagguuuuuugggauugucauuccaccauauuguccuguauguaauuuauaaacaaaguacaguucacccaugagcuacauuugaaucugaacuaucagagcucauuaguuaaaauuaugacaguugcaaaaugaaaaugaguuaagcaacagugacauaaauaaaugaaugccaauacauuuuuacugaguuaaaauaaggucagggaauaagaguagaauguuaauggcaguuucuuucuuuuauguaaacaguggaaauuacuuaaauuacugcaugagucuggguuggguuugcuucguuucagggagcaauuuuaaaaaacaaagcaaaucaauugguguuuugccauuugaugaguuuuauuaaucuggaguccaguauacaauuaggccaauauaccauccauacacaauuagggcaaguucuccaaguuggucugcauuaucucuggaugaauuuagacugugcagauggcaacauggaugcuuaaguuguguuuaauuaugaaguagcacuuuacugaccuuaaagaacaaccaguagugcucucgaaucccgaaacuuuccuuaaagguauuacugauucccgugaaagccuaauggauucccugagugcuuauuuuuaucacuuggaaguggcuuacaucaggacagcugguuucaccacucucaugguguugccuucccaaaagauugcuguuaggcugacuuggguuguggcuguauuaagucaugucaguguucagcagucaagcuaauccagccugcaucuguuccuucaucugcaggucaggugucagccuggccagcgacuccauguucacuacacacagcucagagagguuguucucaguucugucucugaccagccuucuguguacccaaauggaagcuuaugcugguugaagauucuuuuacuuuuguuuuaaaacagucucacuucauacaugguaaaaacuguuaugcuucuccaguaauucaagaaaugcaaguucaaacaagaagaugcuauuuugccacuacugaggaagcaaagauuucugaaaaccuuaaacaccaauauugggauggauaugcugaaaugguugcucauacacugcuuucuggagcaacuuguugauauuuaaaggcugaugaguucaugaaaacuuuuugucucuagacccaauaaucccaaucuaggagucuauucuaagaaauuauucacugauuugggccagguguggugccucaugccuguagucccagcacuuugggaggccgagguagguggaucacuugaggccaggaguuagagaccagccuggcccacaugguuaaaccccaucucuacuaaaaauacaaaaaguagcuggguguaguggugugcaccuguaaucccagcuacuccaguggcugaggcaugacagucaaaaguugcagugagccaagauugcaccacugcauuccagccugagugacaaaagcaagacucugucucaaaaaaagaaaacaaaauuauucacuaauuuggacaaauauauucaagaacauuuacuucagcaugaaagcaacacaaauguccuauaguaaaagaaugauuaaauaaacugauuuaguauauuuuuuuaaauauacuaauacaguggauuaguauacagacauuaaaauaacaguuucaaaaccuauuuaauaacaaggauaaucguuuauaaaagaugagucaaaaaaugauacaauacauaugaucucaauuuuguuuaaaauacacauauauaugacuagaccagagggaaauaaacccauauguuaacagcgauaguguggauuacaggggauuuaaauuuuguuccuuuuacuuucuucauuguccaaauuuucugugacaaauauaauggaauggguagggaauggauggaguagcauuuaccugauuuaaaguaacaacaggcugggcacgguggcucacaccuguaaucucaacacuuugggaggcugaggugggcagaucaccugagaucaggaguucaagaucagccugacuaacauggugaagcccuuucucuacuaaaaauacaaaauuagccagguguggucaugugugccuguaaucccagcuacucgagaggcugaggcaggagaaucgcuugaacccgggaggcggagguuguggugagccgagucaugccacugcacuccagccugggcaacagaaugagacucccucucaaaaaauaaauaaguaacugaauaaauaaaaaauaaaguaacaacaaucaguagcaucauuugugaauagaaauuggaggcaacacaugacuuuuucugcacauuuguaguaauguuaucugcuacuuuaaacaucucuucuaauaugaauauagaaauuucuguagauugauaauuuaucauaauaucuagguauuuuucccuuagauaaaugugauguuuuauugcuuacaagucuaguuuguuccuuguuauaucaaggaguuuuuagaauucaccaauaaaaugagaagguaggagaucuugucuaccauuauaucuccaauaccuagaacaguggcuuagcacaaaggaauugcuaaguuaauauuuguggaaagaaugaaagaguuucaucaguuuuaagguugugaaaauccuaugcuauacuugcuaugaaaaaggauguuauaaaaaauucauuaaaaccaaaauugcuaaagacagaucuaacagacuuagaacuaauguuugugugccuuuggcauauuaauuaugcauaaaaauagacccugcuaauuccaaacuagucuuaaccauuuaugaaaggaggccaaaaugucuccuugaaaaauaauauuugcagcuaagaaaguuacugucucuucuugauucugcaguacugaaauucagacuuuuuauuuauucagaucaccuuucuuacauauuauuuagaauaugcggcauuuugccacauugaagauuuuaccaagaagaacuggguaaacagcagaagaugaaugccuggcacagcguugugcucuacgcugcgguaucaucuguuucuucauuaauuauuuauugugucccuucugugccagaaaccauguuaugugcuggggauccaugaaaaagauacaguucuuaguaucagacccaaucugacacuaaagacuaaugaacacauuuuccuuauaaaacuugugaaguuucaugaaagcagagagaaaacacauaguucagaggggccuucugagagauggcacuucugaauugagcccugaagcccaaguagaagugaaccaggugauaagggcccugcagagacuucugggugaagggcggugagugacucaggccaaggcacuggcugagaacuuguguggugggugcuagguaacaguagaugguugcguguuacuggugcauaaagugccuaccaggaaaagacagcgacaggugacgcaguugcaucagaucacaacaggucaaggacuguggacuuuauccuuugagcagggguggaguaucuguucccuuaggcacuuuugacaggcuucucugaagccugagauggaugaagcauuugaaaggaaaaaggcuggagagagggagaccaguuaggagccuacauacaguauugucacaguccaagccaaugaugaaaugugccuugggguagaaauggggaagaggaggaggugaaaucagcaggacuuagugaucaacuaggggagaaaaucaugaguccauuuuggucauguugucuuggagcagccugugagauguuuagaugggggaauuuuaucacagauccaugcuacuggaaggaucuaaauaauuucaggcauaagcuguuuguuaggcugaauuacugagucuugcacauaauuuuucacucccuguuacaugcauguugguuuuguguccuuagcuaaauuucuucuuacagacagggccuaugccuguuugcagggcauaguccgggcacauagaaagcucucaguagguacauauugggugauuaacugaaaaguauguuuuuuaguccaauuauuaauuuagcuguugacacugugaauucaccauagaacuugauaauuuuccaguauuuuguuuuagugguagugccacaguauugugcguggaaaaauucauuauguucgucuugguuaaaacuaauaagcaacaguuauauugugacuccacagugccacucuuaauauccagagucacacuguaaaacugauuuaaggccuuauguugcuuuuucauuuaguguaacuaagaagacucagcugauuacaagguuugucugguggcugucaucaccacagcagaacccucggugaggaagaucaguuguucccaagccauggcuuucuguucagacuggcaaagggcgccuuugagggggacacuagcucguuguaucuggcggaaugaauaacuuccugugccagacaguccgcggucuugaggcugagguuauuauuuguuaguuucucaggccuuccuuugccgagcaagcuccugggagugcacacuugaaugcccugaggaucagaaauagaaggggcagaaauuaaaaguuuaagucaaaacagagcccucucugggccaucuuguggcaggagguugaggugcuuucuuuggacccauuagcauacuggggcugcgcggcugccuggaaacucuagaguugaacucucccuuuuucgguuccucaccugugggcuccuuacuaggagcugacagugaccucacgcagcugcccuaguuuccuuuccuccagauggcacggguaacacucgaggaaacccugagaguucagaguccaacuuauggcuucuccauaguuucacugucccucugggcuagaguugccaaauaaaauaaaauacaggacaaccaguuaaauuugaauuucagauaacaaauaacauuuuaguaugagucugucucgugugauauuucgguucaguccgauguaucaguuguuaauguccugccauauuuaucucucugaugcacuuuuucuugaauuauuugaaguaaguuguagauaucacacacuuuguuccuaaauccuucagcaugcaucuccuaugaauaaaaacauuuuugauguagcccaugcaauauuugggacauaauuauauuauaaaauuauuuguuguuuaucugaaauacaaauuuaacuggguaucccagguuuuauuugcuaaaucuggcaacucuacccucagggugccaugggguggcagcugcuggaugggugaguaaaucugcacuccuggacuuggucagauuugauuucauuuacuggcuuugugacuugggacagccagugccaccauuucuuugucugcaaaauggggauuuuuauuuuguagugucaguguaaaacucagagauaagguacauuauaaagccccuagcauagcaccugacuuuagcagacucacaguagauugcagcuggcguggcaguaaugguaacugaauaguaacugccauucucugagcugaaagugagaaaauaaaaauaaagacacacuguuuuagaaauguuagcagcuguauuuacaacuucccucuguucucucauuccccaucucucuuccuacuuagugcauucgcaugagcacacacacacacacacacacacacacacacacucacucacucuccagcacgugaucuacucugggauugacagaggguuuccugacaaacauccaacuuguaagguggaggaaaagagacauaugaaagcagcaggaaaagccaccacucuugagggcaagauuugaagggaguaaaaggggcuaugaggauuugucugagugcuggugacucaacuaagaaguggccaggcagagaagggcuguggggguggagggagacagaggagaagccccagcuguaacauggucuggguugguuaugacucuggcaugcugccaaggacaguuuuuauuguucuuguuuuucauuugcuuuguuucauuaagaagucaaauguacuaaauguuuauuucuauccugaaaguuggaggaacaaguucaagucacacuguuuacgcaugucagaacagccagguuuacccuucuuucugguaaccccuucuuucuggaaacccuuccacuugucuuuggauuuaugguugccuaaaagcuggaugccagcccagcaagauaaaccagggagguuagccaucuguucauuuauguuugcugauucuuucaggguuccuaauucugaggugauuuucuucacaugaacaaauaaaugagaucucaaguccuuucucacuggaaacuucacacacuaugaugcuugucaggaaaaauuaggcaggaauacagagugcucacucaacuguccugacaguaauaggaagagaagugcgguggagucgagagugggggcggcugcuccugggccuuugcagcagagcagaccgcagcugaggcagcaucaggcucgccuuuguuuugcuagaacagaggaaagccaagaugaagugaguucucuuuguguccauuccuucuccuugccuuagggucuauccauaacaugcuacagaaucugaguuucuuagauuuucacuuaaaaaaaaagauaagggaacauuuuuuuuucugcuuacagaaguaauuuauuucugguguaaaaauccaaacaaaagcaacagugaguggaagacuccuccuaauccggaccugaauuauaacugauacaaauucucgacacucaaaguucacauuuugguuuguuuauuugcagucugugcuuuuauauuauuuuuguauuucagccguuuuuacaguaaaaauacaaggcuuuucuccauuaacagauagaggacuguugggaauaccagguguuagguuucuguuaaccucaggcgcuguauuuaucaggccucuacugccacggugaguaacaaguaacuccccagucucguugcuuauaacaauaauaugugggugugcagccagcucagcuggcucaguggaacgaggcuggacuccaggcuucugguccgcuuuaggacuagucuacacaucuccguuuuagaaccuaggcugaaggaucagcagcuaccuguggccugcucuucucuuuuccaaggguggcaacuucaagguggcagauagaaacuugccaugcaucuuaaggccuuagcuccaaauugauacauugccauuccacccacauccuguuggucaaaucuagucacuuggccuagccugaagucagugaggcagggagaauacuucacccuuaggggagucaugguguauuaauuugcuagggcuucccgaaugaauacaacagacuggguggcuuaagcaacagaaauuugucucauaguucuggaugcuagaagucugagaucaagguauuggcagaguugguuucuucugaggccugucuucuuggcuuguagagggcugucaguucugcguguuuucacguggccuucccucugugcuugucugugucccaguuuccuccuccaguuaggacaccgguccuauuagcagggccuacccucaugaccucauuuaaccuucaucagcucuuuaaagaccccgacuccaaauacaggcacauugugagguauuggggguuaggacuucagcuuaggaauuuagaguauggggggcauuauucauccuguaacacagaacagggguggaaagugcaggagggauugugugcagagugcagucuccauugucagcuaaccucagugaggcuaggccuccugguuuuugaaacggggauaggcaguuccauuuuaggguuuuuggggauccaauaagaaaauacauuuaaagccccuggugguggaggcgguagggauggaugugguuugacuugaaaaaggaccaaaacuggccuucuugggcccuuccccuuguuauucucucaucugggcaaacugggaguguauggugcuuuucagaauugcuuaacuucuacagaagauacaccauccauggaaucuucaaaaauaacaaagccagcaggcccuuuaggcacucaaucugugcccuagguuuuggaaacacuaugcuucaugcuucugcccaagugcugucuuuaguacccuuccuuuacaauuauuaauuaauuaacuaguuaauuuauuuugagacagagucuugcucuguaacccaggcuggagugcaguggcacgaucuuggcucacugcaaccuccaccucccagguucaagcaagucuacugccucagccucccgacuagccaggauuacaggcacgcaccaccacaccuggcugauuuuuguauuuuuaguagagacgggguuucaccauguugaccaagcacgaacucuugaccucaagugaucugcccgccuuggccucccagaguguugggccacugggcccggccccuuuacaaauauuuaucgaaggccuucucugacuuauuagaacugugggcucuauugguguaagauauggcccuguucucaggagacugcaguugaaugccugugaaaugauuaaaauagugaucuaggaggucagaauagggggcgucccuuccucugcuucuuggguuuaaagccaacuauugccuuacauuuuuguaaaucuccuuuugguuuuuuccuagaaaauuguguuaaggaaugguacugaggcauuugacuccugggagaagcccccucugccuguguauacucaguucuauuucuucaaugucaccaauccagaggagauccucagaggggagaccccucggguggaagaaguggggccauacaccuacagguaagucuugaccaccuccugucuugaaagaaauacagagugaccccaauauggccugaguccuugccucuucccaggagcaaggcuccagggcugugugggagcacacuuucugauuucauugucugaaacgcugcugauguuuuguaugugugugugaaaccucagcagagaauggcuuuguagacugggccaagucucagcguguuguguuuugaagugcagcgguuuccuccugaguuggcagacugugauuauuaaaccaugaaggguuacuccuuacccugacccuuuuaagguugccccuugauauucuuauuuuauuuuauuuuauuuuuuuaagagacaaggucuggcuuuguugcccaggcuggagugcaguagagcagucauagcucacugccaccuccaacuccugggcucaagugauccuccugccucaaccucccuaguagcugggauugcaaguguucaccaccacacccagauaauuuuuuuuguagagaugaggucuugcuauauugcccaggcuggucuugaacuccugggcucaggugauucucccgccucagccucccacaguguugggauuacaggcgugagcaccaccaugccuggcuacugcuugauauucuuaagugacuuuuagggccucccuccauuuccauuccccacauaacuaguuuuaaagcaguuccagaauuuacuuuugucugagacagaucuuucuguuucuuacccgcuccuuuucuccaccuauccugcguauaagcaauaagcaaguagcagaggcuguuagagucuuugcuggugaccaccaauuccaaacacuggggaaucaggaucccuuuaaucauuuuuaaacgauuaguagagggagacgcuugaaucagagcauuuucucuguugcaauguuccccuuuucccuauuacaauaccuccucccucucccauacaauaaucuuuccaauaaagucucuccuuaccagguuagaaaacaaauuaauagaggaagcagacaacaagaucuuucuuuuucaaaacugcugaaugauaaaaaugccugacaauucuguuguaaucgauugcucaauaaauuauugcugacugauucaugugcuaugaaucaguacuauucucaguggugggaauucagagauaaaaauccuaguuccugccuugggugcucaugcucugacucuggagucagaugacccauuuugauucccgccucugcaacuuacuaguucucugugcuuccauuuccuuaucuauaaaauggggauaaaaauaggaccuccuccacaugguuuuuacaaagauugagucaaugagucauguauaaagugcuuagacuagugccuagcacauaauuagugauacuuaaguguuugcucuuacuauuaguuggauuaggcuauuuuugcauugcuaugaagaaauaccugagacuggguaauuuauaaagaaaagagguuuaauuggcucaugguucugcaggcuguacacacauggcacacuggcucugcucggcuucuggggaagccucaaggagcuuuuacucauggcagaaggcaaagcaggagcaggcacguuacauggugaaagcaggagcaaggggugaggaggugccacacuuuuacaacaacaagaucucgugagaagucacccacuguugugaggacagcaccaaaccuugagggauccuccccuaugacccaaacagcucccaccuggcccuaccuccaacacugaagauuacaguucaacaugagauuuggaggggacauccaaacuauaucauuccaccccuggccuccaaauuucauguccuucucacauguuaaaauauaaucaucccuucucaauagucccccaaagucuuaacucauuccagcauuaacucaaaaguccuaagucccaggucucaucuagaaaugaauuccuucuaccuauaagccuguaaaaucaaacaaguuauuuccuuucaagauacaauggguguaucagcauugggcaaacauucccauuugagaagggagaaauuggccauaagaaaggggcuacaggccccaagcaagucugaaacccaacagggcaguuauuaaaucauaaagcuccaaaaucaucuucuuugacuccgugucucacauccagagcacacuggugcaaggggugggcucccaaggccuuaggcagcuccgccucaguagcuuuuuuaugcugagauugcaagcugaugguggcucuaccauucuggugucucaaggacgguggccuucuucccacagcuccacuaggcagugccucaguggggacucuuuguggagccuucagcuccgcauuuccccuccucacugcccuaguagaguuucucuugagggcucugcccuuggagcaggcuucugcuggggcacuuaggcuuucucauacaucaucugaaaucuagguggaggaugccaagcuuccuucacucuugcacucuguguuccugcaggcuuaacaucacauggaagcugccaaagcuuauggcuugcacccuccagaggaguggccugaacuguaccugagccccuuugagccaugucuggagcuggaguggcugggaugugggaaacagcacagggaaguagugccccuggccuggucccugaaaccacucaguccucuuaggucucagggccugugauggaaggggcugucucagagaucucugaaauguuuucaaggccuuuuacccauugucuugacucucagcacuuggcuucuuuuuaguuaugcaaaucguuuuagcaaugguugcucuacagccugcuugaauuuaucuccccacaaaaauauuuuguuuuguuuuguuuuugagacagggucucuguugccaggcuagagugcgguggcaugaucauggcucacugcagccuugaccuccugggcucaaggguucccccugccucagccucccaaguaucuaggacuacaggcaagugccaccaugccuggcuaauuuuuaacuuuuuuuuuuuuugagacagagucucccuauguugcccagacugcggaaaugcuuuucuuucucugccacauggccagguugcaaauuuuccaaaccucuauguucugcuucccuuuuaaaaauaagguccaacuuuaagucauuuuuuuacucccacaucugaguguaggcuguuagaagcagccaggcgacaucuugaaugcuuugcugccuagaaaucucugccagauauccuaaaucaucacucucaaguucaaacuuccacagaucccuggggugugaacacaaugcagccaagaucuuugcuaaggcauaacacaugugaacuuugcuccagucccaauaaguuccucauuuccaucugagaccuuuucagccugaacuucacuguccaugucacugucagcaauuuggucacgaucauuuaaucagucuuuaagacauugcaaacuuucccucaucuucuugucuucuucugagcccuccaaacucuucccuucucugcccauuacccaguuucaaagcugcuuccacauuuuccagcuaucuuuauagcaauauuugacucucaguaccaauuuucuaaauuagguuguucuuacauugcuauaaagaaauaaccuuccugggcaugguggcucauaccuguaauccuagcacuuugggaggccaagguggguggaucacuugaggucaggaguuugggaccagucuggcuaacacagcaaaaccccaccucuacuaaacauacaaagauuagccuggcaugguggugcccaccuguauucccagcuagucaggaggcuaaggcaggagaauugcuugaaccugggaggcagagguugcagugagccgagaacaugccacuauacuccagccugggugacagagcaaggcccugucucaaaaaaaaagaagaaagaaagaaagacagggagggagggagggagggaggggagagagagagaaagagagagaagaaagaaaagaaagagggagagaccugagacuggguaauuuacuuaaaaaagagguuuaauuggccuauaguuccacagguucuacaggaagcaugaugcuggcaucugcuuggcuucuggggaggccucaggaaacuuauaaucaugguggaaguaagagagggggagcaggcaugucacauggccagagcaggagcaagagaggggagaggugccacacuuuacaacagccagaucucgugagaacucacuaucucgaggacagcacuaagccaugaggaauccuucccaugacccaaacaccuaccaggccccaccuacaacauuggggaucauauuucaacaugagauuuugaggggacaccaaaacuauauuauuggucuucguagauuaauuguuuuagucuguacaagucaauauguagaauuauaaagaugaacccuguugcuauaugaagaaaucuaagaaaauacuuggguccucauuuuaaaaagccauuuuguauguguucuaugccugaugaaacacuguguacuggguagagaaaguuuguauuuuaagcucucccacuggcaauaauuagaaguugaaccaggaucaguaucuaagugucccauuguuuguuguuguuguuauuuuuaaaugaaauuccuuaagaugugauggagacucugcaaacuauccaaaauagugucauuccaacauguuagcaauauuuagaauuauuaaugagauacuuuacaaucuuuuuuuauacugucuuugaaauccugugugcauuuuacacuuauagaacauuucauuucagacuagccacauuuugaaugugcaauagccacaugugucuaguggcuacccuauuagacagcauaauuccaaccauacucccaugauuuuuuguuuguuuguuuguuuguuuguuuguuuuugagacagagucucauucugucucccaggcuggagugcaguggcgcgaucuuggcucacugcaaccuuugucucccagguucaagugauucuucugccucagccucccccguagcugggauuacaggcacggccaccacgccuggcuaauuuuuuguauuuuuaguagagacaagguuucaccauguugaccaggcuggucucgaacuccuggucucaagugauccacccgccuuggccucccaaagugcugggacuacaggcgugagccaccaugcuuggccacucccaugauuuauaagcuccccagacacacugccuugccaguauucaugcuguugcuucagucaagaaugaauuccucagcgcuaccucucuugaccuucacaucuuacuuagugcaaaugcugucuccuccugagacuugccugacuucggauacucucccuguuacaucuuauuuaaaaugucaaguagacugggcacgguggcucacaccuauaaucccagcauuuugggggguugaggugggcagaucacuugagcuuaggaguucgagacuaggcugggcaacauagcaaaacuccgucuuuaacaaaaauacaaaaaauuagccaggcgugguggcaugugccuguggccccagcuacgugggaggcugaggugggagcaucgcuugaaccugggagguggagguugcagugagcugagauugcaccacugcacuccagccuggguaacaggguaagacccccaucucaaaaaaaaaaaaaaaagugucaaguauaccacuuuauagcacuuguaaagugguauguugaugugguuugguuguguccccaccagccaaaucucagcuugaauuguaguuuccauaauccccacaugucaugggagggacccagggggguaauuuaaucacgggggcagcuacccucaugcuguucucuugauacugaguuaguucucacgagaucugaugguuuuauaagggacuuuuuaaaaaacccuuuugguugggugugguggcugaugccuauauucccagugcuuugggaagucaagguaggcagaucacuugaggucaggaguuuaagaccaauguggccaacauaaugaaacccugucucuacuaaaaauacaaaaagaaaaaaaaauuagcugggugugguggcacacaccggcuaaggcaggagaaucacuugaaccccggaggcagagguugcagugagcugagaucacgccaccgaaugccagccugggcgaccgagcaagacuuugucucaaacaacaacaacaacaacaacaacagacaaacaaaaacccuuuugcugggcacuucuccuugcugcugccacgugaaaaaggacguguuuguguccccuucugccaugacuguaaguuuccugaggccuccccagccaugcugagcugugagucaauuaaaccucuuuccuuuauaaaugacucagucucagguauguccuuauuagcagcaugagaacagacuaauaaauaugugcauccauuaugacagugacuaauugcauuuuaauaauuggcuuagguaucugucuuucuucccaauguacuggaagcuccauggggugcagugaccaaguccuuuggucucugacugucuacuauuuaaugaauauuuguggaauauguaaauuaaacaucuucaacugugguuuaaauucauaggacacauggaaaaacuaacacuauaggacacaauuauuaaaaaguauuuaaaaguaaugacaaaaaacgcaguuacuuugcacccaccuaauagccggaaccauaggacuuaguucaggaaacccaaauauagguucaagaaaggggaaucaggcccugaaaaugaauggcuuuguuaggaauaugcauaugugcagugcaggcugcuaagagcuccuuacagggcugagugggucgugagaucugggauuuguagaaaaacauggcuuuuuagggagcuguccaaaccuucuauggggccuguuagucucuacaugugccuuuugcggucauucacuggauuugauuucugucacuuguggcuuuaugaugcuauuguuuaggcuggauaagacagaacauuccagaagcuucugcuccaguguuuucucccaacugagucagcugacuccaucaauuguaugccagggggccuggggcaaaggaaggggagggcauguagccccuuucgccaguuaguacagauuggugugguggugggaaaccucugagauggggaagggccaagcaagacuguggagggccuaacucaucugacacaggauuuacaguggcacauuucccaaaccuuucacauacuggggaguucagaauaguaauguuuuuggaaaaagaugaugggcauuccaaauguugauaacagccagucagucugguuuaaggaaugaaguguauuauuuacauuuuuguaaagcugcagauugagcagcccuggaaugggucugugaauacaaggcucauuggccucaugauccuuuugcucagggacauauuuguauaaaauuuguaucaaaguugugguaucccauggcuucugcagccuuuuugagguuuauuuuuuaucuugucagauaccuuuuucuauuuugccuaccauuuaacauuucaagaauuaaaaaagaaaacaauuugucuaagggcacuuccaauuaauuugcguauuucuaagaaguauuuacuaaauuuacaguaucccgugaaauaucuuauuuugggguuucuuaguuuugcuguuuggauuauucauuucuauuuuaggcuuguauuauuuaaaaagauguaagggcuagaucuuaaguuauuuuauuauucauugauaacaaguaauacuggauuuucaaauauaaucaacauauauaauauauacagcauuaucuuuaagaguguagacuauauuuuauauuauaaaaauuacacauauauauguguuccauauauauaaucacuaaagaucaacuugaaaaugcaguaaaguuuugaacaaaaacuacuaauccauggcuucacugucucaaaaauaaccaaugcuaacuaacauuuuaguggauaucuucuuggccauuuuuccauggaugaguuuuagaugguuaucauacuauguacauaugcauguacauauacaaaauauacauauuuuuuauucaccuaauguuauagcauaggauuuuucaauguuauauuuuggucuucauacaaaugaauuuuaaugaugauuauauuuaauagaguaaauguauuacuacacuuaacuguuccuuuccugaacauguagauccguuuucauuuucuccucugguuaccucguggguugaauguucuccucauguuugccagccaguuguguuuccacacuuuuaguucuuguccuuuguccauuugcuuaucuggguucuggaguguucauggcacucugugaaccuuuuauguuucauuuggggcaacugcuuuuccauuguuuaccuugucaauuuuuaaaauguguuguagucaagucuauucuuuuucaacauuucuaucaggucugagcuuuaaaagucuuacucccuucaaugguuugauguucaagucgauuuucuuauaguucuguuuuuccacauuuaauuucuucaggaucuaagugucuuccuugcaauuuagcaaaggcaggaauuuuguuuauacugucuaauucuguccuauuaacccuuuaguucuuuaaccgugucugagccaagcuguauaagaaauuuuuuuaacauaaagagacaacaaaaaauuuaggaacaccgugaucauuguuuccauuauuauaggagaaugcuuucuccuuuuuucuaaacuugccucgcuuuucucugauaguguuuuuagauugguagcuaaaacuguauuuguuuugccaaaauagaaacagauuuugaaaaaaaaaauccuuaaacugcucagaaguaaaaaaaaauagaaaaagaucucucacaccaucuuaucaugcacaaaagguugugaccagguaugugugaguuuuaaaugcacgugguacauuaggugaauugccuacgugagccuaugggucacugccuggggacagggagaccagggagauauuuccaucuuaaggagugaaacuguuucuugcacacugucaacaagcgggugagucuucucccgacccugcucuuaccacuucuucucaguauccugcuuuguaucuacagguugcugccuucaguuaccugagcgggcagcguacucaaaguuaaggguagaggcuccucagccugugccuuuggcuggcuccccuugcuuucccucuucucuguggucacccuaggacuucaguacuccuuucacguugauguguucaucaccccagccucgccuggaucugugauggucuuuuaaagcguguccuccuccuccaggaccacagcuuucucacuccccacaugggaaugcuuucaugcuugcugcccaccuucgccccaccgcugccucuguuggaacacccccuucacccucccaccugcagaagcccacucuuuccagaaucaagcaaaagugucuuuugcaggaguccccuuccaguugccaucccucccuccucuguaugcccacagugcguuuacugugaaggagguggccucugaaggcagucucccaugcucuacuguggauucuuggaggaccagaaccaggacuuaaugucacaccaucucaagagcuuagcacaagccguugcacaugguaucaguagcuaaucccuccuaagcagcaggugugccagguaguguuguaacuggauuuauguggauuucauucucacaacaacccuacaaggugaguacguuauuaccuccauuuuacagaugaggaaacugaggcacagaagcagugaguaagaugaaaccaggguugaauguuaacccuaccagccagaucucagucuaguuuguauccaguguaugcccaaucacuucuuaauaguaauucucaacagaggauuaggugaaugaaggaaccaauaugacugaaagauaacgauacuaugauaguauuauacgcauccaauuuaucaaacaccucugaggaauuagauauaccgauguuaauuuuccaccuaauuaaaauuauuccuuuugauuuccacuccuuaucucagucuauuguuucuaaaauuauuucuaaaaccaaccaugaauuuuccugccugauuaaauaguucauggagcauaacugaaccuugucuuaaugacaaggaccgucauaguaaugcacaaauguuauacuauagucugagauucauuagcaucuacuaaauaccagggaccaugccgggcacuuuuaaguauaguuccuugauuaauugccuaggcugaaaauuugauuuguuuuuuguuguuguuuuuguuuuguuuuuucaaacucuucuuuguauuucugaaaguucauuuggucuucuuugaucuuguaggacaguaacugaucaauaugccccucucugcaggcaccagccuuggcuuacacaaaaguuuggcuuugaaauuuccucuccuccuccauauuccaauaaauuacugugaauuaaccucuguguaaaaucaaggaauacccugaaugagaggugaggucaccaggauucuaaaccuggcccugacacuuucgauugguccugaauccacauauccuuaucuauaaaaagguggaguuaaugauuucuaagugaagggucuuugguuauaagcaaaauaaacuaccucuggcuaauuuaaguaaaacgggaaucuauuugaaggcuauaaaguagguuaacagaaucaaggaaagcagcuuggaagacaaaagcaggaugcagggcagcuuuaaagauccaggucacgagaguguauugaucaucacaucaugugucugccacugggaggaauccugucuuuuacugaguuuucuuguuuuuaaauuaaaauuuuuuuuuuuuuugguagagacaaagucuugcucuguugcucaugcuggaaugcaguggcaugaucauagcucacuguaacgucaaacuccugggcucaagccauccucccaccuuagccucccaaguagcugacacuacagguacaugucaccacgccugguucuuuuacuguguuuucuaucuugaggcacugugcucaggauucagaggccagaggaaaggaauugguugagcucaggucccauagcaaccuugacugauggucuuacacagcuguacaauacaagagaggaaagcaaaucagggcuauuaccagcagaaagcggaaugguugucuaacaaaugaaaaguccacugcaaacacugaacuucaagcuguguaagugguuuaacacggaagugucuaucaaauuuuuaaauauauucuuuguaaacuggaagggcauguaauuuaucauuagauuuggcuuugguuagaggcauuuguuagaggcauuagcugguuucauccuacaggcguuucuuagguaccuguuaggagagguugucucauacagagagaggagcaccuugugcuaaugagaaagacuugggaucaaguucucacucuucugccugugcucuguguccccagcugugaaguggggcaauacuacaugcuguauuuguacuacauacuuguaaggauuaaauaaaauaaaauaauguggguuaaacucuuugaagagcuaugcaagggucagcuauuuauaggauuagugggcauagcuuggugcuuagugugauaugaugugugauauguguauaugugauaggaaguaugcuuccuucuauacacuugacagaguauaggauauagacaugugauaugaugaaauauauauuuagucuuccuccauuuccuggcauacagcuccuaagauccuuggaaucgcuuaagugauaagugucuuuuuguaugcuagugaauugacugaugacuggcagccucuauggcuccuggaugggagcugguccugaaagaagaggacaggauuagaggguugggacuuucagccccaccccccaaccucccaggaggggagaggggcugaaaguuggguugaucacaaauggccagugauuuaaucaaucaugccuauguaauguagcuuccauaaaaaaccaaaaggacugaauuuggagaguuuccagagaaccaaacauggggagguuccuggagaguagcgagccugcagagggcauggaaguucugagcuccuuccccuacaccuugcccagugcaucucuucaucuguauacuuuguaauauccuuuauaauaaaauguaaguguuucccugaguacucugggcuguucuagcaaauuaauugagcccaagcacagggggaugggaaccccaauuuauagccauuaguucagaagcacagguaaaacagccuggggcuuuugauuggcauaggagguggaaggcagucucaaccuguagaaucugaugcuauguccaaguagaaaguaucagaauugaauugaauuggaggacacugcagaauuauuggugcagagaaaacgccacacacuucuuggugaccagaagucucagaagucuuagaagucuucuguguaaguuguuacaguaugagagcacagaaaaaaaugguuuguuuuuucuacuggagaagauacaaagacucaucuauuuguaugcaucuauaugaaugcauuuauuuucucaucuguuuuuauuuuaaagucuagaagggauuuaagagguauaaagagauacaauauacagacaguccuugacuuaugaugguucaacuugaaugauguuuugacuucgcgauugugugaaagugauguauuuggcaugccccuccaaugacgauagaguuacauccagauaaacccauuguaaauuggaaagauacuaaguuguugaaucaaaaacaaacuuucaacuuacgauguuuucaacuuaugauggguuuacugggacauaacuccaucaucaccgaggcgcauuuuuacguaccaguuucagccuucagcuugcuugcagucuaccugaggcuacaugauaauuucacaaucuaaaugaugucacucagaaguuucuaauugaaugcuaaagacauguacggacauccacaggugggugagaaaaaucccugugcugcuaugguugggaaaggccucagaggagguguggguagcccagcuggccaaugccuuccuaaccugugcucuuaaauuagcucuguucaauagaaauauuacaugaaccacauguguaauuuaagauuuuaagauuuucuaguagccacauuuuuuaaaaaguagaaggaagcagguaaaauuaauuuugauaauauauuuuaauuuuacccauuauaacugaaauagcaucauuucaauauauaaucaauauaaaaaaagguuggcacuguuuuugaaauucuguauauauuuuacacuuacagcaaaucucaauuccaguuagccacaguuuaaguacucaguagucacaugugacuaguggcuaccaugucagacauaauaacccuagcugguuuaggaagaaggaaagauaagcaaagggaaagaaacaaaagucacuggaauuuauugaacaccuacuauguaccaggcagggcuagggcuagggcuagugugaggcauuugaugaacaaaagaucagauucuguuuuuauuuaaaauuuuguucaucauaaauuuuuggcauaaauuuugguuuuaauaaauagugcauuaaacuauuuaucuugauuacuacuuguuuaggcaccucuuacaucacucacacugacucuaggcccagcccuggcaccaggcgcuuucuaagaacuuucuaaugcuucauuugggggcucuaacuugaaccaaacugugcuguauaucagaaacagagaccgggugugguagcucaugccuguaaugccagcauuuuggaaggucgaggcaggaggaucacuugaguccaggaguucaagaccagccuggguagcauaguaagaccucaucucuacaaaaaaauaaaacaauuagcugggugugguggcaugcuucuguacuucuagcuacuugggaggcugaggugggaggauuguuugagcccaggaggcugaggcugcagugagcuguagucaugccacugcacuccagccugggcaacagagcgagacccuaucucaaaaaaagaaacaggagugaacuccuguaauuuacuaagccuugggcauuauuuuuuaaaauaaaauuucaauuuaauucaauguagaaacaagaagacauugguaaacaaauugaaauucaaacuaaaucugugaaccaaacugaaaauuuugaaaauacuucaggaccaaaccauaacccaggagagaguucaucggcuuugauucccggucaaggugacccucaacuauugcaccucccuaaucagggaagaaaagaaggaaaacaaaguuuuugagaagacucuauccuaggccucguuuccuucccacauuauagcuucgaucuccagcuuuuuaaggcuuaguagcugcagucucuauauaauguuauauugggaauguuauauugaaaauauaacuuggaugcugaaagaaaggaaaagucuugcuuauuaaaguggugucuauuuucaaauaaaacccuuuucuuucuuuuagggaacucagaaacaaagcaaauauucaauuuggagauaauggaacaacaauaucugcuguuagcaacaaggccuauguuuuugaacgagaccaaucuguuggagacccuaaaauugacuuaauuagaacauuaaauauuccuguauugguaaguaggcauuuuaauaccauuaaguuggauuuuggaagaaaggaaaaagcuaaguuaaugcucuuuaugauuuuacauuuaggagccauuaaguuauguugaaauauacauauauaaaaagaaaaauacuucuuuucuuuucuuuaaaguacaucuuggacuuuuuucuaagauguaucaaauaaggucuuuucaaaugaugacaaaauucagauuuuaggauuuguuuucauaauuucuuccuggguguucaggauuagcaauugugcaaauaaauaugccccuaggauuuuuugguagcuaauaauuuuaaaaauguuuauuugccccuuguuuucauucagaaauucuagcaaugaaauuuguauaccauuucuuacuucagauuuuuauguuggauuuuauacucucaaaauucauaaauugacaccagaaaucaauagacuggcagccuacugugauuucagugggcucuguuuauaaugguaauucuaccuaauaacgacaccuauucuacaucuauucuauacugagacccaugagacuuucuuuuuuuuuaaauuaaauuaauuuauuuauuauuaauuuuuuuugagacagggucuugcucugucgcccaggcuggagugcagucaguggcuccaucacagcucacugaagcuucuaccuccugggcuccagggauccuccugugucggccagggacuccaggcgugaaccacuguuccugggcuggcccaguaaacauucuaauucaccuacaccaaccccugccgacucucccacccuaaccccuaggugaccgcuccauaugcagcuggacacugaugauggacccaggaccuagacaguaugaggucccugccaccuagucccagggguguaggucggguuuauaaugagccucuggcccugcuuaggcggaagguagcgccaccuuguggccaaagaugcccacauguuuacaagagcuuuuccccuuuuguggugucuggauaacucagagccugcaaauggucucuuuguaaauauuacacuuacaaaaugcaguacugggaaaggacagagaagaggcuuugucuuccauaugcagccagaaaggagcucacugccugauuuuucagcuauuuaaucucaaccuuuacauuuauauuuccaacccccuuugcuaugggguaguaggagagaguggauggaggugcuuuggaggggaugcugcugucuuaauauaccucugcuccgcagacugucauagaguggucccaggugcacuuccucagggagaucaucgaggccauguugaaagccuaucagcagaagcucuuugugacucacacaguugacgaauugcucuggggcuacaaagaugaaaucuugucccuuauccauguuuucaggcccgauaucucucccuauuuuggccuauucuaugagguaaguagauuuuucuuuucagaaccucuuuuuuuagcugacaguggguuggggcaccccaagccagauuaacuuugaguuucuucuagaaauugccuagaguuaaguuaucuuauagagugugugaaaaauggaguguuuuuuggaaagaaaaaaaacuugaggccgggugcgguggcuaaugccuguaauuccaggacuuugggagaccgagguggguggaucauuugagguuaagacuuugagaccagccuggccaacauggcaaaacucuaucucuacuaaaaauacaaaaauuagccagcuguggugauguacaccuguaaucucaccuacucaggagacugaggcagguaaguugcaugaacccaggaggcagagguugcagugagcugaaauuacaccacuguacuccagccagggugacagagcaagacucugucuaaaaaagccaaaaaaaaaacaaaaacaaaaacaaaaacaaaaacccuggagugcaguggauaguugggaaguugguaaaagauaaaauaaccccaggaagaggauuagauuaggggugugcucugggauugugaugggucuccucagcuuuaaauuuguagcuguuuucuggcucugccuguucaagagucuuacccucuucauguaauccuguagcauuccaguuuuuauggcaaacagcaauaauugugucccugggccuucaagguuauauaaaacguagaaauuguuaaaauagaauugugagcaaguuuuaaaaaauuauaugugugagagacaggaguccuaaaaguagggccucaccaacucugaaugcaucauucgggagaagcagaccaggcaggaguucccuagaggguccugucucagaggaauacagcuucacaggaccagaggaagcacagauuuccugucaagcccugacugaaccucccuucuagaaauaauuucaggagagccuccuacugagagauauuaugcaaagguucccucgaggcccuuuuguucccaguggcuucaauccaucagccaaguagaucuuguugcuaauaucucacuguuucucagauaauuugcauuauauaacucacuuuuuuuguuuuuacaucauugaauucaccagacugauagccacacuaucuuaugugguugugaggauuucaugagaugauucaugcaaaaauuuuagaacagagccaggaauauuauacucaacaauuguucacuccuauuauuauagaggagcuacuaccugugcuauuucugagaaaucauagcuacaugcccaaauaaagaauuuuaggaauguagugucuguaugugcccuuaagaaguauaacuuggagagaauauacaauugaagaaaccuuaauugaaaauagggcuauauuaauaccgucuucuuccaguguagcuauucugguauaauugguccugguccuggacuuaggcuuuuaaauuuguuauuauugagaaauaauucacuuacuauaacauuuaccauuuuaaaauguacaauucaguaguccuuaguauagucacaagguugugcaaccauuacugcuaauuccagaacauuuucauuaucccaaaaaagaaacugcauacucucuuagcagucacuccuauuccugucuuacucucccaggcccuggcaaccacuaaucuacuuucuggcucugugaauuugcauauucuggacaucucauauaaauggagucauauaauauaugcccuucugugucugcuuuuuaaauuuaguguaauguugucaggguucauccauguuguagcauguaucaguguuccauuccuuuuuauaacugaggaauauuccguuguguagauauaccacauuuugcuuauccauuuaucaguugauggacauuuggguuguguuccuucuuggcuauuauuagaagugcugcuaugaauauuuguucauacaagcuuuuauaugaacauuggguauauaccuugaaguggaauucucuugaguauauacauagguguggaauuuuggaguccuaugaauucuguuuaacuuuguuaagaacugacaaacuguuuucugcagugacugcaacauuuuuauauuccugcuagcaauguauaaagguuccaauuucuccacauccucaccaacgcuuacuauuuuucuuuuuuuuuuuuuuaauugcccuccuagugggugugaagugguaucucauugugguuuugauuugcauuucccuaaugacuaaugaugcugaacauguuuuuaugugcucucuggccauuaguauauuuucuuuucagaaaugucucuucaaauccuuugcccauuuuaaaauugagcuccuacuuuuuaaaaccauaaaauaauaauaugguuaauauaguauuuagcaaaauagucacuauuuucugguccugguucagucuuguguagcaguuaggcccuaguaggacaguuagaugaagauuaaauuuuuuaguuacuguaucaguuaggguugccagagaaacugaaucaagaggguguauauguagagaugagaaagagggagagaaagaaauuuauauuauggaauuggcuuaugugauuaugggagcugguaagucugaaauccauagagcaggccagcagcuggaaacucagguaaaaguugaugauguggucuugaguuugaaaucuguagggugggcugcaaccuggaaauccaggcagaauuucgauguugcagucuugaggagaauuccuccucuaagaaaccucuguuuuugcuuguaaggcuuugaacagauuggagggggcccagccacucauuauugaggguaaccucccuuaaaguuaacggauuguagauauuaaucacaccuacaaaauaccuucaccacaccaucugggcuaguguuugaccaaacaacugggcaccauagucuagccaaguugucauaaaauuaucacaguuacuuuaaaugaucauauucacauauuuucagaaaaaugggacuaaugauggagacuauguuuuucuaacuggagaagacaguuaccuuaacuuuacaaaaauuguggaauggaaugggaaaacguaagucaaaugauuuaucaguggaauuauuuuuucaguuuucauuuaaacuacaugucuacuucuacauugcuuaaaaauguguuuagccuuuuuuggaugaaaaauauaaaaacauguaaauagucuuguaauuauuauucuacaaaucaagauggugguaaaacaucuuacagauuaaauauuagugauuuguagauuuaucauggccaggcaugaauuacaggccagugaaaagucccacucuugcuuaguagucauugagugauguguaguagcuacagcacaaauacuuuucaaaccaccacauguuuugggcuauuuggccauugccucuaugaaagcugauuugggccagggaccuacuuuuucucccccuugaucuaauuaaaacuguugugucuguguaugaauaagauacuguggauagacagcuccaguuaaaucuugcaaaguccugaccauuuaagagaaucuaaacucaaaugugaucaucuuuacucuuucuugugcuuaucaauuauaggucacuugacugguggauaacagacaagugcaauaugauuaauggaacagauggagauucuuuucacccacuaauaaccaaagaugagguccuuuaugucuucccaucugacuuuugcagguaaaagcuuuaaagauaaguucuuuuucaaaaauaaggucuuucacugcaagaccaccaaaagcaugaggaauauaugcagacacacuuauuaugcauggauauuuaugcauaaucagugauaaaugcugauggcacaucgagacaguauaguguacugguucacagcacagacuucugacuguugguuugaaucuuggcucuaccacuuauagcugugugaccuugggcaaauuacuuaaccacucuguaccucacuuuccuuauuuguaaaacaaagauagaaauuguuaacuauguuagagguuguuaugaggacaaaugaguuaguauuagucaaauacuuagcccagggcccaucacacaguaaccaauauuaaguguuggcucuuaguuacuaugauaugcucugucaagcaucaacugaccuggucuacuuccagucaauagguagucucuacauggaagccaaauaaaagauacuguuguccauauuucagcagagugguuuccucaggggaggcagagaaggaauggaaucaagagcauuacguagacagguucaguuauauccauaauauaauuuuuauuugucuaaguggcagauacaaagguauuuguuagaguauuuuaucucuuucuggugccuaaaauuuuucauuaaaaaaugcuguaggggugguuugguuugugcagugaaaccaccuauguuauucacaaccuugcgagagauguaucaacagcucugguucagagaugaaaaagugaggcccagaaggcucuuccggccagccuucaaaggaagggcugaaggcucaguggugacuguguacaucaaagugguuaggcacuaugcaguguaagcaguggucauauuacaugggacuauguuugaaaucaguaagaaugaaaggcagaauuacguugaacuccauuuaaauaaaugacuggggcaaaauauggaaucugauuuuucuuggagggggggauugaguaucaaaguguguauuccaauaaaguaucuguccaaugugacacuuuucaagugccuaagacccuacgaggccacggccaucgcugccuguucuaccuuagcuuuggcucugccgugcccuggcuucccuggcuuugccgguggcccguccacacuggcauauguccaugcaggucuagagaggccucuuauuucuuuuuuaugugagucuccauucuaaauguuaucaucuuaauuuuguaccacauauuguuuuuucuuguuuggaugauaucaccguugcuacaauaaacaccuuccacuacaauucaucuucugcuuuauuacacguugaguugacagaaugccuuccaaacauuccuuucuacuuacccugugagcuuuuggccauguuguaccugagaacuguugcuaacuugcggauuucgggcagauuacacugaccagaguccacauucacuuuuuauucuuacauccuaacaggucaguguauauuacuuucagugacuaugagaguguacagggacugccugccuuucgguauaaaguuccugcagaaauauuagccaauacgucagacaaugccggcuucuguauaccugagggaaacugccugggcucaggaguucugaaugucagcaucugcaagaaugguaagaacucagagaggggacaugauaggggugucaagaaugcagaaggauuggaguucaacaaagaauauguagcugggcguaguggcgcacaccuacagucccagcuacuaaggaugcugaggugggaugaucacuugagcccaggaguucucaaguccauccugggcaacauggcgagaccacugucucuaaaaaacaaaacaaacaaaaaagaauauauugucagcccaauagaaagaucaguuucuuucaagaacaauguuucauaacauggcuauugaaugguaaaaaaaaaucauggcuuuucugugaugcuuuuuauuucuagaaugccauguuguguuuuuuuuucuggacagugguuuagaagucuuaacaguaauaauagcucauguuuacuaagcaccugauguaugccagucacuguccuaagugcuuuacauauuuacauguaguuaaugcaugcaaaacauuaacugauuucauguucaaaacaaugcuaaggcugggcacgguggcucaugcuuguauucccagcacuuugagaggccgagaugugaggauugcuugaggccagggguucaagaucagccugggcaacauagcaagacccugucucuacaaaaaaaaaaaaauuaaaaaauuagcuggguguggcggcacacaccuguaguuacagcugcucaggaggcugaggcagagagauugcuugaacccaggaguucgagguugcacugugcuaugauugugcugcugcacuccagccugggcaauagagugauuccgcaccuccccaccaaaaaaaaaaaaaagcuaaaagaaaaaguggacaacucaguuuuaagaaaguacguaucauggcaaagauucucagugauuuugaagcagaguuaguuuuaaacccugacacaaaugucccaguguuucuuaaugucagagcuacucugcuccuuuccaugaaugaggcagaauuaucaguggcacaacugacaaaacuauuuucuucaucuugaagaguaguuuuaacagccacauguugcagaauuauucacaaugaacuuacuagauaguagacauucagcggccuguuuuuauaauuggggaaacuagggcucagagagggaacgugauuuugaugcgacuccucccucugagcagaucccuggcggaacucagggucuucucauauuugcccugugauucccucuugggcuguaauuccucuuuaaaauuucucuggagagcucucuguguagucccuuucuccugaauaguaaugugcucacuuuugcucccuuaucuaucucauuuuaaaaucuccuuucaggccuggcaugguggcgugugccuguagacccagcuacucaggaggcuaugguggaagggucguuugagcccaguuugauucuagccugggcaacauagcgagacuccaucuuuuaaaaaagaaaaaaaaaaaaagaauaagauaucauuuuggaauaagucugaagucagcaguauaccuccugauccuugucugacagggcagugacccccacaccuggcuuuacaucagaauuaucuggagaguuauuaaaaauauauuggugaggcaugguggaucaugccuguaauccuaacacuuuaggaggcugaagcaggaggcucacuugaggccaagaauuuagaccugcaugggcaacagggagaccccaucugaacaaaaaauuuaaaaauuagcugggcauaguagcauacaccuauaguuccagauacccaggaggcugaggcuggagcguaggaauucaaggcugcagugagcuaugauugcaacacugcacuccagccugggcaacagagugagaccuggucucaaaaaacaaaaaaauuauauauauauaaaaaauuguuuauauauacguauaucauauauauguguauauauacauauauauauacaacugacaaaaguauuuuucaucuugaagacuaguuuuaacagccacauguauauauuuauguauguauauguuaauauauuuguuaauauaugaguauauuaacaaauuuuauaguuauauauaaauaugcauauauuugcauauacuuauauuugcuauauuuuaauauauauguauauaguauauauauauagguauacacacacacgugcgcaagugugcacacacacucauggugcacacacaugcauguaugucccagggucccauguuggauauaccagggccccagaaucuacacuuuuaacaaguacuccagcugauuuccauaaagauggcgucuagguauuuggggaccauugugcaagggaacaugguacccuuuaccuggagauaaagaccaagggugaaugggaacaaguuccugguugugaucucccccauugccuuacugguaauaguccugaaacagugucccugcccccucaucuggugugcaucuggcucaaagcaaaaauguagauauauuuucucuugcuguuuuuauuaaauucuguuuccuuaagaagcugaugccagaaucaacagaaguauucuacuuuacacauuuaaacuucuugcuacaauccuuuuccucuucccucuuaacguauucccgaauuuggacugaagugaaacuccccaggauuauccuccaguguuuugaauucuccagggaaacauuuuggauagcaggaugaguguucuggagucaggcagauuggguuugaguccuauucuauuuguugguaaauuggccaaaguuuauuaaggaggguuccagacaucaguuuucucauuaauaaaauggaggugguuauagcuucuugagguugugugagaguuagaaauaauauauauaaaacacucaggacaguagccccuauuaagcccucaacagauuuaaaaaauacauuuucaaggucauuauaggucacaaagaaggaagucaugccuuuguggaacuauucagcaguaaacagcaaaaugcaugugcaugugagagaugagggaugaguuccuuaagccaugggcuggugaauauguaagcaaauuuaaauaacuugccgacaagcuccuuucuccaaaaauguauuucccuggcagcaauuguugggucccucucuucuuuucaauagccagaucuagaauagguuuccuuuaguaacuuguuucccuauuugguuauauauauauauauauauauauauauuuaaauuuacauaagcacuuauuugguucuuaaaaugaauaggaaaggaaaaaccccagaaucuuugugaucugguuagaggcuggguguauagcacaaccaggcuaacucuuaaaaaauuauguaggccaggugugguggcucaagccuguaaucucagcacuuugggaggcugaggcgggcagaucacuugagguaaggaguucaagaccagccuugccaacauggugaaacgcugucucuacuaaaaauacaaaaaaauuauccgggugugguggugcaugccuguagucccagcuacuugggaggcugaggcaggagaauugcuugaaccugggaggcggaggcugcagugagcugagauuaugccugucuuugguaaaaacaaaacaaaacaaaacaaaaaaccaccaaaaauuuuuuuuuaauuuuaaaaaggacaagaaauaaaaagucaguccacuuacugauagagaauuguaguugaaacuagugcuuugagguacaacacccuucauucacuuaguauucugccuucauagccugauggcuagcugucccuggguaaauuuuguaacuucuaugaaccucacuuucuucaaaugcaaagugaggcuaauaguucugacuuuacugggcuguugggagcauuaaauaaaauaauguguaugaagcacuuauacuuuaacuucaguaaauauuuguugaagaauaaauaauuuagccugaacuucaauauauaauguggaauaaaaaauuggggguaaaugagaugucagaaaaugaaguauaaauccugaacuaggagguaaaggaugguguuuuagccuacccaaguuaauuuauauguagcuuuuuuguuuuucuuuaggaaccaggcuguggccaggaacuuuuauauucagcucagcuuagauuuuaaaaacagcaucauucauuucuguuuuccuucaaaugcaggugcacccaucauuaugucuuucccacacuuuuaccaagcagaugagagguuuguuucugccauagaaggcaugcacccaaaucaggaagaccaugagacauuuguggacauuaauccugugaguacauacuuccuccugguaaaagagcauauguuuuauucugucuauacauuguucaccaguuuaguccugagccuucuuuaaaaauauccuuacuuucauauacauauucaagugggagaaauucagcucagugcugauggaggcauugucucauagcccuguaauuagaaggcugaauuuuguggauugaauagcagaaauacgagcaaaccugccuuuaacaaaaagcaacagugaaaacucaguuauuggaaacuacugauguacccauauaaccuggucaaucuucugaugcuagccuuggaccucaacauauauuuauuucuccccuugggacacagaucgauaagguuaaagaugucccuuugcuuccucacugccaggaauauuuugguugaaauaugaauauguauauuaaccucagucacuuuuggcaaacuucuuucuacagguuauuugagaguuuauuauauuauuaauuguaaagguaucagauauacauagaggagacauacacacguguguguguguguguguguguguauaauacacauuuacuccuguauucauagacgagaaaaacaaaaaccaugcuaaccaugucuucauuuuuggaauuugaacauuauggaccaauaaaaaaaaaaaacaagaacauucuuuuagcacaguauuuuauggguacuucacacucuuagcugcauacauugcauuuguaucugagaaaccagugaucuuaugcucuggugaauaaaaucgugugugguuuucucccuuuucucuuagccaucagcugaucaguucccuuggaucagccaaacuguuagcagugcuugucaccaagggacgaacacagucuuauaaccuuagugcaaagauggagcugcccuaaggaugacaagugcugcagcugugccccauggcuacgcuaggcgggcccuauacuaggaugccacucucuggcagugaccaccacccucuucuuagcucucuggacaacugccuggaaauccagaccugacaggcuaucuuuuaggccuccuuccuguuggaucccuucuaaggcugugcuauucagaguggcagcauccugggagcuuguuagaaauggccagucuacugaaucagagccugcauuuuaacaggauucccaaggaccuacauucauacucauguuugagacacacuggucuaucagccaccuaauacaacccaugguucucauucuguucuggggaucacuuuuacuuguuuccacucugccugucacacaugguaauggucaccuuguuuaugaggacuacacagaaauggugcucuauugaaaaaguuguuugcaguuuaauaaauccuaauguuuccuuuucacuucucugauuugcaguugacuggaauaauccuaaaagcagccaagagguuccaaaucaacauuuaugucaaaaaauuagaugacuuuguguaaguuuugcuucuuucuauggaggggacagcaguuuugcuccauugcccgucuggugggguugaugucaggaggaguacagccuacuucaucuaagccugcucaccccugcccuucagggauggggcaugaucagcauuuucaugggugccuuggucuuggaauuuacuuguuuuauuuaaucauacacuuacagaguacuucccauggaucagguauuguucucagcaccuuauguggauucacauauaaccuuguauuauccccauuuuacagaugaggaaacagaagcagaguguuuagguaacuuggcuaagccuuacuaucuagucaacuuuuauccacuccacuaagccuuucccucaugcaccuugacucucuugguguauuagacuguucuuguguugcuauaaagaaauaccuggcuggguacaguggcucaugccuguaauccagcacuuugggaggccaagguggguggaucacaaggucaggagaucaagaccauccuggccaacauggugaaaccucgucucuacuaaaaauacaaaaauuagcugggcaugguggugggugccuauaaucccagcuauucgggaggcugaggcaagagaaucgcuugaaccagggagucggaggucacagugagccaagaugguggcacugcacuccagucuggcgacagagcaagacugugucucaggaaaaaaaaaaaaagcggggggggggagggagggagggaaaggaaaggaaauaccugagauugguuaauuuauaaagagauuuaauuggcuuacaguucuguaggcuguacaggaagcauggugcuggcaucugcucaguuucuagggaugccucagggagcuuuugcucauggcagaaggagaagcaggaauaaagcacgucacauggggugagcaggagcaagagagagaggaggggaggugccacacacuuuuaaauaacagaucucaugauaacucacuaucacaaggacagcaccaagcgaauggugcuaaaccauucaugagaaauccacccccaugauccagucacugccuaccaagccccaccuccaacacuggggauuacauuucacccugagauuugggggaacaaguauccaaacuauaucacucagagacuugagacagagucucuuccucuuccucucucucuauucccacugaucccacuuggggccagccauagcucucauuuguauaguuauaaucucuugagucuagccuuacuuccccaugcugcagcuuaauuuggauuccaaaguauaaucuccugcucagacuuuucaaugggaauuuuuuagauaugagaaaauuaugauauaauguugagugaaauaaacaggaugcaaaacuaugcauaauauauuuaucuauaaaacuuggcuuguuuaccucauugaauuugccagauuuaauaccaggugucauggcucuuucuaagaaguaggugguuuacaagaaugcauuuugucaucugcauaucuauuuccgaggcaguauaauuuaguaguuaagagcuggaaucuuagaagcaaaguggaauuacauuuguggcuccaucacuuacuuguggugauccuaggccucucugagucauaauuuucucaucuguaaaccugggacaguaauaccuacuguaggugacuacucuaggaauugaaugagauaauaucccaaaaacacccagcacagagcuggcacgugguacaugcucaguuggcucuuguugcaaagacaguacuucaguggccuaguuacaaaacacucugaggagugacaguuuuguucugucgacuggagccuucccugaugacucuaaggagacuagucaucauuuuaaggaaucugccuucaguaucuuguguuuugauaaacguacagcacauggaauugcuagacagacuggaaucuaacuuuugggguacauguuugcaaagauaacuaagaaaucagcaaauucuggguaauuuaagaaauaaguguacuagaaucuucauauaaaugugucuguccgggaaagugugccauugugaugaggauguuucugaaacaaucucauccuuugucuuuguagugaaacgggagacauuagaaccaugguuuucccagugauguaccucaaugagguaaguccugagacggagggagccacggguguuuucagacucagaaaaaauccauuaugaugucuacuguuguaguuacauguaaguuaugacagaagggcaaaagauuuuuaaaaccuguuauuccucagaaaauuucacuuaaauguucacaugaaucugccugugucugagagcugauuuggagaaaugauggaaagaaauuuuccuucucaagaacacuauuugggcaaaacucccuucuggggagcugcucacguaggaaacagaaacagguaaaaggagccauuggcagacauuguugaagcagggaaauagcucacacucagauagaugccagcuagcccuuugucucccccuucuuugaaaccaugcugguuuaagacaccuaugauaaauucuuuucugaaucacauaucacguuuacuguaguuauaucuccucaguuucuccugcuuccgcccaguuugagggaaaaaaaaaaaacgcagguuuuuuucuucaauaaauucuugauuggcaaacuucuccuuuuuauuauuuuuguguuuccuaaaaauacuugcuguuuguagaauauugaauaacagagauuagcaagaaaaagaaaaauuaaaaucacuauucacaaaaucugugucagccugauaauauuuuuauuuuauuuuacucaauguguuguacaauuuuuuccaauaacaacuuuaaaagguaaucuaauguuuuacauuuuauaaaacaugugcucuuuauaaaauucuuagaaauuuuuuuaaaaauugauuuaaaaaguaaauuacugauaagucccucucuaucagaggcaggugcaguucagaugucaacuccugauauuuucuggucuugauauuacauaguugaaaucauacgauagauacaauuuuauaucuuuuuucuccauuuagcauuauauugguauucacauuuacaaacuuuuaaggguuuguuauuacaauucuaagaugagguuuuuaucguuucauaggaaaaauucaagcaauauuuaccaauuuauaggaucucuuugcaauugcuccugaucauccauguuccuguuugugggcaggggcaugaaagaucuuuuugaaaaugcagaagggcccuuuucugccaacuucuguucaguaguggcauauuugaagucccuccacccccaacuucuaauuugcuuuuuugugaaagacuagauuaaguccagguguguggaguggaaccuuguauuuuugcugccuccuaggaagagcgugauuauucucuucucuagaaaaauaaaauauuagaccuggaagucuggaagugacauuggagacuguugccacaccaccuuuuuaccgaggaggaaacucuauccaguuauuggaaaaaaugucuuagaacccaauccacugacucgguccaaugaaaaaaaaugcuuucuuuucuuuuuuuuuuuuuuuugagacaaggucucacucucacccucuacaguggugcgauuuuggcucacugcagccucgacuucccgggcucaagugauccucccaccucugccuuccaaguagcuggaacuacaggugugugccaccaugcccggcuaauuuuuuuuuuuuuuccugagauggagucuugcucuguugcccaggcuggagugcaguggcccaaucucagcucacggcaaccucugccuccuggguucaagcaauucucgugccucggccucccaaguagcugggacuacaggcgcccgccaccaccccuggcuaauuuuuguauuuuuagcagagaugagguuucaccauguugaaacucaugaccucaagugaucugcccaucucggccucccaaagugcugggauuacagucaugagccaccaugcccagccccagcuaauuuuuguauuuuuuguagagaggugguuucaccacauugcucaggcuggucucaaacuuuugagcucaagcaauccgccugccuuggccucccaaagugcugggauuauaggcgugugcaacuaugccaggccuccagugcaaauuaagccuaaacuaggccagaauuguugcucauuauuucuauggaauuaagcucuucagauaccucacucauuacacuaggugguaauuccucugcucugcauacacuaaguguuauucuaguacauuuccuucuaucagcagucucuggaauucuaguuagcccacaacuuugcugagcacuuucuguagagggcugugguccugauuacuauagauguaaccaagaaagaaauuauacuuuccacauaccauuuuugcaguguuucauuuauuuauucauuuaaucagccagcauuaaucaagcaccuacugugugcugggugcuauacccaguguggaggugacugagguuaagucuugccuucagggacuucacagccauugcaagacaaacaguuacaaugcagagugcaaggacaaugauggaaguagagagugagauggaaacuuagggaggaggccuuugacuaggccugagguagccagagaaaacuuuuggaaggaagugaugcugagcuggauuuuuaaggaugaauuggaauuaucugacauaaaacaaaaggugauacugucucaauauuucugaauacauuuuaccuccuuuuuccaaucuauuuuaagaguaaaaaaaaugucuucaggagaagacaagauauuaaugaauaaaugucccuucugauuacucugacuuauaaauggauuuucaguauguuugguuugcuaacaggaggacauucccaaauuguauuaaacaaaggaaagauauagcaaaaaacaguuacacacuggauguuuagucaucaagaauacuauuuucuugccucuccagaguguucacauugauaaagagacggcgagucgacugaagucuaugauuaacacuacuuugaucaucaccaacauacccuacaucaucauggcgcuggguguguucuuugguuugguuuuuaccuggcuugcaugcaaaggacagggauccauggaugaggugagaacuggcugaaggaacuucuuccuuacuggauaacuuuaccugaggaauucaacuguacuucacugaagggcugucagcuggcuuauuaggauaaauucugggauuuuaugcugggcauagugauuucgugcuuauuuuacugcuggaccaaaugggaagcaaaggaagugugucaaagaagguggaggguuagaagguaccaucuaauauuuggggaauagaaucucuuuggauguauccccugggaguuaacuuuaugucuuugaaaacaauaaccugaaagaaaaggaagaauauauaacaguuacacaucugaucuuuggugucagacugccugaguucaaaucccaguucugccacuuaacagcuauacgacccuagaaacugugcuucaguuucuucaucuguaaaaugggauaauaaaagccucccuuaugaguuuuucaugaggauuagaugauauaguagacuuaaaggacuuggcccaguguuagcauauaguaagagcucaauaaagguuuaaguauuauuaaauaugauaaaacagcuccaagauuauagagcaagacagccaggguccugcuuggaaagaaucccugauguauccgaagauaccuaugauuuagguaucacugcauaauaaaugauuggaacauggguguaguuacuuuccuggaaggcuaggauaaagaguuggguucgccuuuccaagugaccagcagcccagccaggaaccugaauaccugcaaugagccuuuucuguagaagcccuucuuaaauuuucugcagcuuccuuuuuuuuacaacaguggccuuuuuuccuccaguuuccucaacuaaguguccaaggcaaaugugaaguagaaaauaaauacgugaaaccaucugaguaaaauuagcugaauuucccugacuuccauauucuuccauuauuucucuuauccccugccagucacuuuagccugaauuagcugugaggcaaacuauuuugccauuucuauguguggaucuuccagugugacuuuaugcagucauugaaauugucuuaagcacaaaugaaaccucauggaaauguuaauuacugcuccuacaauuaaccuuccucauauauucaacaagcaaggaauuauugagaacuaauaccucugagacacuacuccuuaguagguuucaaaccaggaaggaggcaaguugaauagagucuaaguuuuauaauccagaucaacacagagaaggguacugcucugguauugagggugggaguggucagagaaggccuccuggaaagguuaggccugcugaaucuucaagaacaagcagcagcccaagaggggaggugagugagaugagccaccuuccuauaggucucuccuccuuccaugcccccacuccccacccaaacuuuucacacuggggagaaguuucugacaugaacaucuaacuuguuuucucucuucuguguuucagggaacagcggaugaaagagcaccccucauucgaaccuaaacauugccuuugcuuggugaagaaacugugugagcuguccugaccuggacgaugacguggggaaacccuccaccuccuugcaggcuuguugccuguugaaagaaggaaaaagacacggcgcuggcaagugauaggaacauucuggccagagguuaaagagcaggcugacauggcuggccauuaagcuuuauaaaaucaugugggcucugaaauuguucuuuuaugugucuagcaaguauuuaauaaacccuuguauaguaauuuuguuguuguugggugcugguagcuccagaauuuugugaccacuauuguggguaaaaugucucugcaucacuuguuaaugcuacuggucuaacuucauucaguaugcuucauucaccgaacuuugugcucaaaaugcguauauaccauuuuauguuguauuccuccauuucacuugcaaaacagaaguaaauaagaguucgggacccaggguaaaaugguagcuucauccaauauaucauucaaaugcaucugauuucuaaaacauauuacauuuuaugcugaucuucaguucauaauucuuccaggaaaacucagucuuccaacugcaauaaaauacuggguagaaucaaaugggaaagggguuggguggggcaauacccaugaguugauagugauaagcuccuaaggauuuuuaacuuguacuuuugugaacgaagagaaugcauaaauaauguuggugaggauaaaguacagauauuucauguagaauuaauugcuaguuaugaugcuuguggauaguuaacuguuuuuuuuuuagucaaaaugaucaugcuacgaaaagaugcuucugagagaauguaaugaguaacugauuuuucuuccugagucgcccuugccaaauauguuacuguauuaauuaaucuaauauugagugauuauuuguaaaauuaugaauaugggaaauccaucuaucuacagccuaaguuacacauaaguuucagaaagucugauuagacuaaagagauauuucuucugggacagccgccuucuugguaauuuugaaguucuuuuuacaaguuccuuccucaguuucaguucuuuccaguguuuuguagcucacugucacucacugaauagagaaacgugugcccuauacuuccugugacaaucauuuugcugacagaaugauggauguuuaaaauauugcacaaaguacuuuaaagaaaggucuguuaggaccagaagcagagacaccacuuuucaaaggacuucuugguuucagcauaaccuaagacagggaauugggagccaucauaugucacaguguucagaauucaagcauauuuaagggcauuuucuuugauucucaaaguucagcauucauuuugaauugagaagccuauacauuuagcugacaaagugcuuauagaauuucuuaacaacugaaccauucaaaaggauuuuuuuuguuuaaaacuggauuucaauguaagcaaaugaagaaaaaaauauagauuucauuuccauagcuucuuaucccuguauugagguaauaaauuguuuuacugacaauuuuuccuuuuucuacacuaaaacaauaugugauauauuuccccucuugaagaggcaauucauuaaacucucaaauuuucuauagaaucaagauagaaccuuuagauacuccaacucaccaaaauguaaaaaaacuaacaaaaauauuuggucuucaauaaugcuaaauaucuacauuuuuagaauuuaucaacauuuaacuagauaauugggcaugucuuaauuaugcauguacuuauccauacuaauaaaauugacaaugcuagugcauacuuauugguuuaguccuauuaucaggauauaaucaucugugaggaggauauuuuaaauacuguaaaugauaacaguuaaugauauacacauuuagacugaguugcacacuggcagggagaccaaaaacauuacuuccauacuugugucaugauucuuuuuuuuuugagagagucucacucugucgccaggcuggaguacaguggcaugaucucggcucacugcaaccucugccucccggguucaagcaauucuccugccucagccacccaaguagcugggacuacaggugcgugccaccacgcccagcuaaauuuuguauuuuuaguggagacgggguuucaccauguuggccaggauggucucaaucuccugacccugcgaucugcccaccucagccucccaaagugcugggauuacaggcguaagccaccgggccuggccuguuuuaugauucuuaauaguuacuugguuuaaaucacauuugauacuauccuucugaaaagucugagacagaucuacaaacuacagucaaaauuauagauuaagaggaaugaaugcaccuauuuggcuuuaaguugaagaugaauuauuucucaugcucauuuucuugcggcaguuaucuuagaaagacccccaaaggcuuugugauuguaagcacugucaugaucacagaaugcaagcuucugguaccaugauccucaacuuagagaggaagaaaccaagacagagagcuuaacucacuucucucagggaaaauuaggaguugagcacaggacaggaaaugggcuuugccacuuuuagcuccaggcuuuucuaaccagacuugauuuccucauguucuagaaagaucacuaauggucaaguggaacaagcacuacacgacuaaccccuauugggguuuuuaacuuaagggaggcuaauuuuuaauuuaaacugcucgagauaugaguucugcaaaaggugguccgcauccuuggcccucuggacauuaucacuaaauugcuugugccuguuaacaagaauacugaccagaaugcucuucauguagcuuauacaguugguucacuucaugcgguucuugacauguuuauuucuacccuuaaugcaaugaaauguuucauuaauaaaaaaccacuuuauauaa

SEQ ID NO: 191485 - RNA, 94267 nt, Homo sapiens
gcacgaagcauauuaagguagauauguucuaucguuaauuguaguuuugacagguggcaucucaguaaucaaaaggaagaaaaugugagugaaauaaaaaugaauuccguuuaauaaaaacuguuaagcucaggguuuuuuuaaauuuuuagagacuuuaugcuuacaaucaugaauuaauguaaaaaugauaagcagcguguuacaugaucuuccucuucccaucacuuuagugguccucacccacaucuauuuuguuuuguuuuuuagagaaugaagauuuugauucaugaauuugacucauuguuuuucuuuuuucuaucuuaauuucugcuuuugcauuuauuauuuccuacuugugcuuucuuuuaguucacccauuuuucuauguuuuuguguuagacacuuaaugaauuuacuuuuauuauuucauuuuuauugauguagguguccagggcugggaauuuucaucuuuuuacuauuuuaauguaugucacagauugauauguacuauuuucauuauuauuuuucagaaauuauuuaauuucagcuuguguuucccuuaucacacaagaguuguuuaauagaaggccuuuuaauuuccagguagaaagaccuuuuuaauuuggagauuuugauuuuaauuuuuagcuuuauuauacugugaccagaagguguuguuuguaacauuucuacuuuauggaaaccuacuuuauggaaccuacugauuugugcccuagaauaugacugauuuuugugaauguuucaugugcccuuggagaggaaaguauauugucuguuaucaaaguauaguguuuaauauauagccaaaaggucuaccuuagugauuaguucuucuaaaucuuuuauaucucuacuuauuuuuuguccacuuggccugucucauacuaauuguccguuaaagccucccauuauuacugcguuugcaguucuuaccguaucuucuguggauuuaugcuuuauccaagugauugcuguguuauaugguacauaucuuuauugugcaauguggcuuuuaacuucaagugcacugcaauuuguuuuaguuaaugcucucuggcuugaagacaacuuagucugguauuaggauuuuaacccgugcuuucuuguuguuuucauuugccuggcaauuuuuguucauccuuuuauuuuuagucuuuuugaaucucugcguguguuuuuaggcauacuuuuuuguacauagcaggguuguuuuuuuuaaagucaauuugaaaauccuuuucuuccaauaggcaaguuaaguccucuuacauuaaucaacaugacuguuuggucuaaauucugugguauuuuuuucacaucauucuauuaucuuguggguguaauuacugaauguguuauauuugcuagaguuucuuuauuugguguuucuucuuuauguuuccauuuaaaauucuuugucauuuaagaagguuuguauuuuuacucuagugguuacuuuuguacuuaugcuuuuuauagugcacuuuuaaaccugcuuuuucuuacuugaccuuuuacuuuuucucaguuuuaagugguguccuuugacugcugucuauuccauuuuaagucaauggucuuuuacuuuccacuuuucucccucuuccuuccguuuuuaguuacauuuauucuccuuugucaugcacauaauauuuauaucgcuauucagugccauuaccucaccuuuguuuuucucaacucuauaauugaguauuuaaauauucaccaucaguccccuugcaguuuucccggucuuguuuuuuaaauguuugucuuuauccuuuuuuuccaaauuuacuuuuaaaaauuuagaaccuacacaaaaccuugaagaucuucaccaguuguagacacugccacauuuuacaguggucuucugggugaaugaggcucaucuucucuaguagaauccucagcagaggcacacggcacagugucccgguacagucaaaacugcuuuuuuguggcuucaaaccuuuugagggacaucuuggcuggcuguaauauccuugguuuguccuuucuuucccuucuugaaaguacuacuacacucuugccuuacuguguguauuguuuuuuaauaaccuggugccagucuaaucuucuugccuuuguaaauuauuucaucuuuuuugccuggacacacugaggauuuuuucauuaucuuuaaagucuuaauauuguauuacuaguguaugucucagaguuuaucauucuugaucacuuuucccugauauggaaaauguguagauucgggucuuuauuucuagaaaauuuucuuggauuauaguuuuaaauaguaguucuguuucauguuuuuccuuuaggaaacccaguuguauuauauucaaccucauuuaccugucuucaauuucaguccucucucacuccuuuuuuuugucuucuuuucuuccuuuuuguggagaauggggucuugcccuguugcccaggcaguucuugaacuccgggguucaagcuauccuccugcuucugcaucucuaagugcugggauuacaggcaugagccaccacacccagcucucacccuuuuuacuucuuuauuuuauuuuuuauucucaugguggcuuuccugauuuucuucagugccuuuauuaaauuuuuauuacaaccugucaucgcuuguguacuuugugauucagucuuuauuucugauauaguuuuguuuuuuauuucucugucuuuccuaacuuuaaucaacucucauuucaucucuuccuguuuguuuguuuguuugcuuguuuuguuucuuguccauuuuuauucuuuggcuuuacauuucuaauucaggggugauuuuucauacccuaaauucuuguuugagccuacuggguucaguuuggaguauuauguuucaguuuucuuuggcuucauguuuguuguuugugggagagacuuuucaucagcagaaaagauuguauucauguuuucugacauuuugcaguagauauagucugcuuuuaucuauuccuauucauuuuguggacaaggguccuacuuugagacugccuucugccaugcacuuucuuuauggguagugguguugggugggaaggauggaagaagggugguauaucuagcuuguguuuugcuucugcugguuccuugguguuccucucucauuuccuucuuucccuugacugccaugucccuaggggagaccauuuuuucucucuguaucucauucaccccaagaaacccugcuucucugaggccgcuacuucuucaaacccuuaccccauugucagggcuauggacuaucaaguuccaaccugugcuuaauauuuuggccuuuacuuuuucaccucuggggaugaauuuaucuguacuuuuucugucuucugcuuaccucuucccucccauuuucuguaccccuaggcuuguaguguugguaggugggcugcgggaauuguuuuggaaaaagauuucccuguacuugcagauuauuugaagguugugguacucucugucuuccagugaugcuagggguguggagugccugguugauuuuaugguuauuugggaagaugugaggaagauuugaaaucagaccaccaccauuguucuccacauuuagaauucuccucuuagcuuaaaugaaaauugugagcacuauuugacaucagagaaguucuucaacuuuuauuagugacuuccauuuugaugauuugugguuuuugcuaaggagauauuuucuuccauuauuugaugguguaaccuuaugagaaaccucuacaauaauuaguuucuuauuuucagguugucuuuaauaauguacuuggcuauuaaaaucaauaauuuucaccauaagauuguauucacuuauuaauuuuauguaauauaauguauuucuguauaaauaauuauuuuucuggagaagaaauuauuacuaaauuucaauguuaaaaagucaguuccuguucuucuaugaacuuuuuucacauaguaccuuguuaauaaagauugaaucucugucuuucauagacaggaaccaaaagaaccaaagagggaaccauucauacuucaagaucucuaauaagaaguagcaauauuuaauauggaaucaaaagcuugggaaucaaauaaugaagaucuuuuaucaaguaguggugucacaucuaauggagguaugugcuguuuauaaaacaaaauggggaaaaaauagaauuaaccaugauauucauucaagcugcuguuucuaguauguuuuauuuuuaaccauguggguuacagaccaugaucaugaaugucuaccauauuguuuauaauucuacuuuuugaagaagagauuccuuugucuuuuaaggaauuuuuuguuuuaaaaauguuucuacauugaaguacuucagccucaacaugccccaugccucccuaaugccuucucuuccuccugugucuuccuagccugccuuccuuggucugcccuaagucagaauuuuguaucauuucauucuuuuuccucaccugcugcuacauccagucagguacugaggcccugcugauuuuaccuuugaaaugucucuugaauccauuuuuucccucuccauuuccauuacugguguucugguucaggcccccaucaccucugauccaaauuauuucaaucaaaggugauuccuaugucaggaaaacagacacagauggaauaaauaguuggaauuuaauacaaggaaugguuacauagguguugaaagagcugcaaagccuaaagggaugaaacaacacagaaauuaccaacugcaagaagcugcuaccaaccaugccuuuggcuagaaggacaaugagaaaagcagcuguugcaagggcauggaagcuagagguagaaccacggagagggcugccuggaaggagcugaagccaccaccaacuaccagauccucaucugagacagugagaggaccaugaccuuggcuuccccucuucugcugccuccagcucuucugcgagcucuucccauugcaaaccuauguggaagagaacuagaaagggaaccuacaacacucaacagagaaggggaaggacagagaaugcauucaagggcaaucaggcaaaugaccugcacuuucccuuccuugccccucucuccucauucuuuuuuucuuuucaauuuaauggucuaucucagaagccagauucauauaaguuuuuucuaguagaaauucagguucagaauaggauaaucacagauguaacucauucuuuuagugcaugcagagguuauucucaguuacugaucuguuguuuuacuggucugcuuaaaaacguuucuuucagcaccauuauuguauaaacauuucugcuucucacuaugcucauauauccuaaaaugccauugucaucuccaccuuaccacacccaucuccccugcccaccuccacuugcucacuuccuacauagccacauccucauacucauuauuggcacuggcacuuagaucacggguugucccucccugcuuaggugcaucgucauccuguaauacuguccucauaggugacccaucugagaucuuagacuuacagcuuuuugaccucuuaaauucuuauuauuuuaaccuuuacucuaguuacccacucccuuauuuuggaucuuauuaccaagaacugauagacuucugaaauucaaccuccugucuuuuauuuuuuaacauaaacucaagauuuuauugucuucauaauaaaacaaaagaugacacugauaacuggauugcuuggccguuucucuucauaucucaagccaguucaagggcuugcuucucuuaguugccagcguucucuuagaucugcagcuggguucaaugcacucaaggccucagcacaaucuugaucguuuuagucuuuuuccagaaaauugacuuagucugccuaccauagccacucugcuuccugucaucaugcugcuuucucugggcauacagagaauccuugcccuucuuguacugugucacuuuguggaguuggugcuugccacacuuuuuauagaaagucugauggguguuugggaacauucaccaugcuugugggagugcuacuggcgaagaaguuuguuuuucuuuuaagcuccuaucuuucaaccaucucacuccuuuauuccuagaguacaccuauuuucugcacaugaagguaguguacccauaucaaaaaucacuuuuugagauuuuaaacacuuaaauggcuuagauccacaccuugagacucugauucaguaggucuagaguggagcucaggcaccgcuggguuuuuuuuaaagcuccccaggugauccugauuuauaacaaagguugggaacaacugcuuuagguucugccauuuucuccaaaauuaucaaccucuuucuaucuucacuuucuuuuguaucauuccuuauuucagccagucacuugccaguauucucaacuuccuuuccccuuuauuauucucuugcacucuuacaggaaaaaccaaauccuuaucaggcugacugccuucccuguuauucaaugggcugcugcaagauuuugaauuugcuagggaaaauacacaaauguggauuuuccacuucaaagucagucucuuaucucaauuggaugcugcuaagaaaucuuucucaugaucuuagccagauaucuuuccaguuuuccauaauacuuauuucaaaaucacaccauucuuuuuuuugggggggugguggguggguagugcagaggaaggaguaugaguuuuuuuuuuuacuauuauacuuuaaguucuaggguacaugugcacaccgugcagguuuguuacauauguauacaugugccauguuggugugcugcacccauuaacucgucauuuacauuagguauaucuccuaaugcuaucacuccccccuccccccaccccacaacaggccccgguaugugauguuccccacccuguguccaaguguucucguuguucaauucccaucuacgaguaagaacaugcgguguuugguuuucuguccuugcgauaguuugcucagaauaaugguuuccagcuucauccaugucucuacaaaagacaugaacucauccuuuuuuauggcugcauaguauuccaugguguauaugugccacauuuucuuaauccagucugucauugauggauauuuggguugguuccaagucuuugcuauugugaauagugccgcaauaaacauacgaaaaucacaccauucuuaacucccuuccccugucuucugucucacucucagauaacauuauuuccuaauuucuagagaaaauagaagcccuaugcugguccucucuuuucuccucauauccuaugcugaaggcccacuauuuuucacaguccaugccuccuucucccauagcucaauggaagagucagcuucuuaauucacuacccaugcauuucuucucaccccccacugucaacuccucugccccuucagagaucuggcucagaaaucacccugcucauucauaucuucagccuuuuucucuccguuugaaccuuuccaucaauaaaaacaugccaagucucucccaaucugaaaacacuaacaaauacauauaacacacaaaccaaaaugacaaaaacccuuuuccccaaacuaucccuuccugaucucuccuucauagcugugccuucugaaagaaaaaucuguauucccuaccuacguuuucucaccauccauucacucuacaagcuauuaucuuacagcuuuugcucccaguauuccagugaaaucacucuggccaauguagccagauucccccucugcuaaguccaauggacagcuuuuuauuuauuuauuuuuaaauuuaauuuaauuuaauuuuaaguucugggaugcaugugcaggauaugcagguguguugcauagguaaaugugugccaucgugguuugccgcaccuaucaacccaucaccuagguauuaagcccguaugcauuagccauguauccugaugcucucccuccuucugcaacccaauaggccccaguguguguuguuccccucccagcuuuuuauuugaaauuuucugaaguuguagaaaaauggaaagaacaauacagugaacaucuuauauacccuccagcuggauucaccagcuguccacauuuugucauauuugcuuuaucucuauaccuauaauauguaucuuauuuugccagaccauuugaaaauuaguugaaagcaucaugauucuugcuuuaaaaccugaaugugcaucuccuaagaauaaggaugauuuucucaaaucacauuauuauaucuaagauaaauacugucaauacaguauuaucuaauguguucauauuuaaauuucuccaguuguccucccaaaaagucuuagguauuuuuacuaaucuaggagcaaaucaaagaucaugaauuguauuugguuguuuguucuccuuauucucuuuaaauuuauaaccauucgcucucucucucucucuguauguuucucauggcauuggcuuuaagaguucagaccaguuauuauagaauguaucauagaauguccccauucuagaauuuuaaaaauuguuucucauguucagauuuagauuauacucauuugacaagaguuuuacauaaguuauguauacuuuuuuuuuuuuuuuuuugagacagagucucgcuuuguugcccaggcuggagugcauuggcaugaucucagcucacugccaccucugcuuuccggguucaaaugauucucaugccucagucucccaaguagcuggauuacaggcacacaccaccacaccuggcuaauuuuuuguauuuucaguagagaugggauuucaucguguugcccaggcuggucuugaacuccugagcucaggcaguccaccugccuuggccucccaaagugcuaggauuacagccaugagccaccacgcccggccaagugauauauacuuuuacagccuacaccagggaacacauaaugccacaucccacuaauugaaaguuacauuucccccuuuauaauuaauauguaaucuauaguguaucuuuugaaaccuugugaauauccugcuacuaaauaauccuucauccaguggcuuuagcaucaacuaaagaucugugccuaaaucaauuguuacauugaugauuuucuaauuuuaucauaguuauuagcugacauucuucaggaauaaaacagcuuucccuauuaucauuauagaaccaucuuuuguuuuuuuaauucaaagugcuaugaugcauugcugucacuacuguuuuugauucucaguuguaugaaauuugaccagcuccuuaaacuggcuccugugucuuuuuaaaggcauggccccaauuuuuugcucucugacacaucaaaacguuucaggcucaccuuguauuuugccuguucccucagaccuggauucaacuaucuugcuaggaagcccuuguuccuuuuaggagggaaucauauuuagaaaucaaggucuggcaugcauauugcuacugaggugccauugugucuaggaccuuucaguggcuaaagcuuggaagucgauuuuuaaaaaucauaaguuagaagcacugauaacucaaauucaaauccaauaccauagaguucuuccuuaucauucauauuugugucuuuccuacagugaaaacacuaauuuccaaagacuucaguacauuuauucauuuucucucuucuacaauacacaugaacuaguuucagaauuauaacaauacuaccaacauuaacaacuuacuaaguaacuaaggcuggcuguacaguguucuaauguuaacacuguguucuaauguuauuugaaggaacaaucuucuuuucucugugaggugguuauuaguuuccuuauuuacuuagguuuacuuguuucuguuaguauuuaauuuauuuucauuuuguuuuuaauuuuauuuuugaauacaucuaacauuuauauggcucagaaauaaaaacuuuguaaacugugugcucuaaauagagucuugcucccaucccuaucugcaccacucuguuuccaccuaucccuauaccccauagauaacugcauuuaugaguuucuguuuuauucuuccagguggguuuuuuuuuuccaaaauuaagcaaaugcuacaaacacacauaaacacauacacucuuccuucuccuuucuuacaaagaggagggaaauuaaccucuaccuccucaagggaagaauaucgaagaauuuuuggacauauuuuaaaaccaccaccaguuugcccccgaucacaaauuauuuacauuucacucacaugcaaauuacauucaccuucucccaagaaggcccccagcagucucauccugcuacagcaucagcuuaaggccaaaauugcuuuauccuuucacaugcguauuuuccccuugagaccuugagcuucuucgggguucaauaagggaaucaguuagcauaaagugugcacaaaauuauuuuaugaaaaaguuaauuaaugggccaggcgugguggcucaugccuguaaucccagcacuuugggaggccgaggugggcagcucaccugaggucaggaggucaggaguacgagaccagaccaugguuucaccauggcuaacauggugaaaccccguuucuacuaaaaauacaaaaaauuagcccggcaugguggcacgcuccuguaaucccagcuacucaggaggcugaggcaggagaauugcuugaacccgggaggcagagguugcagugagcaagaucgcgccauugcacuccagccugggcaauaacagugaaacuccuucucaaaaaaaacgaaaaguuaauuaaugaauucuuuaauauuuagguucuucaaguucauuuuuugugucaucuauucgugguacaauaauugaaaacacaucuucagcugggacuuugacacagguuccuuuuuucccuaaauaugaaguggaacuugauucuccuagaaaaaucaucccaucuccuggaaaggaacacuuugaacguguuuuggaagaauauucacaucaagucaaagauuuacagagaagacuaaaugaagugaguugccuucucuucuagcaccugaugcuauuugggggacaacagugagauccaguauguaguuguaaagccaguuauacaacuuccuggaagaaaaaacuaacaaauggguuuauugguuaaauuuguuaauuugaccugugccuucuauuuucgguauuaaaauugggcuaaugaaaagucuacauauuuauuuuucuuuuuuaaauaauuauucaaaacaucuugguuucaugauauaaauuuuaaugaaacuugaauaacucaaaauuauaauaaguagcauuugucugcauuuauaguuaauaauuggcauagaccugcuguccugcuaucaugauaccugauuucucuuuacaaagcaaugguagaggguagguuuuuagauauguguguauacauuauagcuaaauagcaucuagaaguuauuugcuaaaaauuucaaguggacauuacguagaaucaaacuggcuuuacaauugcauauuuggucccaguaguuaacagucuaaaagucaaacucauuacugccacauacaaagcucuucaugcucuaaccucucccugguacauuuuagccucauaugcuacccauucuccauugguaccuauucugguaguaucaggccacuugcucuucccuagauauacugcgcuauuccagaccugcaugccuuugcccaggccauuuucucuucucuaccuugucugccuggcaaacucuuauuaugcaccaagacucagcccaugcauuuucuucucugaagccuuuccucuagaugacauuaggugugcucuccucuguacaguuacugccauuugugcacauuuauugcaguauuuaguacaucuaauuuuacucauuaccacauuguucuaccucaucagauugugugagcacuuuuaggaaaaaaaaaucuacaauuuuauuaaguguugaaaauuauguaccccaguaugcacagggauacaaaaaugaauaagguaggacuuacaaggaauucauagucugggaggggagcuugucauauaaacaguggcauuaccuaugauaaauacacuaaugaaguuguauauauagacaaacgaagcacagaggcacuaaugaggagaagaaacagugucuuaauuuguuuucuauguuuauccccuaacagaguauaugacacuuaauuggccuucaauaaauaaguguuaaaucaguaaauuucccuucuuguguagguuuuuguuuuuacugggguuccuaauugccuuuuuccuuacacuauuugccuuuacauauccuuauuagaaaaaaacauaucauauagauuuucuauauccuccuuugacccaggacacuccaagugucuucugaccuuuugcucagucuagauuaguuucucuuagguaucuuguauaacucuuuuccaaagacuccugccacuacuuuccagguuggauccaugguuuccaggaaucacuguuuucuaucuucuuucuuuuuuuuuaauuaaacaaaaagguauauauauuuauggaguacaugagcuauuuugguacaggcaugcaauguguaaaaaaaucacauaaugaaaaauuggguuuccauccucucaagcauuuauacuucauguuacaaacaauccaauuauauucuuuuaguuauuugaaaauguacaauuaaauuauuauugacuauagucacccuguugugcuaucaaauacuaggucuuauucguuguauuuuuuuuguacccauuaaccauccccacuucuccuucacucccccacuacccuucccacccucugguaaccaucccucuacucucuaucuccaugaguucaauuguuuugauuuuuagaucccacaaauaagcaagaacaugugaugucugccuuucugugccuggcuuauuucacuuaacauaaugaccuccaguuccauccauguuguugcaaaugacaguaugucauucuuuauuauggcaaacaguacuccacuguuuauaaguaccacauuuucuauauccauucaucuguggauagacacuuagguugcuuccaaaucuuggcuauugugaacagucugcaacaaacaugggagugcagauaccucuuugguauauugauuuccuuuuuggggaguauauacccaacagugggauugcuggaucauacgguagcucuauuuuuaguuuuuugagagaccuccaaacuguucuuuauaguggcuguacuaauucacauucccaccaauaguguacaaggguuccuuuuucuccauauccuugccagcauucguuauugccuaacuuuuggauaaaaaccauuuuaacuggggugaguugauaucucauuguaguucagauuugcauuucucuaaugaucagugauguugagcacuuucucauaugccuauaugccauuuguauuucuucuuuugagaaaugucuauucaaaucauuugccuauuuuuaaucagauuacuagauuuuuuccuauagaguuguuugagcuccuuauauauucugguaauuaaucccuugucaaaugaguaguuugcaaguauuucuucccauucuguggguuuucucuucacuuuguugauuguuuccuuuguuguguagaagcuuucuaacuugugaucccauuuguccauuuuugcauugguugcuugugcauguaggguauuacucgagaaauuuuugcccagaucagugccugagaaguugaccccaauguuuucucauagaguuucauaguuugaggucuuagauauaagucuuuaacccauuuugauuuaauuuuuaaauauggugagagauagggaucuaguuucauuccucugcauauggauauccaguuuucccaguaccauuuauugaaaagacugucuuuucccuaauauauguucuuggcaccuuuguugaaaaugaauucacuguaugugaguggauucauuucuggguucucuauucuauucuauuguucuauguguuuguuuuuaugccaguaccaugcuguucugguuacuguagcucuguaguguaauuugaagucagguaaugugauucccccaguuuuauucuuuuuguugaggauagcuuuggccauucugugucuuuugugauuccauaugaauuuuaagauuguuuuuucuauuucugugaagaaugucauuaguauuuuuauagggauugcauugaaucuguagauugcuuuggauuguauggacauuuuaacaguauugauuuuucuaaucaaugaacaugggauaucuuucugauuuuuaguguccucuuccauuucuuucaucagcauuuuauaguuuucauuguugaggucuuucacuucuuugguuaauuccuaguauuucauuuuauuuguggaacuuguaaugggauuacuuuuuugauuucuuuuucagauugcucacuguuggcauauagaaaugcuauugauuuuuauauguuaacuuuguauccugcaacuugacugaauuugcuuauuaguucuaacauuuuuuuugguggagucuuuagguuuuuccaaauauaagauuauaucaucuggaaacaaggauauuuugacuucuuccauuccaauuuggauguccuuucuuucuuucucuaugugauugcucaagcuaggacuuccaguacuauguugaauaacaauggugaaaguggguaucuuugucauguuccagaucuuacaggaaaggcuuucaauuuuucucccuucaguaugauacuagcugugguucugucauauaugacuuuuauuauguugaucuuguaagugugcuucauuauuuucuauucuauacccauuuuuuuugaguuuuguccugaaaagauguuuaacuuuaucaaaugcuuuuucagccucaauugaaauaaucauaugguuuuuguuuuucauucuguugauaugauguaucacauugauugauuuacauauguuuaaccauccuugcaucccagggauaaaucccacuuagucaugauauaugaucuuuuuaauguauugcugaauucagcuugcuaguauuuuguuaaggauuucugcaucaguauucaucagagauacugaccuguaguuuucuuuuuuugaugugucuuugucugguuuugguaucaggguaauaacugccaucauagaaugaguuuggaagaaguucuucuuccucuauguuuuuggaacaguugaguauaauugguguuacuucuuuaaauguuugguauucagcagugaagccaucagguccugggcuuuucuuuacugggacuuguucagguuuuagauuucuucaggguucaauccugguaaguugaaugugucuaggaauuuguccuuuucuucuagauguuuccaguucauuggcauguaaucacucauaguagccacaaauuauccuuugaauuuaugcaguaucaguuguaauguauccuuuuuuugucucugauuuuauuuauuugggucuucucucuuuuuuucuuagucuugcuaaagguuugucaauuuuguuuaucuucucaaaaaaccaacauucuguuucauugaucuuuuguauuuuuuucauuuuauuucugcucugaucuuuauuauuucuuuucuuguacuaauuuuggguucaguuugcucuugcuuuucuaguucuuuaaaauacaucauuuaaauuguuuauuugcaguuuuucuucuuuuuugaaguaggcacuuaauagcuauauauuucccucuuuguacugcuuucacuguauaccauagguuuugggauguuguguuuccauuaucauauguuucaauacaauuuuaaauguccuucuuaauuucuucauugacucacuggucauuuaggagcauauuguuuaauuucuguguauuuguaugguuuccaaaauuccccuuguuauugauuuguaguuuuauuccauuguugucagagaagaugguugauauuauuucagguuuucuugaauguuuuaagacuuguuuuaugaccuaauguauagucucuccuugagaaucauccaugugcugaggaauguauucugcccagaacauuccugugucuauuccuguguguauacaaggcuguguauucuucagccuuuggaugaaauguucuguaaauaucuauuggcuccauuuggucuauaguacagauuagguuuuauguuucuuuguugauuuucugucugaaugaucuauccaguccugaaagugggguguugaugucucuagcuauuguuguauugaggcuuaucucucuuuuauuucugauaauauuugcuuuauauaucugggugcugcagucauggcuccauagguauuuuaaauuguuacauccucuuacugaauugacccauuuaucauuauauugugacuucuuugucucuucuuaugguuuuugucuuuaaaucuauuuugucugauauaaguauagcuacaucugcucuuuuuugguuuccauuggcauggaauaucuuuuuccaucccuuuauuuucaggcuaugugugucuuuguagguguaguguguuucuuguuggcaacagaucauugagucuuguuuuuuaauccauucaaccacucuaugucuuuugauuagacaauuuaguccauuuauguucaauguuguuauugaugacuaaggacuuacuccugccauuuuuguuauuuguuuucugguuguuuuguggucuucacuuccuucuuuuuuuccuuccuguauuccuccuagugaaggugauuuuucucuggugguaugcuuugauuucuuuauuuuuaagccagucaaauuuagcaguugguuuuauaccaacucuagugacacuaauguuaauaaguucugauaacccacuaccaugcuuugauuucuugcuuuuauuuucugcguaucuguuguauguuuuuuuaccuuugagguuaccaugaggcuugcaauacucucuuauaaaccauuaucuuaaaaccaucacuuaaaaagugaugacaguuuaacacugauugcauaaacaaacaaauguacgaaaaccaaacuaauacaaacucuacacuuugacuuugugcccccacuauuuaacuuuuaguuguuucucuuugaaucuuauuguacuaucuauggcuugaaaaguuauuauuacuuuugauugguuuaucauuuagccuuucuacuuaagagaaguuuacacaccacaauuacaguguuauauuguucugugugcuuacuauuaccaaugaguuuuguaccuuuggaugauuuauucuugcuuauuaauauccuucucuuucagaaugaagaacucccuuuagcauuucuuguaggaugggucuggucugguguugaugaaauuccucaucuuuuguuuucuagaaaaguguuuauuuuuccuucauguuugaaggauauuuucaccagauauacuauucuacaguagaugguuuuuuucuuucagcacuuuaaauaugucaugccacucucuccuggccuguaagguuuccacugaaaagccugcugccagauguauuggagcuccauuguauguuauuuguuucuuuucucuugcugcuuucaggauccuuuauccuuggccuuugggaguuugauuauuaauugccuugagauagucuucuuugaguuaaaucugcugauguucuguaaccuucuuguaguugaauguugguauuuuucucuagguuugggaaguucucugauauuuucccuuugaauaaacuuucuaccccuaucuucuucucuaacucccuuuuaaggccaguaacuuagauuugcccuuuugaggcuauuuucuagagcuuuaggugugcuucauuguuuucuuuucuuuuuucuuuuguuuccucugacuguauauuuucaaauacccugucuucucacuaauucuuucuucugcuugaucauuucugauauuaagagaaucugaugcauucuucaauacagcaauugcauuuuucaauucuaauauuucugcuugauucuuucuaauuauuuuaaucucuuuguuaaauuuaucugauagaauucugaauucuuucucugaguugucuuuaauuuccuugaauuuccucaaaacagauauuuugaauuaucugucugaaaagucauauaucucuguuuuuucauaauuggucccugguaccuuacuuaguucauuuagugaggucauguuuuccuggaugguguugaugcuuguagauguacuuuggugucugggcauugaaguuaguuauuugugguagucuucacaguugagcuuauuugugccuguucuucucgggaaggcuuuccagguauucaaaaccccaagcccaauaaugcuaugguuuuugcagacucauagggauacugccuugguggucuuggauaagaucuggaagaauucucuggauuaccaggcagacacucuuguucuuuucccuuaccuuucucucaaacauauggagucucucucucucucucugugcugagccacguggaacugggggugugguuaugcaagcacuccuguggcugccaccacugggaaugugaugggucagaccugaagucagcacugcccugagucuuguccaagguccuucccuucagggugauaagauccccuaggcccugugcaugucuggacaugcuguccaggagccagggauuggagucaaauaccuuaggaguuuaccuuauguucuuuucuacugcggcuaagcugacucaaaccacaauacaaagucugucccauucuuuccuccccuuuccaaaggcagaggagcuucucccuguggcuaccaccaccacuaguccaugggguuucugccaggccaccacugauguucacuuaaagccaagggcucuuugaucagcuuguggugaauguugccaggccuggaacucacccuuuagggcacuagguucccuucugacacagggcagguccagaaaugcugcccugcccaggucccaaugcauaguccuggacuuagagacuccaagagccugcuuguugcucuacccgacuguggcugagcugguaccuaggguguaagacaaagucuucuuuacuuuucccucugcuuuucucaaacagaaggagucuuucacuguagccaccauagcugggaaugugcuaggucaccccggaagccagcacaucucagagcccaaggcccaaagcauacucucaggguaucacugcugguuauucagggcccaagagcucuuuauuuuuauuauguuuacuuuuauuauuuuuugagauggaguuauguucugucacccaggcuggagugcaguggugccaucucagcucacugcaaccucucccucccggguucaaaugauucuccugccucagcccccuaaguagcugggacuacaggcaugugccaccaugccuggcuaauuuuuuuguuuuguuugguuugauuuuuuuuuuuuuuuuuuuaguuguagucugucucugucgcccaggcuggagugcaguggugcgaucucagcucacuacaaccucugccucccaggugcaaaugauucuccugccucagccuccugaguagcugggauuacaggcgcgcaccaccacgcccggcuaauuuuuguauuuuuaguagagaugggguuucaccaucuuggucaggcuggucucaaacuccugaccucaugauccgcccacuucagccucccaaagugcugggacuacaggcgugagcuaccgcacccagccuauuuuuuuuguauuuuuaguagagacaggguuucaccauguuggucaggcuggucucgaacuccugagcucaaaugaucugccuaccucagcuucucaaagugcuggaauuacaggcaugagccaccaugccugguccccaaggacucuuuagucagcagguaaugaacgauuccaggacuguguucuucccuucaaggcaauggguucccuuuuggcccaggguguaucuugaauuauugucugggagguagggcuuggaaugggggccucaugacucugcccacugcccuacccuacuguggcugaacugguaccuaacaugcaagacaaaguccuuuuuacgcuuugcucuccccucgucaaacagaaggaaggaggcacuuuuguuguugcaagcuacaccgucugggguugggaaagggauggugcaagcacucucuuagccacaccagcuugggucuccuuaggucacaugccacccuaguuuacuggcucuaagcccagccuagcacuaggaauugccuaagaauugcaguccuuguguccuaggcugccuuucaaguuuaccuaggaccccagcgcauuucagcaugugguggugaggcuugcugagaaacucgaguucugaccacugaaauggaccauuccccucuggcuagggcugguccaaaugcucccucuaagcucagcauggcuugauucuccccucugacggggcagcacugaguuaaauauaaaaccccccaguugcugugcucucccugcccuaugcagauucucugcacagccacugcugggggaugguggaagggguggcauuggagauucaagacugucucuccugcccuccucaaugccucuuuccaccauaugaauuaaaaccagauaauauuuuuaaugguggaggguguccagguucuuggcaucuugaacaaagaauuggacaaaacacacaaacaaagcaaggaaggaaugaagggauuuauugaaaaugaaaguacacuacacagugugggagcaggccugagcauaggaacucaaaagccccauuacugaauuuuugggaguuuaaauacucccuagaggauuccauugguuacuuggggguaugcccuauguaaauggggagaaugaaauaaaguuacaaagucauuuacagccuacacccuaaggagaggauauuuccugucacagcugaagugugaaucagccuuauguucccugccuccagacccuauuuuccugccucacuauuuuucacuugacuuucguguucuuaugauggugcucuucugugugcagauaguuuuuaaaauuugguguucccaucgaggauggcagggguuagggaaugaaugguguaggcuucuauuccgccaucuugcucugccuccagccucuccugucuucuuucucgaucugcuucuucauuuagucaaaacacaucuuuguuaaauucuuaagaaagagauauauuuuaugcaucuuugcaugucugagaaugacucuauuuuacacucguacuucauugauaauuggcucgguaaaguugaaaguaauuucucucaaucuuuugaagauacugugcuuuugcauucaguaucgcuacugagaagaugucugucugguucuuguuccuuuguagaugauuuuuuauuuuuuacuuacuugaauuucaucuuuaacaucuuuucuuugucucugaaaugccaccauaauguacuuagauaugaauuuuuguuuuuuuucauucaccuugcuagggacucaguagaccuguucgucuguagaugugugccuuucaguuuggaggaauucaguugcguuuuuuucuuuggccguuuccuuucuucuguuuuuucaguucugucuuuccaaaguuccuguuggaaacauauuuucaccucgguuaaaucucuacaucucuuacuuuuuguuucaaaaauuugucuacuuuuucuaccuuuggaggaaauuucuugacuugcaacauuucuauugaauugaacuuuuuucuuuacaaccauauuuuuaauuuucgugacccuuucuccccugaucacuuauuuggcauagcaucuuauucuugcuuuaugcugauaaugucucuugaauuucucuguaaauacaaguuuuugaagcguucuucuuuuccuugcauuaucuuucuuuaguuccucugguucuuuuuuuucuggguguuugcuuguuuauuugaucuugaucuauuuauuacuuugggauuuuucuucaaguguucagugguuuuugguuuucuguuuauauucuacaauuaggcaauaaaaaaucugauggcaaacuuucuauucaugggcagaauuugauggcuuugcuuugggaggauuagguauggcaucaacuauguacgggagcaucuccuacagcaucuccuauucugggagaucccucagugccugaucuuagaaaucuuuguguauuucucuguaguaggacaccuggaguuuuggauggugguguuugcugccagguauuuuaaguggguaggagguagggauugacuuuuuuauguacagaauuucaacuaauucucauguuuucauguaaaaaauguauuucuaucuccauguugagcuggaaguaagauuuguuuuagaagcagaguguugguuguagagaauggauuaaaaggggucaagcuugauacagggagacugguuaagguauucucauaaucuaagcgagaaauuauuaauuagacuuugaacugcagcagugagggaaggaaguagacauaaaaaugaauugaaaauauauauagaucuuuggaaguuacuagcuauaaggaaauguguuucucuaaugaagauuaauuugcauggcuuuuuuuuucagagcaaugaauugcaugagaaacaaaaguuuuauuugaggcagucagucauugauuugcaaacaaaacuucaggagaugcaaauggagagagaugcuauggcugacaucagguugggauuugugaaauuauuuuaaagucacauauuuucauuaugugaaauuauuuuaaaguuuuacuguuuguaguaaaacuacuugugugaauaugaguuuuaucaauguuauuuauuuucuuucauuuauuucauagacgaagggagagucagucccaggaggauuuaagaaaucagcuucaaaauacaguucaugaacuugaagcugccaaaugccuuaaagaggacaugcugaaagacagcaacacacagauagagcaacuacgaaaaaugaugcuuagucaugagggagugcuucaagaaauccggucaauccuaguugacuuugaagaagccucaggcaaaaaaauaugugaacaugacagcaugucuacucugcacuuccgcagcuugggcucagcuauuaguaaaauacuaagagaauuagacacagagauuucuuaucuuaaagggaggauauuuccaguaaguggugagaaugcuacuuaaauaauuuuauauuaaaaugcauuaagagaauagcauuagauguauaauuuuuaaaauucuuaaaauaagccaaguucucauuuuucugaaauaacagaaguuacuuccacaguaaucucucauaauaggaacuagcuugguuuaccguauagcuucaugagaguauagacaaaguaaaagaucuaauaaaauauggggauagaauguaucugauuuuaguauuauuuuuacuugcauuuaaagcauuccuuuaguugaaaaucuccagauuuuccaagccuuauauuuaccaguaacuaaaucagugucucuuuuuaaaaaccagguagaggaucaacuugaagcacugaaaucugaaucacagaacaaaauagaacuacuucugcaacaacaccaagauagguagguuucugacugagguauggaaaagccuagcgaaacuaaaccacaguuuuacaguguuucggccacaauuccaaaaucuaaacagcucugaaacacauaaguuuuuuuauagguuuauaggaaacucauguuaacauuuuguuuuccugacccugguuauaaaaucguaaggaagaugucauuugagaugauuacaauaggaguauugcuguaggagagagagagagagagauuaagcucagcucccaauacaaggccaaauggggauuuauagccagggggcauggugagggggucuguggauggaaaauuacugagaaaaggcaucaagaguagggggauucuugcuaaaugcaggccaagggcuuagauaucaaaggcaggggaugaagaacuugaucagauaucgagggugggaggacuaaacugacuuggcaagauucuugcuaggucugggcuaggcaggccaaagguugaggcauaguugaaaagaggccucagaagagucugacuaaaguuuggugaaggagagaguuuuugucacucauuuguuggaaaaaccugaccagagcuaauguaaaccuuuccauagucuacaauuuagugugaauacuuauaaauuauugcauucaugauauguuucguuaaugggacacuucccuagaucucauugggggugucauauaauauuuacuacuugcaauuuauuaccauuguaaaauaaaaaaaaauucugaauuccaaaacuaucugacucccaaaagauuuggauaaaggguuuuggacuuguuguagacacuuguuauuaaaagaguagcauauacaaaagcaaagcaaaauacuaaauuugagaguauugaaaaucauuaauuuuuaaaauaauucauagucaggaaaaucuucuguaucaaaugacaaucaccacauucuuuuuauaggauugagcaguuaauaagugaacaugaaguugaaauaacaggacuuacugagaaagcuagcagugcucgaagccaagccaauaguauccagagucaaauggaaaucauucaguaugugguuugaaacuguuagucauucaucuucauuuuaaagauauuauucucauuaacuuucuguucuauaaucuuuuagaacuugcuuaguaagauuucauaagaaagugaaacauuuuucuaacauuuaaaugaacaggaaguauuauguaacauagguacuguuaucugaccauauaagaaguauuuuugcaaguauuuggggcuccugggauuggcuguuuuaaguauucauauuuguccauucuuacacugcuauaaagaacuaaccaagacuggguaauuuaugaagaaaagagauuuaauugacuccuaguuccacaggcuuaacaggagucgugagugggaggccucaggaaacuuacaauuaugacagaaaacaaaggggaagcaagcacaucauaccauggcaaagcaagagagagagagaauggggaugugccacacuuuuaaaucaucagaucucaugagaacucacucgcuaucacgggaaaagcaugggggaaaucuguccccaugauccaguuaccucccacaaggccccuccccugacacauggugauuacaauucagauuuguaauaucccaaauaucaugucuuucucacauuuuaaaauacaauuauuggcugggcaugguggcuuacgccuauauucccagcacuuugggaggcugaggcgggcagaucacgaggucaggagaucgagagcauccuggcuaacacggugaaacccugucuccacuaaaaauacaaaaaauuagcugggcaugguggugggcaccuguagucccagcuacucaggaggcugaggcaggagaauggcaugaacccgggaggcagagcuugcagugagccaagaucacgccacugcacuccaaccugggcgacagagcaagacuccaucucaaaaauaaaaaaaauauaauuaucccuucucaacaguccccuagucuuaacucauuuaagcauuaacucagaaauucaguccaaagucucaucugagacaaaauaaguccguuccaccuauaagccuguaaaauaaaaaacaaguuuguuauuuccaagauacaacuggguuacaggcauuggguaaaugcuccuauuccaaaugggaaaaauaggccaaaacaaaggggcugcaggccccaugcaaguccaaaauccagcugugcagucauuaaaucuuaaagcucugaaauaaucuccuuugacuccaugucucacuuccagggcacacugaugcaaggcagggcucccaaggcguugggcagcucugcccuuguugcucugcauuguacagccuccgcagcugcuuucacaggcuacacugagugccuguaguuuuuccacgugcacagugcaagcugccuguagaucuaccauucuggggucuggaggguaguggcccucuucucacagcuccacuaagcagugccccaguggggacucuguguggggguuccaaccccacauuuccccuccacauuacccuaguagagguuccccaugagggcucuacuccuacagcagaugucugccuggacauccaggcauuuccauacaugcuaugaaaucuaggcagagguuuccaaaccucaacucuugcuuucuguacaccuccaggcucaacaccacauggaagcugccuagucuuggggcuugcacccuuugaagcaacagcccgagcuguaccuuggcccauuuuagccauggcuggagcuggagcagcugggacacagggugccauguaccgaggacgcacagagcgauagagagggcccuggcuuacaaaaccauuucuuccuccuaagucacaaggccuguguuggaaggggcugccuaaagaucucugacaugccccggagacauuuuccccauugucuugcaccucuucuuaugcaaauuucugcagccggcagcuugaauuucuccccaggaaauggguuuuucuuuucuaccacauggucaggcugcaaauuuuccaaacuuuuacacugugcuucccuuuuaaauagaaguugcaauuucacaccaucucuuuguaaauauauaugacuguaugcuuucagaaacagucaggugacaucuugaaugcuuugcugcuuagaaauuucuucugcccgacacccugaaucaucucugucuagaucaaaguuccacagaucuuuagggcaggggcaaaaugcuaccagucucuuugcuaaagcauagugagagugaucuuuacuccaguucccaagaaguuccucaucuccaucugagaccaccucagccuggacucuuuguccauaucacuaucagcauuuuggucacaaccauucaacaagucucuaggaaguuccagacuuucccucgucuuucugucuucugaucccuccaaacuguuccaaccucugccuguuaccuaguuccaaauucacuuucacauuuucagauaucuuuauagcagugccccacucuccugguaccaguuuucuguauuaauccauucuuacacuacuauaaagaacuauccaagacuggguaauuuauaaagaaaagaaguuuaguugacucacaguuccacaggcuuaacaaaucaugacuaggaggccucaggaaacuuacaaucauggggaaagcaaacacaucuuaccauggcggagcaggaaaggggggaagugccauacuuuuaaaccaucagauguugugagaacucacuaucaugagaacaguaugggggaaaucugcccccacaguccaaucaccucccaccaggucccuccccugacauguggggauuacaauuugacaugagauuuggguggggacacagagccaaaccguguguguguguguguguguguguguguguguguguguaauauauaugaauauauauaaguaaaauguaugcauauguguagaaauaauuuuauuugaguuguauguuaaaacuuuuuauauggacauuuucuaucauauacaaaaguagagagaaaauaguguaaugcacucccauacagcugucacccagcuucagcaguuuacaauauauuugaggugaaacuuuugagagucaguuuuggaaaauaaaagacuauuggcuuaauaaugccauauaaaauaacuagugguagugucaaaaagcuagaauacucagguguuacucuuauucuuaguuugcuauuugcacuuauuccccuucuaaacucuucuuagagagcaagcaagaaaccaaaacucuauguauaugcgucagcucagcgaucuggaaucuacuguuucucagcuacguucugaauuaagggaagccaaaaggauguaugaagacaaggugaguuuagguuuugcuggucuguuucuagagacuuuaauauccagaaucaauauuauauuaguaauaguuuauuugaaaauaaggaaucaaaguaauuucaaauuaaaagcaguuuauaagcuggaguaagagcaugcuaaauuauauuuuaaacuauuuauaaacuauuuuuauuuaaauuguguacucugauucauucuuagcaaaauuuuuugcauaguucaagugaguuucuaaaaaaugcauuaaaaaugagaccaucuuaauuauuuuuacuuagcuaaacuuuagcaaauacuuccauaccagccagaucccccugcuacucaauauuuuuggggccuaccuccucucuuacuucaacuccuaacuccuaaucauugugaagcuaccaaacugaauuaauguuaagauuaauuaaaugaauuaauuacauaaaaauuaauuaggaggauaagucaucucucaucaucauguaauuccuuuuaaaaccacauuaauauuugauauucuguuuuuuucuuucacuuuccauagcuaaagagaagcuauucaguaucauugucaucuguuuauccagaguuuagacuuuuguucauuucaaccauuuguaaaacaguaagacccuaaaaaacaaacaaggagcugccauuaagaggagugguggucuucauucccugugagaagggugaucacccaaggcggcuugccugggacagucucgguuuacacccgcuagcccaguguccuguuuuaugaaugcuaccucucaucuccauaguguccccauuuggaagauaaagucuauauuuagucauccuaccuauaagagacccuuagacagccaagcagaaacaauuuacauacaguucugucacuuguagucaguuucucacaccuuagcuauuuggagcaguagguuagaagaaauagaguauaaggaagcugccauacucccuuuauaaaaugaaaccaauucuauaggguaacaguacauggaggaaagcuccauauauugcagcacgaauucuuccagacauuugcccuucuuugggcaccccauuuuaauuaccgcuaucacuccagccggccacaggagggggcuguuucuacuuggcucgcgcauggaaauaagauaccucaacauuuaucaaagcuaagauaaggauggaauuuagacaggacuuuacuaaagucuaagccauagagaguaacaugaaacuguauaaucucaguuauagauguggguccuuuacagcagugucuuccaaaguaagaaauauaguucaucuuaugauccaacacacaugcaacugaagcaagauucauaaaacaauauuuacuccuauuacaugugaugccagcuauuuucuguucucuucagaugcuuauuugaagcucacuaaauugauuucauaauuuauugggggguugcguuugaauaacacugccuccuuuuguaaaccuccuugcauaacccuuaaccuaaauccuuguggcaauguuauuucaaccagugccgccucugagcaaccuuaagcaaccuuagacugcuuaaaggguacacucaacaaacaaaaggucagagaggaacacacgcuuuucucugccucucugaagccugcuuuuuauguucuagugucuuuucucaggacaagcuuuuccccugaugauuuauagcaggaauguccaccccagucugggcagaccaagccuauaccaaaaggucaugaccgcacccugcagacaacagcaggaggggcugauuuuagugcaccaugaggugggagggugcuuuuucacuugggucuaguggagguaggcacucuggcagaagugagagcugacaaucugacaaugagagaggaaauaagagagcuguugugucacaguccaauauaauaaugcauauucaugaauaaucacaaaucauuuuggaaagauuaaguacucauugucuauugacaaacuuuuugaaaagccgcaaaguacuaaauaaagcucaacucaccugugguuucuuacaugauugguaacugcuauagcuuuccauuauacuguuguuuggaaaaauuauccuuucagaagccucacccauuguuugcuaauuugcauuugguccaauauacaguaucaugcugauuuggacauauugggaaauuuuuucacaaauacugaaauguccaucuaaaauguauaaaaagaauuucuaaguuuuuauaagcauuuaaaucuuuggcauuguagaagcacgagauccagaugaaugacugcaagcuuuuuacaugaauguuuuggggucauauagauacaaacaugauauuagaaucauucucuuauuuugcucuaauguaaauaguggcugagcaagaauuuugacagucuuaaauaguaaagagcuaacggaaauaaggagggcauaucagcuucauuaguuuuaauaaaucacugagauuuauaauacaccacagugacccuaaauagaguuggcaccuaguugaugguuaacuagacugucuuaacaguaacucccuuugguuuggucagggagcacugagagaugacugccauguaaauauagcuaaguacacucuggccuaaggugacauuaauuacaugguguagcugagcaaggaaaaucaaacaaguuaauaacaaggauuucacuugggaucauaaaaaauuguauuguuauaaaauguuuuuguuauaaugaauugaauauaaaaucuaaaaacacaaauuauucugcuuuauuuuucauuuucauaugacuuggcauugcuaaagccuauuaaaaccuuaaaaucuauuuuuucucuguugcuucagugcauauuucaguauauaccauucaaauaacaacaaggaaaaauaucaaaggacauaauacauaaaagcugugauuaaaagugagauucauggccaggugcaguggcuuacacccauaaucccagcacuuucgaaggcugagacagaaggauuacuugagccuaggagcuugagacaagccugggcaacauagugggacucugucucuacaaaaauaaaaacaaaaauaaaaaguuagcugggcaugguagcgugcgccuguaguucucgcuacuagaaaggcuaagaugggaggauagcuugaggcugagagauugaggcugcaaugagccaugaucacaccacucacuuuagccugggcaauagagggugacccugucucagaaaaaaaaaaaaagugagauuugugugaaaggaaacuaauaaagguguguugauauuaaacaucaacauguuuuaugaggggcaguauuaguauuuucucccaaggucagauuucuucauuuuaaaaaguguuuucauuuuuaaaaauugaugacaugacaggucuaaacaaaacuuuuccaacuagaaugcauaaauuaagagaaaacuuguuuuggaaguuaauauuucucuucagauuaacacaguuauuuuaugcuggugaacauagaaauuguacuucaaaaaaaugugagauguagcuuucguagcuuacaaaaguguuuuacuguaaugcuguuuucuauucuucucuuuccacuuuaggagaaccuccagaauuccccuuuacgaauuuggaccaguagaagcugucacuauuggcucuguagauuuggcuuuacccuuaacuuucgcuuuuugacaacaaaaauaucuccugauguugauucagcauuuauuuuuacuacuuugaaagcaguuggggcugaauuuuguauuaaaaaagugaugauuuaguagcacuggcuggagcuauauacugugcaggaagauucugugcaaaccucugcauaguucugccaaugcaccgccaugcuggccuguagcaucccuuauuauuccauagcugugucuuuuugagcacagaaaaacagaaaacaccaccaccaacagacaaaccaaaccucgugugauuugauaugauuggcaauaucucuaaaaucaaugugagauuagaaugaaaucccaauacucauuuguccagugauccaaaccaaaaagugcauucauagauggugaaagggaaaaccagugcuacuacguaaaaauaaaagaaaaagaaaaaaucuuuaauacaucucagaugucaauauuuauucuggauauuuuaaaaggcuuuucuuuauaguguuuuuuacagcuguuuauaucaacucagcugcuacuucaaugguuuucccuuucacucucuauuuaucuuuuugauugauuaauauaaauguuuuuacucuaaaaagugaaagguaaaagcagaccuauagcagcugagucaguacugacaacuacaaaacaaauguuccugcagggggcuggaggaacuucuuauacuuaauagacagauggaaagauaagacuuggcucguuucuuuuucuuucuuuuuuuaauuuggucucaugucaaguuugauguuaugaaaugauuauccagaaguuuuuuuuuuuuaagugaaagcagacaaaagagaaaaucuuaauuuaagcuuuuaaagcauauauacaaauuauuuucuuugcucaaggauagaaaugguuuaugccaggcuaggaguagaaaacauuuauuuuaaucauaugauuaauucaaauuggaaauguucuuguuaaauuuauagcucaaaagacagguggagaauaaauuguuucagcuuuauuaauacuguucuuguggaauaaaguauuagaauugaaaggaacaugagagaucgucuagaauacucuuuccaauuacagaugaaaaaaauggaaacacagggaaguuauguaacagaaacuagacaagaaccuaagguguuuggcucuucgccugaucauauugccccucggaucauguucauguacccauuccuugccaggcaaacauaauuguguaacaguaaaguuuguguuucuuccccuuacuguauuuacuaaguguguacugauuuagucuuuccugauaauaacaaaagugaagagauuuuaucaauugauauuguucauucauuuuucuuaggaaguaaccuguguuacagagcuugaauuuuuaugggacuuuuucauuucuuuuccuguauaugccccaaaaggagcacaagaaguacuuuuuuguuuuuuuaagagagugucucacucuguugccaaggcuggagugcaguggcacgaacaugacucauuacagcuucaaacucccaggcucaagcgauccucccaccucagccuccugacuagccaaaacuacaggcaugcaccaccaugccaggcuaauuuuauuuuuauuuuuguagagauggggucucacuaugcugcccaggcuggucucgaacuccuggccucaagugauccucccaccucagucuccuggaaaguacuucuuuauuagauuaauagagucuaggaauacauuuuagacagugaucuaauauuuuacguguacuuaauucuggugaaauacuuuuuauacauagcaugcagccagauacaaagucaguuuaggaauauagccaauauaaauauuaaagucuauacucugauuucuguagguaaaugggaaacugauaguccuauauuaguacuuucuuagucauauauguauauguggauauauauauaacuucuauuccuuaugauuauuauuaaagagagauguguguauguauguauagauaauauaauucaauauguguugaauaagugaagaucuuuaaaaauaaauaguaaauaguaaaacuagaaaguucucaagaaaaaguuagucuuagucauauguucucuaguuaagaaaguuuuaucauaguacaucauccaaaccagguuuuauuauugacaguagauuggaaaccuacuaaauagccaccuuaaagcuaagaaggaauaugcaccauuuaugcagacaugaaagauuuccuauuacuagaaaguagaugauaaaauaguaauguagauaccuacuuaaaguuaagauaucaccauauaacuaaguaucaacacguucucauuguuuuaauaucuuauuauuuaaguuaugauauuguguggcucagcuaaaaucuaaacccuuagucuccacagucugagauccuagccucuuagcauacgcugaaccuagacauaaagaacuauagaggccgggcgcgguggcucacgccuguaaucccagcacuuugggaggcugaggcggguggaucaccugaggccaggaguucgagaccagccuggccaacauggcgaaaccccaucucuacuaaaaauacaaaaauuagcuggccaugguggcgggcaccuauaaucccagcuacuugggaggcugaggcaggagaaucauuugaacccaggaggcggagguugcagugagccgagaucgugccauugcacuccagccugggcgacagggcgagauuccauuucaaaaaaaaaagaacuauagaaacgcuauuaacagucaugcacuuuauggcaugugucauagaaaugcauauucaaacagaucaaacagcugccuugucagaauaaaaugcacuuuaacauccucuaaaauugguacuuuuauucccauuuuauauuaauaguugaacaaaaugaggguuagaaugguuaaauaaauuguccuacuguaaauauaaauauauauaaauucauccuuuaaaaaaguaguggcuauaaaauaaugacaauagcuaauaacuuguuaccauucauucuuuuauauucaaugccuuuuauuaccgaaacuuugauauucugaagcaaaauagcucuucuaaguacaauacaguucauuuauuuaggcucugcagcauguuguuuaugccauaucaagcuuccuuuuuuugaaacaguuuugcucugucacccaggcuggagugcagggacacaaucauggcucacugcagccuuaaccacccagucucaagcagucuucccacuucagccucccaaguagcugggaccccaggugugcaccaccauggccagcuaaccuuuaaaaaaauauuuuuuguagugauggggucucccuguguugccuagguuggucuugaacuccugggcucaagggauccuccugccuuggccucccaaaggauuacaggcaugggccauugugccaacccucaagcuuucuuaaauaccaaauuauagaacaugucuucacagaagauaaaucuugaauaguaugaaaacaggagacagauguauuacaggcaauucccaaauucaacaguacuaaauauuucauuuugucuaauuucccuggcuaaacucagcauagauuuucuuuaaaaaaaaaaaaaacuuuacaagacacaucacaauacacuuuuuuuuuuuuuuuuuggagauguaguuucacuuuugucacccaggcugaagugcaauggcacgaucuugacucacugcaaccucugccucccggguccaagcgauucucuugucucagccucccaaguagcugggauuacaggcgcccacuaccaugccuggccaauuuuuguauuuuuaguagagacgggauuuugccauguuggccaggcuggucucaaaauccugaccucaggugauccacccgccucggccucccaaagugcugggauuacaggcaugagccacugcacccagccucacaacgaacuuuuauuuuuguucucaaaauaauaccauuuguuuuccaaagucuauauuuauuuuauauuacccacugucauaaucagacacuguucaauuuguacuuuccuuucagacagaagagcuggaaaagcaguuaguccuugccaacucagagcuaacugaagcccggacagagcgugaucaauucagucaggaaucuggaaauuuagaugaucaacuucaaaagcuguugguaagauuaugcuuuaaaauaugaauaagacuaauucugggaaguuuuucacugaaauauaucacaaaacucguuuccuuuauaaaauuacaaauuuacaaaauauuugugcauacaugcaauagauuauuuuagacacaauucaaguuuugcauauaaaauaugauauucuguauacuuaacuuuuuucuuaagcagagcuauuacaguauuaggugaaggagaucuugacauagccauagucuuucaaguagauaccauauuccauuaaauugaaguaguguuacacguucauuuuaaggccaaauaacauucaaaacacauaaaaauuguguauauagaaauuuggaauggacgguuaggugaaguuguuuuaaaagaaaaggacaguaugauugugcucauaaugaagccacucuguccucuguuagaggaacuauaggaugagaaauuuaggaaaggaaauguuuggaauccccuuuugcgguauuagugguauaacagaauaaauuucucggcuuaccaaaccccauuccagggaauggugcucuuugcugguaaagccauccuuugcaggcugacaaggguuugaugagcugagguaaggauagaacugagagcuguguagagaagcucuuaaucuuggcauaauucuucaguucuuuaccuaacauuugcauguuuuucaguguucuccuaucuaauuugaaaaucuuggagacugaaugucugaaagauccucaaaccuggccucccuuuucauucuuaccaucaccaccucucguucaaccccucauuacucauugccugaagcauggcagucuccuuacugauguucccaacuccaguuuuucuccucuucacuccuuccuguaaagggcugccgcauacaucucucuaaaauguagcuccgaugaugucacuguucaacucaaaauuacuuucuccauaaagucagacacccucccuuucaauacuguucaugauccaucacccugcuaaccuuuccaauccuuucucucuacccggacccagugcaccaagcaaacacacaggccccuuuccugucccuucuuccuaaucucuacaucuucaggucuaacucaaauacuauccugaagcauuuugaucccuuuagugagauucugucugcuauuccuuaucuuuguuccuuuaaugaaaaaccacuuccaguuacuuaugucuaugucuuaacuuucucuuggauccuaagucauuugaguguagauauaucuuuguuuuuacuagucugacuagaguuuuugcuccuauucaacacuauguauuuuuuaagugacugaaaagggagguaauucuauucacagcccagaugcuacuccaauuccaguaccagccacuauucugccaucucuccauuacuuaucauuuuuccuuuacuuaucauuuuuccuucaugcuuuugagcauuucuuuauuauaggagcauaccugaugugagacauaaugucuuucuuagaaaaugcaagacuuaaaaacaggaugacuuuuaaaaucuacuguauuuuccuuuucauuguauauuauuugaggucuagucccucgagauagacuaguaaugcuagaaauuuuaagcaaaauguuaacuuauuuuucuuggaaauaauugcucuuaagccauuaaaaaggaaucagauuccaaaaucaaaggugucugaaaucacauaaaaacuccaaauaugauauaaagacaauauguuuuaucuuaauuauuuaauagcagggaggaaaaaagcauuccucucuuuuuuuaggcugaucuacacaaaagggagaaggagcugagucuggagaaggagcagaauaagcgucugugggaccgagacacaggcaacagcaucaccauugaccaccugcggcgggaacuggacaaccggaacauggaggugcagcgccuggaagcccugcucaaggccuugaagagcgagugucagggccagauggagcggcaggucagugccugcacaggcugugccaucgccaaacaaucuccucuggggaaauaaauauuuuaugucuaaauagagcuuuuuauuuuuaacauauauggaccuaaaauggcuccuaaaauaaagcuauggauucugugagcaauuuaugaaaaccugauacuuauuuuucauuuuauuucauuuuuuguuuauuuauuuauuuauuuauuuuuagauggcgucuuccucugucacccaggcuggagugcaguggcgcgaucucggcucacugcaaccuccaccucccggauucaagcaauucuccuaccucagccucccaaguagcugggauuacaggcgugugccaccaugcccagcuaauuuuuuguaguuuuaguagagaugggguuucaccauguuagccaggauggucucgaucucaugaccucaugaucugcccaccucagccucccaaggugcugagauuacaggcgugagccacugcgcccggccuauauauagacacuaauuaaacuaaaugugucaagcuuuaucucacuuguacauuguugaagaacuaaacucuuaucccauugccuuuucacguuuaccuaaaaauugguaaccuaauaauugcuuauuucugcugcagagaagcaucaaauuauugggcagccugagaagcaacaggguugaagguuucuaacagauuuuuuugcuuuauuuuucucccaaaagagacuugccucucuuuccccaagucucaucacugauugagacugaugagugcauuccauuccggugcacccuccaguagcaaaacguggacugccuucuuaauagcaguguacuuucugugcuaggaagacaugguucuaaugccaguuacugccacagggacauaaaaagcaucccacaaaaguguaagcuucucagaaugugaaagcaaaccaagggacuggucuuggcuuagacccaggcaaagccauuaaccuacucucuggcuuaaccugggcaagaagaaagaugaaaggaccaacuggaaguuagaauuuucagcuuuuccaaacaaggaucagagaauaugaauguguguguggauaaaagccauuauucauuuuuuuccucagagguagaauuaaagguaaaguuggagggaaauuaaaaauaagggguaguuauuguaaauuccgccacccuuccccccauugccaggguuaucuuaaucuaaaucaguacagaaaacauccacagaggaaacuucccaagacugcacucuagaacaccguuguggaggagcguuauuauuuaauuaagcccucuccaccuuggucuaauuagcauaugucagucuuacauauguuauaagagcuagaguucugacagcaaaaugauugaguuaauuuaacuagacauggcuggguacaguggcucaucccugaaaucccagcacuuugggaggccgaagcaggagaucauuugaggcugggaauuugagaagaccaaccuagggaacacagugagacccccaucucuuaaaaaaaaaaaaaaagaucuuacuaaacauugccuaauucaugauuucaugcuuuuaaguuaacuuguaucucuugagguugccuauaccuauccucccaaaucuaugaaauucucuuuucuuuaacaaucagauggcagcaauucaaggaaagaaugaaagucuagaaaaaguauccuccuugacugcucagcuugaauccaccaaagagaugcugcgcaaaguaguagaagaguugacagccaagaaaaugacucuggagagcucagagaggacaauaucggaccugacaacuucucuccaggaaaaagagagagccaucgaggcuaccaaugcagagaucacaaagcuccgcucccggguggacuugaaauugcaggagcugcaacacuugaaaaaugaaggggaucaucucagaaaugugcagacagaaugugaggcccucaaacugcagaugacagagaaggacaaggugaucgagauucugcgacagcagauugagaacaugacacagcuggugggccagcauggacgaacugcuggagcuaugcaaguagaaaaagcucaacuggagaaagaaauuaaugauaggcggauggaacuaaaggaacuuaaggucuguagaguuuuuuugugauuuaacuucugaaauaucauuuauuagcagguaugaccuguacugaaaagugguucuugguaucuguggacacucugaaacuguuggaagguguuuguuucuauguguauauguguguuuuugugagaaaggauaaauacuuuuaucagauuauagaaggaauggaugacucgaaaauggcucaaaaucacggguacaaaagaaaaaagaucagaaaaucuaugaagucuuuccugauaccacaggaaaguauuuucucccucuucagacagaccuaaauuugaaccccgucucucacuacuuaguuacagugaaacauuggacuguuugcugaaucuuggcuucgauaucugauaaacaaaaccaaaccaaaaaguaaacaaaacaaaaaacucccaacaaccuguuggguuacugugaggcuuaaaucagaaaguauauaucaaggaaugagccuauuaauaguuucuggcuauuuaauaauuuaaaauuuaaauaacuuaauaauuuaaaauuuaauaaauauuaguuucuuuccccuguuuuggucuccuucugaacuuucucauacuuuauuuguaccuguuaaaaccugguucacauucuauauugccguguguguguguguguguguuuguguguguguuuauguagcagugucuccuuuucccuacaagauuguagacuucuucaaccaggguacacaucuuauuagccuuuguaccuccugccccauauuuuugugccuugcacccagaaggugcucgauaaauacuuaucaaaauuuaacacaauuuaauggguuuuuuaaaaaaauugauuucauaggauuaaugucaccuuuaucucugacuuggugaguaguaggagacaaaucacauauacuguagaugcuucaguuuccuccuucuaaaaauagggccagcaauagauaauuauccaucuuauggaaauaaacaaguucauugcauuaaaaauagaauuuucuauugcuuaaguuuuuaccugauuauauacauuuuuaaauggccaaacucaccaugaaaagggacauagaaaggauucucaauggccagcccuacaaugaaacccuuagaacaggugugaugcagggcagagcauaucagaggagaaaggaugguuguucuaccuugcuuaggaagaucacuaguggauugcuaguguguuaagguucuaaacaggagaaucccacucuuauacucuaaaacuuaaaucaauuuaauccucacaaaaccuuaugagggaggcacuauuauuaucccauuuuacagcugaggaaacugagacacagagaguuuaacuuucuggagagcagcacuaccuugugguuugaaccuaggcagccuaaguagauguuacugugcagugguucucagugagaaccggaaucgccuggagggcuuuuuaaagcauggacugcuggccugcucccagaguuucugacucaguaggucuaggauggggugugagauuugguguuucugaacaaguugccagaugacguggauacugcugguccugagagcauccaucaggaucuguguuagugccucaaaggaauguggagcuccugacuagagggccagugaaagcuucagagagagcugggaaccugaaaugggcaaaaacuaggcaaagagaaggaaggauggcauuccaagcccgggaagaagccuagucuguaauuuagccuagagauggugugggagacauuaaagguuuagggguaggaaggaggggguaacaugaagaagacaguguuggaaguggauuaaucuggcaucaguaugcagaaguggcuuggagagaguaaaacuaauuuucaguuccuaaauauggagcuggagcagcuucagggaauaauuuccuagguaauuagaguuucacacagacacaaagaacauaaguuuaaaacucaaguccuaaugccacauccacuucccucugugaucugauaagaaaaaaaggugggggaaucauagcuguagaagguaugguuucucuccugguuucuguccccucuucagaguggguacugcacacauugacagcagagaagcagagugacuuuuauuucaauaacuguggguccccagagcuagaccuuucuuaaaaacaaauaaauaauaagacuaagaaaggacugaauucuaucagcuggccucaagagguggaacaggagcagcacucguccuauguguguugugaugccucagguugucccagggaaagcccuccccgucccuuacugcaugaggucagcuggauuuagugugacaguugccaggaguggcuaggcagagaucagauagcccagauuagggccuuuacugcccaaacccaucacaggcgggcagugagacaagccuggggcuccccaccaauccuuuuugaacagccaaaagcuugucauguggcuauauuucagauguaucauuggucuccacaguuaaacugcugcuauagcagucaaauugcaucugccaggauacuaaggccaguagggcgauaauuuggggaaacaaucugaugaccaaagaaagucaauauuuuuuucaaaugucacuuauucggaaggaucuaggucaguucuguccaccagaaauacaguguaagugacauauauaauuuuaaguuuucuaguagacacauaaaagaaaugugaaauuaauuuuaauaacauuuuauuuaacucauauucaaaauauaguguuuuuaauauuauaaucaauacaacagaucaccaagauauuuuauauucuauuuuuauacaaagucuuugaaaucugguguauauuucacacuuacagcacauaacuuaguuuggccacauuccaggugcuccagagucaugugcagguauuguguuagacgacacagaccuacacccugggaagagagggguccuccuaggaagccuuaccaacacagauagagaccaguuaggaggcacuguggcaauccauaugcaaagugauggcaguccagaccugcagguugggcaggauuugaucaacaauuggguaugaggggcgagggacagggaaagacauggugacuuugugaguucaaacuuagacuggcaacaugguagugccucuaacagagaagagucagaaaggauuguaggggaaggcccucugugaagaaggaauaggaauguuugagucagaguuugcagaagcaugccaugcuggggguuucugacaguuaguuggaaacgccgaauuagaguugccauauucacauucccuacccuagucaaaggaccagauacuuucaccaccacaaaccaccccagucuaagcucccaccucucuuguuugcucuuccaguugccuucucacuggucuccaugcuucucccccuacccccacgccaaccacuguuuuccuucauaccagagccagaguuguauuuuuaaauuguuacacuacaucacucucauacucaaaacuguccaaugacuuccugacucacucacaaugcaugcucaaguucuuacauugccucugagcaaccugaucauucccuuggccccucucugacuucaucuccugcuuaccccaagcucacuucacuccagcccuacugaugucccugcucuuccccagacacguuaccuguacacagagcucuucccagacuguccacgugucuuguccuuaugcucaggagcacaaggagcaucugcuuagauguuacaucaucagagaggccuuuccuugccaacuguggcaggguccccaagaccgaccccagguuugaugauucccuaggaggacucgccagacucagcauauaaucauacacaaggcuaggauuuauuacagugaaaggauacaaagcaaaaucagcaaaaggaaaaggcacacggggcaaaauccagagaaagccaggcaugagcuuccaagagccuucuccgaguagaguuaugcaggacaugcuuacuuccuacuccacccccugccccagcaagacaccgugacaacaucugucaagugcugcuaaccagagaagcucauuaaagccucagugcccggguuuuuauauuggaguuuggucccauaggccccucuaccuggcagguauccagauuccacguucccagaaggaaagcagggguucagcaugaacacauuguuugcacaaacaguuuaggcacacugagccacucuuauuaggguggugggaacccucccaaaauccaaguucccagacgacagucaagggccaaccuuguaagcggccuuuuugaggagagcacccaaaccugcuaugugaacucuuucugcacaccagcuuaccucaaguagcaaccccucccuugcauucauucuguaccccucaccugcuuuuauuauuauucuugccacuucucuuaccugacauauuaaauauuuguuuguuuucuucucuucuuacuagaggaggacaugaagacaaagacauuguuuuguuuauugcuauccagggccaggacuagggugagguaacugaggugcccagguuagaggcccucaccuagcugcuucacuugcauuacccuagucauagcccugcuucuauaucccuugcuuguaaaauaguuccugccacaaagaagguucuuaauauguauuuuuugagugaauggagauagaauaggaauaaugaaggguuguugcaagcaauacuaggaauugacaucuaagguuaaaagaaagugaaauauuuucccacuuucuauugaugcuuuauaauaaaauacaaauuuaguguccugggaaguaaugaaaagauaauaaauauagauggaauacagauaggaggcagaaaaggauauuaaguaggagacuguugucagauuuuaggacuguguuagcagcuaucaauuauaacuauacauguacauauuuuuuacuucucuauccuuuguauuuauccauauauuuagauauuaaaagauaaaaaagaugcaaagauccgggagcuugaggccagagugagugacuuggagcuggaaaaggugaagcuggugaaugcaggcucugagcggcuccgugcagugaaggacaucaaacaagagagagaucaauuauuaaaugaggugaaaacaaguaggagugaauuaaacaaucuuucagguauguugcuucagcacaaauccuacuaaaaaauaagagucuuagcagugaagccaauguagacccuagcacaauugcaaaagaagggugucucacucacaugacaaacaugaauaguuaugcugcccccauggaguuauucauagcaugaaaucucauaguuuucaugaagaguucccacaucuuacacuuacugaccuuaacuuuagucagcccucaguguacuggaaauucuguacugaauuucuaagagaagugugagguguccagaguccaggcuuccaaaaggaaaacagguguucacauaaaucacauugucugcacaguuuuguguuuaugaaaguggaaaaccuugaguccuuggagucaaauagcuugauuagaaguuuacuaaugaagugacaugugaaaauagacaugugaauuuauugacaggaaaaauccauggccuuauauuaaacagugaaacacuccaguuuaugguugguauguguauuagucccuucucgcauugcuguaaagaacuaccucagacuggauaauuuauuuuauuuauuuauuuuugagacagagucucacucuguccaccagguuggagugcaguggcgugaucucagcucacugcaagcuccgccucccggguucaugccauucuccugccucagccucccaaguagcugggacuacaggcgcccaccaccacgccuggcuaauuuuuuguauuuuuaguagagauaggguuucacuguguuagccaggauggucucgaucuccugaccucgugauccaccugccucagccucccaaagugcugggauuacaggcaugagccaccccacccagcccagacuggguaauugauaaagaaaagagguuuaauugacucacaguucugcaggcuguacagaaagcauggcuuggaggccucaggaaacuuaaaaucguggaagaugaaggagaagcaagcacauauucacauggcaacaggagagagagagacagagagagagcacacaaagggggaggugcuacacacuuugaaacaaccagaucgcaugagaacucacucacugucaugagaacagcaaaggggaaauccgcccccaugauccagucaccuuccacaaggccccuccuccaacacugggaauuacaacaggacaugagauuugaguugggacacugagccaaaccauaucauucugccccugggccgucccaaaucuuauguccuucuuacauuucaaaacacaaucaugccuucccaauggucccccaaagucuuaacucauuccagcauuaacucaaaaguccaaguccaaagucucaucugagacaaggcaaaucacuucuaccuaugagccuauaaaauaaaaaacaaguuaauuacuuccaagauacauggaggguacaggcacuggguagauguuccuguuccaaaagagauaaauuggccaaagcaaagaggcuacagggcccaugcaagucugaaacccagcagggcagucauuaaauuucuaagcuuugaaauaaucuccuuugacuccaugucucacauucagggcaugcugauguaaggggugggcuuccaaaaccuugggcagcucugccucugugacucugcaggguacagcccccauggcugcuuucaugggcuggcacugagugccuaugacuuuuccaggcacauagugcaagcugucaguggaucuaccauucuggggucuggaggacaguggcccucuucucacagcuccacugggcagugcuccagugcagacucugugugggggccccaaccccacauuuccccucugcacuacccuaguagagguucuccaugagggcucugcuccugcagcagacuucugccuggacauccaggcauuuccauauauccucugaaaucuaaguggaggcucccaagccucaacucuugcccucugugcacccacagccccaacaucacauggaagcugccaaggcuuggggcuugcacucugaagcaacagccugagcuguaccuuggccccuguuaaccagaguuggaacuggagcagcugaaaugcagggcaccaugucccaaggcugcacagugcagcagggcucuggaucugguucacuaaaccauuuuucccuucuaggccuccaggccagugaggggaguggcuucugagaaagucucugaaaugaccuggagacauuuuccccauugucuuagcuaugaacauuuggcuccucuuuacuuagcaaauuucugcagccuugaauuucucccuagaaaauggauuuuucuuuucaacugcaugguugggaugcaaauuuuccaaacuuuuaugcucuacuucccuuuuaaauauaaauucuagcuucagguuauuucuuuuuuaaugcaaaugagcacaggcuuuuaggagcagccaggccacaucuugaacacuuugcugcuuagaaauuucuucugccagauacccuaaaucaucucucucaaguucaaaguuccacagauuccuagagcaggggcacaaugcugccagucucuuugcuaaagcauagcaagaaugaucuuuacuucauuucccaguaaguuccucaucuccaucugagacuucuucagccuggacuucauuguucauaucacugucagcauucuggucacaacaauuuaacaaguuucuaggaaguuccaaacuuucccacaucuuccugucuucuucugaucucuccaaacuguuacaaccuguaucuguuacccacuugcaaagcugcuuucauauuuucagguaucuguagagcaguauccuaccucucugguaccauuuuucuguauuaguucauuuuugcauugcuauaaagaacuaccugagaaugaguaauuugugaagaaaagagguuuaauugacucacaguucugcaggcugcacaggaagcauggcugggaggucucagaaaacauaaucaugguggaaggugaaggggaaacaagcacaucuucacaugguagcaguagagagagagagagagagagaagagggaggugcuacacacuuucaaacaaccagaucucaugagaacucacacacugucacaagaacagcaagggggaaauccuuccccaugauccaaucaccucccacgaagccccuccuccaacacuaagaauuacaacaggacaugcgauuugggucagaacacagagccaaagcauauuaguaugguaugaaguaucauguacuucauaaagucagaaguuacugagcauuuacuaugcaagacacugugguagaaccuggaaaccccacaaugaagcucacagucuaguagggagauaaaccuagauagaaaugggugaauaaccagugugugaggcacagugaaaguguauugaguacaaagauagcacagaggauacagaauuuaccuccuguaggaagugacaucuguacuggguuugaaagaggaaaaggaauucagcaggugaaaaaggggugcaagggacauuccaggcagagagaacauuaugggcaaaugcaugaagccaugaaauaucaaaaugugaccucagaaguauuagcuggagcaaaagugaaacgaaugagggcuaagaaauaaggcagaauagauagguagagccggguaauguggagcccacaaaagauauuaaguaggagauuuuuugucagauuuuagauggacugugucaguaaguaaauuagagaaaagaaaagcagaccaagcaguuaaggaggauuuuugcagucgucccagauaaauagaaugaggacuugaauuaaggcaguggcagugagaauggaaggaaagaauuaaggauauuuuuggagguuaaaucaacagcacuuagugguuggagggauuaaguguagguuucaggauuuuaguuugugguauuggaaaagcaauguaagcaacugggagagggaaccagaaggaaaggcaggcuugagggcuggaggaugagauguaggcacugugaggcaguugguuucagguggcacgaggacaucuacauggagaugucuggacaaauggagcuggagcuuugauccuuuucuauauaaaucuaaucauauaaauagauacauauaaauaaauaugugugugugugugugugugcacacauguguguauuguaguauaucaaaugaugaguuugugccaaguauuuucacagauacuggagauaagucagauaagacagauggcagccucagguuacuuauagugucauggagauucaucuaccagcagauggugguuaaaucuacucuagugaacacggucauccaagaagaagguuuaagaugagauaacugcaaacuaauuauaauguuugggaaaaaacaaugaguaauaaguggguagaggaggaauaggauccacccaagcagauuaaaaagaaagggucauaucccuggaauuguguauguacaucucauuucuguaacaaaggaagauguaauuaaaugacuucucuuccaguucuaaaauucugugaucauuaauuacaaauaaaauauacuuaauuaacaaugggauagaaaaaaguaaccaucuauuauugauuaucacauuguauagaggaguaugaagucuuaaaaaggaauuuccgaaacaaaagugaagaaauggaaaugacuacaaauaaguugaaaaugcaauuaaaaucugcacagucugaacuagaacagacaagaaauacauuaaagucaauggaaggaucugauggucaugguaugcucuguuagauuuaaaauuuuuucuucuguuuuuaauuuaauggacuaaauuuguuaaaacagaaacucaaauacguuaccuaccaccucuucacagugcuaaaugauguaagaaauauacaauaguagguauuaaugauggagguuauguagcaguaguuaauuguuuuuaggaaauugccauggaguuaauuuaaucccuaaacuaucugaaucuuuccuuucuaguggcuauuucaguaauuucuaacagaucucaguaucuauuaacgucaaguaauuauuuuuaaggauauaaauacaaguuaccuguaauuuccauucaauccuuuauuuuucaacauguacacuauauaaacuguaggucccuggcuaguuggcaguucuugauugcuucaccgugauaaaaaugggaaggaauccuggaaauugaauuguuaggugaggggaccuucucaccacccagauuuauuccccuuuuaccuugcugcccauacuaaugcagagagauaaagagguuaucuuccaguucauguuauucauauaauuguugacaugaccauauuagcugaccauaaaaauuaauauuuaucuaauuaaaguauauacuuuuccauuucucaauauuuuuuaaugucagaagauuuauuuuugugcucgcuuuggccgcacuuauacuaaaauuagaacgauauaaagaagauuaccauagucucugugcaaggacgaccacaaauucuugauguguuucauauuuugugugguuuggcccuuugcugguuaacacagauaaacuuguuggguuuggagaagucacucgagaggucuuuuggggucugcugccccugcuccccagacagcaacccagccucacuguugggcaucuucacaaccaccccagggacauuacaauuauuaaguuaccuagagaacccuuguguucucauucaaauucuuguuucuauuuauuaaaucagcuuaaaauaaaaaaaaaaacauuuguuuuagaaaauuuccuuucaaggccaaccaugauccacuuaaucagaccauaauucuucaaaguggugagcaaaugaugucagacuuuuacccuauuaauaaaucaauauacagugucaguuuaacccuguuuugacaguuuagauagaagaacuguaucuuguuaaugagaagucagaccuuucauucugauagcuuguuuauaaugaaugguauauuuucauuuuucuuuuuaaccucuaaguuauagccagacuggacucaaagcuguggcauuuucaauccuuuuuccucagcugacuauaagagaaaaaaucagauaugcuuaugcuggcaguuuggcuacugagaugguagugaguuccaagcacaugacaacaaucaugagaauaaaaauugaaggguuugugauaucacuggacccuuuaaaagauacacuagaugucuugugcaguauuuuaaguaugagguucuugaaaaaucauuuuaguaauaauacaauauauauuauuauuuaugugacaccccccaugucuacacacacacacacacacacacacacacacacguacauauauuauauauuauauauuucccuacauggguaaguaugaguuuagucaauguuauuguuauuacuggaaagcuggcaacguaucauggucaaugaaauuaaucccaguggcaaaaacccuacaaaacaugauuauauguauguuucccagcuaaaaaucucuaguaguaguuaaaaguuauuauauuccaacauuauaaaaaccgaagacauucguccaugaucuuuuccuugaaacugcccagauaccuuggaggaucuuacuugucaccuucucauaaaguuuaaccaucaaauuaccauagucucucaaacuuaagaaccuaaggcauaguuugccucuuuuuuuuuuccagcuaugaaaguggcaauggggaugcaaaagcaaaucacagccaaaagaggucagauagaugcccuucagagcaagauacaguuuuuggaagaggcaaugacaaaugcaaauaagguggguugcuguccucagaguggggaaaccaacauguucacucacaggcagaccacgaggcagaauaagaugaagcagagaugcaagugcaaggggaaaaggaaagcuuauuucuaggugagagaacaagggaaaaguuccuagaaaagcauuugagcaggauguugaaagacagcuacuauuuuaaacgugggaaaugggaaaaagaacauucuugguagaggcaaggaaugauuauaaacaaaauacagugaguuccauuauaaugugacauacauguuuguaaaaaucgcugugcuaugcaaaauuguguaauaaaaaccacagggcuuaugggaacaaugggaucaggagcaccacacuaacaaauuuuauuagugacacauaaaauaauaggaaccuaauaaaaacaauagcaguuuuacacauacuaaauuguuaagaaauauauaaauacaacaauaaguauagcucuuugucuugaaaaugaccugaaguuuucuuaaguauauaugcagcucguauguuauuguggaggaguaggaggagaguuuccuguaacaccggauguggauggaugugguucauaacacaugguaaaacugaggucgccgguagguggguguuugaggagugugcauguaugcuucuuguguauuccuaugcugcuguguuuagcuggauugaguuuucugccuugaccuagugguucucaugaaugagacucauucacgaauaagcaaccaugaaguuugccuaaugcucaaauauucucugguauauccauuacuuuggaaaaagcgucuauuucagaagaagauuuauaacagaacugaccauaauagaggugaaaaaguaaaugacaaguagaaaauaagugcaaccaaaguaauugcuaacuuacuauccaugaugagcugccaaaauacuucagaguauuugcagcuaaauauuagcaaauauaaaccuacauuugugcauaccccuuaucauauagacuuauuucuucuuuccaauuuuuucuucccuuccuuucucuuauccugaauucacuuuuuucuuucuccuuuuuuuuuuuuuuuuuuuuuuugccuuugggaaccuaaagcagugcuuauccuuccugauggcgcuuauggcuuuaagagguuacugccugcugucaacaaagaugccugccuugccuaaaggaaaauauucaucguagcucuaagauauucccuccaaacaaaaaggagaaagccuauacaauuaauuccucuuuccuucugaagucuuuucugccuaaucuacucagaaaaggaaaacuuuuugcauuuuacaguagcaacaccuucuaccuuauuuacaauaaauguuuuucacuaugaaaaaauacauaaagaaauguagacucaaugcacugauguauuuuaacuugacaacuauacauuuauuauuuuuguauacauauuccauggcgcuuuuuuggagggaugaacuaauuuuaaugaaauguuguuuaauagcagagacuauuguaucaguaagcucacugucaucauugggcuguuaagugacuugagcgcaggaacuauaugucccauuuguuuuucugucgcagguaugcaguaggaauuugugaaaugaauauucaaccuugaaacaaaauagaaauccauaaaacuuucaaguaaugcaucuuuuaaaaaucucuguuguuuaaaauaaauuuuaguaaaauuugauauacgauuauuugauccuaauucacuaaaacacugucuuuuuaugacaauauaguuauuucauauuuuguagauuuuaucaaagauuuauuaagacuagaaagaaguaauaauaccagcaaugauuaaaauaggagagaguacauaauaacauacucccagcagcucccaaccacaacucagaagcaauuaaauggcauauaaauuaaacuuaccuaguucaggguccuuuaaacaagaauuuuauauuuccauuaccuuucagcaucuacaucaacagguuauuucugauguuuuucucucauauaauuguaggagaaacauuuucugaaagaagagaaaaguaaacucagucaggaauugaguacuguugccacagaaaaaaacaagauggcuggggaguuggaaguucugcgaucucaggaacgccguuugaaagaaaagguuacuaauauggaaguggcucuggauaagguaauuauuaacuaaacauaugaaguaauuaucaacuaaauaguuauuaaccaaauagaauuguucugaacaaaagcucuauguagacaggaacugaauguaucaauuuguguuguaucccaaucaccuagcacaaaggaaaacccuauccuauuagagaaggcguuucugaauuuuaaaauguggucauaaugcauacuuuuugccaaauuuucuuuuucaggcuaacauagucacaggagcaguaagaucaaagauguaagauguuccugauauccauagugacaugaauaaguaaaaaggucuccaugagcaccugauuuaccaccaaaaagugacuuggguacuugguagaauacagucuguuaauaaugucaauaaaaugauaaaguaaugcuaauggcuggcacuuugugggguccagaaggugcauguaggaaacauagcuuaaagaaugagaaggaucagugauacuuuuugucauugccguuuauuguagagaaauaaaucucccuuccugucaccuagaaacucuggaagccuaaaauuguaccaaaaccauccuugauugcuaagaaaacagugccuuuaugguuagauacaauaaucugggaucucaucucugcuaccuuuguuucuuaaaacaugcuauauugacucugugaauuucaguugugguuauuuuuuaaaauuuauuuuauuuuauuuuauuuuuuugagacggagucucgcucugucgccaggcuggagugcaguggcacgaucucggcucacugcaaccuccgccucccggguucaaacgauucuccugccucagccuccugaguagcugggacuacaguugugcaccaccaugcccaguuaauuuuuguauuuuuaguagagacgggguuucaccauguuggccaggauggauggucuccaucucuugaccucgugaucugccugccucggccucccaaagugcugggauuacaggugugagccaccaugcccagccaguuaugguuauuuuaauauaaauuuuuauacuuugguaaagcuguuugcucauuccauccuuaguucauucauuguuugcccuucacauacuaaaaguuacguauuugcuggggguauagaggauaaaaacauggccuccaguugcucacaguucacuaaauaaaacagauaaauagaucauuguaauauaguuugguagaagggcaggaagauuuuuugaagagauggcagcucugcauucauagguuaauaaaauauaagugcauaaagaaugcaagauaaaccauuuaugauugcuccauuuguaggcaucuuugcaguuugcagaaugucaagauauaauacagcgucaggagcaagaaucagugcgcuuaaaacuucaacacacuuuggauauaaaaguaaggucaucauaaauauuaguuuaagcgaaaauaaugccguucuuugauaugcuuuuauauuuucuuguguaccuuagauacacauucaaguauauuucaacauuacuugauacuauuaauagcaaugauaagauguguacauuguuauauacuauaccuauccuuuucauauaugguaacaaauagaagcaccacuauccuuaguuuaaaauaggugaguuuaaaauaggugaguuuaaaauaggugagugaagguacuagugaaguuuacgaguaccugcaugggaauacccaaagcaagaguuuuccaugcucaggagucaagcgaguacaaaacccuaagugcaaauauauuugcuuguuuggggaauagcaaaagugauguaaucuacaugacaaaacguuuuuuuuuuaaaucguacauuuuacacugaaauauaugucuauuuuaagaaguguacuuuaaagcuacagacauauuuuaaaaucucaauaauggauuuugccugugaaaucaaaaaauacauuuugauuucacauuucuuuauaauuguaggcuggcaguuauuuugcuuaccucuauauuguuuuccaggaacuucagggcccuggauacaccucaaauucuucauugaaaccacgccuucuccagccagcaucuguuacucguucucauucuaauguaccaucuucgcagucuacagccagcuuccugucucauguaaguaaccagucuuaugauccauuacgcaaaugacauaugcguaaguaauuuuaaauuggaaagaauuacguuaaaaaauaauaucucuauauccauagcauuuucaauuacuagauuuuagauuuauacauuuuccuauaaauucaauggaguccaggugaauaaaaauauuuucuucacuauuugguguuuucuuaucuucaauucuuugguuauuuccaucucaagaauuuccagauuacaaagcaaauagugagauggcuaaaauaaacaucacuucaaaaggcaaaggcaaguuggugguauauuuaauagucuaccaaaaugaaaauuauuugcuauaugugguuucuuuguuaacuuauuuauaacagaauuuuauuaauuauaagacacuuuuauucccuuuaauuaaaauauuagaaacuuuggaaauuuuuuaguuuaaucuuuuauauuuuuaaugcucagaaaaaaaauaugugcaauguaaaauucaaguuuguuuucucugaaaauauguauuuaugaaaccacaaaucccuugcaaccaguauucaacuguaaagaaauaaggcauuccauaaaucacacaugaaaaucaauuaaauuaguuaaaaguccuaucuuacauauggcaacaggaucaccaguaaucuguuguuucaccuguaccauuuaaaugaaaauuauguacuguuuaaaugacuaaaauggaauccucucacacacuuaagaugugugcgcugaaacauaaacuaucauacaacaaagaguagucuaucaaacaauagaauaauaauauuaguguuagaaguuaagcauguuucccucuggacacugaaauucagagaugcacaggggaagggcaggagacugcugcuuuuuaaguguuaugaaaucauuuuauuuuuaaaaauauguacauguuccauugauaaaaauuaaauuagccuccccuuuccaaaaguaauuuugcacaucaagcaacaacaaagaacauuugaccaggagucauuggaaccauauuuuuaacucuuugugugaccuugggcgagucaguuaaauauauugcaccuugaucuuuuccucucuaacaaguagucuggacaagaugaccucuagggucaccaagaaagauuagcucugaaauucugugauuuuuaauuacccaaaaucuauuagauuuuuccuagcagcuuaauauauagauuguacuugauuauuaagaauggcauccaucacugaaaaaguacuagucauuagcuuguuuaacuuuaaauuuuaacuuaaguauuuauuuguuuauuuauuuauuuuuuccugagacagagucuugcucugucacugaggcuggagugcaauggugcagucaugcucacugcagcuugaaccagccagaaucaagcaauccuccuaccuuagccucccuaguagcugggacuaaaggugcgugccaccacgccuggcuaauuuuuguauuuuuuauagaaacagaguuucacuauguugcccaggcuugucucaaacuccugggcucaagcaauccucccaccuuggccucccaaagugcugagauuacaggugugagccacugcucuuggccucagcuuaaguuuuuaaauaauaauucuaacagcaaaaaugaacuagauuuuuaaaauauacugucagacaugcuuuauacaauuaauuccuucucuuaaaaauguuuauuauauaauuuuacacaauaaaaguaauauucauucuuuguuuuguucacugauguuucccaaguaccuauaacagugucuagcauauauucaauaaauauuuaucucauagaugaaugaauucacuguagaacauugucuucaggucuccauuacuuccacugauaagucaauuguaaaucuuguuguugcuguuuuggagguaguuuuuucucugacuguuuucaagauuuucucuuugguuugguguauaacaguuugccuaucaugugccuagaugugcuggucuuuauaucuaucuuucuuaaggguaguggucuuccugaugcauggauugaaaucuucaucaauuugagaaaauuuucaucccuuaucuacucaguuuguuuucucuauuuucuuuuuucccucugggacucuaacacacguauuaauuguuuauucaucaugccuuauaugucuuuauaucuuuacacuuuugcccauccuuuugucucucugugcuuuccuggccuauuuuccagauaauuaauucucccuucaccugagucuaaucuauuaaacccaucaauuaaguucuucauuuuagaaauugugguauuuaguacuagauuuccauuuaauucauguuuuuuaacaaguucuuuacagaaauucucaauauuaucuuuuacuuuuuuguauuguuaaguauauguuaugguccacguguuuguguuuucccuuagauucauauguugaaaccuaaaccccaagguggaaccaaugggaggugauugggucauaagggcucugcccuuacaaaugguauuagugcccuuuuuuuuuuuuuuuuuuuuuuuugagacagaguauugcucuguugcccaggcuggggugcaguggcacaaucucagcucaccacaagcuccgccuuccggguucacgccauucuccugccucagccucccgaguagcugggacuacaggugcccaccaccucgccuggcuaauuuuuuuuuuuuuuuuuguauauuuaguagagacgggguuucacuguguuagccaggauggucucgaucuccugaccucaggauccacccaccuuggccucccaaagugcugggauuacaggccugagccaccgcgcccggcauuagugcccuuuuauaaaacaggcuugagagagcuuguuugccccuucucccaugugaggacacauagaaggugccaucuaugaggaagagcuccucaccaaaugcugaaucugcuggcaucuugaucuugcacuucccagccugaacugugaacaguaaauuucuguuguugauaaauugcccacucuaagauauuuuccuauaacaacccaaacagaguaagaaaauaacuguuuuaaaaauuggcacaugauaauuauaugauuugaauccccuccgagccugugucgauuuuuucccuugguuucuagucacuuuguuguuuggucucuuugcuuccucuuuaaauaauugagucuggacacuguaugugaaaaaauuacagagauaauuuuggguucuaggcgauuuuguuucuuuuuuuaauuuuuaaaaauuauacuuuaacuucugggauacaugugcagaacgugcagguuuguuacauagguauacaugugccauggugguuugcugcaccgaucaacccgucaucuacauuagguauuucuccuaaugcuaucccuccccuagccccucacacccugacaggcccuauuguguaauguuccccucccuguguccauguguucccauuguucaacucccacuuaugagugagaacaugcgguguuuguuuuucuguucuuguguuaguuugcugagaaugaugguuuccagcuucauucaugucccugcaaaggacauaaacucauccuuuuuuauggcugcauaguguuccaugguguguaugugccaugugccuggauagacuggauaaagucuauccaggcacauuauccagucuaucauugcugggcauuuagguugguuccaagucuuugcuauugugaauagugccgcaauaaacauacaugugcaugugucuuuauagcagaaugauuuaugauccuuuggguauauacccaguaaugggauugcuaggucaaaugguguuucugguucuagauccuugaggaauugccacacugucuuccacaaugguugaacuaauuuacacuuccaccaacaguguaaaagcauuccuauuucucuacauccucuccagcguuuguuuuuuccugacuuuuuaagaucgccauucuaacuggcaugagaugguaucucauuuugguuuugauuugcauuucucuaaugaccagugaugaugagcuuuuuuucauguugguuggccucauaaauaucuucuucugagaagugucuguucauauccuucacccacuuuuugauggaauuguuuguuuuuuucuuguaaauuuguugaaguuuuuuguagauucuggauauuagcccuuugucagauagauagauugcaaaaauuuucucucauucuguauguugccuguucacucugaugauaguuucuuuuuuuugagacggagucuuguucugucaccagucuagagugcagugacaugaucuuugcccacugccaccuccgccucccggguucaagugauucuccugccucagccuccugaguagcugggacuacaggcacgugccaccaugcccagcuauuuuuuguauuuuuaguagaaacacgguuucaccauguuggccaggauggucucaaucucuugaccuugugauccacccagcuuggccucccaaagcguugggauuacaggcgugagccacugcaucagccuaguuuauuuugcugugaagaagcucuuuaguuuaauuagaucccauuugucaauuuuggcuuuuguugucauugcuuuugguguuuuagucaugaagucuuugcccaugccuauguccugaaugguauugccuagguucucuucuaggguuuuuaugguuuuaggucuuacauuuaagucuuuaauccaucuugaguuaauuuuuguauaagguguaaggaaacaguuucaguuuuuuguauauggcuaaccaguuuucccaacaccauuuauuaaauuagggaauccuuuccccauuucuuguuuuuguuggguuugucaaagaucagaugguuguagauguguggcguuauuucugaagccucuguucuguuccaguggucuauauaucuguuuugguaccaguaccaugcuguuuugguuacuguagccuuguuauauuguugaagucagguagcaugaugccuccagcuuuguuuuuuuuguuuaggauuguuuugaccauaugggcucuuuuuugguuccauaugaaauuuaaaguaguuuuuucuaauuuuuugaagaaagucaaugguagcuugauggggauaucauugaaucuaccaauuaguuugggcaguauggccauuuucacgauauugauucuuccuauccaugagcaucaaauauuuuuccauuuguuuguguccucuuuuuuaagauuuguagaaaucaaaauauuuauucacauaauuuuaaacuaaaguuaaagcuaauaaaucuuccaugguaaugauuuaagugcaagugaugcuuggcuuucuuucacauucauuuauuuucuucugagugaaggcauaucaguuauucuugaacaagucaauacagcucugcaaaagggagucauuguuccuggcauguuuuauuuccaguucagacauuucaaugagaaucuuucuaaaugcugccacucucuucgguuugaaauuuaucaguucuucuuuugcagauuuggaaagcuguucaaauuucaggcagcacuccugcuggugugccucagccaauuugacgucuuugcucuuuaaccgggccuuauccagagcuuuguuugaguucucauaaucaaugagggcuuuggugugucuguauaagagauccuuagcagcuucgauguugagcauguaguaucguuggagcucuguuagcuucagaucuucaucugaugaaacuugacccucuacuuuccuaaguuugucaaauagcacagcaaccuucaauagguacuuuuugaugacugugggcucuucuaaagccaggcaauguaagcaggcugcaguguggauauagacaucggcaacaauuuuuaugagaucuggucauuuugucagcuuucacacaagaaucguugauccuauuguaauaauuaguaaggaaguucuucucuugcucaaagaagucaucuaccucccuaacuccaguaaaaaggacuucuucagcacuuuucaccacacuuuugaagaagccaccaaacauuucuuuaguauuuuuccaccuaacacuuaggcuuccaguucuuguuucaucuuggcaaauucuucuuuggucauagacccuucacccucucccgguuucugcaucuucucucgaggaccauugaagucgggcuucauagcagcagguggaauaauaagcccagcauagucuguuguuucaauaagagugucauguagccacacaaagucuucauguugccuuguaacagaaaacucugggcucugaaacaugggcaguguggucuuugugugcacuguaaauuugacuuuaucucucucacugagcacaucagguaugucaaccugaagcgagggaucaacauucagguccagagauacagaugucagcuauucaucagcuucccagcuggggcacaucaggcacuggcuggaggacaagccuguagcucuugagcuccugcccaccagucuucauaaacucauuuuugguccaaacuucacuuacaacucacuguggcacaagacaauaccaccagcaaagcugccucuucaaaagauuuaauggcuuacauguucguguccucccuuauuuccucgagcagugguuuguaguuuuccuuggagaggucccucacaucccuuguuaguuguauuccuagguaauuuauucucuuuguagcaauuaugaaugagaguucacucaugauuuggcucucugcuugucuauuacugguguauaggaaugcuugugauuuuugcccauugauuuuguauccugagacuuugcugaaguuacuuaucagcuuaaggagauuuugggcugaggcgauaggguuuucuaaauauacaaucaugucaucugcaaacaaagacaauuucacuucuucucuuccuauuugaauauccuuuauuucuuucuuuugccugauugcccuggccagaacuuccaauacuauguugaauaggaguggugagagagggcauccuucucuugugccaguuuucaaagggaaugcuuccagcuuuugcccauauuuuuuguuguuuucuaaagucuucucuuuauguagcuuuccguucuuucauggauacaacacuuuccugguuuguuuguuuguuuguuuguuuuguuuuuugagauggagucucacucugucacccaggcuggagugcaguugcaugaucucggcucacugugaccuccgucuccuggguucaagcaauucucaugccucagucuccugaguagcugggauuacaggcacccgccaccacaccuggcuaauuuuuguauuuuuaguagagaugggguuuugccauguuggccaggcuggucucaagugauccgccugccucggccucccaaacuauuuggauuacaagcuugagccaccauguccagccaauacuuucuugcuucucuuuaaggauauuaacuuugguuuuuaaauaauuuuuuguguuaccugaauuauuaauguuucuuggaauucauuguuuuguuuuuguagacuuucuuuuaaugcuuggugacccuuggauguccauucauauuuaagacugaggcccuaaaaagcuauccaaagcuuuauguaagguugucagggcuuuucaacugguagaugguuagguaaugcuuuuuuauugaaggacccaaaaauuuucuauaggucuuuauucuugggcugaucaguuucccuaaagagggaucucuuauuccugacuuauagguauaaaucugucagaauucugugacgugagugggagaggaagucuaggguaacuauuaacauauaucuaugcagucucacuuaauacucauauuuaacauuugcaaccuuacuccugcuauacaagauagauaucucuauggaguccaaaguccuuugguucaaccuuacccaaagauuaagccucuaaauucauuuagggggaaagaaugaguaaucaccugaguauauggagacagcuucugggauucuaacagcuucuccuauagacuuagccaauccuccaauuuugcugcccuguuucuuacccuggacuuugaaauacaugagacuuccaauucgugagccuuccuggaauacucagaggcaugguagcuugcuucacauuggcagcuucugugcagguacuguaaguuuuaacuucauuuugcuaaauuaauuaugaauuauccauaugccugccaucucccaaaauuuuguuagcauuacuaaucuauuauuaucuguccuuuccucuuuacccuucuuaauuccuuuagugucauuuuaguggggcuuaagauaguacagaaauuaaugccaaguuuauaagcagaauauuacuguuuacauuguucuacauugccccuucauuuauuauuuaucuuuauuuuagucucuuuauuuuacaauucuaauaauagcuuagauuuacugaaaacuccuuugccaggcacagugcaaaguacuuuggagauuaguucauuucccacaacuacuuaacaugagguaagugcuauuacuauaccuguuuuacagacaggggaaaugaggcuugaagaagcuaagugacuuacacaugguuuacacagcaaaaagacacuugagucugggcacugugguuaaugcuugaaauuccaacacuuuguagggacugaggcuggaggguugcuugagaccaggaguuugagaccagccugggcaaaguagugagaccucgucucuacaaaaaauaaaaaaauuauucagacauguuggcauuugcuuguaguccuagucaggaggccgaggcagaaggauugcuugaguccaugaguacgagguugcagugccugggcagcagaguaggacucucucucucaaaaaaaaaauaauaauaauaguaauaauuucggcaggacuuauccagacagccugaguccagaacuuauguccuuaauuauuauacuguacuguuucucuacauuauacagcugauugauguuuauaaaaauaauuuuaaguugaugacguaaauagauacccuauaugaacuauuauuguauuucauuagucuuugugaaugaggaucauagaguuuuaaagauucaaaggcaguugaaauuauccaggugauuuucuuguguuaaaaguaagaaaguaggaaaaccagaaaaguaauauuaugugauuuggcccaaacucaaacaccuagaacauguuauuacuguaucuuuguguguguacacacauacacauauacauacauauacacauauauguaacugauaguuugauauaggagcauuuuagauuaauauuucaaauacaggcuauuuuaacauaagaaauaaaauauaucuaggaugauagaauugauuuugguuguguaucagauucuauuccuaugcacuacaauuuguuacuacugugcuugaucuuugccaaugaaauauacaugaugugggcaagauuuuuagcaaugcuucguaacuuuuuuccuguuuccuguccaucuauuccuaauauauuauguaaaugguauacuuauauuccauuuuuauuacaauguucuaaaauauaagagaugaguuuggggcagacauucucaaaauagaaugguugaauucaagcugaaugagaucaagcuguuauuuuuagcuuuuucauuuaucuucuaucuuuggagaauggagacagaacugguugaggaguacacucucccuaggccucacuuaucuuacaucaugacugaugacucauaaguuugccuguaauagacuuaaggccauuagaaaaaacaguauuggagaagauagaaguacauuaaagauauaauuuaugaaaaauuuuagaaacaagucuaacauaaaaugauuucagagucaauguuuucagagucacaauguaauaggaaacuaaccaaaccacaaaauaaaccuuaagcuuaacaacuuauuguauaagcuuguauucuucccauagcacaaaaagcuguacaaguuuuacccugcaaauguaugugcccuagaaauagccuuaaugugucuccuaaggcagcaguucccaaccuuuuuggcaccagugaccaguuucaugaaagacaguuuuuccauggaacagguugaggcggggggugauuuugggaugauuuaagugcauuacauuuauugugcacuuuauuucuauuauuauuacacuguaauauauaauggaauaauuauacaacucaccauauuguggaaucaguggggucccugagcuuguuuuccugcaacuagauggucccaucuggaggugaugggagacagugacacccgaaggguguugcuuauguccagucuacucccuaaucucaucugguugcugucacugcagaaaacacugcuucacaaagauaggauguuggaaauggaagcaggcuuuuccaugcuuuuguggcaaucucagaauauucugccuugacuuuaauccagaauauagggagauuugaaguugucucaaacauacuuuuaaggccacugucauuugcaaucucaagaagcugauccucuucuagcauggacaaagccagugcaccugguuuauucacaaaugggugacggauccauuccuucccaguuugggggccuuuugugguugggaaguaaugcuuaaacucuuuugaaagcugagauaggugaucaugcacuagcugggagaaaggaggcccuggcacagccucuuucaaaaucucugauaauuuugacacaugucaaaaaucccaauguuaacucauugcucccauaauuccaguuugacuuugaaugcagccccuuuaucugccaacuugaacauaguuguuguucuccccugaagugauagauuuuguugagcaaguugaauaugucacacaaguaagcaaguuuugugacccacucugugucacugaaaugugcugccaguggugauuuuuucuaaaagaaaucucuggagcggcucucauaacccaaaaacucuggucagugaucuaccuuuagaaagccaucucacuucuguguauaagagaagacguguaugcuguggguguaucuccucucagagcugugugaaaagaugaguuaaaggcauguacuuuagugugguuaauaauuuuaaucacauccugcaaaacauuguuaaguucaggugacauuuuucagcuagccagcaucucucuauggaagacacagugcauaaacucacauucaaaaucgaccucuuugaccagagcagugaaaccagaaagcuguccagucauggcaacugcucuguccaugcauauaccaacacaaaaugaccaguuucccugauauguaaacauucaaagacuugaauaguucugcagcugugguguuggcuggcaguaaaagcacacauaacaugugcuccugcacauccuccugaaaaauacacagcacaaaacaagcauuguugccuuguuguuaacaucaauagacuugucaauuuggguuguguaccauggugauucauuaacccucucuaacaauugugccucacuauucucugcuauuucaucuguaugucuaguuacggugcuagcugaaagaggaacacaugucaccuuuugaacugcagcuucuccuaaaaguucaugacaaauguauguagcagcaggcaggaucagcucuucaccaauaguaaggggcuucuucacuuucucaauacaguuagccacuaagaaugaugcucucggugcagacacauuugacgaagugguggcauucaauaauugcuucuguucuucauguucaugguuuuuuuucuuuugaaaaacuccaaaggcuugucuuuuaaugcaugguccuuugucuccaugugacaaagcaguuuugaagguuucaugguuucauuggauagccggucaccacauauuauaaaaagagggcuucgagaauuugaaccgucuauugcaaugaaccuguaauuuaaguaggacucuugguauuuucuuuucaaugcagcuuucuuuucaaugcagcuuucuuuucguuggcagucuuagagccuucugcugucucaucauugggucuuucccccuuuucaaagaagcuuuccagugaugauuguuuuuauccauuuuggcuaggguucucuugugggcuuaccaaaacugacugagacaagugugcagugcaggaaagagguacaggcaaagugguaaaucaaauaaugggcaggacacacauggacaaaaaucagugucuaguucugacuuaaacccugccaccaggugcagcuguacaguugaaguacaucaacucacuuaccacuauaaaaccagccaccagaugcagcuuaauuguuacuugccacauacugauaggguuuugauaagucugugagcaauugauuuauuauggucuuugugcagucaacccucucugcuaauguuuuucauuuuguuuuuguuuuuuugagacggagucucucucuguugcucaggcuggaaugcaguggcacgaucuuggcccaccacaaccucugccucccagguucaagcgauucuucugccucaggcccccgaguagcugggacuacaggcauacacgcuaccaugcccagcuaauuuuuguauuuuuaguagagacgggguuuugcuauguuggccaggcuggucucgaacuccugaccucaugaucugcccaccucggccuccuaaagugcugggauuacaggcgugagccacugcacccggcuuuugcuaauguuaaucuguauuugcagccacuccccagcacuagcaucacugccuuagcuccaccucagaucaucaggcauuagauucccauaaggagugugcaaccuagaucuccugcaugugcaguucacaagaggguucgcacuccuaugagaaucuaaugccaccccugaucugacaggagguggagcucagacgguaaugugagugauggggagcagcuauaaagacagaugaagcuucacucacucucccaucacucaccuccugcuguguggccccauuccucacagaccaugggccgguaccgguccaggguuuggggacccuuguucuaaggaucaaaggacugggguaggggagagcaggauccuuuguugggcucugcuaacuucaggaagagcauguguuuauuucuuuacaagccugauaagaguuauaugaaacuauauuuuagaaccauuuccuagcuauuuucuucuuuuuuuuuuuucuugagauggaguuuugcucuuguugcccaggcuggagugccauggcacgaucucgggucacugcaaccucugccuccuggguucaagcgauucuccugcuucagccuccuaaguagcugggauuacaggcgugcacuaccacauccagcuaauuguuuguauuuuuaguaaagacgggguuucaccauguuggccaggcuggucucgagcuccugaccuaggugauccacccgccuuggccucccggagugcuaggacuacaggcaugagccaccacacccagcagugcuauuuucuaauuuuaaaaaguguauuuugcucauuuuauaaaucaagguauauuuccuaugaauuaaccaaugaaguauuuaacaugaauuaauaaaaccauuauaagcuaugcaaacauuaaaaagaaagauugauaauuuugacuaaauaaaauuuaaaucggccaggcauggugguucacaugggagcacuuugggaggccgaggcgggcagauugcuugagccaaggaauuggacaccagccuggccaacauggcaaaaccccaucucuccaaaaaauacaaaaaaacccaaaaauagccgggugugguggcaugcaccuauagucucagcuacucaggagacugaggcagaaugaucaauugagccugagaggucaaggcggcagugauccgugaucgcaucacugcacuccaguuugggugaaagaaugagacucugucucagaggaaaaaaaaagacauuucuauuguuguagugaauacccaaaaauacaagguauaggacacagaagaggaagcuuauuaagaacuucuggaaaagacauaaggauucugaguugacugccugcucagucucagucggcguuauuguguggcaaccaaaaaugguuucaacgauagcauccagaucaagcaagggggacaguucucugcucugcucagaauuuuccugagaacauuuagcuugaggugugugucaggaaguaaggaggggguguaugaguguaggauaaaauaaguaucauuuuuacaagguuauguuaugcuuguuucuuaugaccccagguguuagaacugugaccaggguuggaagguguauggguauggagggaagcuuuucuuuaaaagauuugaagcuauacaaaaauuaaacugccuuccuugaucuuuggugaucaagcaaaggccagauaagcauauuacuagaaugccguagagagaauucuucaucacuuuugauaugggaguuggacuagaaccaaaugauuuucaggacgccuccagccuugauauuuuugugguuuuauacccaaacaaauuauggguuauauguaauggaauauauaaagacaaugaugaucaaaucaaguccuugccucuguggagcuuacauuuucacuggaggagcaacacacauagaaguuugaaagguaaguauugggauaaagucaauaaaagaaugucauaggacugauuauaauuaauuucuaagugaaugguaaauugaaugguuuuuuuuuuuuuuuuuuuuuuuuuuuugagacagagucucacucuguccaccaggcuggagugcaauggcacaaucucggcucacugcaagcuccgccuccugggcucaugccauucuccugccucagccucccaaguagcugggacuacaggugccugccaccaugcccggcuaauuuuuuuguauuuuuaguagagaugggguuucaccauguuagccaggauggucucaaucuccugaccucgugaucugccugccuuggccucccaaagugcugggauuacaggugugagccaccgcgcccugccaauugaaugcuuuuucaaaccucaugucagccagcacaguggcucacaccuguaaucccagcacuuugggaaaccaagaugcguggaucgccugaguccaggaguuugagaucauccagggcaacauggcaaaacuccauucuacaaaaaaguuagcuggucaugguggugcaggccuguaguccucagcuacugggggugcugaggcaggaggauugcuugagccugggagauggaaguugcaguaaacugagaucaugucacugcauuccagccuaggugacagagugggacucugucucaaaaaacaaaacaaaacaaaaaaaccuuauguauuguaaagcaucagucacucucaaagaaccuaggugccacaaugacaggggagaacaacauauuuauauauguuuauggguuuuacauugcucacuuauaauaaaugucaauggcucaaaaauuuuaacaauaauugccaaagcuuauuugauaaacuuucuggugggcagaagaugggaagauaagaaguccagguuauaacuaaggugagugaauauugccauaggauaaguuuuucuuuauuaacuuuaugagguuuuauuccauauuggguauuaugcauauuagcgugagggcaagaacaaaaccaguguuucguaaaauuggaucaucuuuuuagagacaaauguuuuuauucacaauugacaaagugauucacauccuuauauuuuuaagcaaaugaagucaaauuuaauaauugaguggagucuaauuuaugaaacuuuagacugacucaucaugacaauuuccagguaagauagccaucaguaaacuggaaagacauacuuagcacacauucagugaguuggaacucucauaucuucagcuggauauuauauugguuuauuaguggaguugagaagaggagaauaugagaauuauauuauaccaguaacaucagcucuucguuggcauaaacccuagaaaauuaaagcccagugaauaaaaaaucugcaguguucaucccucagcagccaaucugugugacagguguaacuuuucagugggauggacuccuucagcuagaauagcucaaggauagccugagucuaccugcucaccagugcacucugaucauuugguuuccccucuugaugugccuauugaaaaugucaguauuccuuauuauauuauaaauauuuauugggguacacuaucaaucugaaaaucucauauuauucuuaaacaccaacuaacacaguuugaaaauauuggauguuucuuuccucaucaguaagauguggggaguagauuaacucaucucuaaauagcuccuuaauucucagguuuuguugcuuuaucaaauuaguuuagcuuuaaacaaaguauugaaaguuauuuuguccagguguacuugaaaauauuuaaugacauaguaaggauguucauacuacauuguuaaaauuuuaaaacaaaaguaguuuaaaaauaaauguaaguaguuuggccccauauguguauauguguccaugcacauauaaauuagauauaguacucuauugauuauuuccugguuauuauugauuaucucuguguaauaagcuugugggugauuuuuuuguuuuccucuucuugcuuuuccauaauuucuguuuaccaguugcauuaauuuugugauaggaaauagcauagaaaucugaaaaaauaagugucuuuguaaauuguuuuaacucagcacucuacaaaagcuaacacacugaaggaagauccaacaagggaccugaaacagcuucuccaagaguugagaagcgugaucaaugaggagccagcugugucucugagcaagacagaggaagauggaagaacaucucugggagccuuguauguggcuguguaaggcugugugcacacagaaugggaaagcucaucucuugaaugguuugccauugaguuauucacauguuacucucugggagggugagguuuaaaugacuuuaaaaguaucugaaguuacuaccacagaaaauaauaugaaaauggaggaguuaagcaaauguaaaacaacuugacacuaagagaaaacaauacagucauucuauucagaaaauacccagugcaaggugucacccaaaguuauguuuguaaauuuuaauucucaaaagauuuuauauccauaaucuuauugauugagacaaggcagagcaggguuuauuuaucccauuuuguaaaugagaaaaacacaucucaaaaggucgacgugucugcagccacaaguucaaugguggagauaaaacuagaaccuugagaacuauauacucuccaaguaggagauaauaggaaauacuucguuuucucuguauucaugccaaugacuugauuugauuauaucauauuaguaaaagauuagauccaaaaagaauuuagccaguucaccagcccuucuuugcacauagcuacagacaacaaugggagucuccuauucuuucagagaguggguuuuacuuuuuuguguuaucauuuagcuuagcuuaucuuaaagcauuuuaauaugguauauauauuuuaguguuauaauagcccauuauuguaauauucauuuucugauuauaugacaaauaccuaaaaguaauacuuccugaaaugauaccuauauauaaauaaucuccaguuucuuaugauguccaauucguauuuaccugagguagcaaaauauuagcugaguuuaucuaauuguuaauuauuaguaauaauaguaaaacauuaguaacaguccaguuaccuuagcauaacauuacauuaucugaagcacauaaugucagaacugucccacuagccacuccaacgaacauuuucauuuucagagcacuuucauuuuugucauaacuauaauaugccuuccaaaccagggcaguauuauuacacuuauuugacagauuuguaaacuuaggcauauauugacaugccuccuccuaugaagcagaggaaaagccagaaguaaaaguuacagacccuugcucccagcacugauuauucugagggauuaccaggacuucccugaucagcuuccaccacuccagccacuaaugaugggcuuggacgcuauuggacuguauugaacgugaauauauuugaucccuaccuuuagagaguuuauguuaauuugcuauaauccuauaaauguccuugucacuaaagccuaaacucagcguaaagcuuuuaagaauucaugggaggaaagcauuucucugucgaugaacuccagagcccuuugcaaaauuugcuuggaggccuaaaaucuacagcugucacuaaaagaaaaauugaauauauguaagcaauugauuagucuaaaaaagacauggaugaaauugugcuuuauaugauuaacugagaguuauauuuucuauacagagaggauaggguaagagauugcauuacugaauccagccugagaucagacaugugccauagguaagaagaaucugagauucugaaucaaauuaauuguccaaauauuuuauauguggccuuguaauuugagaagucuguuuggacauaaguuuacaugacacuuaaugggcauauuggguucguuguuuaacugacuuuaagaaagauuucagugaaauguacugaaguaauuuaguuucuagaaaucaacucaauagacauuuuuucuuuaaaauuugcugauguuuauccauaugaagcuauuauuaugguaugccauaucaaaaauggaagacuuuuucuacauuuacacauauuuacaauggcuuacauaacuuuugagaaaaggaugauucagaaggaaacuguaaaaacuucaauuuaggacuauaagcaccuuacugaaaaccauccuauuuucaucaauaauugaauagcugaauucuuaaaugaaaaauuuuaaaagcacaaagaaaugaaauccauaacuccaaauaagaccauaaucaaagacagcuuucaaaaauugacuuuagccaaaaaagaaaaaaggcuaauguuaauucauuauuuaucguacuuuaagacacuauagcuauuacuugaaaaucuucaguagcuccucacugccuacugcauuaaguacaugucccucagucugacauugaagaaucucccagaguggucacacgaaucucucuugugaccacucugcuuucacuccuguauuauccucuaaucaaaccagacuccuccugauucccaaaaguucauuuauuuuugucuucaagcuuuuucuccauucuguuuccuccaccuggaagagccaaugccccauucucacucuuuugaauccauaucuaucuaaaaguaauguugagagaagcaauuuuaucauuaaguuaauguuuaugauuuauuuauccagcugucagaugauaccauuucacccuacauaagaauacauuauuuuucucacaaacuuuuguuauauugguaaggaaauaacauuauuuaaacugugauuucucccaucccucuaccaacagaagcaacaacucguugagggacuccacugaaggaagcaaaucaagugaaacucuuaguagguaggaaauaccagcccccauuuucaaaaugucccuuuuacgacuguucauuauuaauucaaaagaucuuuaacugucuguaaugugccaugcacugcaguagacccuuagaauauagugagcaagacagauaugggcucuguccucaaguugcuuacaaucgugaagucugucuuuugacggacugccuggaaaaacuuacuuuugucuuuucuguuuucaccaccuaaauagacagagauauccgagcccucuauauauauuaacaauuaugaaugugaauucuacuguuaagaucuaguuagaauaggggcuaauucauugcuguaucuucagcaccaagcauaaugacugccaccuaguagccauucaguaaauauuuguuuagugaauggaugaagauaguauuauaaauauuuucauacugucucugcugccugaucaaaauacagugaauuugaaucuuucuaaacacaguugucccuugguauccaugggggauuuguuccaggaccccugcagagacuaaaauuuacagaugcucaagucccuuauauaaaauggcauaguauuugcauaugaccuacacacaucuucccauauucuuuaaaccauucuuagauuacuuauaauaccuaauauaauguaaaugcuauguaaauaguuguuauauuguauaguuuagggaauaaugacaagaaaaaaggccuguacauguucaguauagaugcaaccaucuuuuuuuuccccaaguauuuucaauucacauuugguugaaucugugauugcagaacccauggaugcagacuagccaaguguaaaucuuucuuguagccuaaaagaaauguuguuuuuauuuccgucucaccuggguauaugauacuauaucauaccuauuaauaaccacaacuaucaacugcauauguuuuauucuuauauuuuuauucuuaauaaaaauucuuauuuuccaguugauuuagacuugucucauuagucuaaucucauguaugagggaaacauuauuuucccuuagaaaugaagacucagauugcauagcaacuugucaaagucauacugcuugaaaacaguggagcucagguuugaacucagguuuagcuggcuccugagcccguguuuaugaccacugcuuacugccucugaguacccacacugagcuacuggggauggagcccaguccuaggcaugggacaaauagaagcuacuucccugagauaauuaaagcucugcaguagaguuucuucaugacuagaaaaaucugcuuccuucagcaaugaaaguacuguaauacuucuuuauucugaaauuaugaaaaauaacuuuuucuuuauuaugaaaaauaacuauaugcuccaaaacgucauugagaaaacauguuuuacauuucaguaacuggguuaagaaaauacagcuagauucucauaucugcuuaugcauuuaaucuguugugauuaaaugcauaucaacuaucauggagcuucuggagaacuccacuguacacuugugagagacugaaaguuauaaagcaaauaacaaccugauaucauaaugaaaguaguuuugaccucacaaaccuccugaaagggaaccacuuugagaacugcugccauaauauucucauauugguacccaacucacagagaacuauguaguuuacuucaacuuauaugucuuauaguuuuguacacugauacuacuaauguuaugaguuguuguugucauugucauuuauuuauuuauuugagacagagucucucccugucgcccaggcuggagugcaauggcgugaucucggcucacugcaagcucugccuccuagguucacgccauucuccugccucagccuccugaguagccgggacuacagguucccgccaccucgcccggcuaauuuuucuuauuuuuaguagagacgggguuucaccauguuggccaaauggucucuaucucuugaccucaugauccaccugcgucagccuccgaaagugcugggauuacaggggugagccaccacacccgaccuaauuucuuuauuuuuaaaugagucauuaagauugcaucucuuagaauccaugaacagaugacguggauuuuauagcuauuaguaugcaaaaauggauuuucuaaugaagauuauauauuuucauucuguaaaauguucauggauucugaauacaaaaagauaaugcaacuuugaaccuaccucuuagaguauuuuaggacuuuaggguuaugauugccaucuugagguuauauuuuaaaccaucacauuugccuguguucacuugcuucuaucuaugaaucuuaguacuguguuugugaaauggaaugcuugcauuaccauucuuaugcuuccagagagccagucacauuacacgcaggagacagggaagaucccucugguugcuucacauucacaucugcaggugaguuuccaaugaaagcacagaaauaggcccuacaaugucuccccauuuccacgaggguaaaagccaaagucauugcaguaucuuccaaguccuuuuuaacucucuggccucauuuccugcuacucccucuuucaugcauucuguuuuauccacucucaaacuguuccuugaacacgucaggcagcuuccauguuagggcuuuuaugcccuguucccuuauguugcuaaaaccucagcuccuuuaaagccuuugcccaggugucacuuucccagugggacuuaauugucaucaccucauuuaaagaucacaaccagccaggugugauggcucaugccuguuauuccagcacuuugagaagccaaggugaguggauugcuugagccuaggaguucaagaccagucugggcaacauggcgaaacccugucucuaaaaguaaauuaaaauaaaauaaaaaucacgauuuucccacacuuccagugcuccuucuuccuuuuaucaguuacucuuagcaucuucucacauacugugucaccccugugagacaagagcugugcaagggcagaugucuuuagccauuugguuccuggauauaucccaggugccuggagccuuccuggcacauagcaggugcugaauaaauauuuauugaauagacaaaaggaaaagcagaagaaucaagauggacagcucuccauaaaauuuccaaagaauuauagauaagaugaucuccauuaaaaauuaaaaagcuccagaaagaagagauugaaagucaacacaauuuguugauaagcaaaguggcauaacucagacuagaaauggaagagaaagauuaaaaacaucagaggaaaaaguuuuagaaaaugaaaaauaaaauagaugugacugaaauuauagccauggagaaaauuacacaaaaggaauuuuuaaaaauaaggaccaaaaauaauuauacagaauauguuagauuuggaaggcaaaggcaaaccaacagacacguaauuggucuuccuauggaagagaacaaaauaaaugagaaagaaugaaacugugaugaugauuguucaacaaaaauguaguuauaaaucuggacuguaaauuguaaauagagaaaauugagguaagguaaaaagagaugggagaaagauaaauuuucauuguuuuucuucgugucaauauacagucaugugcugcguaauguuuuggucaaugaccaugucauauacaacagaggucccauaagauuauaauagagcugaaaaauuccugauaccuggugauguuguagcuaucauaaugucauaccacaguguguuaccuuuucuauauuuggacauauuuagauaaauaaauacuuaccauuauguuacaguugccuacaguauucaguacaguaacaugcucuacagguuuguagccuagaagcaauaagcuauaccauauagccuguauaccaucuagguuugugaaaguauacucuaugaugguugcacaaugacaaaauuaacuaacaacgcaauucucagaacauauccccauuguuaauuguaacuauauuuauaaucaaaauguaauauucuuaaauaaaauaauugcaaauucuuaauuuuuaaauaaucuuuggcuuggggaagaucuuugaggaacuaauauuuugaagaaaagaacauuuaugugaaguuaauuccuucagguuuacuucguuuauauguuuuuuacuauuguuucagugauuacucaggacaguaaaacauuuauccuugccuuauuauauugauauaaaugaaugcuuuuaccuuuucucauacauuggcaguaccuuagaauauauuaacugcauucacuauccuuccaacuuucauacaauugucauauauuuuaauuaaaaauaugaauuauaaaaauaugaauaccacauuuaauuauuuguauuguuuuguacaguuaauauucauuuagauauacccacauauuuacacuuaacuuucugguaucauuuuacuuaugccuuuaaagcuucuuuuaauguaaaucugcuggugauaaauucucuccauuuuuguuuuucugaaauuguguuuauuucauccuaauuuuugaagaauauuuuugcugaguauagaauucuagauuggcauuuuuuucuucacuuugaagauaucacuuuccauuguuuucuagcuuucauuguuucuacuaagaagucagcuguaaguuuaauuauugcuuauuuaaauauagucuguuccuuuuuuccccuuuugcuuuaagauuguuuuuguuuuugauugguuuguuuuagcagcuuuuauucauuugugcagauaugauuuuuucaugcagauaagaagaauucacuuggaguuugaaguaaugcugcuugaaucuauggaagucuaugccugauaagcccauuaucuggacccuauagaucuaugucguuauuuauauuuuuuucuucuugauuuucugccauaucaucuugucuccuuauaugccugguuauuuuuauuguaugacauauuauauaugaaaaguuguacagaugauuucaugcuaugaaugagauuaccuuacucuagggagcauucaugcuugcauuugguagacaacuaaggcauccaggucaauuuaaucacauuagaaagaggauuugaagcuagaccucaggaucccaagggcaggucuaauuucuguucacccuuauucccaaggcguaacccuuuucaguuccaaccccaaaucuuggguauuuagaagaaugucccccugucccuccaccauugggaacauuuucucaugaaagcuugacuuuuugagaggugcaguuugcuauuuuuaauuaauucuguccuuuuacuuuuauucuugcaaacuuuuagcaaguccaucugugaaaaacucagcuucucguucauucaauucuucuccuaagaagucuccagugcacucacuccuaacuaguucaguugaagguucaauagguuccacaucacaguauagaucugccaaaccuauucauucaucugauucuguuaaagguaagaaagaucugauaucauugacgugauuaauugauuuccuacacugcugaacuguaaguucuuuuuacucagaauuaagguuuugcaugcugcucuuauguguaagcucuaacugauucuguguaauuuaaacaggucuuuuuuaaauagaacagcuauuguguaccaugcaagccuuaguaaauguacauagauauuauauguaaacauuaucucucuuuuucucuaaaugaauaaugaacauuuuugccucuauuuuauuaaaagauuuuggauccucuuuuaaaugcugugaacuacuuuucuuucuuauuuacauucuuugaaaucauagcucuuauucagucucugccuuagugaguauaagugcauaccguacaaacuuuucaaaauuuucucauuuuuaauauuuuaaguuaguuuguuauuugauaagacaaaugagaaaaaaauguuugauuuagaauaaaugccugguaaauaagugagaguuaaauauuauguguugaaugaacuugaaauauuucucaucauguaugacagugaccaaacaaccccaguguucuaugacaucauucccuuuuguaagagauaaacuagacaaaguuguauuaucaucaaguuauuucuuagucuuuugaaauucuauagcuuacacauuucuagauccuaaaaaauaccuaaucacauguuaguacauuuuuuacaucuuuuuuucuguacuuguguccucuuucaucucuuauguuucuaagcuauucauuuacuaucuucuucaauuuuaacugugaaauuacuuuccuguucuguggugggcaagugugugcaaaccuacccacaaagacugaggaagcugagaggcugaagaaagagacugacaaauccaauuucucagaaagaaacauuuaauagggacuuaagauuggagccaugucugugucucugcagcagugaaacaaggugguggauccuuguaccacuauccccgcagaugcagggccucuauaccauagguaaaggguauacuugccucagaaaggaugaacaggacaauugcuuaaggguagaauuuauggcagguacuugcuaccugccguacaaggaaacuggaaaucuuggaugccuuccuggaacugggauuaaucagaagucaacuuggcagauuagcauccaagauggaguugcuucggccuccauguuaccuuuuaaagcugugguuauugcaggaauagagcaaugcugcuugacacuucauuauuaauuuuuguuacauaaaggcauggcauuuucuucucacccccaaccccccgcuuauugucagauacucaucaaaccuauauuuuauauuauuuauguuaaaaacuucuggcugggcgcuguggcucaugucuguaaucccaacacuugggaaggcugagguggguggaucaccugaggucaggaguucaagaccagccuaaccaacauggagaaaccccaucucuauuaaaaauacaaaauuagccgggcgugguggcacaugccuguaaucccagcuacuugggaggcugaggcaggagaaucacuugaacccgggaggcagagguugcaaugagcugagaucccaugauugcacuccagccugggcaacaauucugucucaaaaaaaaaaaaaaaagaaacucuccaagaaacuguuucucauucucuuaaacuggaguaauuccuagauaauugccuugaaugcuguaaugaaaaggguauuuuuugauaagaaaauuaaccauuaaaaauauugucaaauuuauacagcuaggcagggauuaagaucaaaauuuaaaucuucagauugucaauuaaguacuuuuagagguugacaaaacagcauacugguaagagaauagcuuacaugcuccuaggccuucuuuaguugccacugccacauuuguucuagguucagugugaucauguuggcauccaugccacccucugccaucauacaauaccauucacguuaggugacagaacuaacgugggcacuggccucacauaccuugaaaauggugcaguuucuauauuagaucauacucccucaaaccccaaguuaaucaaacuacucaggcuugguacgaaaagcugucauuuauaaugcagaaugcaucauuaaacuugaaguguucuuuucacccaucuuauuuaauauuauguaguuaaauaaugauacaucggauugguuugagcacaaucaaauaggcuagcauugcaauauuuagauaaaacucauuuuucucucuuuuaaaaucauguuuuagaguuuccuuuaaguguuauagcucuuuuagaauuugucaugaaaaaaaguucccuuuauuuuaaagaaaaauuguuuagccuuuaauucaaagauuucuaaaaggaaauguugaguagacuuuuaauaucacaucuaagcaauuuucuaauagauucacagucuccgccaauagaaacaacaggaaaaacaugcaggaagcuucagaacagacuagaaagcuugcaaacucugguagaagauuuacagcugaagaaccaagguacaguguacguuuuuggagagaucuuccucgcucaugagaauguucaccuucuuuucagauuaagccuccugucuauagaccugcugaaaggguauugaauuaacaacuguaaacugaagucuaaauauaagggucuuaaccauuaauagccccuggauuaauugugugaccaugggcaggucacucuugcccugcuauacucucuuaucuaauggggaugacaauccugccggccaucccucaggaggagugguuuugagguucugaguggcuugucacaugggacuuucccacacaccgucuuucuuguugcuauuaggucuauagauaaacauuuauacaauaauagccaagaaaagaguauagucaauagcaagaaagcaaaauaaugguauuuaucuuuacacaggauuuaaauuagcauagcacuauaagacacuaugccacccaacgaaucacaaaauaaaaagaauccacuucuaaaaaugcuaaaacuauuugaauaagaaacuguucuaaucugcagaugaccagcagcuuuuugggcauaaguucuaaguaccaugaauaugggggagcccucaugauucaugcuuuuauaacccgccuucaugaauccaggagccuuuaucagagagaaaugaauuuugaaguacauuuuuuaugccaucuuuucuaucccuagaaaacaauaaauugcuggguaaaggaaaauacuauucuaagaacgaaucuucauaaaauaaacuuaaccuuauuaauaauaauaguugcuauuuacacuuaauugagcacuucccaacugugugccaggccuuuuacucagagcuucacuugcguuuucuucauguaauuuucacaacaacauugggaaauggguacuguuauuacagcauuugaaaaugaggaaacugaagauaaaagaacagucaauaaauuccaagucacagugaagaguagaucggggacuuggccucugcaauuucugacuccaaaauccacauguuuuuaauauaguaaggcuuuagcaaauuguuguugaagaaaauuccaagucccugugauaacccaagaccccuauguauaugaacauuaggaaaagcauuugguuuuaaguuuauugugaauuugugggguuuuagcauuuuuuuuuaaauuucaauaguuuggggggaacaugugguguuuaguuacagggaaaaguucuuuaguggugauuucugagauuuuggugcacccaucacccaagcaguauaugauguaucuuuuuucccucacccaccucccacccuucccccaaguccucaacguccaucguauuauuauuaugccuuugcguccucauagcuuagcucccacauauaaugagaacauacaauguuuguuuuucuuuuccugaguuacuucacuuagaauaauggucuccaacuccaugcagguugcuacaaaugccauuauuuuauuccuuuuuauggcugaguaguauuacaugguguguauauauauacauauauauauuuauuauauauauauaaaaaauauauauauuuacauauauauguguacacaccauguaaauauaucauauauauauauacacacaccauguaaauauauauauauauaaaaauauacaugguauauauaugggggaagaaugggagguggcugaggugugugcauauauauauaauauauuauauuauauauauauacacaccauguaauagucucucuauauauauagauagaucgauauaauuuucuuuauccacuaguugguuggugagcauuuaggcugguuccauauuuuugcaauugugaauuuuguugcuauaaacaugcgugugcaaguguccuuuacauauaaugacuucuuuuccuccaguagugggauuacugcaucaaaugguaguucuacuuuuaguuguuuaagaaaucucuguacugcuuuccauaguuguuguacuaguuuacaguguaaaaguguucccuuuuuaccacauccacaccaacaucuguuggucauauuuuuaacuuaugucauauuuuuaaauuauggccauucuugcaggaguagguaguaucauacuguuguuuugauuugcauuucccugaucauuagugauguugagcauuucuucauauguuuguugaccauuuguguaucuucuuuugagaauugucuauucauguccuuagccgacuuuuuaaugggauuauuuguuuuuuucuugcugauucgauugaguuccuuguagauucuggauauuaguccuuugucagaugcacaguuugcaaauauuuucuuccacucuguggguugucuguuuacucugcugcuuauuucuuuugcuaugcagaagcuuuuuaauuuaacuaggucccaucuauuuaucuuuguguuuguugcauuugcuuuuggguucuuggucaugaacucuugucuaacccaaugucuacaagaguuuuucugauguuaucuucuagaauuuuugugguuucaggucuuagguuuaggucuuugacccaucuugaguugaaguuucauucuucuacaugccacuugccaauuauuccagcaccauuuguuaaauaggguguccuuuccccacuuuauguuuuuguuugcauugucgaagaucaguggcuguaaauuuuuggcuuucuuccuggguucucuauucuguuccauuggucuaugugccuauuuuuauaccaguaccaugcuguuuuggugaugauagccuuguaguauaguuugaagucaaguaaugugaugccuccagauuuguucuuuugcauagucuugcuuuggcuaugugggaucuuuuuuuuguuccuuaugaauuuuaggaauguuuuuuccaguucugugaagaaugaugaugguauuuugaugggaauugcauugaauuuguagauugcuuuuggcaguaugaucauuuccacaauacugauucuacccauccaugggcaugaaauguguuuccauuuguguguguugucuaugauuuccuucagcagcauuuguaguuuuuccuguagcgauuguucaucuccuugguuagguauauucccaaguauuuuauuuuucuugcagcuguuauaaaaggggcuggguucuugaauugauaccaagcuuggucauuguugguguguagcaaugguacugauuuguguacauugauuuuguauccugaaacuuuacugaauucauuuaucagaucuaggagcuuuguggaugagucuuuaagguuuucuaggcauaggaucauaucaucagcaaacagcaauaguuugacuuccucuucacccauuuggaugcccuuuauuucuuucucucgucugacugcucugacuaggacuuccaguacaauguugaauagcaguggugaaagugggcauccucguuuuguacaaguucucuuggaaaaugcuuucaauuuuuccccuuucaguauaauguuggcuaugaguuugucauagaugguuuugguuaccuugagguaugucccaucugugccgauuuugccgaggguuuucauuauaaagggaugcuggauuuugucaaaugauuuuucugcauuuuuugagaugaugauaugauuauuguuuucaauucuguuugugugauguaucauauuuaucaacuugaguagguuaaaccaucccugcaucccugguaugaaacccacuugaucaugguguauuaucuuuuugauaugguguuggauucaguuagcuaauauuuuguuguggauuuuugcaucuauguucaucauggacauauauauauauauauauauauauauauauauauauauauauauuuuuuuuuuuuuuuuuuuuuuuuuuuuuuuuuugauacggagucuugcucugucacccaggcuggagcgcaguggcaugaucucagcucacugcaaccuccaccugucggguucaagugauucuccugccucagccuccugaguagcugggauuacaggcacaugccaccaugccuagcuaauuuuuuuuuuuuaagauggagucuugcucuguugcccaggcuagagugcaguggcacgaucucagcucacugccagcucugccucccggguucacaccauucuccugccucagccucccaaguagcugggacuacaggcgcccaccagcacgccuggcuaauuuuuugcauuuuuaauagagacaggguuucacuguguuagccaggauggucuucaucuccugaccucaagaucugcccaccccagccuccuaaagugcugggauuacaggcguaagccaccgcgccuggccacucccagcuaauuuuuguauucuuaguagugaugggguuucaccauguuggccaggcuggucucgaacucuugaccucgugaucugcccaccuuggccucccaaagugcugggauugcaggugugagccacugcacccggcaucaucauggauauuggucuguaguuuucuuuuuuuguuauguccuuuccugguuuuaguauuaggaugauacugacuucauagaauauguggauuuuugcaucuguguucaucauggauauugcucuguaguuuucuuuuuuuguuauguccuuuccugcuuuuaguauuagggugauacugacuucacagaaugauuuagggaagauucccuauuucuuuauguuugaaacaguuucauuaagauggguaccaauccuuuuuuaaugccugauagaauucagcugugaauccaucuggucuuggacuucuuuuuguuggcauuuuuuuaauuacuguuucaaucucacuacuuguuauuagucucuucagaguuucuguuuuuuuuccuagcuuaaucaggaggguuguauaucuccaggaauuuuccaucuccucuagauucucuaguuugugcacauaaaaguguucauaguagcccuaaaugaucuuuuguauuucugugguauaaguuguaaaaucucucauuucauuucuaauugagcuuauuuggaucuucuaucuucuuuucuugguuaaucucacuaauggucuaauaauuuuaucuuuuuaaagaacaagcuuuuuguuucauuugucuuuuguauuguuuuuuauuuauuuacuucaauuucauuuaauucuguucugaucuuuguuauuucuuuucuucugcuggguuuggguuuaguuuguucuuguuucucuaguuccuugaggugugaccuuagagugucuauuugugcucuuucagacuuguuuauguaggcauuuaaggcuauuaacuuuccuuuuagcaccacuuuugcuguauccuagaggguaugauaaauugugucacuaguuucauucaguucgaagaauuuuuaaauuuucaucuugauuucauuauugauccaaagaugauuccagaguagauuauucaauuuccauguauuuauauaguuuugaggguuccuuuuggaguuaauuucuaguuuuauuccacuguggucugagagaauacuugauaucauuuugcuuuucuuaaauuuguugagacuuguuuuguggccuaucauuugguuuaccuuggagaauguuccaugggcuaaugaaaagaauguauauucugcaguuguuggguagaauguucuguaaauaucuguuaagucuguuuguucuaggauauaguuuaaguucauugcauuguuuaggugcauuguuuuuuguuguuguuguugacuuucugucuugaugaccugucuagugguaucaguggaauauugaaguccuccacuauuauuguauuagcaucuauugcauuuauuaggucuaguaguaaucauuuuauaaauuugggagcuccaguguuaagugcauauauauuuaggauugugauauuuuacuguuggacugauccuuuaucacuauauaauaucccucuuugucuuucugaacuguuguugcuuuaaaguggguuuugucugauauaagacuagcuaccccuguucguuugugguauccauuugcauggaauaucuuuuuccaucccuuuaccuuaaguuuaugugaguccuugugcauuaggugagucucuugaagacagcagauacuugguugguagauuuuuauccuuucugccauuccguaucuuuaaguggcacauuuaggucauuuacauucaauguuaguauugaaauacgagauacuguuuuguucauccuacuaguuggugccugaauuaccuugguuuuuuuuuucauuguguuauuguuuuauaggcccugugagauuuaugcuuuaagaugguucaauuuugguguguuuugagguuuuauuucaagauuuagaauuccuuuuagcauuucuuagugaugguuugguacuggugaauucucucagcauuuuuuuuuuuuuuuuuuuuuuugucugcaaaagacuuuaucuguccuucauucaugaagcuuaguuuugcuggauacaaaauuauuggcuggcaauuauuuuguuugaggaggcuaaaaauaugaccccaguuccuucuggcuuguaggguuucugcugagaaaucugcuguuaaucugauagguuuuccuuuauagcuuaccugauacuuuuacuuugcagcucuuaagauucuuuccaucaucuugacauuagauaaccugaugaccgugugccuagguggagaucuuuuugcagugaauuucacagguauucuuugagcuucuuguauuugaaugucuagaucacuagugagucuagggaaauuuuccucaauuguucccuuaaauaaguuuucuagacuuuuagauucaucuucuuccuuaugaacaccaauuauucuuugguuuggccguuuaacauaaucccagacuucuuggaggcuuuguucaauuuuauuaaauucuuuuuucuuugucuuugucugauugggcuaauuugaaagccuugucuucaaguucugaaggucucucuucuacuuguucuagucuauuguugacacuuuccagugcauuuuguauuucuauaagugugucuuucauuuccagaaauugugauuguuuuucuuuauaucuauuucucuggagaauuuuucauccauauucuguauuguuucuuagauuucuuuaaguugguuuuuaccuuucucugguaucuccaugaguagcuuaaucaaccuucugaauucuucaucuggcaauucaaagauuucuucuugguuuaacugcauugcuggcaagcuaguguggccuuuuggggauguuaucaaaccuuguuuugucauauuuccagaaucgcuuuucugauuccuucugauuuggguaaacuauuucaguggaaaagcccggaacucaagguucagauucuuuugucccacagggugaccccuugaugugguguccucccccucccccaagggaugggccuuccugagagcuggacugcaaugaucauuauuguucuugcacaucuagccacucaguagggcuaccagacucggggcuggugcugggaaauuucugcaaagagugcugugaugugauucaucuucacgucucccagccguggauaccagcaccuccucugguagaggacguaggggaguaaaguacacucugugagaguccuuggucauagauauguuuaguguccuggcuuaaucaaauacugauuaugcuagcagugauauuuucacauggacagacuuaguaccucugguuagccagaauguugcaggcaguggaauuagcugcuguuuucuucuuccuuggugcaggguuauucuaucauuucuaucaugaguuacuguaauguucggaguugguuggccuccagccaagggguggcacuuucaagacggcacaagcuaugauaguagacaggggaauguaagcuugcccuaaguuggccaggauaaguauuuggguuuaucgggugaugugcagggccaucaagcucucaauaguuuguguguuuugugaucagcuaccagggcagggaaaaaaauaccaucagguuggggcagaguuaggugggucugagcucagacucuccuuguguagggcuugccguggccacugugggguacgcaggaugguucuugggccaguggaguuauguuccagaggugauuuuggcugccucuguugccaaggaaguuggggaaagccugugugauaggccuuaccuagcucccacacaguuggcaaggccaaucuugcucccaccaugcccugcuaacagcgccagugucuccaggcagccagugcaggguggugguuggggguggcgggcagaucagaccuugcccgugcuauaaacuuccccacugacaaagcaaguauggcuuucacgucucaccugccccuuccugucugcccacacugucaguaguggcuucugugcuccuuucuguagcauuucccauucaccacccagauuccgcucaaaagaguuugugcccaguugaaauuauuacagaguucaguuggaagcuucuuucacccugugaccacucccaaauucugccagccaccuuucccgagggccccugugagauauagucagggauggcuucccugggcucgagcuggagaaugggaaugccuccaaggcucuucccacugcuccuucuacuuuuauauuuugcgcuaaauuuguuccagcucuagguaagguuaaauccuucucccguaaucuggauuuucagguuccccaauggggguauuuguugagaggcaggauuucccccuccacacuuugggaacucacaguuuuuuaccuaucuuguggaauuugcaguggcaugccacuuuuuucaaaguaucuguaaauucuuuugguuuucccaguauguuccugcaguggcucuuggagcaaaagucaacagugugagucuccacacguugcucuguccauccaaguuggagcugcacguuagcccugucuccuaucugccaucuuccucuccacaucuauugugaguuuuuugaaggaagaugcauuaucuuauugauccuauuuuuacucacaccaugacauauguuucugaauuuaucugauguaugccaccaaauaauaauccacauggaagauauuuacaaaauaaaaagaccuuuuugcugaaugcagugucuggaugggacgccucuugaaaauucuaaaacaaauauuuuuagggggaauucugggaggacugucaaaacuugaagugcauuuacgcuuugacccagaaauuucacuucuagcaauuuauucuauaagaaaugauuguacaaaugcacagaaguguuuauacaaaaguauuuauuauagcaagaaagaaagaaagaaaaaaggauguuuagaaaaaggauguaaccuuuuuuagucuguuuacuaaauucuaauacauuuguauaaugaaauacuaguaaauacuaugcaguuacaacaaaacauaagcugaacuggaaacuuauugacguuuuguuauaugaaaaagaagcuacagaacagucuauagcauauguuuucauuuguguaaagaauaaaacaugugcacauucauguauaugugcagauauucaccaaauugcuuaugguaaugaccucuugggcggaggcagauuccagcagauugagggagcagagacaaagacugaccuucaucuaucuuuguguccuucugagguguuugaauuauuuacaauuaguauuacuuuuacaauuaucaugcccauuuaaaacaacugaggcugggcacaguggcuuaugucuguaauccugacacuuugggagaccgaggcaggaggauugcuugaggccaggagucuuagaccacccugggcaacauagagagacccugucucuacaaaauaaauaaguaaauaaaacaccugaaacacuaaagauuuacccuuagcucucuuccauaacaccaaccuuuucaaaaauaugcuacaucacaauuuuuaagaaugucuugagcucagaacaugucuauucuauacuaucaagcugaucuuuuaaguagcacauaguagaauuaaagccuaaguagauuuuguuauucuaacuguuuuaucaacauuuucagcaaugucuucaaugaucagaaaucaagaaaagaggauacagaaaguaaaagaccaggaaaaaauguuacuaaaaugacucguugcuugccuauucuuuacagaggaaugaggcccaauuaauugugguguuacucguaauuagugcccuguguacuuuuucuuuuuaugugaaaauuuaauaaaagauacccugucuuguaaacucua

SEQ ID NO: 191486 - RNA, 27949 nt, Homo sapiens
uuggucuuuaugugcuuaaauaacgcugaauuauaauuagccacacaaauaaugagaguuuuauuuuuuuuuucuggcucacuccaaaucagccuguuaagguauauuuccuucuacagccuuuccugauuuugcauguucucauucccaaaguagucuaccuuaguuuacacucaaagguagcacuuguugaaacuacaugacagaaacaggcugcaaagguggacaaggggaagcaugucccucuugucuugauaaaucagugccacacacagaacccacauuuucugagacauuaucuucauuauagagccguuugauuccaucauagaagucauccacuuccauuuccucuacuuugcguuuaguagaggucugcuugcacccacuggcagcugggagaugaugguaaaaggcugcuguaccucugacuggcacuucuggcuugcuguuguccuuggagaagucugggccugggacagaggagggauguaaucugaacacuccuuugucacaggucaccagggugugcuugaggggacgguagacauaaacggaauucagaggcagggaagacugcagaguagaaaggugaugugccacaagcucccgacaauggaucaacugggagcuauccaucugggccaggaaaaaaaaaaagccacacacaguugaucauuaauuaacauaggcugcucuguuaucucugguggccauuuuuccucccugugcuuuccguccccgcugagucuuuucucuccccacaucuaccuccaacucauuuauuuauccagcuacccauccaucaacaucaucuuagaaauuagguccaaaucuguauuucuaauauaauuaucuuuggaacuugaguuuuguauuugcaauguaugcugaacauuuacaugagaacagaaacuacuuuuuuguauccaacgucuguuuuuuuuuuuuuuuuuuuuuuuuuucagucuauucccccugucuggaaggcccuucauccuacucucuuggccucuucuaauuuuuuucaguggaguccaaaguacucauaaacacauucauuaaaaauguaagaagccaaagggcaaaaaaaaaauuuuuuuuaaucagggaugaggagggaagcuaagaauuuuaaaauaguaaaugaaaaauuuagaaauauguauuuuguagaaaauaguagacuuagcacuaagaugaaauguuuuugguaaaguuuuuaauuugggaguuuugcugauuccuucuuacccuucaggacaauucacagauaucaauccuuucuggaguuaccccugacucccucaacaccccaaaacucuaaaugccacggucaucuguuucuauaucaaccuuuuaacauauuuauggccaggcgugguggcucaugccuguaauccuagcacuuugggaggccaaggcagguggaucgcuugaagccagaaguucagaccagccuggccaacauggcgaaaccccuucucuacuaaaaauacaaaacauuagcaggacaugguggcagaugccuguaaucccagcuacucaggaggcugaggcaugagaauagcuugagcccaggagguggagguugcagugaggugagaucaaaccacugcauuccagccaggccaacagacagagcaagacucugucuuaaaaaaaaaaaaaaaagacacuaaaaccuuucaacguauuuaccacauuucaguauaauaaucuauuuaaccauuuagccuuuccauuauagacuacaagaccaaagguguggcauuguauuauauucaucuuuuuaucccuaaguuucuggcacaaugacuguacauggaaggccuuuaaauuauuaccuguaguaaagugucucucuuccucacuuucaauuacagcauugucaaaauaaccuuaguuagcaucauauauuccuucccugcucucuccagcggcaccccaaugccuaccagaaauaagcuaaacugcuuaguuuaguauuaauaagaaucuccauaaucugaucucaaccuucuuuucuagccuuauuuccuagcauacccucaacuuguggucuacacucuugcucaacaguccugcucuauaugaugcacuaaucuuccccuuucuuauuuuacccuuaaucaucuuauuucuaccuguugaaauuguauugcgcauuccuuccaggacuggcuaaacaccaucaccuucaggaagccuaucuugaccauuuaacuaucagggaucacuuuuuuccaguuuugaguauucuggacauuucuguaccaagucuuacuuauccucauauaaccugcagcacucaccaugacuguuugcaauaccacagagaaaauaggggaaaauaacgcacucuacaagaacacauuuggucacaaaauuauuuuuaucucuaaauacauucacuauuuguuacugaaaaauaccagaggaaagaaugguaaaaggcugauguuagucauuguauaauacaaaugcaaaguaacugaaacugucagaaauauacaagaaaauggcagauuuuagcaucuaccauaauguucacugauuuuuuuccccuaguuugaaaggcauuagauaacacacuguggguaagacacuauuaacuaguauuagaauuuguucucccucccuuaaaagaaaaaaaguuaacauaacacuuaagauagucccugaacuaucaagcuuacauuuaggcuaggucuuauuauauaucccagggauguagaacaagcugaaacaugcuaaaaacauuggaacaaagcacagagaaaggauggagcuucugccaauauuuuaggaagccuaaaaaaaaaaaaaugaaagaaacugggaguaaaaaaggggcuauaguguagaaauuauuucuaaaaaauaaguacagucaucccacaguauccaugggggauuaguucuaggaucccccaaaagauaacaaaacccaacaugcucaagucucuuauauaaaauaauguaguauuugcauauaacccacucgcauuguccuguauacuuuaaaucaucccuagauuacuuauaauaccuaacagaaugccuacacaucacuucaucuguguagauucaauguaguacucagcaugccacaaauuccagguuuuuuuggaacucugugaaauuucuuccugaauauuuucaauucacgguugguugaauccagaugccaaacccauggauauggagagccaacuguaccucguuuaaugaaauguucuuuagcaaaugaaugauauuuauuggccuaaaaagguaaagguaccacaaauauucuaaugccuuggucacugggcauaauaaaugccauggcagaaucaauacuauggcagaauccuaaaaagacauguauuuaaguaagaggaagacuaugucacuauaaucuuucugugugaaaaaacgaaguaaauagaguuauauuuuagcggugggagacugacaagaaaugauagagcuaaaagaccuuagaaauuauucaaaacaaaaccauccauaugaacuccacuuccacccaagucccaaguaagucuuuucuccaaaauaacaucaaaauaaauuccuucuaaucuaguacaaucugaauuuguucuauaagacaccaaaauaauuuguuccuucuugagauccaguggaagaaacaaaacaagcacauauacuggaacuaccaaaacucucgacaccagacaaguacucuaauggaguugauaaaaaggacuuaaaugaacucuaauuauaaggugucaagagaauauguauuauuuuuuauaacaauaaaugacauaaaugguagguccagauggauccagguuugaugaacagcaugaagcacugaggaaccugcuggaauagucugaccacagccaccuucaaaaagaaccaggagacugguggggaggggucuguuuuuuuguuuuuuuuuuuuuaaauuugcuucuuuuuacuuuuagaugguacaugugcagguuuauuaacuagauauauauugcaugaugcugagguuuggaguacaagugauccugucaaccagguagugagcacaguacccaacaguuuuucaacccuugcuccccucccucccucccccuucuaguaguccccaguuucuacuguugccaucuuuauguccgcguguacccaacguuuagcucccacuugugagaacgugugguauuugguuuucuguuccugcguuaauucacucaggauaauggccuccagcugcauccauguugcugcaaaggacaugauuuuguucuguuuuauggcugcaccuacucuaguuuuaaacuagaacauguacuuugacuacugcccagcuaggaacuacaaagaccaccacacuaaucuagguagaguuaacagccugaguuuauaaggcuaaggagagaaagagguuuagccaucccagaauggugaccaacagguggcgcaagagcuuaaggggguguagugggagguuaacagggacaaaaggaagauugccuuucaaaccugggaacacucaccauacuuugucucaaagugggggcucaggcagaacuagugagaguggccuccucacagcacgguaugucugugauggacucuccucaaaccaagacacugggaaucaugucgcaaauaauuuuggcaugaucucaucaaucugaugcaagacuuuccuauauuaaaaccagaaaacuaggaagaaaucugauauuguggccuugucacacgucuaaacacaaagauauuagaccugguguucccuaccugaacacagcaaacuuagcaaaaacagaaaugaguccuaaagaacuaggagccauccauguuuggaccacauggguugguguuagagaacugcuagaacaagucccaaaagucucuaccaagauuuaugaccuuccuuuucuucacuaacuuccccacugcaauuauauacuacauggggcauaucucuuaaaaagaaaaaaaauucacuguauuuccaguuuucaaacuacguccaaagacuaccuacauaauauaaucuaaaccuacacuacauagguagauuucuagcuauggaagggaaaacgcuauguugaguggagaucugcccuuaaacacaaguauagcuccguucuucuauucuauauucugggauuguguguguacaagauuuucuuuggggaagggggacugggaaaggguuccacuucuaaaacaaauuaugaaaaccacugaacuagaauuuuuaagguuugugugguaugaaaaaaagcauugguucuuuuaaaucacuacuaaguagcucuacacggcucuaagaaagucuccaguucccuacaccagagcuauaaaauaaaggaggugaaugaaauaacuucuccaaagauucugucaaaucccagguuugcaauacuccuucagcuaagaagaaaaaaaaguuucagugaauacucucuuccucuagcaccagaaaacuuacaaaagaguaucagauuuuccaguguuuuucacuaggaaaacaugaucucaaagcuacagaauacacaugcuauuuacaacauuauuauuuaugcuucaaaaucuguccucugacacuaacacuuuaaagcaaucuuuuucuguacuaucuugagaguaagcacagagaauaagucagaaggcauuuagagagaugucauuuguuccaauaaaaauaauguaauguaggagguuuucuauuaagccuauuccucuacuucacagucuaaugugagugauuaauauucaacuuuucuuucuaacacuccagggugagcaaaguaaauuuucugugucauauuauucauuuaaauggugguuuaucauaauuucuaaaaauucuaaguagcaacuaccuccuaggauuuauucucauuacagcauuuaauuauuuuaaucuaagacaauuaagauaucccuucaaaacaaaaaacagcccauguuacacuacauagguagaucucuagcuaacauacugcucugaucaucaaccuuuuuaugaaaagacugagcuccccucugcucacaaacuagagccuaaaauucuuggaagcacugacauacuuguuuaaaaaaaaaauuauuuuuuugccugguucauuuucuucagacauacuucuuaaaauguuugcuauaagaucaauuauaacuuucuuagaaaaacaccaaauucaacuauuauguuuuucuuuuauaauaaucuaaauuuuuagcucaauaacugcaguucuuugcuacaauuaguuuauugcaaaauguuaagcuuagaauuucacaaucuucuaaguaaaauccaauaaaacaaaucagaauaacuacuguuaaauaagaauaaauagccauauaaagggaaaguagguucaugagucuuuuauggauucagguggcaggaaaauggucugcagcagaucuaaacucgguaaguucuauuuggugacaugaauagaaccaguaagccuucucucaaaguaguugcuaacauacagcacucucaccaacuuuccauuugaaugagaauuuucuccacugaaccuuuacauuuuacuuagguaguugauaauuuaucaaccuauacauuuuauaauaaucuguagauacaaguuacaaacuaaucuuagguaauaauggaacugccagggaaaaaccucuuucagaaaaguggcuucuaccugccaguuugguauaaauacuucacuuacuagccaacaauaaauuauuugcuugucuaaaaagcaacuuauucuaauuuuuguuccugacauccguuauaaaaugagugaaguaaagaaguacuacauuaaaaccuacagauguagcuaggaaguuucuuuacaaaaaacuaaaggacaauaugguauugacaaucuuaugaacauuuuagaauucuuaaaaauaagagaaaugguuaaaaggaaucuuaaaaauacuauauaaguuuuauaugaaaaaaagagaucaccuagcccguaaauuuaaaauauauacuuuacucuugucuacucuuaagaaugguuugccauuacaacaugagaaaugucuuuuaguuugguaacucuauguauuccaauaauagaaaaacuuaaaaagaacacuauuuaauuagacugacaccuaccugugcuuucugaagcaguucaauuguaagagaaagccaaucaggaaugaguuucuccauuuccagacuaaccauggccagagcaagcauggauccucugaauugcagaaguugguugcaggccauacagugaaguaguugcuugguaaggacugccaaauguugagaugggcucaauuugggcaaacugaaaaguaacugaggccuaguugacacugcaauggcauggaacugaaaaucacaagaacaucauuuuaacuuuauuuaaauaucugggaaauuacauauagaaauugaugcaaccuauucaauuucuuuuuuuuuuuuuuuugagacagagucucacucuguugcccaggcuggagugcaguagcaugaucucaacucacugcaacauccgccuccuggauucaagcaauucuccugccugccucagcauccugaguagcugcgauuacaggcgccugccaccaugcccggcuaauuuuuguauuuuuaguagagacaggguuucaccauguuggccaggcuggucucaaauuccugaccucaagugauccgccugccucagccucucaaagugcugggauuacaggcgugagccaccgcgcccagccuaaccuauucaauuucuaagucugcgaauuaagcuucagugauaugacauauauacuaauuuauaauuuuuccuuggauaucaaguuuucuuuuuccuauuuccaguacaaaauaaaugaguaggcaaucuauuuuuuaauuuacugaaaacuacacacucaaauaagaaacuaaaagacuucagguauauuuacaauaugaagaaaauccaaugguguggcugugugaagaucccaauucaacuuauccagaauaauucucuccauucucaaaauuucagaugaggaacauccacagaaacugucucuugccaauaccuuuaguacuggaauucucuauccaaagcaaaggggaacagggacagggagaaaaggacagaaaagaaacucauuuaugauuuuuguuuuagcaaacgaagcaaguuaauaaauguggagagaaauuuucacggaagaaacauuaucuugaaaggauuuauuaccucaucuuccucaacagucuuggcagcuaggaaaaaacagcugauugcaauacaacucaaguauuuuggaugagccuaaaauuuugaagagggaaaaagcaacuuuagugauuuuucaaaaacaauuuaacuuuuuguaacuguuuuaaaaaccuagauaugcagaugagacagguauacacaaaauacuauggaauucaauuaaugugacugccacucauuacuuuuuagaucagagcuaacuuuaagaacaggaaagaaaguuuauuaaaaagcuuuagagcaguaaugaaaggaaggaaaguacacuugcaagaucaagugugucuagagcuaacuuuuuuuuuuuuuuuuuuuuugagacggagucuuggccugucgcccaggcugcagugcaguggcacgaugucagcucagugcaagcuccgccuccuggguucaugccauucuccugccucagccucccaaguagcugcuacuacaacgcccgccaccacgcccagcuaauuuuuuuuuguauuuuuaguagagacggggguuucacuguguuagccaggauggucucaucuccugaccucgugaucugcccgccucggccucccaaagugcugggauuacaggcgucagccaccgugcccggccugagagcuaacuguuagcauuacaauccuagccauaugauauucuacaaaaauaauaucaauuccauugcucaaaguucaaccaaagccaauuaaccaaaguucauuucuauccagcagaaaaaaagcuugauuuagaaguuuuuaauaaauaauauucccaaaauuaaaaaauuuuuuguguauguaaacauuuuuuaaagcuaauugcuugcaaucugggauaucugaaaaaugccuacuuuuaucucagcaacaaguccacaucacuccucccucccucucuacuacaucuaaccuacuuuucacagauaauuccacagaaagaugaguuuaaaguuaguguccuuucuuggacaguacauuuuucaaaaauuauuagugaacacauuguuguaguuucuaucaugaguuucuugcuguguuuauuaaacauuugaaacaaaguuggagaaauuuguggaacaauuagagaauuuugccaaauaucucauuuuuucauauuucuuauuuauuggguccugucauguuuaguaagugucuuaagaguagaaguuugagcagcuauucagucuuacacuccguaauuauuuggcuucuauucuguauaccuaauaaagcauuuaauugacaguucccccaguuuacauauucuuuugcauacuaaugccuacaaguuuaaauacuaugcuacuuuuucaugccuugccauuaaauaaaugcucauuuucugcuuuaaauauguugagggccuauuuacuaacuugacacagccaaugacauggcaauggggacaauauaaaaccuaauuauuuguaugcugucauucaacaaaaauauaccaaaguugcuuuaugacaucuuguuauauaccaaaguaagcccguagaaagcacuuuguuuuucagaaagccacacaguauggauauucaauaaguagugacagagaaaaacgugcaauaggcuuauacuuuauucuagucugauuccuuguccaccucuguacaccaauauguuagaaaaugacuaaguauucugcugaugcuauacgguuugugcuaaaaucaagagauaaaaaauuucauaggcuaaaaaguuaugaauacuuguaacaaaaagaaaauuacagaauacuauuagaaacacuuccaaaaacacuucugcuuuuuaaacaauaguagaaagccgggagugguggcucaugccuguaaucccagcacuuugggaggccaaggcaggcugaugacuugacgucgggaguucaagaccagccuggccaacacggcaaaacccugucucuacuaaaaauacaaaaauuagacuggcaugguggcacgugucugcagucccaacuacuugggaggcugaggcacaaaaauugcuugaacccaggaggcagacacacuccagccagggcaacagagcaaaacuaucaaaaaauaaaaauaaaauaaacaauagcagaagacaucaccaugucuucuuauggguacauacaucauucuccagcaaaguucuccacuucuuucuaccuuacagaauguucacuaauagccucuaguuuagcauacauacacucaaaugagguuauauguaagucuaucuuaaaacacuuaccuuuacgguagcuaaaaaccuauccaaaagacugcuagccagagcaaauguuucuggguaaagguugaauugguacuugaguuuggccagccauugaauuacuucaucucucugggauggagaaacauucuauaagggaacaauuuugaaaacagaagacaaaguuugagcuaucaucaagaguauguuuagaauucucucucauaaaagguuagguaauacuacaaaauauauuuaaaaauguuaagguuauucaaaaucuaucagacuugagacacaugaaauaaaacuuuauguauuaucacauuuaauaucaauauccaauauucuccuacucuuuauuaaaauuuucacuaugucaucucaccaaauauccauaguugaauuaaauuuaggugcucagagaauauaacauuuuaaaguuuaaguaacacuauuaucaacugauaguaauuuggaguuaaguuaccccaccucuuaagauuaagaaaauacagugaauuucucccgcagcaaguagccauuaacuuaucuuaggaaauauaaaugaacuaugauaauggaaaugauagcccauuugaaaaacuaaaaucaauaguaauaaguaaaagauaccagggacaacagaugaauuauacacuuagagaugaugaaaaaauauugaacaggaaauuaaucugaaguaaauuacuauuuugaaaaauuuccacaaacacaaaacauuauuguuuuauuguuguuguaagccuauugaguauaagcuuaauuuuuagcagggacacacuuuaaaguaauagugauuagaaaacuuuuacucuugaguuuuggagucgccauuaaaaaaauaaaaccgguuguuuauuuugggaacauucaguauucuccuuacagcucuuucaaacuguaguuucaaacaguuugaaagagcuguaaggagaauacucaaauaauauguaggaagauuaaaacaacaauguuuuguguuuguggaaagcuuucaaaauagucauuuacuucagguugauuuccuguucaauauuuuuuuucaucaucucuaaauguauaauucaucuguugccccugguaacuuucacuuauuaauauugauuucaguuuuuuaaaugggcuaucauucuguuaucauaguucauuuguauuuccuaaguuaaccauaguaagccuacaaugguauggaacacuagaaguuauuccucauaucuagcuguaauucuguauccaggcuacuuuaagaucuaguucuggacuaaggauccauaaaaaucccugagaaccaaguaaagccaaucacaagacuucuggaugaagaguuaagcauucaagagaaauuaaauuccuaucaagaugagcuuuuauccaaaaugccacaacaaauaaggaaaaguaauguuaacuaagccagccaaacacaucaacaaggaaauaaauucccaggagagguaggugauguuauaaucugaugaaacugggaaggcuuuuagggagaugaaaggaacgaugacuuacaguagcuaugaaaacaagaacaccauuaacucuaaccuucaguuagagauacaaugugggguaugggagaaaaaaaaaaaucccugaaugacagauuacauuaaauaaugucacuauuugguguuuggcauuaaacaauaacagaaacauacaauuguaagaagaaucacaaagguaacauacaaaaaaagagaauacaguuauauggagauuaucauauaguuauaacuaaaugacauaacuaauguaaagcauauauauggaaugcaaacguacucaaauauuaguucuccuuucccaccucuaaacuacccaauucucuaauaaugucagaaaaacaaauuuacaaaacauuaucuaugaaguuauuuuaaacacuguuaacaauuagucaugaaagaaaucaugacaauaucuuugaacuuuaauauuccauauacuuuuugagacagggucuugcucugucacccaggcuggaguacaguggcacaaccauggcacacugcagccucgaccucccagccccaagugauccucccaccucagcauccugaaguagcuaggaccagagguacgugccaccaggcccggcuaauuuuuuuuuuuuuuuugagauggagucucgcucugucacccaggcuggagugcagugguucaaucucaguucacugcagccuccgccuccuagguucaagcaauucucccugccucagccucccaaguagcugggauuacaggcuugugccaucacgccuggcuaauuuuuguauuuuuaguagagaugggguuucgccauguuggccaggcuggucucaaaucccugaccucaagugaucuacccaucucagccucccaaagugcugggauuacagacgugagccacugcgcccggccuaauuuuacuuuuuuguagagacgaggucucacuauguuacccaggcuggucuucaacucccaggcucaaguaauccucccaccucggccucccaaaguguugggauuacagguguaagccacuauguuuggcccauauaccagauaguaaaauuuaacaacagggccaagaaaagcauuccugcauagccaauguuaucaucacuagccaaaaccagcaauaauuuuuuuaaaauccaaaagauaacaguuuaagaagacucaauuuaacugaaguaauacugagucuaaggucacuuuuucaaaucaauucaaauauguacuaaacaguaauaucaucaugacagcauuacaaauaguaaguucugcgccuaauucauuucauuccuauuccucuaaaauaaagaaugagagagaaaaagaaaaagcccaaaacaguauuuccugauuccaucaggugaacuguuucucauauggacugcuuaaauaggauuagaaggauucaguaguugaacaaauaauccuaaagagaauuuauaauggauugaucaaacaugguaaaauauagacugcuauuaauauauauucuguauauauauuauauuccacaugcugcuagucuucuccuuaaaauauacaaccuccccagcuuuaaacucuaaaagguucaccauuaccuaaaagauuaaguacaauuccccagcauggcauacaaaucuaugaccuaccucuucuuuguuguuguuguuuuuguuuuuuguuuuugagacagucuugcucugucacccaggcuggagugcaguggcgcaaucuuggcuaacugcaagcuccgccucccagguucacaccauucuccugccucagccuccuggguagcugggacuacaggcacccgccaccacacccagcuaauuuuuuguauuuuuaguagagacgggguuucaccauguuagccaggauagucucgaucuccugaccuugugauccacccgccucggccucccaaaguguugagauuacaggugcaagccaccaugcccggcuaugaccuaccucucuaaccucggacaucuuccaucacuuucugucuuaaacuucaugcuguaauaguaacuucuacugaugauccuuccuugccccugguauuuuacguuacugcuccuuuguucauauugcuccuacugacuggaacgcacucccuucucucucaccugccuuauuauguaucucuugagagcuauuuugauguuacuccccgccagauacuuuuccugauaauucaaguugggcugaguaccuuccuauguucccacagcaucucauuacaccuguuaaacguucaacauuuuuuuaaaaauuaaauuucugggcauggcucacaauuguaaucccaguacuguagggggccaaggcaggaaaacugcuugagcccaggaguuugaaacuagccuggguaacacagugagacuucaucuccacaaauaaaaaaauuaggcaugguggugcgugccuguuaccucagcuacuugggaggcugaggugggaggaucacuugagccugggaaauagaggcuguagugaacugugauggagccacugcaccccagccugggcaacagagcaagacccugucucagaaaaaaaaaaaaaauuaaauuuuuccuuuuggcuuugaugaaguaggaagcagcaaaucuaaacuccaguugagaaugacuagaaaagcuguuaacaaccucuuuuuaagauuccuuagaguucuaaaauucuacugaaaaucaucuguauaucaacaauuuguggcaggguuuuaucuuuguaaaucaaaagcacuuuggcaaaauaaauugagaacaucugaaaguaugugccacuuugaccaguuucaauguuuuccccaaauucauguaacaaaauuaucaugaacuugaaaguacuauuacauaauauaaaagaaguucucugcaagugccaagaacacaguaagguaccugaaugaaucauaaagaaaugauaaucaccauucacuuaaaugcuuacuuugagucuauuauaugcaaguaaacaaaaaugacaccaccauaccccucagggaaacucacagucaaaucaccagaaaauuauaauacuuugugcugucauaagggaagcagaguguggcagaaacacauagaaggugagugacagcugcauaauauucuugccugaccacacuguccuaaauuuggggauaggggaugcaaauuaaacaagaauuaugugagagacugacuucaaaauauaguuggggcaggggggaaguuagaaggaaacuggaggaaaaaggcauaagagaaagcuuaaaaauaucuuacuuuuccauuuuuaccaacacuucaaaaccaaauuagaaaagucagagcaacaguggaaagggagguaaaaaaaaaaaaaaaaaaaaaaaaagccagucccuuagaggaaaauaagaguuagaacuagaauagagaaggugcugggugcgguggcucaugccuguaaucccagcacuuuggaaggccggaucacaaggucaggagaucgagaccauccuggcuaacacagugaaaccccgucucuacuaaaaaauacaaaaaauuagccgggcguuguggcgggcgccuguagucccagcuaauggggaggcugaggcaggagaauagcgugaacccgggaggcggagcuugcagugagccaagaucgcgccagugcacuccagccugggcagcagagcaagacucugucuccaaaaaaaaaaaaaaauagaauagagaagugucccuggggguuacccuggcaagcaacucaagccccuauagccuuuuaccccuauucuuaacuccuauccccaccagaccaaggccacccaaauuuuacaaguauuaaauauggcuucuacuuggcauuacuaaaggcaaauccuuaagaaguggaucucucucagaaguucugauacuauucuguucucugguauuaccacaccaguauucauuaaaucaccuacagaaauaggccagauuugggugugguugcucacgccuguaaucccagcacuuuggguugcuggggcaggaagaucaucugaggugaggaguucgagaccagcucggccaacauggugaaacccugucccuacuaaaaauacaaaaauuagccagguaugguggcgggugccuguuaauuccagcuacuugggaagcugaggcaagagaaucacuugagcccgggaggccgagguuacagugagccgagaucaugccauugcacuccagccugggcaaaaagagaaaaaaacuccuucucaaaaaaaaaaaagaaauaggucagauuauuugguaauauagcaauauacuacaaucuagguagaauaucaccuucaaagaccaggcuguaaaaauauauuauuguugguuacaugcugacuuaaggagauagcaggaggaggaaaggaaugguccuacaagcagcuauaaaaaaguuuugaggcucacuagaaugucacaacauaagggcaggaauuuauuuucuccuguuguauccccaauaccuagaauagugccuagaguauagcagauacucagcagacauuugcuaaaugacuugaauucccaacuaaucuaaaaaucacacaugcgcgcgcgcgcacacacacacacacacacacacacacacacacacacaaaauaucacaggaagaggacuaccuuaggaaaaggaucgaauuauaauuuuuuuucuuuuuuuuuuuuuugagacggagucucacuuacccugucguucaggcuggagugcagugacgugaucucggcucacugcaaccucugccuccuggguucaagcaauucucauaccucagccucccaaguagcugggucacaggaaugacucaccacacccagcuaauuuuuguauuuuuaguagagaugggguuucgccauguugaccauggcuggucucgaacgccugaccucaggugaucugcccaccucagccucccaaagugcugggacuacaggcgugagccacugcguccagcccaaauuaucauucuauuacuuauuaaagucuugagcaaauugggacuacugaguacuuuuucaaagaauuaaaugagauauuaaaugagauagcauauauauaaacacuccucauucaaguuaacuaaucaguuugcaaaaugacaaguaacaguaaaugaagaauguauuucuuuagcuugugggaaagaauaaguaggaaaaauuagaauugaauuaaaaaggcauauauacuuucaaaaccaauaagcaaaggauagccuaaaacaacacacgaggaacuuacauauuugccauucauucacucaugcauauuaaaagaacauuugaccacuauucuauuuuccaagcaccauguuagauauuaaggauaaaagacauauaagacaucuuauacaauaaacuuuuggaguggauaaaguucacaguuauuugugaaaaauaauuauauaugacagaaguauaaaaauuucuaaaagaaaaacuaugcagcuaacaguaguuaagagaccagcuggcuaucuucuaaaaagcuuccaacauugguauuaccuuaguaauucacaugaacuccuuaccgcuaaugaugaaagaguagguuuuuaguugacuaaagacaaugguaugaagauguucagccucuguggcuaacuauaaacuauauaucuaaagaagguuacuacuguuaguauagauuaugaugaaagaaaacaaaccuaacuauuuucccaaagcuguaacucagauaacaacaaaacaggucaacaaacaaaaacaguuaacucuuguuucagaaagaaaaggccacagcaggagcaggaguuuuuaaaaaagaagaggccgggcaugguggcucacgccuauaauccuaccacuuugggaggccaaggcugguggacugcuugagcucaggacuuccagacuaggcugggcaacauggugaaaccccaucucuaccaaaaauacaaaaaauuagccaggcaugguagcaugcgccuguagucccagcuacucaggaggcugaggugagaggauugcuugagcccgggaggcagggguugcagugagcugagaucaugccacagcacuccagacuggaugacagagugagacccuguuacacaaaaaagaaacagggagagucucucaaauacagcacauccuuaaaugguacacacuccuccaauguagugucaagauauuauuauguauggcaguaguauguuuauuucuaauaaaauucaucugucuuaagagaaaaaucauuaccugauuugaaggcauuuuccgcacauucacuuuccacaucugugcuucccuagugauugccuuuuccaacaggaaagacaaucucugguuuuccaaaggcccuggaaacuucaugauauccuuuggaucugccugcuacccagcuugcuguagcuaccuacagaaucaaguaaguuuuaaaauuaguuauagaauaaguguagcauuauauaaaguacuaauuaagcaacucauaaaacaaaauaagaaugcuaugaggcaguauaggauuuuauagcucuuuaaaauaucguauuaaaauaccaaaauaaucaguuaucuaaaacauucacacuugaaaucugaaauucaguuauaaagagaauaaaaacaaggccauguaauugauggaaccuuuggacucugaucaaaacauguuauuacuguuucaaauugucaaaacuuugucacuggcuuuuuuaccaggaauucuuagaaguaguuauuccaaacauuccucuuaaaaaccuaaucagauaaggaccacuaacauuuuuccuucauuaaaaagaaaauauauuacauuaaauccuacccauucccacuucuucaguaugaaaccauacccuccaguaugaaaucaucuuaaauugcgcuuccaauucaguauccauuagcuacacauguggauauuuaacuaugagcugaauaaaauuuaaaaauuggccaggcaugguggcucacgccuguaaucccaucacuuugggaggccgaggcggguggaucacuaggucaggaguuggagaccagccuggccaacauggugaaaccccaucacuacugaaaauacaaaaauuaacugggcaugguggugggcgccuguaaucccagcuacucgggaggcugaagcaggagaaucguuugaaccagggaggcagagguugcagugagcugagaucacaccauugcacuccagccugggcaacagggugacacuccgucucaaaaacaaacaaaccaaaaaaaaaaaauguauuucuucagucacaauagccuuacuucaauaaccagauguggcuaguggauacuauaucggacagugcacaaaaggaacauuccuauuaauacaguaaguucuacugaacagugcucaccuagaaagcuccacaguacauugacuagcacucuaaaaugagcagcaugucuaaauagcaaguuuagcagugcaagacaacauagaguccaagagaaaugucucuagguuuuauguuuauauguauuuggaaacaagagucccacucuguugcccagguuagaguacagugguguaguggcucacugcagccucgaacuccuggguucaggugauccuccugccucagccucccaaauagcugggacuacagaugcacaucaccaagcccagguaauuuugugggguuuuuuuuuuuuuuuguagagaugcaguuuugcuauguugcccagccucacgcaguccuccuggcuuggccucccaaagcacugggguuacaggugugagccaccgugcaggcuucuagguuuaaaaaaaaaaaaaaaaaaaaaaaaaaaaagaagcaaacuacagacuugagguuugacuguguguagaaaauuggauuaagaaacugcuaaagaaugugaaaagguggcugggcacgguggcucacaccuguaauccuagcacuuugggagguggaggcgggcagaucacgaggucaguaguuccagaccagccugacaaaacauggugagacccccgucucuacuaaaaauacaaaacuuagccaggcaugguggcaggcaccuguaaucccaguuacuuggaagccugaggcaggaaaaucgcuuuaacccaggagacagagggugcaaugagccaagauugcaccacugcacuccagccuggcgacagagcaagacuccgucucaaaacaaacaaacaaacaaacaaaaaagaaugugaaaaggcuuagcuggauuuguugaaagguaagcaacuaaaaagguaauuaacuucagaaaaaagaauuuaagaaaguaauguaucacaauauuuauacagcaauaauaaugaaaagacuggauagggaucgcaauaugauaaaacuacauuggcaggauguggagacauaacuauggauauuggaagaggguaaaauaaaagccacgucuuuacauuucauaguaggaaauucauaaauaucucaaacugaaaugucaaaaaacagcagcagagcaaguuguuugaaaaugugaugcuaaauaacgggacaaggaggaaagaguugggaguaguuaaccucugcagaguaagaaaagggugagaaaggccuagcguaggagaaugcuguuuuucauuauaaauuucacuaacaauuugacuuucucaacuauguaccuguaaacuauguaucuguauuacacacuucagauucaugggcucuaagaauuuuuuuaaauauccagaauuaacauguaaaaaguuccaauuuuuuuaaaaauaaaaaauuuggaaaagcaaaaaauagcaaaccacuucuuuaauuuccacauucuaucccaacuccagcuacuauccuccuuccuauguaccacuccacauaugcuaccuauuugcuucucaacuuacuagagacuaauucugguuaacucaauuaugauuuuguuaauuuuugugucuuuaaacgccugaguuuuugcaaaucuucuauaauuagcauaaaauaucuucauacuaagaugacaagggguaaauagagaggaaaaagaacuaauauuaauccaaaaagaccuaucucaaagguaauuucuucuaaaaacucuugauucuuuaaucaugucauaaagcagcuuucuguuaacuccccaacuacguuauaaauuccuggccaggcgcagcggcuccggccuguaauccuugcacuuucgaaggcugaggaggacagauugcuugagucaaggaguucgacgccagccugggcaauguggugaaacuccaucucuauaaaacauacaaaaauuaggcaggcgugguggcacgugccugugguccaagcuacuugggaggcugagguugcagugagccaaaaucaugccacugcacuccagccccagcaacagaaugagaccgugucuccaaauaaagaaaucccuaugcagucacaucugccaauaucauuuuuauauauauauauuuuuuuuauuauuauacuuuaaguucuaggguacaugugcacaaaguucagguuuguuacauauguauacaugugucauguuggugugcugcacccauuaacucaucauuuacauuagguauaucuccuaaugcuaucccuccccccuccccccaccccacaacaggccccggugugugauguuccccuuccuguguccaaguguccucauuuuuuuuauuacucacuguguccacagcacaguacuucgacggaacagagacccaaccaauuguuccaguuucaaccacuggugccccaaacaaaaacacacaaccaaaaacucuacccccaccuguaccaacccacugugugugggguuuugguaccuucuuuuuuuugauacauccuuguucacaacuuuaaccuaccaaaaucuaaucucuuucacaccaauccuuccaaucuuugaagggugcuaucaugcucaccaauucaucuuuuccauagcugaaaacuucgauagcuccucacgauauuuugccucuucuaaauuagcuuuaauuuuaccauaaauacagucuaaaaucaugggcuuuuuuuuuuuuuuuuugagacaagagucucacucuguugcccaggcuagaguguaguggcacgaucucggcucacugcaaccuccaccuccuggguucaagugauucuccucccuuagccuccugaguagcugggauuacaggcacacaccaccacacauggcuaauuuuuguauuuuuaguagaggcagguuuuaccauguuggccaggcuggucuugaacuccugaccucaagugaucugccugccuuggccucccaaagugcugggaguacuggcaugagccaccacucguggcccucauuagcuuuuuuuuuuuugaagaccacaccucgguaucaauucagauauaauuuacggucaacaaaaacucuuaggagacuuucucagguuccuuguuaagccaguucuaccccuaccugccccaacccauugugugcgagguuuggguacuuucuuuuuuuuuuuuuuuuuuugacacauccuuguucacaacuuuaaaaauauucuuuauaaaaaagaaaaaaggucauccuguuauauucuaucccuguugcauacugcugagauguucugagauuccaauuuuguugccuuggugccuuucucagaucuucaacaauuugguaggcaagcucacuauaauuucuucuaaugcagacauaaguauuaacacuagaaacggaauguaggccaggugcuguggcucauuccuguaauuccaacacuuugggaggccaaggcaggaggagcuaucgaaguuuugggaggccaaggcaggaggagcccaguaguucacgaccagccugggcaacacagugaaaaucuuuauauaaaagaaauggaauguaaaccagaugaccaucugacaagagauauuuagaagaaacagcuauuugggucaagauuagacuucauagguucuaagguuucuuccaaacuccuauuaaaaaccuuaaaacuuuaauaauucuuucacgccauuagcuacaaccaaauggauccaccagccuucacaagcuaucccaacaaccgacugucacuagugacucaaguuccuucacuagguuucaagauuauuuuuaggggguuuagaugguacagaaagagacacauaaaguagaaucauguaaaaagaaguaaaucagguucaauggauucccguucuccaauugccuauaauuaaagcccucaguaugacuuucaaauauuuauauuguaauaacuuuuuuuaaaacaaagguaucuggucaaagaagagucacaggggaaauuagauaauacuuugagaugagugaaaaugaagauauaccaaaacuuaccagauacaauuaaagcagugcuuagaaauaaauuaauaccugaaaaugccucuacuaaaaaaggauaucucaaaucaagagccuaaucuuccaccuuaagguaauggaaaaagaagaguaaacuguuccuaaagcaagacagaagcaaggaaauacuaaauauuagaauggaaauuaaugaaguagagaauacaaaaacagcagugaaaagucaaugaaaccagaagcugauuguuugaaaagaucaaaauggacaaaccuuuagccagcuagacugaccacgaaaauacagaggacaaauuacuaaaaucaagacuaaaaagaagacacuaccuaccuuacagaaauaaaaagaauuauaaaggaauuuaugaacaacugugugcaacuaaauuggcaauuuuagaugaaaugguccaguucccagaaauacaaaauaccaaaacuuaggaaguaaaaagcugcacuggugagaugauuccaaaaaaacaaaaacagaaaaaaagaaagaaagaaaaaagcugaguauuuguaaaaccaaagauuuaaacaguuaauuuuuuuaaagcacugccaaagaaaaauccaugcccagauggcuucacugguuaauucuaccaaccauuuucagaaaaacuaauagcaaucuuuacaaauucuucccaacuuauucguugaagccaguuauuacccugcuaccaaaaccagacagacaucacuagaaaacuacagauuaguauuucuucugaauauaaaugcaaaauuucucaacaaaauacuagcaaacugaauccagcaauauuaaaaaaaggauuauauaccauaaccaagugggauuuguuccaggaaugcaagcuuguuuuaagauucagaaaucaacgcaauacauuaucaauaguaaaaaaaagaaucacucuuugcucacucuagagaaagcuaacaaagaaaaaguaaaacgagguaaaauuuccuuaaacuuuuaaaaacaggacagaaggcagggcaugguggcaccugcuugugaucccagaacuuugugaggcaggagaggagcacuugaggccaggaguuugagaccagccuggacaacagagcgagaucccugucuccaccaaaaaaaaaaaaaaaaaaaaaaaaauuuaaacuagccaggcaugaugucacacaccugccuguagucucagcuacucaggagacucaggugggaggauuacguaagcccaggagcuugaggcugcagucagcuaugauuacagcaccucacuccagccuggguaacaaagugagacccaaucucuuaaaaaaaaaaaaaaaaaaaaaaagaaaagaaacgaaacugcaauaccugacccucaacuagauccuguacuggaaggagacaaaugguguaaaggucauuauugggucaaaugagauaauugggacgguagauuacacaagucaauguaucaaaugcuaaauuuaccaaaauugaaaauuuugcugugauucuguaagagaauauuacuauucuugugaaauauuuagcaguauagggucauaauguauguuccacauaaaagaacaaaagacaagacuaguaagacauacuaugauacagaaagcaugggcuuggcuuuucuuuuacugacagugcacaagccuauuuucuacggguaaagcacauuuugaguugaauuaauaaauuccgcuaagaaaaugcaaacauuuaaaauacaauuuuaguuuuaacagaacuauauaguuauguuuuguuacuguaugccuauuguugguuacauccaacuuugcaugcuuuuuuagaaaagcaagaaauaacaaaagacuauuuuaguuggcauauuccacacacaucaaacuuuaugccaguuucacauuucuccucccauccucucaauugcugccgcuucuccuuucuccacgguuaucaaauagcuuaaugucugagguaauaguuuauaaaaggcuuacuguacagcauaacuauuacagauauacauacagggcccccugcuccucugaggaaaagugcugcacagugcuggguauacaauauaaacaacuucacuaauauguauuauuguauuugcuaucaucaucacaccaauuccauuaauaauccuguacuagugcugacuucugaaucuuaguuccucuucugaaaggagggauuaacguggccauacaagaaacugaaguucuacuauucccuccuugacuuuaugcacuagaaacaaugaauuaaagguauuugcaauuccaaguguaugcucuuucccaaucucccuggcuguacaagcacugcuguuucaacuugaaauguccucuagcucauacuucccuuccuaaaguagccaucagucuguaagacucucuggauuugugcaguugugcccugccuuccaacaucuguacuuggacauaauucuaccuuuacauuuaguugcuuugagacuauugguaaacuugccuuuccuaauaaugaauucuuugauguuaaucuccagaguugagcauaugccuaauagcuucacuuguaaacagcuuaacaaguaaaagcacugagugcuuacuauuugacuaccuauuguucaaagcgcuaugccauauuaacucauguaauguucccacaauuugaugaaacuguggaaagcccuuuuuuucuaguuuuuuauuuuucuuacuacacccccauuucagccauaaagcccauuuuaaagacgaagaaacauacauaggaagaugaauauucauuuuuaauguauuacacaaucaaaacaaaacacggacacacucagcuuccaaucuugaccaacacacaugcuaagcuccauucuaaccuacuaggaugucacauuaccacauaaacuaccuguaacugcagaucauuuuuacugaacuucccuaacacaugcugacuguauuagucugcccuucaucgguaucaagaaauuucuaguagaggggcucagaaucucucggagauucucuggucccagauuagccaaucuacaucuauuccguccauuauuucuuaaucuauuuguccaauccuuucuauuucaucugccacaaaugaccuggaaaagcuagcagcagauaacacugcuauuucaacaaacucauuuucaggacagagaccacacagcguagaaucagacuuaauucuggcuacuggguuuuagccgcguuaccuaaggagaaaguuaaucuuguggagucucaguuuuccucaucuguaaaaugaggcuccuacuaccagccuuggggggauuaagugaauugcaagccacuuaggagaaugccuggcagauaauaagccucaucaaauguuguuauuuaacgucauuacuguaaugcucugcugcucuaagucgaguggcuccccacugacagaauaaaacauaaacauuuuaguucaaaccccuucagagucugaauccauccuaccucccgaaacaccuuccacuguuuugauacccaauugucaacuucugccaaaaggaucuguaacggagcccccuagcuccagcggaggcuccucuguccuccuuucaaauuccaguuauuuaaucuagccuuuagagcacaacucaaaucucaccucccccggauuccccccacccacccgccccaagcccuggguaacguugcccucccccgaauuucacagcaccggagguucaccccauucauuuggcauucagucugccgugcaaaguuaguaauccuccugguguccccggagaaucguucaaccugaggguggggguguguccccuucuuuguguauuaacacgggcucguagagccuccaacacgcacuauagaguagcuaauuugccgcugccacaaaaaaaaguuacucgcugacagaaaaacuggcccgaaaaggaacacaguagugccguuuucaagugggcaggugacgggucugucugggccggagaggacgaagagggcggccccgagguuccccgggcugggggaugcgggagggugggucuccggcgagcagcgcgcggccaagggcgcugccacgggggcggcgcggggggagcagcggggccccagcgcgucgacgccggccgcggagacgcgucgagcccccgcccccgcccccgccccucaccuucuccuccucuuccuccuccuccuccuccccggcagagcuguaggccucacaguggugacgcggggucauccgggggcccguuaccaccucauucucauaggcgcgcggaggcggugcgcgcgggacgacucggccaacugaggagggagaaaggggaagcggaucggggggcgcgggcgcgggcgcuggcgcucgagcgggacgcacggcugcggccgcugggucggucagcgaauuaguuccaugaugacccccggccugaggccgccgccgcucgagcccggguugggagggggcucccucucgccauagggcggcgggggccggggagaggcggggggugagaccggcucugccccugcccggggaaagcgccuccgaggggaaauggugaaagggggggaggggagaaaagaaaagaaaaaaaaaaaaagaaaggggaaaggggggaaaaauaagaaaaagcgagacagaggcgcugccgcguccgcucgcggg

SEQ ID NO: 191487 - RNA, 27949 nt, Homo sapiens
cccgcgagcggacgcggcagcgccucugucucgcuuuuucuuauuuuuccccccuuuccccuuucuuuuuuuuuuuuucuuuucuuuucuccccucccccccuuucaccauuuccccucggaggcgcuuuccccgggcaggggcagagccggucucaccccccgccucuccccggcccccgccgcccuauggcgagagggagcccccucccaacccgggcucgagcggcggcggccucaggccgggggucaucauggaacuaauucgcugaccgacccagcggccgcagccgugcgucccgcucgagcgccagcgcccgcgcccgcgccccccgauccgcuuccccuuucucccuccucaguuggccgagucgucccgcgcgcaccgccuccgcgcgccuaugagaaugaggugguaacgggcccccggaugaccccgcgucaccacugugaggccuacagcucugccggggaggaggaggaggaggaagaggaggagaaggugaggggcgggggcgggggcgggggcucgacgcgucuccgcggccggcgucgacgcgcuggggccccgcugcuccccccgcgccgcccccguggcagcgcccuuggccgcgcgcugcucgccggagacccacccucccgcaucccccagcccggggaaccucggggccgcccucuucguccucuccggcccagacagacccgucaccugcccacuugaaaacggcacuacuguguuccuuuucgggccaguuuuucugucagcgaguaacuuuuuuuuguggcagcggcaaauuagcuacucuauagugcguguuggaggcucuacgagcccguguuaauacacaaagaaggggacacacccccacccucagguugaacgauucuccggggacaccaggaggauuacuaacuuugcacggcagacugaaugccaaaugaauggggugaaccuccggugcugugaaauucgggggagggcaacguuacccagggcuuggggcggguggguggggggaauccgggggaggugagauuugaguugugcucuaaaggcuagauuaaauaacuggaauuugaaaggaggacagaggagccuccgcuggagcuagggggcuccguuacagauccuuuuggcagaaguugacaauuggguaucaaaacaguggaagguguuucgggagguaggauggauucagacucugaagggguuugaacuaaaauguuuauguuuuauucugucaguggggagccacucgacuuagagcagcagagcauuacaguaaugacguuaaauaacaacauuugaugaggcuuauuaucugccaggcauucuccuaaguggcuugcaauucacuuaauccccccaaggcugguaguaggagccucauuuuacagaugaggaaaacugagacuccacaagauuaacuuucuccuuagguaacgcggcuaaaacccaguagccagaauuaagucugauucuacgcuguguggucucuguccugaaaaugaguuuguugaaauagcaguguuaucugcugcuagcuuuuccaggucauuuguggcagaugaaauagaaaggauuggacaaauagauuaagaaauaauggacggaauagauguagauuggcuaaucugggaccagagaaucuccgagagauucugagccccucuacuagaaauuucuugauaccgaugaagggcagacuaauacagucagcauguguuagggaaguucaguaaaaaugaucugcaguuacagguaguuuaugugguaaugugacauccuaguagguuagaauggagcuuagcauguguguuggucaagauuggaagcugaguguguccguguuuuguuuugauuguguaauacauuaaaaaugaauauucaucuuccuauguauguuucuucgucuuuaaaaugggcuuuauggcugaaauggggguguaguaagaaaaauaaaaaacuagaaaaaaagggcuuuccacaguuucaucaaauugugggaacauuacaugaguuaauauggcauagcgcuuugaacaauagguagucaaauaguaagcacucagugcuuuuacuuguuaagcuguuuacaagugaagcuauuaggcauaugcucaacucuggagauuaacaucaaagaauucauuauuaggaaaggcaaguuuaccaauagucucaaagcaacuaaauguaaagguagaauuauguccaaguacagauguuggaaggcagggcacaacugcacaaauccagagagucuuacagacugauggcuacuuuaggaagggaaguaugagcuagaggacauuucaaguugaaacagcagugcuuguacagccagggagauugggaaagagcauacacuuggaauugcaaauaccuuuaauucauuguuucuagugcauaaagucaaggagggaauaguagaacuucaguuucuuguauggccacguuaaucccuccuuucagaagaggaacuaagauucagaagucagcacuaguacaggauuauuaauggaauuggugugaugaugauagcaaauacaauaauacauauuagugaaguuguuuauauuguauacccagcacugugcagcacuuuuccucagaggagcagggggcccuguauguauaucuguaauaguuaugcuguacaguaagccuuuuauaaacuauuaccucagacauuaagcuauuugauaaccguggagaaaggagaagcggcagcaauugagaggaugggaggagaaaugugaaacuggcauaaaguuugauguguguggaauaugccaacuaaaauagucuuuuguuauuucuugcuuuucuaaaaaagcaugcaaaguuggauguaaccaacaauaggcauacaguaacaaaacauaacuauauaguucuguuaaaacuaaaauuguauuuuaaauguuugcauuuucuuagcggaauuuauuaauucaacucaaaaugugcuuuacccguagaaaauaggcuugugcacugucaguaaaagaaaagccaagcccaugcuuucuguaucauaguaugucuuacuagucuugucuuuuguucuuuuauguggaacauacauuaugacccuauacugcuaaauauuucacaagaauaguaauauucucuuacagaaucacagcaaaauuuucaauuuugguaaauuuagcauuugauacauugacuuguguaaucuaccgucccaauuaucucauuugacccaauaaugaccuuuacaccauuugucuccuuccaguacaggaucuaguugagggucagguauugcaguuucguuucuuuucuuuuuuuuuuuuuuuuuuuuuuuaagagauugggucucacuuuguuacccaggcuggagugaggugcuguaaucauagcugacugcagccucaagcuccugggcuuacguaauccucccaccugagucuccugaguagcugagacuacaggcaggugugugacaucaugccuggcuaguuuaaauuuuuuuuuuuuuuuuuuuuuuuuugguggagacagggaucucgcucuguuguccaggcuggucucaaacuccuggccucaagugcuccucuccugccucacaaaguucugggaucacaagcaggugccaccaugcccugccuucuguccuguuuuuaaaaguuuaaggaaauuuuaccucguuuuacuuuuucuuuguuagcuuucucuagagugagcaaagagugauucuuuuuuuuacuauugauaauguauugcguugauuucugaaucuuaaaacaagcuugcauuccuggaacaaaucccacuugguuaugguauauaauccuuuuuuuaauauugcuggauucaguuugcuaguauuuuguugagaaauuuugcauuuauauucagaagaaauacuaaucuguaguuuucuagugaugucugucugguuuugguagcaggguaauaacuggcuucaacgaauaaguugggaagaauuuguaaagauugcuauuaguuuuucugaaaaugguugguagaauuaaccagugaagccaucugggcauggauuuuucuuuggcagugcuuuaaaaaaauuaacuguuuaaaucuuugguuuuacaaauacucagcuuuuuucuuucuuucuuuuuuucuguuuuuguuuuuuuggaaucaucucaccagugcagcuuuuuacuuccuaaguuuugguauuuuguauuucugggaacuggaccauuucaucuaaaauugccaauuuaguugcacacaguuguucauaaauuccuuuauaauucuuuuuauuucuguaagguagguagugucuucuuuuuagucuugauuuuaguaauuuguccucuguauuuucguggucagucuagcuggcuaaagguuuguccauuuugaucuuuucaaacaaucagcuucugguuucauugacuuuucacugcuguuuuuguauucucuacuucauuaauuuccauucuaauauuuaguauuuccuugcuucugucuugcuuuaggaacaguuuacucuucuuuuuccauuaccuuaagguggaagauuaggcucuugauuugagauauccuuuuuuaguagaggcauuuucagguauuaauuuauuucuaagcacugcuuuaauuguaucugguaaguuuugguauaucuucauuuucacucaucucaaaguauuaucuaauuuccccugugacucuucuuugaccagauaccuuuguuuuaaaaaaaguuauuacaauauaaauauuugaaagucauacugagggcuuuaauuauaggcaauuggagaacgggaauccauugaaccugauuuacuucuuuuuacaugauucuacuuuaugugucucuuucuguaccaucuaaacccccuaaaaauaaucuugaaaccuagugaaggaacuugagucacuagugacagucgguuguugggauagcuugugaaggcugguggauccauuugguuguagcuaauggcgugaaagaauuauuaaaguuuuaagguuuuuaauaggaguuuggaagaaaccuuagaaccuaugaagucuaaucuugacccaaauagcuguuucuucuaaauaucucuugucagauggucaucugguuuacauuccauuucuuuuauauaaagauuuucacuguguugcccaggcuggucgugaacuacugggcuccuccugccuuggccucccaaaacuucgauagcuccuccugccuuggccucccaaaguguuggaauuacaggaaugagccacagcaccuggccuacauuccguuucuaguguuaauacuuaugucugcauuagaagaaauuauagugagcuugccuaccaaauuguugaagaucugagaaaggcaccaaggcaacaaaauuggaaucucagaacaucucagcaguaugcaacagggauagaauauaacaggaugaccuuuuuucuuuuuuauaaagaauauuuuuaaaguugugaacaaggaugugucaaaaaaaaaaaaaaaaaaagaaaguacccaaaccucgcacacaauggguuggggcagguagggguagaacuggcuuaacaaggaaccugagaaagucuccuaagaguuuuuguugaccguaaauuauaucugaauugauaccgagguguggucuucaaaaaaaaaaaagcuaaugagggccacgagugguggcucaugccaguacucccagcacuuugggaggccaaggcaggcagaucacuugaggucaggaguucaagaccagccuggccaacaugguaaaaccugccucuacuaaaaauacaaaaauuagccaugugugguggugugugccuguaaucccagcuacucaggaggcuaagggaggagaaucacuugaacccaggagguggagguugcagugagccgagaucgugccacuacacucuagccugggcaacagagugagacucuugucucaaaaaaaaaaaaaaaaagcccaugauuuuagacuguauuuaugguaaaauuaaagcuaauuuagaagaggcaaaauaucgugaggagcuaucgaaguuuucagcuauggaaaagaugaauuggugagcaugauagcacccuucaaagauuggaaggauuggugugaaagagauuagauuuugguagguuaaaguugugaacaaggauguaucaaaaaaaagaagguaccaaaaccccacacacaguggguugguacagguggggguagaguuuuugguuguguguuuuuguuuggggcaccagugguugaaacuggaacaauugguugggucucuguuccgucgaaguacugugcuguggacacagugaguaauaaaaaaaaugaggacacuuggacacaggaaggggaacaucacacaccggggccuguugugggguggggggaggggggagggauagcauuaggagauauaccuaauguaaaugaugaguuaaugggugcagcacaccaacaugacacauguauacauauguaacaaaccugaacuuugugcacauguacccuagaacuuaaaguauaauaauaaaaaaaauauauauauauaaaaaugauauuggcagaugugacugcauagggauuucuuuauuuggagacacggucucauucuguugcuggggcuggagugcaguggcaugauuuuggcucacugcaaccucagccucccaaguagcuuggaccacaggcacgugccaccacgccugccuaauuuuuguauguuuuauagagauggaguuucaccacauugcccaggcuggcgucgaacuccuugacucaagcaaucuguccuccucagccuucgaaagugcaaggauuacaggccggagccgcugcgccuggccaggaauuuauaacguaguuggggaguuaacagaaagcugcuuuaugacaugauuaaagaaucaagaguuuuuagaagaaauuaccuuugagauaggucuuuuuggauuaauauuaguucuuuuuccucucuauuuaccccuugucaucuuaguaugaagauauuuuaugcuaauuauagaagauuugcaaaaacucaggcguuuaaagacacaaaaauuaacaaaaucauaauugaguuaaccagaauuagucucuaguaaguugagaagcaaauagguagcauauguggagugguacauaggaaggaggauaguagcuggaguugggauagaauguggaaauuaaagaagugguuugcuauuuuuugcuuuuccaaauuuuuuauuuuuaaaaaaauuggaacuuuuuacauguuaauucuggauauuuaaaaaaauucuuagagcccaugaaucugaaguguguaauacagauacauaguuuacagguacauaguugagaaagucaaauuguuagugaaauuuauaaugaaaaacagcauucuccuacgcuaggccuuucucacccuuuucuuacucugcagagguuaacuacucccaacucuuuccuccuugucccguuauuuagcaucacauuuucaaacaacuugcucugcugcuguuuuuugacauuucaguuugagauauuuaugaauuuccuacuaugaaauguaaagacguggcuuuuauuuuacccucuuccaauauccauaguuaugucuccacauccugccaauguaguuuuaucauauugcgaucccuauccagucuuuucauuauuauugcuguauaaauauugugauacauuacuuucuuaaauucuuuuuucugaaguuaauuaccuuuuuaguugcuuaccuuucaacaaauccagcuaagccuuuucacauucuuuuuuguuuguuuguuuguuuguuuugagacggagucuugcucugucgccaggcuggagugcaguggugcaaucuuggcucauugcacccucugucuccuggguuaaagcgauuuuccugccucaggcuuccaaguaacugggauuacaggugccugccaccaugccuggcuaaguuuuguauuuuuaguagagacgggggucucaccauguuuugucaggcuggucuggaacuacugaccucgugaucugcccgccuccaccucccaaagugcuaggauuacaggugugagccaccgugcccagccaccuuuucacauucuuuagcaguuucuuaauccaauuuucuacacacagucaaaccucaagucuguaguuugcuucuuuuuuuuuuuuuuuuuuuuuuuuuuuuuaaaccuagaagccugcacgguggcucacaccuguaaccccagugcuuugggaggccaagccaggaggacugcgugaggcugggcaacauagcaaaacugcaucucuacaaaaaaaaaaaaaaaccccacaaaauuaccugggcuuggugaugugcaucuguagucccagcuauuugggaggcugaggcaggaggaucaccugaacccaggaguucgaggcugcagugagccacuacaccacuguacucuaaccugggcaacagagugggacucuuguuuccaaauacauauaaacauaaaaccuagagacauuucucuuggacucuauguugucuugcacugcuaaacuugcuauuuagacaugcugcucauuuuagagugcuagucaauguacuguggagcuuucuaggugagcacuguucaguagaacuuacuguauuaauaggaauguuccuuuugugcacuguccgauauaguauccacuagccacaucugguuauugaaguaaggcuauugugacugaagaaauacauuuuuuuuuuuugguuuguuuguuuuugagacggagugucacccuguugcccaggcuggagugcaauggugugaucucagcucacugcaaccucugccucccugguucaaacgauucuccugcuucagccucccgaguagcugggauuacaggcgcccaccaccaugcccaguuaauuuuuguauuuucaguagugaugggguuucaccauguuggccaggcuggucuccaacuccugaccuagugauccacccgccucggccucccaaagugaugggauuacaggcgugagccaccaugccuggccaauuuuuaaauuuuauucagcucauaguuaaauauccacauguguagcuaauggauacugaauuggaagcgcaauuuaagaugauuucauacuggaggguaugguuucauacugaagaagugggaauggguaggauuuaauguaauauauuuucuuuuuaaugaaggaaaaauguuagugguccuuaucugauuagguuuuuaagaggaauguuuggaauaacuacuucuaagaauuccugguaaaaaagccagugacaaaguuuugacaauuugaaacaguaauaacauguuuugaucagaguccaaagguuccaucaauuacauggccuuguuuuuauucucuuuauaacugaauuucagauuucaagugugaauguuuuagauaacugauuauuuugguauuuuaauacgauauuuuaaagagcuauaaaauccuauacugccucauagcauucuuauuuuguuuuaugaguugcuuaauuaguacuuuauauaaugcuacacuuauucuauaacuaauuuuaaaacuuacuugauucuguagguagcuacagcaagcuggguagcaggcagauccaaaggauaucaugaaguuuccagggccuuuggaaaaccagagauugucuuuccuguuggaaaaggcaaucacuagggaagcacagauguggaaagugaaugugcggaaaaugccuucaaaucagguaaugauuuuucucuuaagacagaugaauuuuauuagaaauaaacauacuacugccauacauaauaauaucuugacacuacauuggaggaguguguaccauuuaaggaugugcuguauuugagagacucucccuguuucuuuuuuguguaacagggucucacucugucauccagucuggagugcuguggcaugaucucagcucacugcaaccccugccucccgggcucaagcaauccucucaccucagccuccugaguagcugggacuacaggcgcaugcuaccaugccuggcuaauuuuuuguauuuuugguagagaugggguuucaccauguugcccagccuagucuggaaguccugagcucaagcaguccaccagccuuggccucccaaagugguaggauuauaggcgugagccaccaugcccggccucuucuuuuuuaaaaacuccugcuccugcuguggccuuuucuuucugaaacaagaguuaacuguuuuuguuuguugaccuguuuuguuguuaucugaguuacagcuuugggaaaauaguuagguuuguuuucuuucaucauaaucuauacuaacaguaguaaccuucuuuagauauauaguuuauaguuagccacagaggcugaacaucuucauaccauugucuuuagucaacuaaaaaccuacucuuucaucauuagcgguaaggaguucaugugaauuacuaagguaauaccaauguuggaagcuuuuuagaagauagccagcuggucucuuaacuacuguuagcugcauaguuuuucuuuuagaaauuuuuauacuucugucauauauaauuauuuuucacaaauaacugugaacuuuauccacuccaaaaguuuauuguauaagaugucuuauaugucuuuuauccuuaauaucuaacauggugcuuggaaaauagaauaguggucaaauguucuuuuaauaugcaugagugaaugaauggcaaauauguaaguuccucguguguuguuuuaggcuauccuuugcuuauugguuuugaaaguauauaugccuuuuuaauucaauucuaauuuuuccuacuuauucuuucccacaagcuaaagaaauacauucuucauuuacuguuacuugucauuuugcaaacugauuaguuaacuugaaugaggaguguuuauauauaugcuaucucauuuaauaucucauuuaauucuuugaaaaaguacucaguagucccaauuugcucaagacuuuaauaaguaauagaaugauaauuugggcuggacgcaguggcucacgccuguagucccagcacuuugggaggcugaggugggcagaucaccugaggucaggcguucgagaccagccauggucaacauggcgaaaccccaucucuacuaaaaauacaaaaauuagcuggguguggugagucauuccugugacccagcuacuugggaggcugagguaugagaauugcuugaacccaggaggcagagguugcagugagccgagaucacgucacugcacuccagccugaacgacaggguaagugagacuccgucucaaaaaaaaaaaaaagaaaaaaaauuauaauucgauccuuuuccuaagguaguccucuuccugugauauuuugugugugugugugugugugugugugugugugugugugcgcgcgcgcgcaugugugauuuuuagauuaguugggaauucaagucauuuagcaaaugucugcugaguaucugcuauacucuaggcacuauucuagguauuggggauacaacaggagaaaauaaauuccugcccuuauguugugacauucuagugagccucaaaacuuuuuuauagcugcuuguaggaccauuccuuuccuccuccugcuaucuccuuaagucagcauguaaccaacaauaauauauuuuuacagccuggucuuugaaggugauauucuaccuagauuguaguauauugcuauauuaccaaauaaucugaccuauuucuuuuuuuuuuuugagaaggaguuuuuuucucuuuuugcccaggcuggagugcaauggcaugaucucggcucacuguaaccucggccucccgggcucaagugauucucuugccucagcuucccaaguagcuggaauuaacaggcacccgccaccauaccuggcuaauuuuuguauuuuuaguagggacaggguuucaccauguuggccgagcuggucucgaacuccucaccucagaugaucuuccugccccagcaacccaaagugcugggauuacaggcgugagcaaccacacccaaaucuggccuauuucuguaggugauuuaaugaauacuggugugguaauaccagagaacagaauaguaucagaacuucugagagagauccacuucuuaaggauuugccuuuaguaaugccaaguagaagccauauuuaauacuuguaaaauuuggguggccuuggucugguggggauaggaguuaagaauagggguaaaaggcuauaggggcuugaguugcuugccaggguaacccccagggacacuucucuauucuauuuuuuuuuuuuuuuggagacagagucuugcucugcugcccaggcuggagugcacuggcgcgaucuuggcucacugcaagcuccgccucccggguucacgcuauucuccugccucagccuccccauuagcugggacuacaggcgcccgccacaacgcccggcuaauuuuuuguauuuuuuaguagagacgggguuucacuguguuagccaggauggucucgaucuccugaccuugugauccggccuuccaaagugcugggauuacaggcaugagccaccgcacccagcaccuucucuauucuaguucuaacucuuauuuuccucuaagggacuggcuuuuuuuuuuuuuuuuuuuuuuuuuaccucccuuuccacuguugcucugacuuuucuaauuugguuuugaaguguugguaaaaauggaaaaguaagauauuuuuaagcuuucucuuaugccuuuuuccuccaguuuccuucuaacuuccccccugccccaacuauauuuugaagucagucucucacauaauucuuguuuaauuugcauccccuauccccaaauuuaggacaguguggucaggcaagaauauuaugcagcugucacucaccuucuauguguuucugccacacucugcuucccuuaugacagcacaaaguauuauaauuuucuggugauuugacugugaguuucccugagggguaugguggugucauuuuuguuuacuugcauauaauagacucaaaguaagcauuuaagugaauggugauuaucauuucuuuaugauucauucagguaccuuacuguguucuuggcacuugcagagaacuucuuuuauauuauguaauaguacuuucaaguucaugauaauuuuguuacaugaauuuggggaaaacauugaaacuggucaaaguggcacauacuuucagauguucucaauuuauuuugccaaagugcuuuugauuuacaaagauaaaacccugccacaaauuguugauauacagaugauuuucaguagaauuuuagaacucuaaggaaucuuaaaaagagguuguuaacagcuuuucuagucauucucaacuggaguuuagauuugcugcuuccuacuucaucaaagccaaaaggaaaaauuuaauuuuuuuuuuuuuucugagacagggucuugcucuguugcccaggcuggggugcaguggcuccaucacaguucacuacagccucuauuucccaggcucaagugauccucccaccucagccucccaaguagcugagguaacaggcacgcaccaccaugccuaauuuuuuuauuuguggagaugaagucucacuguguuacccaggcuaguuucaaacuccugggcucaagcaguuuuccugccuuggcccccuacaguacugggauuacaauugugagccaugcccagaaauuuaauuuuuaaaaaaauguugaacguuuaacagguguaaugagaugcugugggaacauaggaagguacucagcccaacuugaauuaucaggaaaaguaucuggcggggaguaacaucaaaauagcucucaagagauacauaauaaggcaggugagagagaagggagugcguuccagucaguaggagcaauaugaacaaaggagcaguaacguaaaauaccaggggcaaggaaggaucaucaguagaaguuacuauuacagcaugaaguuuaagacagaaagugauggaagauguccgagguuagagagguaggucauagccgggcaugguggcuugcaccuguaaucucaacacuuugggaggccgaggcggguggaucacaaggucaggagaucgagacuauccuggcuaacauggugaaaccccgucucuacuaaaaauacaaaaaauuagcugggugugguggcgggugccuguagucccagcuacccaggaggcugaggcaggagaauggugugaaccugggaggcggagcuugcaguuagccaagauugcgccacugcacuccagccugggugacagagcaagacugucucaaaaacaaaaaacaaaaacaacaacaacaaagaagagguaggucauagauuuguaugccaugcuggggaauuguacuuaaucuuuuagguaauggugaaccuuuuagaguuuaaagcuggggagguuguauauuuuaaggagaagacuagcagcauguggaauauaauauauauacagaauauauauuaauagcagucuauauuuuaccauguuugaucaauccauuauaaauucucuuuaggauuauuuguucaacuacugaauccuucuaauccuauuuaagcaguccauaugagaaacaguucaccugauggaaucaggaaauacuguuuugggcuuuuucuuuuucucucucauucuuuauuuuagaggaauaggaaugaaaugaauuaggcgcagaacuuacuauuuguaaugcugucaugaugauauuacuguuuaguacauauuugaauugauuugaaaaagugaccuuagacucaguauuacuucaguuaaauugagucuucuuaaacuguuaucuuuuggauuuuaaaaaaauuauugcugguuuuggcuagugaugauaacauuggcuaugcaggaaugcuuuucuuggcccuguuguuaaauuuuacuaucugguauaugggccaaacauaguggcuuacaccuguaaucccaacacuuugggaggccgaggugggaggauuacuugagccugggaguugaagaccagccuggguaacauagugagaccucgucucuacaaaaaaguaaaauuaggccgggcgcaguggcucacgucuguaaucccagcacuuugggaggcugagauggguagaucacuugaggucagggauuugagaccagccuggccaacauggcgaaaccccaucucuacuaaaaauacaaaaauuagccaggcgugauggcacaagccuguaaucccagcuacuugggaggcugaggcagggagaauugcuugaaccuaggaggcggaggcugcagugaacugagauugaaccacugcacuccagccugggugacagagcgagacuccaucucaaaaaaaaaaaaaaaauuagccgggccugguggcacguaccucugguccuagcuacuucaggaugcugaggugggaggaucacuuggggcugggaggucgaggcugcagugugccaugguugugccacuguacuccagccugggugacagagcaagacccugucucaaaaaguauauggaauauuaaaguucaaagauauugucaugauuucuuucaugacuaauuguuaacaguguuuaaaauaacuucauagauaauguuuuguaaauuuguuuuucugacauuauuagagaauuggguaguuuagaggugggaaaggagaacuaauauuugaguacguuugcauuccauauauaugcuuuacauuaguuaugucauuuaguuauaacuauaugauaaucuccauauaacuguauucucuuuuuuuguauguuaccuuugugauucuucuuacaauuguauguuucuguuauuguuuaaugccaaacaccaaauagugacauuauuuaauguaaucugucauucagggauuuuuuuuuuucucccauaccccacauuguaucucuaacugaagguuagaguuaaugguguucuuguuuucauagcuacuguaagucaucguuccuuucaucucccuaaaagccuucccaguuucaucagauuauaacaucaccuaccucuccugggaauuuauuuccuuguugauguguuuggcuggcuuaguuaacauuacuuuuccuuauuuguuguggcauuuuggauaaaagcucaucuugauaggaauuuaauuucucuugaaugcuuaacucuucauccagaagucuugugauuggcuuuacuugguucucagggauuuuuauggauccuuaguccagaacuagaucuuaaaguagccuggauacagaauuacagcuagauaugaggaauaacuucuaguguuccauaccauuguaggcuuacuaugguuaacuuaggaaauacaaaugaacuaugauaacagaaugauagcccauuuaaaaaacugaaaucaauauuaauaagugaaaguuaccaggggcaacagaugaauuauacauuuagagaugaugaaaaaaaauauugaacaggaaaucaaccugaaguaaaugacuauuuugaaagcuuuccacaaacacaaaacauuguuguuuuaaucuuccuacauauuauuugaguauucuccuuacagcucuuucaaacuguuugaaacuacaguuugaaagagcuguaaggagaauacugaauguucccaaaauaaacaaccgguuuuauuuuuuuaauggcgacuccaaaacucaagaguaaaaguuuucuaaucacuauuacuuuaaagugugucccugcuaaaaauuaagcuuauacucaauaggcuuacaacaacaauaaaacaauaauguuuuguguuuguggaaauuuuucaaaauaguaauuuacuucagauuaauuuccuguucaauauuuuuucaucaucucuaaguguauaauucaucuguugucccugguaucuuuuacuuauuacuauugauuuuaguuuuucaaaugggcuaucauuuccauuaucauaguucauuuauauuuccuaagauaaguuaauggcuacuugcugcgggagaaauucacuguauuuucuuaaucuuaagaggugggguaacuuaacuccaaauuacuaucaguugauaauaguguuacuuaaacuuuaaaauguuauauucucugagcaccuaaauuuaauucaacuauggauauuuggugagaugacauagugaaaauuuuaauaaagaguaggagaauauuggauauugauauuaaaugugauaauacauaaaguuuuauuucaugugucucaagucugauagauuuugaauaaccuuaacauuuuuaaauauauuuuguaguauuaccuaaccuuuuaugagagagaauucuaaacauacucuugaugauagcucaaacuuugucuucuguuuucaaaauuguucccuuauagaauguuucuccaucccagagagaugaaguaauucaauggcuggccaaacucaaguaccaauucaaccuuuacccagaaacauuugcucuggcuagcagucuuuuggauagguuuuuagcuaccguaaagguaaguguuuuaagauagacuuacauauaaccucauuugaguguauguaugcuaaacuagaggcuauuagugaacauucuguaagguagaaagaaguggagaacuuugcuggagaaugauguauguacccauaagaagacauggugaugucuucugcuauuguuuauuuuauuuuuauuuuuugauaguuuugcucuguugcccuggcuggagugugucugccuccuggguucaagcaauuuuugugccucagccucccaaguaguugggacugcagacacgugccaccaugccagucuaauuuuuguauuuuuaguagagacaggguuuugccguguuggccaggcuggucuugaacucccgacgucaagucaucagccugccuuggccucccaaagugcugggauuacaggcaugagccaccacucccggcuuucuacuauuguuuaaaaagcagaaguguuuuuggaaguguuucuaauaguauucuguaauuuucuuuuuguuacaaguauucauaacuuuuuagccuaugaaauuuuuuaucucuugauuuuagcacaaaccguauagcaucagcagaauacuuagucauuuucuaacauauugguguacagagguggacaaggaaucagacuagaauaaaguauaagccuauugcacguuuuucucugucacuacuuauugaauauccauacuguguggcuuucugaaaaacaaagugcuuucuacgggcuuacuuugguauauaacaagaugucauaaagcaacuuugguauauuuuuguugaaugacagcauacaaauaauuagguuuuauauuguccccauugccaugucauuggcugugucaaguuaguaaauaggcccucaacauauuuaaagcagaaaaugagcauuuauuuaauggcaaggcaugaaaaaguagcauaguauuuaaacuuguaggcauuaguaugcaaaagaauauguaaacugggggaacugucaauuaaaugcuuuauuagguauacagaauagaagccaaauaauuacggaguguaagacugaauagcugcucaaacuucuacucuuaagacacuuacuaaacaugacaggacccaauaaauaagaaauaugaaaaaaugagauauuuggcaaaauucucuaauuguuccacaaauuucuccaacuuuguuucaaauguuuaauaaacacagcaagaaacucaugauagaaacuacaacaauguguucacuaauaauuuuugaaaaauguacuguccaagaaaggacacuaacuuuaaacucaucuuucuguggaauuaucugugaaaaguagguuagauguaguagagagggagggaggagugauguggacuuguugcugagauaaaaguaggcauuuuucagauaucccagauugcaagcaauuagcuuuaaaaaauguuuacauacacaaaaaauuuuuuaauuuugggaauauuauuuauuaaaaacuucuaaaucaagcuuuuuuucugcuggauagaaaugaacuuugguuaauuggcuuugguugaacuuugagcaauggaauugauauuauuuuuguagaauaucauauggcuaggauuguaaugcuaacaguuagcucucaggccgggcacgguggcugacgccuguaaucccagcacuuugggaggccgaggcgggcagaucacgaggucaggagaugagaccauccuggcuaacacagugaaacccccgucucuacuaaaaauacaaaaaaaaauuagcugggcgugguggcgggcguuguaguagcagcuacuugggaggcugaggcaggagaauggcaugaacccaggaggcggagcuugcacugagcugacaucgugccacugcacugcagccugggcgacaggccaagacuccgucucaaaaaaaaaaaaaaaaaaaaaguuagcucuagacacacuugaucuugcaaguguacuuuccuuccuuucauuacugcucuaaagcuuuuuaauaaacuuucuuuccuguucuuaaaguuagcucugaucuaaaaaguaaugaguggcagucacauuaauugaauuccauaguauuuuguguauaccugucucaucugcauaucuagguuuuuaaaacaguuacaaaaaguuaaauuguuuuugaaaaaucacuaaaguugcuuuuucccucuucaaaauuuuaggcucauccaaaauacuugaguuguauugcaaucagcuguuuuuuccuagcugccaagacuguugaggaagaugagguaauaaauccuuucaagauaauguuucuuccgugaaaauuucucuccacauuuauuaacuugcuucguuugcuaaaacaaaaaucauaaaugaguuucuuuucuguccuuuucucccugucccuguuccccuuugcuuuggauagagaauuccaguacuaaagguauuggcaagagacaguuucuguggauguuccucaucugaaauuuugagaauggagagaauuauucuggauaaguugaauugggaucuucacacagccacaccauuggauuuucuucauauuguaaauauaccugaagucuuuuaguuucuuauuugaguguguaguuuucaguaaauuaaaaaauagauugccuacucauuuauuuuguacuggaaauaggaaaaagaaaacuugauauccaaggaaaaauuauaaauuaguauauaugucauaucacugaagcuuaauucgcagacuuagaaauugaauagguuaggcugggcgcgguggcucacgccuguaaucccagcacuuugagaggcugaggcaggcggaucacuugaggucaggaauuugagaccagccuggccaacauggugaaacccugucucuacuaaaaauacaaaaauuagccgggcaugguggcaggcgccuguaaucgcagcuacucaggaugcugaggcaggcaggagaauugcuugaauccaggaggcggauguugcagugaguugagaucaugcuacugcacuccagccugggcaacagagugagacucugucucaaaaaaaaaaaaaaaagaaauugaauagguugcaucaauuucuauauguaauuucccagauauuuaaauaaaguuaaaaugauguucuugugauuuucaguuccaugccauugcagugucaacuaggccucaguuacuuuucaguuugcccaaauugagcccaucucaacauuuggcaguccuuaccaagcaacuacuucacuguauggccugcaaccaacuucugcaauucagaggauccaugcuugcucuggccaugguuagucuggaaauggagaaacucauuccugauuggcuuucucuuacaauugaacugcuucagaaagcacagguaggugucagucuaauuaaauaguguucuuuuuaaguuuuucuauuauuggaauacauagaguuaccaaacuaaaagacauuucucauguuguaauggcaaaccauucuuaagaguagacaagaguaaaguauauauuuuaaauuuacgggcuaggugaucucuuuuuuucauauaaaacuuauauaguauuuuuaagauuccuuuuaaccauuucucuuauuuuuaagaauucuaaaauguucauaagauugucaauaccauauuguccuuuaguuuuuuguaaagaaacuuccuagcuacaucuguagguuuuaauguaguacuucuuuacuucacucauuuuauaacggaugucaggaacaaaaauuagaauaaguugcuuuuuagacaagcaaauaauuuauuguuggcuaguaagugaaguauuuauaccaaacuggcagguagaagccacuuuucugaaagagguuuuucccuggcaguuccauuauuaccuaagauuaguuuguaacuuguaucuacagauuauuauaaaauguauagguugauaaauuaucaacuaccuaaguaaaauguaaagguucaguggagaaaauucucauucaaauggaaaguuggugagagugcuguauguuagcaacuacuuugagagaaggcuuacugguucuauucaugucaccaaauagaacuuaccgaguuuagaucugcugcagaccauuuuccugccaccugaauccauaaaagacucaugaaccuacuuucccuuuauauggcuauuuauucuuauuuaacaguaguuauucugauuuguuuuauuggauuuuacuuagaagauugugaaauucuaagcuuaacauuuugcaauaaacuaauuguagcaaagaacugcaguuauugagcuaaaaauuuagauuauuauaaaagaaaaacauaauaguugaauuugguguuuuucuaagaaaguuauaauugaucuuauagcaaacauuuuaagaaguaugucugaagaaaaugaaccaggcaaaaaaauaauuuuuuuuuuaaacaaguaugucagugcuuccaagaauuuuaggcucuaguuugugagcagaggggagcucagucuuuucauaaaaagguugaugaucagagcaguauguuagcuagagaucuaccuauguaguguaacaugggcuguuuuuuguuuugaagggauaucuuaauugucuuagauuaaaauaauuaaaugcuguaaugagaauaaauccuaggagguaguugcuacuuagaauuuuuagaaauuaugauaaaccaccauuuaaaugaauaauaugacacagaaaauuuacuuugcucacccuggaguguuagaaagaaaaguugaauauuaaucacucacauuagacugugaaguagaggaauaggcuuaauagaaaaccuccuacauuacauuauuuuuauuggaacaaaugacaucucucuaaaugccuucugacuuauucucugugcuuacucucaagauaguacagaaaaagauugcuuuaaaguguuagugucagaggacagauuuugaagcauaaauaauaauguuguaaauagcauguguauucuguagcuuugagaucauguuuuccuagugaaaaacacuggaaaaucugauacucuuuuguaaguuuucuggugcuagaggaagagaguauucacugaaacuuuuuuuucuucuuagcugaaggaguauugcaaaccugggauuugacagaaucuuuggagaaguuauuucauucaccuccuuuauuuuauagcucugguguagggaacuggagacuuucuuagagccguguagagcuacuuaguagugauuuaaaagaaccaaugcuuuuuuucauaccacacaaaccuuaaaaauucuaguucagugguuuucauaauuuguuuuagaaguggaacccuuucccagucccccuuccccaaagaaaaucuuguacacacacaaucccagaauauagaauagaagaacggagcuauacuuguguuuaagggcagaucuccacucaacauagcguuuucccuuccauagcuagaaaucuaccuauguaguguagguuuagauuauauuauguagguagucuuuggacguaguuugaaaacuggaaauacagugaauuuuuuuucuuuuuaagagauaugccccauguaguauauaauugcaguggggaaguuagugaagaaaaggaaggucauaaaucuugguagagacuuuugggacuuguucuagcaguucucuaacaccaacccaugugguccaaacauggauggcuccuaguucuuuaggacucauuucuguuuuugcuaaguuugcuguguucagguagggaacaccaggucuaauaucuuuguguuuagacgugugacaaggccacaauaucagauuucuuccuaguuuucugguuuuaauauaggaaagucuugcaucagauugaugagaucaugccaaaauuauuugcgacaugauucccagugucuugguuugaggagaguccaucacagacauaccgugcugugaggaggccacucucacuaguucugccugagcccccacuuugagacaaaguauggugaguguucccagguuugaaaggcaaucuuccuuuugucccuguuaaccucccacuacacccccuuaagcucuugcgccaccuguuggucaccauucugggauggcuaaaccucuuucucuccuuagccuuauaaacucaggcuguuaacucuaccuagauuagugugguggucuuuguaguuccuagcugggcaguagucaaaguacauguucuaguuuaaaacuagaguaggugcagccauaaaacagaacaaaaucauguccuuugcagcaacauggaugcagcuggaggccauuauccugagugaauuaacgcaggaacagaaaaccaaauaccacacguucucacaagugggagcuaaacguuggguacacgcggacauaaagauggcaacaguagaaacuggggacuacuagaagggggagggagggaggggagcaaggguugaaaaacuguuggguacugugcucacuaccugguugacaggaucacuuguacuccaaaccucagcaucaugcaauauauaucuaguuaauaaaccugcacauguaccaucuaaaaguaaaaagaagcaaauuuaaaaaaaaaaaaacaaaaaaacagaccccuccccaccagucuccugguucuuuuugaagguggcuguggucagacuauuccagcagguuccucagugcuucaugcuguucaucaaaccuggauccaucuggaccuaccauuuaugucauuuauuguuauaaaaaauaauacauauucucuugacaccuuauaauuagaguucauuuaaguccuuuuuaucaacuccauuagaguacuugucuggugucgagaguuuugguaguuccaguauaugugcuuguuuuguuucuuccacuggaucucaagaaggaacaaauuauuuuggugucuuauagaacaaauucagauuguacuagauuagaaggaauuuauuuugauguuauuuuggagaaaagacuuacuugggacuuggguggaaguggaguucauauggaugguuuuguuuugaauaauuucuaaggucuuuuagcucuaucauuucuugucagucucccaccgcuaaaauauaacucuauuuacuucguuuuuucacacagaaagauuauagugacauagucuuccucuuacuuaaauacaugucuuuuuaggauucugccauaguauugauucugccauggcauuuauuaugcccagugaccaaggcauuagaauauuugugguaccuuuaccuuuuuaggccaauaaauaucauucauuugcuaaagaacauuucauuaaacgagguacaguuggcucuccauauccauggguuuggcaucuggauucaaccaaccgugaauugaaaauauucaggaagaaauuucacagaguuccaaaaaaaccuggaauuuguggcaugcugaguacuacauugaaucuacacagaugaagugauguguaggcauucuguuagguauuauaaguaaucuagggaugauuuaaaguauacaggacaaugcgaguggguuauaugcaaauacuacauuauuuuauauaagagacuugagcauguuggguuuuguuaucuuuugggggauccuagaacuaaucccccauggauacugugggaugacuguacuuauuuuuuagaaauaauuucuacacuauagccccuuuuuuacucccaguuucuuucauuuuuuuuuuuuuaggcuuccuaaaauauuggcagaagcuccauccuuucucugugcuuuguuccaauguuuuuagcauguuucagcuuguucuacaucccugggauauauaauaagaccuagccuaaauguaagcuugauaguucagggacuaucuuaaguguuauguuaacuuuuuuucuuuuaagggagggagaacaaauucuaauacuaguuaauagugucuuacccacaguguguuaucuaaugccuuucaaacuaggggaaaaaaaucagugaacauuaugguagaugcuaaaaucugccauuuucuuguauauuucugacaguuucaguuacuuugcauuuguauuauacaaugacuaacaucagccuuuuaccauucuuuccucugguauuuuucaguaacaaauagugaauguauuuagagauaaaaauaauuuugugaccaaauguguucuuguagagugcguuauuuuccccuauuuucucugugguauugcaaacagucauggugagugcugcagguuauaugaggauaaguaagacuugguacagaaauguccagaauacucaaaacuggaaaaaagugaucccugauaguuaaauggucaagauaggcuuccugaaggugaugguguuuagccaguccuggaaggaaugcgcaauacaauuucaacagguagaaauaagaugauuaaggguaaaauaagaaaggggaagauuagugcaucauauagagcaggacuguugagcaagaguguagaccacaaguugaggguaugcuaggaaauaaggcuagaaaagaagguugagaucagauuauggagauucuuauuaauacuaaacuaagcaguuuagcuuauuucugguaggcauuggggugccgcuggagagagcagggaaggaauauaugaugcuaacuaagguuauuuugacaaugcuguaauugaaagugaggaagagagacacuuuacuacagguaauaauuuaaaggccuuccauguacagucauugugccagaaacuuagggauaaaaagaugaauauaauacaaugccacaccuuuggucuuguagucuauaauggaaaggcuaaaugguuaaauagauuauuauacugaaaugugguaaauacguugaaagguuuuagugucuuuuuuuuuuuuuuuuaagacagagucuugcucugucuguuggccuggcuggaaugcagugguuugaucucaccucacugcaaccuccaccuccugggcucaagcuauucucaugccucagccuccugaguagcugggauuacaggcaucugccaccauguccugcuaauguuuuguauuuuuaguagagaagggguuucgccauguuggccaggcuggucugaacuucuggcuucaagcgauccaccugccuuggccucccaaagugcuaggauuacaggcaugagccaccacgccuggccauaaauauguuaaaagguugauauagaaacagaugaccguggcauuuagaguuuugggguguugagggagucagggguaacuccagaaaggauugauaucugugaauuguccugaaggguaagaaggaaucagcaaaacucccaaauuaaaaacuuuaccaaaaacauuucaucuuagugcuaagucuacuauuuucuacaaaauacauauuucuaaauuuuucauuuacuauuuuaaaauucuuagcuucccuccucaucccugauuaaaaaaaauuuuuuuuuugcccuuuggcuucuuacauuuuuaaugaauguguuuaugaguacuuuggacuccacugaaaaaaauuagaagaggccaagagaguaggaugaagggccuuccagacagggggaauagacugaaaaaaaaaaaaaaaaaaaaaaaaaacagacguuggauacaaaaaaguaguuucuguucucauguaaauguucagcauacauugcaaauacaaaacucaaguuccaaagauaauuauauuagaaauacagauuuggaccuaauuucuaagaugauguugauggauggguagcuggauaaauaaaugaguuggagguagauguggggagagaaaagacucagcggggacggaaagcacagggaggaaaaauggccaccagagauaacagagcagccuauguuaauuaaugaucaacuguguguggcuuuuuuuuuuuccuggcccagauggauagcucccaguugauccauugucgggagcuuguggcacaucaccuuucuacucugcagucuucccugccucugaauuccguuuaugucuaccguccccucaagcacacccuggugaccugugacaaaggaguguucagauuacaucccuccucugucccaggcccagacuucuccaaggacaacagcaagccagaagugccagucagagguacagcagccuuuuaccaucaucucccagcugccagugggugcaagcagaccucuacuaaacgcaaaguagaggaaauggaaguggaugacuucuaugauggaaucaaacggcucuauaaugaagauaaugucucagaaaauguggguucuguguguggcacugauuuaucaagacaagagggacaugcuuccccuuguccaccuuugcagccuguuucugucauguaguuucaacaagugcuaccuuugaguguaaacuaagguagacuacuuugggaaugagaacaugcaaaaucaggaaaggcuguagaaggaaauauaccuuaacaggcugauuuggagugagccagaaaaaaaaaauaaaacucucauuauuuguguggcuaauuauaauucagcguuauuuaagcacauaaagaccaa

SEQ ID NO: 191488 - RNA, 106004 nt, Homo sapiens
gcgcgcgcgcgcgcguguuuguguguguguuuccccugccgcggggaaauggcugcuguugcuucugggccagaggaagagaaugagguagaguguucuuuugccuccgaguaggaccgagaguguugggaagaggagcgcguccccggggaaaugaggugggagagggacaaaugugcgugugggugugcgaguugggacuuuggcgggcggggaggcggcccgaggacccacggcgagugggugugugucgggugacuggagggggcggcggggcugacccgcgucucuucagaggcgggcgaagguuccggggugugugugugugugugugugugugucggggguggcccggggccgggaccccagaguggcgugucccucccgcuuuguggcugcggcucccgagccucgcaggugagagcugcuccuagggggccggccggggagggcugagugagugcggcacacgcgcggcagcggggcugggagagcugcuggucggugccgcgccgcugaucccggggccgccguuccccggccgcggcaggaagcgcgccggccugcagcgcggccuaacugccugggcgcccgcccaccuccccggacgccucccgggacggcgagcccgcgcgagcccacggcgcugccucgggccugggcaggugagggucggaggcgggacucgccgauugccgucgccguggccgccuccgcgucuccugagaggcgaaggcuuauuuuggcguuccaacugcaagccuucgcccggccggcugugggacccgagggaggaaagugaaucagaacagucagucuugggaauacgcggugucguguucccuucuuuucauccuuccccuaaggcuguguggagggacugaguaaauauuuuggauuuuuguugcaaauacuuugccguugguaagauuuuuuuuuuuuuaauuagacaaacauuuucuuggaagggcugaggaagaaagggaaacuggcuuuccuggccugugggauuggauggauuuugugcauuugaaauuguuuuauccugccuccuagggggagaggcguguacgcgccgccgagcugaggagcugggugaggaagaggaaguuacuggagcugucauccugcuuaacucggucggcuauugagcuuagacuguuuagguggauuguguucagggaguuuagcugagccguuuguacacauuggaagcacaguguuacauuuuaccguauugccucuaguuaucuugucaaucaagauaggcucaacaaacauguuuuccucagucuccaaaaacuagaucaagcaaccucuguugucuacucaguaugugcugcuggaaagcuauuuugagaauagccuaagcaaaacccaguuguaaagauaaaccugcugccaauaggucuacaguacauuucagaaccaaauacaaauggcauuuggauaauuauuugcuaaugugcuuuucuacuccaaccucauuacauuuguauguaguuagaucauuuagcuagaaccgugcuguggauaaaagcauaauacaguuucgauccuuguaggccguacucugugucauggccagagauugcucuuugcaccuggucucacaaagaaauaguguaugcuguucacggggaaguggagggaagagaaggaggggcgaagagcuguucucuauuaccacuacuggaaaaacaauuuaacauacguaguuagugggaaaaggacuuguuuuacagacuucaguuagccucccagcugugugauuuuuccuuagcuguuugaccuuagguaacauaucuauaagccacaguuuuaucagucacagagagcuaauaccuuuauaguaaggucguuuugagaauagaaugagaaaacauauguuuggcauguaguagaugcuuaguuaaauuuuaguucugccuccugcagcccugacuaugggcauugaagaaccuuugcaaacacaaauaugauuaauuauuuagagcaauauuaaguaacuauaacguaaaaaagacaauggaaucuuucagagcccuucaguauacaaaagguauauauauaaacuuuaauguauauaagaaguuuuuuucuaauaauaaaaauagucauuaaaauagccuaguuauuuauaaaaauagucauacuuaauuuuuuuuucauauuuucaaauagaccaucucucaguuucauuauucuuuaugauuuucguuuuguagcccuggaaaaaaauuuucaaccucuauauagcacauguauguuucaauacaguuaaacauuaaaaaggaucaaggaaccaaaauuuagauagauccccaaaguuuaaaugcuacgaaaaaugcuagcucauguugacugauuugguaaauaaaacuucuuagaauauuucucugaauauaagguaaaauccucuguccacuuaauuuucaauaacuuuccauuuuuaguauuuucucuggaguaggaaauguguucauuaaauuuuaacugcuguguggaaaaaauaaugucauggagagguauggaauuuaagguaaagauaacagaaaaguuaacauaaagauuguuuucuuuuuguuuugggaaaagacaggacagagaaugugggaguuugauugguuuaaguuugucauggcccuauuuacaaaugccggguuucccaguagggcuuacguaauuuauuuguaucaauaaugauaagcuuuaaaaaauauuauuuucuaaaauucaaacuaaaauuucaacacauucaguauagcuuuuaugcauauuuuuauauaaaaauuucugugaagguaagagucacaggauggggagggggaagcucucaucauugaggggcuugaauuuuuauaaauaacuaggggcaacuauuagaaugcaaauugugauuuucuuaaaguguguguugugggaguguguauuuacauugaacagaaucuucugccaugugguuauauuuaaaggaauaauucuuaccuuaaaacuauaaaugauacuuuuuaauaccuuagaaacaaagaaauagaaaugaaucugcucuuauuuaguauuugguaaaguaauuuucauuggacuuuaugaauuauuuuaaaagacuuuauauauauauuuuuuaauuugggagaauugggaagaacauuucccuguaguaaucaugaaaacagaugauauugaacuauaaagauauuuggauaugaaguggaaguacuaagguuauuauuuagacuaaaggaauuauguuacaacaaaaucaagguggaaacuuguuuagauuuuaaaaguuaauguuacuuaaaugggcuuuuaagcaaucuuuccaaaauaucuguuauuaaugucuuuaauuugggagaauuggaauacuuaggaauuucuguauguauuacuuuggguaaugcuaaucagaguaauaaauacauuccaaaauuucaaagaaguuuacuugcuuucaugacaguuccagugcagauguuuacuugcuuucaugacaguuuacuugcuuucaugacaguuccagugcaggugcuccugguuagcagguuucuuguggcuuuccucuuauguuguuuagggacucauacaacuuagaucuugugacuccaccauuucuuagggccuuggaguccucccuauugccugaagaccauuucuuaagaaacuccagacuuaaaugacaaacauuccuccaaauuuuauuggcaagauuugucacagagucuuauuugaaugcaaggggagugggaaaugucccuggcagguggaaagcuuggccaucucugcuacaaggggcauuucaugguguuauuuuagauguuagcauauauuuaugaaauuacauccaaaaggugaauuaugauaguuaggaauugcuuuccaucuucaaagaguaaaauugggugugaguggagagugguggggagaggagaaaggagggaagagucacaggagugggagggggaagcucucaucacugaggggcuuaaaugacaagugaguuucuguaacuauuuaaagauauaaauuuuucagagaacauuacaguuggauucuguaaccuuuagugggucucuccuguaguauccaguuauugauugucauugugcuuuaaugaguucuggcaguuugaguuauuucucuuuguauuuugaaaucaguucagaucaguaggacaaaacucugaauuucaguuucuggguauaguuucauaggaaacacauuuuuugaauuuucuuccucuguuauugggauaggugaugaagauuacuuuauacuuugagggaaaucucauuuagguggaccuuaccauauucucuuguuuguugcugcaguuuuuauaauucuaaaguuauuaaaauuaauacaugugagccuuaacccagaaagaccaauaaaaucaucaaguaaacaacagaggcuuaauuauuaauuugugcucaugcuuugugaugaaaauacuacaacuuucuuuuacuaacugcacugacacuggaccucuaauacaguaaaugguauuuuaucacuggacaacuuuaauugaaucacaauuuauucuaugauugugcagguuuauuauaaugugaaacuucagcucugugucaccuuuacuuauuuuuuauucuaagaguuugguuagggaucucuggggaguuauauauaaucucuuuauuucccaaagggaagauuuuggaauagucugguuaacuucuccaugguaaauacuucucuaacaucuugcaucuugaaaauugaaaaccuaaucugaggacccacugugcaccuauuauuguacccaguucuaaagagaaguaugaaagauguagaggcuuauaguuugugaguaagggaaauaaagcauguaauuuaguuauuucaaaacaaaugaacuagugcaagucaauaugauauaaacuguuuauagacauucugagacauaaaauggaaugucaauugggucaggaauuacuuaaaggguugcuuuuuuuuggacaacuuuuaugagguauaauuuagauaccuuagaaguauccauuuaaauuguacaacucaguaguuuuuaguauauuaacaauugugcaaccaucaccauaguuaauuuuagaacauuuucauuaccuaaaauauaaauccuguaucuuucaagagucacccuucauucucuuaugccccuaguucuaggcaauuacuacuuccuuucucuauagauuuggccaauuuuggacauuuuguacaaaugcaaucuuaauauauggucguuuaugauaagcauauuucacuuaccguguuuucacgguucauccgugucauagcaaguauuucauucuuguaauggcugaauaguaugucagcauaagaauacaccacauuuaucuuauucaugagcugauggacauagacuuuuuggcuaucauuauaaaucaugccgcugugaacauucauguacaaguucuuauguauguauguuuugaauucuuuuggguguguaccuaagaguggaauugcuggaacauauaccacuuuguguuuaaacuuuugaggaacuucuagacugcuuuccaaagcagucgcaguauuuuacauuuccaucagcaguguaugagagcucuaauuuauccacuucaugccaacaauuguuauuaucuccuuuuuucaucauaguucuucuagcaggugugauuugauccugguuuugauuugcauuucccugauggcuaaugaugcuuuuuaugugcuguuggacauuuguauauccucuuuggagagaagugugugaaaagacucaaauucuuugcccauuuuuauaaugaguuuuuuaauuauugaguuguaagagucuuuuuuauacucuagaugugucccuuauauaugauuugcaaauauuuuccuccauuuugugaguugucuuuucauuuuccugauggugucauuugaggcacaaacguuuuuagcuugaugaagugaaauucuuguuauuauuuuugcugugcuuuuggugucguaucuaagaaauaaugacuucuuguuucuaaucuagcuaaucuaucuaauauaucuauuucuaaucuauaucuaaucuauuucuaaucuaucuaauauaucuaaucuaaggccacagauauuuacuucccuguuuuguccugagaguuuuauagccuuaacucuuacauuuagaucuuugauccauuuugaauuaauuucuguacauggucuguuguagaagucuaauaucucuuugccuguggguacuuaguugccccaguaccauuuauugaaaagacuguucuuucuccauugaauuguaucaucaccccuguccaaaauuaauuaacuguaaguguggaggauuuauuucuggacuuuuaauucuauuucauugauuuauauguuuauccuuauacuaguauggucuugacuacuguagcuuuguaauugagaggucugaguccucaaaccucucaaaguuuuuccuuuugagaagaaaaaaugaaaaacucuuuuuuucuuuuucaagauuguuuuggcuauuugaaucucuuguguuuccauaucaauuuuaggaucagcuugucaguuucugcaaagaagucagcuggaauuuugauggggauuguguuaaaucuguacaucaauuuugggaccauugccaucugaauauuagggcuuccuguccaugaacaugggauguuuuucuauuuauuuagaucgucuuuaagugucaacaguguuucauaguuuucagaauauaaguuucauacuucuguugcugcauuucuucccaaguauuuuauucuuccagaugauauuguaaauggaauuaaaaaaaauuugggggguuuuugcaugacaagugcauaaaaauacacuugauuuauguuuguugaucucguauccuccaaccuugcugaauuucuuaguucuaauaguuuuuuuuuucuuuuuuuuuugagauggagucucacucugucgcccaggcuggagugcaauggcacugucuuggcucacuacaaccucugccuccuggguucaagugauucuccagccucagcuuccugagcagcugggauuacaggugccugccaccaugccuggcuaauuucuguauuuuuaguagagaugggguuucacuguguuggccaggcuggucuugccgaccucgugauccaccugccucagccucccaaagugcagggauuacaggugugagucacugcacccggccaguucuaauaguuuuuaaguggauuccauaagauuuucuacauacaaauaucaugucaccugcaaacaaaugaaguuucaauucugcuuuuccaauauggaugcauuuuaguuccuuuucuugcuuaauugcccuggauagaaccuccagaacauuacugaaaagaaaugucaagagaagucacuugaguugcagcaauccuugucuuguucccagucuuagggggaaaacauuccaucuucugccauuaaguagauguuagcugugauuuuuuuuuuuuuuuuuuuuaaacugcuccuugcggagaaaggcuagcccauaggcaggcagugugcggaaaguagugagcuauaaguuuuucauuaauagccuuuaucagguugaggaaguucauuuccuagauuguugaguguuuguuugugugaguguguguguuugugagagaguguuaggauugaguuuugagagaauugugaaauguggauuagaaaaauaaagaugcuaugucagguaauaaggggcagauaauaaugcuuaucuugcuggaggaagaggggcuagauuuuccucuuuuucccucucccuuucuuccccauuccuuucuuguuuuuguuuugagacggagucuugcucuaucgcccagucuggagugcaguggccugaucucagcucacugcaaccuccgccucccagguucaagugauucuccugccucagccucuugagaagcugggacuacaggcuaauuuuuguacuuuuaguagagacgggauuuuguacuuuuaguagagaucacuauguuggccaggcuggucucgaacuccugaccuugugaucugcccgccucagcugcccaaagugcugggauuacaggugugagccaccgcgcccgacccuuucuugaucuuuaaucaucuucccaucaguccacaugcacauuuggagagcacuuaaucuuuuacugaucuguauaauuaagauuuuuugagcaguggaaguauccuuucuuuugaaaaauacuaaaaauuguguggagaauuucuuacugaauagcuugauagcuagguuuggagggcaucagagaagauacuaaaucauaaaugaagugccaaccauggacuuacaaagaagugaacacaguggaauacuucagccauaaagaaugaaauccgucuucaaaaagaauggaauccugucauucuuggcaacuuggauggaacuagaggacacuguguuaaguggaauaagccaggaacagaaagguaaaacaccacguauucucacuucuagguggaagccaaaaaaagucgaucucuuagaaguaaaaaguagaaaagaggauucuagaggcuggaaaggguagggggaagagggcuagggagagagauuguuaaaggguacaaaauuauagcuagaugggggaguaaguucuaguguucuguagcacuguaggaugacuauaguuaacaauauuauuauguaguuucaaauagcuaggaggaaaauauugaauguuccaaaugcaaagaaaugauacauguuugagaugauggauaugcugauuaccuugaucugaucgcuacacauuguauguauggaaacaucacuguguaucccauauauauauacaauuaugugccaauuaaaaaauuuaaaaaguaagcaaaccuuugccauauuggggguaugguuaauaaaaaauuuuauguuuaguuuaauguacuuugaaucuagcugucagcugacauucucccacccuaaacauuucagcaucaauggcuuuguuuuuacaaguuuucuuuauaauuuucuaaaaaauuuaacaaauuucauaugaaacuuugcucaguaagguaaaguuguguuucacuuugauguggugauuacccuuuguuuacuuuuugaaauuuuaauuguguucccaugcauccacauucugaucagauaaauauuuuuaaaaauuuuuauuuuugucuuucauguauaguucucagaaguuaagauaacuuugaguuuagcuaagaauauuccuguuaacaggugaaauuggaaagugguaauagaauuuuuguuuuguaacagguuuauuaguuuucauuauuuuuaguccgcuuuaaaauuuugauacagauacaauuuauuauuauuuuuaaagaaauaaguagucuaauaaauaagacaaaugagaaacucgucauuuguacugaauagaugccugguaauuuggggcuuucaaauauuguuuucauuuauuaacaauugaaauuggugacacaaaauagagauuaaaacacuuuauguuccuuauauucaucuuuugcagagagaaccucccucucuaaucuuaaaguuuaaacucuauuuuucucuuucccauauuacuuaaauagauuuccuaaaugaguaacauaaauuagaguuacauaauaccagcuacaaauacugcuaaaagaauagaacuaaauuuaguauaucccaaccuuaaugucucucuauacaaagacuuuguuggaaucucauauauccauugcuuucugaucauaauguuuaucauauuuaacaaagcaaaacucagaaauuacuuaacaggguauauucuucuauagguucauauuuaguacaaucuucugcaauaucuacauauaauuuuaugaaacaacauaaugugaguuauauacagaaugguagccuugaaacacugucagaauuugaaucaccaaaauauaaccuguuaauuaauauuuauuaagcuucuauuuguuauagacuauuguauucaggguucuggggaauaaaaagaaauguagaauaaucuuucuaccagggaauggagcuaauauuuuuuugacuacugaguaccaaggaaugugaaaagccacuccccuccuucccuuuaaauguguaaucuaaauuauucuucaugaaaauccuaugagagaggcaguaugauucucauucugaagcugguuaagaaagugagccuuggguccuccacuuuccagcucuacggaaacucauuuaacuucucuaugcuucaguuuucucaucuguaauagggagauaauauuccuuaucucguagaguuuugugaggauuaaaugauguaguccuguaaaguauuuaggacacuaccuggcacaucuguaguaaaaaaccaaacuaaaaaacaauacacguacacuauuacuguuucuuauuaggaaagaaguuaauuaacgugcccaagauuacaaccagaucuauuugaauuuaaaacacucuuauacuauaaugcuuacauuuauaggauguuuaagucuggaucuaguaaacaggugaaggcagaauaugcuaagugacuaacauuaagugcuaugacauacagaguacauauggauuuuaaacuacagggauaaguaagagaggagauagauguugcucuugccuuuaugaugagaaaaaaggcagggaaaaaauuaauagacuacuguaauaucuuccuugcuagucuacaacuuccauuauaucuccuuuaacaucuuuuccuuuguacacauugucaccagagaaauccuuguaaaauucaucccacauugcuuaaauucucugcuuacaguccuuuaauaauaauaguuacuguuuucugguuaccuacugugggcuaggauaggagacagcaagcuucucuucuuuucucuucucuuuuuuuuuuuuuuuuuuugagauggcagagucccacucucacccaggcuggagugcaguggcacgaucucagcucacugcaaccuccaccucccagguucaagcgauucuccugccucagccucccgagaagcugggauuacaggcgcacaccaccacacccggcuaauuuuuguauuuuuaguggagaugggguuucaccacguuggccaggcuggucucgaacuccugaccucaaaugauccaccugccucagccucccaaaguguugggauuacaggaaugagccaccucgccaggccuagcaagcuuuuuucuaugaagggacagauguaaauauuuuggcuuuuugggucaugcaagaucucuguugcauauucuuuuuugcuguaauuuuuuuguuuuuuaacaauccuuuaauuuuuguuguaauucuuuuuucacaauccuuuaaaaauguaaaaaccauucuuugcugccaaaucagucuggaugcagcuuauugacugaccccuaugcaaggagauuuacgugaacuaacucauuucuucuuguaacaauccugguaaaguugauauuauuucuacuucacaguugaggaaauugaagcuuagagaggcagauuugaugaaggucaaguaagugacagauugaggccauuggaauaccuaaaccuguguacuuccuaagauaucuugcugcuuccuauuacuuuuaaauaagaugcaaauuucuuagcauuauguguaaggcccuugaugaucuugucuuugcuuacuuuucuaguuuucguauuuguuacuacucucucucacauauucccuagccuagcuguagugagugacuuacagcguggucugugcuuuauauaugccuacaauaccuuauacuuuaugaccucauugauuucuuuaauaaucugccucugguacuuccuacuuugggaaaccuuacuugguacuuguaguccuugcuuuaugaacuuuuucugugcuccucuagcauucugugcauucuucauucauaacacuuacuacauugccuuguguuuaacuuggguuuaugucuccguuuugcguuagacugugaguuuuuuuuuuaagagauggagauuuugcuauguugcccgggcugaccuugcauuccugagcucaacagauccucucccuguagccuuagauuguaggauuuuuuuuuuuuuuuuugagauggagucucacucugucgccaugcuggaaugcaguggcgcgaucucggcucacugcaaccucugacucccugguucaagcgauucuccugccucagccucccgaguagcugggauuacaggcacacaccaccaugcccagcuaaccaaggcaggcggaucaccaggucaggagaucgagaccauccuggccaacauggugaaauccccucucuauuaaaaauacaaaagauugugagguuuuuaagggcauagaugauauaugccuuaccuuuguagcucaaguguuugauacauaguaggggcuuaauacagaguuuggcauauaguugggaauuugaaaguguuuauuaaaugaaugaauaauuaaauggcauuacagacauggaaaucauaucagcagaucuauaguugcagaaaaaugaguccagguucaggggugguggugagugggaaaguaaguaaauuucugguuaacuucuagggcucgagugggaacaugagguuaauaaggcaaauuggagaaugaucguggaggggcuugaauaucuugguaaggaauuuuaauuuuguucuggagucauugauacaaagcuuucaacucuagagcagcagguguuuuuuaaauccauaacuuggguucucuuaauacacaaauuguauguuguaauauugcuuuagguauuuuauagaacauucauuaccuaaacaauuguuuugauuaauagauacugcaagauguagcucuagaauaucauaauuaucaguacuacuauuaaagacauugggaaccauggaaugauuuugaacagguugguggcaguuugaaauuaaucuuuuuuuuuuuuugagacagaguuuugcucuuguugccuaggcuggagugcaguggcacgaucuugguucacugcaaccuccgccucccagguucaagcgauucuccugucucagccuccugaguaccugggauuacaggcaugcgccaccacgcccggcuaauuuuguauuuuuaguagagaugggguuucuccauguuggucaggcuggucucgaacucccaaucucaggugauccgccggccucagccucccaaagugcugggauuauaggcgugagucacugugcccggccugaaguuaauuuuuuaagauuaaucuaguugagguauucaccaucaguugaggagaugggacugggaagaaggaggccuuuuaaaaaaaguuaaaauauaaagugauaagucaaugauugacuaugaggaagucagagacgaaugagaaaaacggaagaggcaggucaaggaaggaaauuguguauuuuauguugguuaaauugauuacugugaauucuauuggagugauuucuaucguugccugaauuugggcucugcuuacuuuaugcuugaauaauuagaauacucuuaugauugguuucccuuccuguugcuaauucauggauucuuaaucuuuggugcuguggaccuuucuucagucuggagaaggcugugaauccaauguagaaugacaauuuuaaaugagugaaauaaaguaaauaggacuugaaaggaacuuguuauauugaaaugccaaaauaugauauaguaauauauaugcuucucuacuaauacuguuaaguaacgucuugcaaugagucuaauagcuaccauaauuuuguaauacugguacauauagauauuuugagauuucuguaacaacuauaauaugaaaugaaaauguacuucuguuagugacagaaaucacagguacugcuaauacuauuaugguugauuguuuagguuugugugaaaauuuuagagauuagugaaaauggugauguaauuuuuuuucuauauaaauucacagguuuccugagauuuauggaaccuagguuaauuaccuuugcuuguacuagcuccuguuuuacucuucuucuguguauuuuugucauaguaauguacuuuucuuugcagaugguaguauuuuuauugcaucaugucuguuuugggaaauaauauguacucuuuguaaaaaaaaauucaaaugguaauaaaacgcauaauuuucugguuauccugcuucauggcgaucaagcuuguuagcaguauaauauauacaguaguuucuugguauagagaggauuggcuccaugacccuuguguaugccuaaauccaugcauacauacucagguccugccauguauaugaaaaauuggcccucuauauacauggguuucucaucucacaagugcuauauuuuccaucuguguuugguuaaaaaaaaucuccacgagugaaccugugcaguucaaacccauguuguucaaggcuaagugguaguacuguuaccuguuucuggucaauauauacuuacauaaccacaaaaacauaacuaaaauagguucauacuguguauacuuuuuuaaaaauuugcuuuuuuuucauuugaaaacaucuuuuuucauuaauaaauacaccucaugcuuuaaaaaauuguaggaugaaaguugagauauguauuacauaacacaaacauucaccauuuuaaaguguauauuuuagugguuuuaguacauucaguauguugccaaccaccacuacaagcaaauuccagaacauuuccaucacccacaaaagaaaccucauauuuuaugucaguuaguuccaguuaccccauccauugacaauuucuggucuacuuucugucucuauggauuugcuucuucuagucauuuaauauaaguagaaucauauaauaugugacugugucugcuuuuuucacuuagcauaauauuuucaagauucauguuguagcauauaacaguauuucauuccuuuuuuuuuuuuuuugagauggggucuugcugcaucacccaggcuggagugcaguggcacgauaccgguucaccacagccuccgccucccagguucaagcaguucuccugccuaagccuccugaguagcugggauuacaggagcccaccaccacgccuggcucauuuuuuguauuuuuaguagagacgguguuucaccauguuggccaggcuggucucaaacuccugacuucaggugaucugcccaccuuggccucccaaagugcugggauuacaggcaugaaccacugugcccggccaauauuucauuccuuuuuaugagugaacaauauauuauuauacauacuugguuauuauaaauaauucauguauaugguuuugugaagacguauguuuucauuucucuuggguguauaccuaagaguggaauugcugggucauacguauuucuguguuuuaacuuuuugaggaauugacaaacuuuuccacaguagcagcgcuguuuuacauuuccacaccucacgcuuuuuucuuuuuuuuuugagacggaauuucgcucuuguugacaggcuggagugcaauagcaugaucucggcucacugcagccuuggccucccggguucaagcgauucuccugccucagccucccgaguagcugggauuacuggcaugugccaccacacccggcuaauuuuguauuuuugguggagaugggguuucuccauguuggucaggcuggucuugaacugccguucucagguuaucuaccugccucggccucucaaagugaugggauuauaggcaugagcaaccgcaccugcccuaccuccugcuuuuuaauggcuucauuguaauccauuuuauugauguccugucauucaguccccuguugauugacaauuuauuucuguauuuuugaugauuaucaacacuaaugcagugaaaaaacuuguauaaacaccuuuugcacacuuuuuuaaaguauaaauuuuuaggaaaggaauugcuggaucaaaguaauuacacauuuaauauuugauacaucuugucagauugcccuuuagaaauguuuuauaaaauuuuacucccaacaauugugugauguaugcuuauuuucucaaacucauauucacauaauuaauuuuugucauuuuaauaacaaaaagucauacauauuuuaaauuuuggaauuuguuaauuauaguggagauaauuuuuuuuuucacauuuuuuuuggccacugcauucuuuugugauuugccugaucaugaccuuuacccuaaauuuuucuauugggugucucuguuuuucuuauuacuuuguuaauagcuguuuacauuuuagaaacauuaccuuauugcucauuaucaauauugcagagacuuuguuccaguuucuuguuuguuuuuugacuuuguuuaugacuuugcucuuugccuuauagacauuaaauuuuuaaaauacuguuuaucauuccuuauaaaaggucuuugccuugcuuagaauaaguuuucugcaccccaagauuauaaaauauuuucuccgcauuuucuucugggaaugucuaaaauuuggcaugauuuaguagaagcuugguuuuuguaguuggucuuaacuauguucagauucccgucuagccacuuacuagcugugagguguuagaugucugcacaacuucucuguaucucaccuuccucaucuguaaaaugauaguugauaauuagggucuaugcuuuugguuaaguuaaaugcaauaauucaaauucucuagcauaccaucuggccacauacuggguguucagugcauguuuucuuuucucucucacccauaaacuccaucuucuaucagucuaguuaaaaucugguccagaagauaagggaggggaaaguuucaagaaauaauguugcccuuaguuuucaaagucagagaagccaugugggaugaguacugucugaaaaggagauugaaaauucauuuaguaauuaggaaguaauuuauguuuaaugaaaacauuuuuuaguagcaugauaagaggcauauuuuaauacaaagaagacuaaaaccuauauaacauaccuaaaggauaugugcauaugcaacauguauccaucaugauuuguaauauuugggagaaauaguuguaacucuacucuucuuauuguuggaauacugguaagaggauagagaaucaaugcugacauacaguauauuuauauuguauguauaagguguacauaaauuuagguaauuuuuacuauuaauaguuacaaauuacuguauuuguaacacaccucacaaucaucaaccuguauuagaacuacugcuccauuggaaucuucuuaguagcauuauaauggacuuuaauggaauuuacacauauucuucacuaaauuaaaauuauguauaaacuguuauauuucuuuuggggaaagcaacuuuaaauacauuuuagaaagaaaugggaaauaaauguuuacaacaugguagucauuguuuacauuuuucucaucuuguuuccuggacuaugaggauuuuaggacagggggacauaguuuuugcuauauugcccaggcuggaauacaguggcuauucacagaugugaccauaguuugcuauagccucgggcuccugacuucaagcaguccuccugccucagcuucugaguagcugggacuacaggcacaugcaaggugcauggcuuauaauggguuuuugauaaauauuuauaaaauguuucauucucccccccccccaauuuuuaucuucugguaaaauaacuucaaaauaaagguuuuaaaauuuguuaagaaaaauaaauauuccucaaguggaguaauaauagacauggauucugugcaauuuguuuucagaaaauuauaucaaacuguauuccuugacucuuaguaacugucuaaaaauuuuuuuugguauguuacauguauacugucauuauuuugucagcuucaaaacaagaaggaaauuauucuguauugguuagcucaggaggaagguaaugaguuuuaaguaacaaaacaggaaauuagcuccucugugaccuuugaugaguuugugaagcuggcguugugagugcaggauugaaauugugaagagcauuauauuuaguuugcuuuguugcuuuugcagaguaucuauuugccaggaaaaccuaggaauugaaguuaaagacucugcuaccuuugugggaaaugaacaauacucuuccuucugcuggcaaaaucugggugucuacuuuucaguggcugguuuuugcuuucacguagggucagaguauccuuuuccuggaaccaagcuugacucaaagccauuguaaguucucuuguucuuuauccuucuaaucaacuauuuuaggagcaauuuuaaaguugacacccuuucccuucuaaccuuucugcucaauacaaagcaccaccuucuuggcagucauuuauaugaguagaguggauacuuuuguaggcauuuuauucaugccaaaaaguuaaggguuagcucuuuguuuaaugcuaguuguuuuggaucagugugagucagcauuggccuuaacuuucuuuuacauccuuuuguaauuaagauguugguaccuuggaacccucuccuggauggagcuuuucuuuauacuuuaucaaguuuuauuucagacaguugggcuacuaagauuuuucuguuuuacucuacuguuuuuaauggagacuuguagauuucagauauggcuuauacacauucuaaacccugcuucucagaauagucauacuaguuuuaacaccucuuuacacaacuuuuauguuuaucuaacauuaaaauauuguauaauuugguucaguucaaaaguaugggauggcuguuacagcuauucagacuuucauauuguucaaaacuuuguauacaagacuuuauuuuuuuuaauuuuuuuuuuaagagacagggucuugcuuugucgcucacaggcuggagugcagugguguaauuauaagcucauugaccuccugggcucaaguaauccuccuaucuaagccucccaagaagcuggugcucacucacagucacaugcuacugugccuggcuacuuuaaaaaaaaaaauuuuuuuugguagaguuagggucucacuauguugcccaggcuggccuugaacgccugggcucaagcaguccucccaccuuggccuccgaaagugcugggauuauaggugugagccauaauaccuggccuuuguguaagacuuaauuuaaaauauuuuccugaagaaauagaaaagcuaaaguaauuagcuuuaugaaaaggauucauuaguucaguuuuugauacuaucaaguucaguuuucugguaauuaaaaccaauuucuugaauuaguuuuuuuuuuugauggaguauaacaugcuuaguuuuauguacaggugauuguuuauauaaacagauauuaaauuugugaaaaaauacucaauucuuggauuugccauguacuaccagagaggcagagcccgaaauuggaagguaggaaaaggaaaaagaugaaggauuucauaugaaguguuagaauguuacuucaguuuuuuuccacauuaaaacauggacuaaaucuacuuuuucuagaggauuuguuacuuugaaugaaagagcucucauacacuuggcuuauaauagaugauaugugauccuuuuacagguacccuugcaacuucuuaguuugggucugaacauguuccuuuuuuuuuuuuuuuuuuugagauggaguuucacuccccucaccuaggcuggagugcaauggcacaaucucagcucacugcaaccucugccuccugaguucaggcaauucuccugucucaccuccugaauagcugggauuacaggcgcccaccaccacgcccagcuaauuuuuguauuuuuaguagaaacgggguuucaccauguuggccaggcuagucucgaacucuugaccucaggugauccaccugccucggucuccgaaagugcugggauuacaggcgugaaccaccacacccauccugaacauauuacuuuugaccuuguuuauacuagccuaggcuggagugcaguggcauuagcgugguucacugcagccucaaccuccugggcucaagugaucuuccugagcaguugggacuacaggugcgugccaccauucccagcaaaguuuguuuuuuguagaaacagggacuugauguguugcccaggcuggucuugaacuacuggccugaaacaauccucucaccuuggccuccgaaaguguugggauuacagucaugagccacugugccuggccuguucaacaguuuccaguuuugggcuguuauaaauaaagcucuaagaacauuugaguucaguuuaaucuuugggugaacaaauguuuucauuuaucuuggguaaauaucuaggaguggaaugucugggucauaugguagcugcauauuuaacuuuuuuucuuuuuuugagauagggucuugcuccuucacucaggcuggaaugcaguugugugaucauggcacacucuagccuugaccucccaggcucaagcaauccuaccucggcugccuuaguagcugggaucacaggugcacaccaccaugccuggcuauuuuuuuuuuuuaauugaaauggggucuaacuauguugcccaggcucauguugaacuccuggcucaagcaauccucccaccucggccucccaaaguguugcaauuauacgugugagccaccgugccuggccuguuuaccuuuuuaagaaaccuucaaacuuucucccaaaguuguagcauuuugcauucucaucuuuaguguaugaaaguuccgguuguuuucuuggcucgguuuuuuaaaaacuuagccauucuaauaggccaaaguauagaguagaaucucauugugguuuaauuuucacuucucuaaugacuaaagcaucuuauguacuuuuuuaccaucaauauaucuucuuuggugaagugucuauuaaaauguuuugcccauuagaaauuuuuuuuauuacugaauuuugacaguucuuuauguuggauauacauucuuuaucauauacaugauuuguaaauauuuuuucccaguguguggguuauuuucuuuuuuuaaaaaaauuauuuauuuguuuuagagacaagaucucaaucuguugucaaggcaggagugcaaugguacgaucauagcucacugcagccucugggcucaagcaguccuccugccucagccuccugaguaacuaggacuauaggcuccuggcugauuuuguauuacuuuguaaagacggggucuugcuauauuugcccaggcuggucuugaacuccuggucucaagugcuucuccuuccuuggccucccaaaauguugggauuacagacaggagccaccaugccuagccuauuuuccuaauaauguuuuucaaggagcaaaaguucuugaaagucuaauuuaucaauuuuuuguuuuauggaucaugcuuuuguuuugguguugaagauauccuugcgaaacucauagucaccaagguuuucuccuguguuuucuucuagauauuuuauaauuuuggcucuuaaauuuaggccugugauccauguugaacauagaguagucccacccuuauuuguggaggauauauauuccaagacccucaguggaugccuaaaacugcaguuaccacaugaauuucuguuuccuucuucacaaugucauagguggaagauuaauucuuaccauugauuuuggcaaccucacuauacgauuuuuuucuucccuuauuaaauugagaauuuucaccauuucacuuaaaaaggaagccccuuaugguuucuuuuuggcauaccugaauuuccagcaucacuacucuugugcuuuggggccauuauuaaguaaaauaaggguuucuuaaacacacugugagacugacagucugauaacugagauagauacugauugacuaauaggcagguauacuaaacagugugaauaugcuggacaaagggaugaaucauguccaagcaggacugaaagagacagcaggagauuucaucacacuacucagacuggcacacaauuuaaaacuugugaauuguuuauuucuggaauuuuccauuuaauaucuuuugacccuguuggcuacagguuacaaacugcagugaaacuguagauaagggacagagauggggggcuacuguguuuuuguuuuuuuuuuauauaguaugagguaaaguuugagguucguuuguuuaaaauaugguaaucuaauugcucuaccacuauuaguuagagauuauccuccccagugaauauccuuggcaguuuuuuuuuuuuuuuuuuuuuuuugagacaaggucuuccucugucaggcuggagugcaguggcaccaucacggcucacugcagcggcaccaucauggcucacugcagccuggaccucccaggcucaagugauccucucaucccagccucccaaguaguuaagaccacagggacaccaccaugcccagcuaauuuuuuuguauuucucuguuagacaugggguuuugccauguuguccaggcuggucucgaacuccugaggucaggcagucugccuuccuugcccucccaaaguggugggauuacaggcaugagccaccacaccuggcguccuuggcaguuuuguugaaaauuaauugaccauguauguuuguguuuguuucuagacucuguucucuugauguuaaucuuugucaguaccuuauugccaugauuacugaagcuuuguaauaacucuugaaauuacguaguucuguuagucuguucucacacugcuguaaaaaauaccugagacuggguaauuuaugaagaaaagaaguuuaauugacuccugguucgcaggcaagaagcaugacugggaggccucaggaaacguagaaucauggcagaaggugaaggggaagcaagcaugucuuagcauggcagagcaggagagagaguguagggggaagugccacacauccccuucaagcaacaaucucuaaugagaacucacuaucacaagaaaaagcaagggagaaguccucccccaugauucaaucacuucccaccaagcaccucccccaacacauagggauugcaauuugagaugauauuugaguggggacccagagccagaccauaucaauaguguaaauccuccaauuuuauuuuucuuuuucaaaguuguuucagcguuagcuuuucuaggcccuuggaauuuccauauauauuuuagaauaagcauguuaauuucuauaaaaaaaaaaugucaugaggggaacagggcugaacaacuaccuauuagauauuaugcuuacuaccugggugaugccaucauucauacccuaaaccccagcaucaugcaauauacccauguaacaagccugcauguguacucccugaaucuaaaauaaaagcugaaauuauuaaagauaaaaggaaagaaaaaagaucacuuucaaugaauaaaaaaaaaccaccuuagguauuucacugggauuguguuaaauuuguagaucauuuggggaagaauaacaucuuaauauugauucuucugacccaugaauauaagguaugucuucauuuauuuaguucuuuaauuuuucucaguaauguguuauaguuuccaguguacugguguauuaguccagucucacacugcuguaaaaacauaccugagacuggguaauuuauaaagagaagaggcuuaaucagcucaugguucugugggccccguacagacuucugcuucuggggaggccucagaagacuuaacaaucaugguggaaggugaaggggaagcaggcacauccucacaaggccagcaggagagagacagaaagaacaggagugaagggggaagugccacacacuuuucaaauaaccagcugucuuaagaacucugucaugagaacagcaagggagaagucuguccccaugauucagucaccucccaccaggccccuccuccaacacuaggaaccacaacuggacaugagacuuggguguggacacagagcuaaaccaugucaacugguuugcacaucuguuuucauauuaaucucuauuuuuuuaugucauuguaaaugauacuuuaaaaaauuuuacuggccgggugcaguggcucacaccuguaaucucagcacuuugggaggccgagguggguggaucaccugaggucaggagcucgagaccagccugaccaccauggagaaaccccgucucuacuaaaaauacaaaauuagccagccgugguggcgcaugucuguaaucucagcuacucaggaggcugaggcagaagaaucacuugaaccugggaggcagagguugcagugagccgagauggugccauugcacuccagccuaggcaacaagagggaaagugucucaaaaaaaaaaaaaaaaagaaaaauuucuuuuuuacuuuugcuuguuaccuguauguagaaauaaauacacuugauuuuuuugcaggggacauauuaaucuuguauucuguuaccuguuaaaucuauucauuaauucuguuagauuuuuuguagauucuauaggauuuuuuacauauauauaauuuauuguuugugaauaaacaugaguuuaauucuuccuuccagucuccaugacuuuuauaucuucucucuugcuugauugcaugggcuagaacuucuggugucugguguaaacuucaauagaagugagagcuaacauccuugcccuguuucugaucuuaggagaaaagcauucagaauuucaccauuaauguuagcuauagauuuuucauugaugccauuuaucaggcuaaguaaauucacuuuuauuuuuuaaaugaagguuuucuuuuuaaauaggaauggccauuggauuuuucagaugcuuuuuauguaucuauugagaugaucauguguauucuuuuaaguuucuuaauaggugguuuuuauuauuuugaacguuaaaucaaccuugcuugcauuacugggguagucaccacuugguauaaugauggaucacucuuuuuuuuauauugcuggauuuaauuugcuaaacuucaaaaaagacuuuauuugcauuuauguucaugaaguccauaguuuucuugcacucuuguuucauuugauauuaggguaauguuugccucaacuuuauggaagaguuuauguggaauugguauuguuucuuccauaaaggccaaccaagguugagaacuaccagacuauaagacuauaaucucucuuuccuucuauuucuaaaaucuuuuuuuuuuuuuuuuuuuuuuuuuugagacagagucuuacucuguugccaggcuugagugcaguggugcgaucugggcucacugcaaccuccgccuucuggguucaagcaauucuccugccucacccucccaaguaacugggauuacaggugcccacuaccaugcccggcuaauuuuuuguauuuuuaguagaggugggguuuuacuauguuggccaggcuggucucgaaccccugaccucaguugaucuacccgccgcagcuucccauagugcugggauuacagguguuagccacugcgcccagcuggcuauauaaaauuaacaaaaauuguuuuacaauuuuuaaguuucaugggagacauuuuaguaaaauuuauaacgcauauaccuguacacucuuacugcauagaaagcuuaucugucuucuaaucuugagcaguuucuguaguaaucauguuggccaugucuuucucagcuccccuacccaacacucagaaaucaguggcugcugcuuaguacucagggaaaugcccagaauuccugucaaguuuuucucuguucuccugcucuguccucagaguuuuccaaguccaucauaagagacgggggcagcaugauguagucucugcugcugggacuguagagccagacugcuuggguuaaaucccacugugccacccacuaaccaugugaccagaggcaaauuucagaaugcgcuuaugccacucuaaaauaaagauaauuaaagcaccuccaacuuaaaaguugugauuacugacgcguaaaacacuauggauaauguuugucacaugguuggugcucauugaaugauaguuauauccuauuauuugucuccaguuggaaauugcugggaugcucagccuuugguggaauagcugucugcuucucagcauccagagauacuuuugauggcuagaauaucaucaucucuuacgaagaauuuggaaauaaauacaauucauaaccucuggcuuuuucauuucucucugacaaugauuucuuugcaugguacuugauuuucuaaaugcuuuuuucaauggauacuauacucuggacucaugcuuaggucauauuugugcagggauuuuuaaccuuagcaccauuggcauuugggacaagauauuucuuguugugggggcuguccugaguucuguagguguuuaacagcaucugugaccucugccuacuagauuccaguagcaccccugccaagccacccaaguuguguuaaccaaaaccaucucuaaacauugccaaaugucuccugaggggcagaaucacaucuggucgagagucacuuuuuuagaggggacuucaguaugugcugccauagaaaacugugauuuguuauguuaguauuucuuggagagagccaugacaguuacuaaucaauacuuucuagacuugucuuuuuuuuuuuuuuuuuuuaaggcagagucuuacucugucacccaggcuggagugcaauggcacgaucuuggcuuacugcaaccucugccuccuggguucaagcgauucuccugucucagccccucaguuagcuggaauuacaggagcaugccgccaugcccagcuaauuuuuguauuuuuaguagagacgggguuucaccauguuggccaggcuggucuugaacuccugaccucaggucaucugcccaccucagccucccaaaguacugggauuacaggugugaaccacugccuggccuauuaauuuuacuuaauauauuuuucucauauuuucaguuuagcauagcuacuugauuuaguugcugccacugggauuggucaauaagggcgucuguauuuuuuuuaauuugcugauuguucaaacugauggcuuaaaguauagaauuuuugccucuauaguugccauggauguaggcaccuagggagguuaucggugguuaacagcacccaaaucuauacuuuuuuauaugucauugcacuuugguuucaaaaagaagagacauagcuuacuuacuaaugauucuauuuaucuuaugccuagagguuguugggaaaacaaguauuuuguaucucaagacaggauguuacugcuuggggauaaucuguuauccaugggcauuuauaaaugaccuuuaggcacuucuaaacaaaguaaaguaacucuggguaauuuuauuugaauuuaaaauuauugaacagcugaugaguaaauacaguguaaaguauccuuguuuuuaaacaugcuuuugaauauauuuaugcuucaaguauauauauauguacauauauauucucugggaggaauauggucuugaaucuauaaauuaagaacaugcaguguuuccuuuagaugcaagguuuuccuuaucggaauauuuuucacaauaccaaaugauuuuuaaaauauuauggguaugugagugauuuacagucaaaaauaccuaccauuuguuguuuaaauaauacccaagcaaaaucagauuaauuuuucucaaucagaauaugaaaaaaaacuuagaaaaauaucaugaguacaacagaagaaugagccuuagagaaauuauaugcauuaguauuaggcuuauaauaacaaaacauuuuacaaaaaaccauaaauguucugcuuuugaucaaagaaaauauggauguuuaaauggacacugaacuuuuuacauacccauuuauuuugugaaucuguaaguauucuuaaacuacuuccucuacuuggcaguauuuucucauuuuauuaaucuuugcuuuuuuuuuuaaccguacacauuuguuacuuaucuugauaguuugcagauaucuuuagguaauauauagcuuucucaauguugauaacaugcuaggcuaucagaaauaugacaaagaugaugcugaagaugaugaugaugaugauuauuuggagacggagccuggcuuuguugcucaggcuggagugcaguggcgcgaucuuggcgcacugcagcucccacuucccggguuugugauuuuccugccucagcuucccgaguagcugggauuacaagugugcaccaucaugccuggcuaauuuuuuuauuuucaguauagacgguguuucaugauguuggucagucuggucuggaacuccugaccucaagugaucugcccgccucagccucccgaagugcugggauuacagguaugagccaccgcaccuggcuaacaaagauuguuuuuaaaaaugugaaaguuuuggcugggcacaguggcucaucaugccuguaaucccagcacuuuggaaagccgaggcggguggaucacgaggucaggaguguucgagaccagccuggccaagauggugaaaccucaucuuuacuaaaaaugaaaaaaaaaaaaaaaaaucagccaggcgcaguggugggcaccuguaauucuggcuacuugggaagcugaggcaggagaacucuagccugggcgacagagcaagaauccgucucaaaauuaaaaaaaaaguggggaaaguuuuuugcauaucuucaaauauagucaaaugccuuuuuauuuuuuaauuaaaaaauccuuuguaaacaacaaugagauaccaguguaccuuuuagaauggccagauccaaaacacugacaacaccaaaugccaaggaggaugcggagcaaugggaauucauugcuggugagaaugcaaaauaauauagcuaaucuggaagacaguuuggcaguuucuuacaaaacuaauaagcauacucuuaccauaugauccagccaucaugcuuuuugguauuuacccaaaugaauaaaaaacuuaugucuacacaaaaaccugcacaugaauguuuauagcagcuuuauucauaauuguccaaacuuggaagcaacccagauguccuucaguaggugaguggauaaauaaacugugguacauccagacagugauguguuauucagugcuaaaaagaaaugagcuaucaagcuaugaaaagacauggaggaaacuuaaaaugcauaauacuaaaugaaagaacccaaucugaaaagacuacacaccguaugaguccaacuaaaugacacucgggaaaaggcaaaacuauggaggcagcaaaaagaugagugauugccagggggagggggagagggaaugauaaauaggcagagcacagaggauuuuuagggcaugcuuuauauuuaaaaauuuguauguuguauuaagcagaugggaaugaauuuuuuuuuuuuuuuuuuuuuuuuuuuuuuuuuuugagacagugucuugcuuugucgcuuaggcugcaguggcacaaucaccggucacugcagcauccacuucuugggcucaagcaauccccucaccucagcuucccaaguagcugagaacauaggcacaugucacaaugcccagcuaauuuuuguauuuuuuguagagacaggguuuugccauguugcccaggcuggucucaaacuccugagcucaugccaucugcccaccucugccucccaaaguucugggauuacaggcauaauccaucaugcuuggcuuuuuuuuuugaggcgggguuucccucugucgcccaggcuggagugcaguggcaugaucauggcucacugcagccuuaaccuccugggcucaaggaaucuuccugaguagccgggacuacaggcaugcaccaccaccccagcuaauuuuauuuuuuguagagacagggucuugccauguugcccaggguggucuugaacuacuggccucaaacagcccucccaccucagccucccaaugugcuaaacaaaaaaagacugacuuuuuuuuccccuuuggcuaaaagguccuugcauuguauuugaacauuuuguuaaugagaaaauugaguugacuaaaugauugcauuggggcgggguuggggggagcguggggggagcuguguacucagcauagucaguuuguaggauaucuuaaguuuuuccuugaaaacaagcaguuagaggguuuacuaucacuuuggguuugacuaagagcuguaugauuagcuaaauaauuuaacaguuugggagacagcucugcauugaaucauucuguguuuaccuuauucuguuuuggccuaaaguccaucccauucaagcauaccaguuuuagcugcuuaaaauuaaaaaauugaaaacauuaucuucauuguagugaaauacuagugauguguggaaggggaguugguggaaaauuuaaaucaauuuauuuacuuaugaaaagagagaaaggagacuuguacugccauauagauauggcuguauuuuauuuaacuaccuuauuguugagaauaaacucuugucuuuaggcuuagguuaaauuccugaaaguggcauuauauuuuauugccuuguguuuuuuuuuuccguuuagaaugagguuaauuuuuuauauauguauuacacauuugcacuucuuucaucaauugcauauuauuauuauuauuuauuauuacuuuuuugagacagagucuugcucugucgcccaugcuggagugcaguggcauaaucuuggcucacugcagcgucugccucccagguucaagcaauucuuuugccucagccuccugaguagcugggacuacaggcacaugccaccacguccggcuaauuuuuuguauuuuaguggagaugggguuucgccguauugcccaggcuggucuugaacuccugagcucaggcaaucugccugccuuggcuucccaaagugcugggauuacaggcgugagccauggugccuggccgaauugccuauuauuauaauauguucuuucucauuuaaaaagguauuauguaaucucuuagcauguuuaaaacuguuaaccuuaucaugcaugucauacauaucuuccguauuuuacuugcuuuucauuuugucuuguauaauguacaggagguuugaauuuuuagauaaucauauaaauaugucuuuuuauguuucuauuuuuggauuccugccugaagagaucuuuucccauccaaguuuuuaaaaaacuguucgcuuacauuuuaccuuaguaugcaaaaaaauuaaaucuugaauauauucauuaaaucuuggaaugugaucgagcuauuuuaacuuacuuuuugccaaauuguggaauguagauuucccacuaauauuggaacaaaaaagaaguuuggucaaagaaaguagauuuucagauuuaugauacuaguauuggagaucauuuugaggguuuucaaacuuuaaagacaaaggauuuauugaaggcauauaucugaggcagaucaauguaguggaauuggauuagaauuccaguucugcugcuugccagcaagcuucuaaaccucuuuauauuacaguuuucugaaugcuagaauuggaauaguaauaccugcuuacaagauuguugggagaaauuaauuaagugaaauaaaguuagguaaauaacuuauauguaguagcuaguaguugguaguugcagugauggugaucauugucaucaucauuugcugcaccuaaagaaucccaaauuuagaaauagauaguguagucuccuuuaaguggauucucugaguuucaaggaagaguuugaguacacauuuuagauuugagucuugugcuaacugaaugaaucucuucacuacacuagugauuauaauuguguaugcugagaaacuggggguaaguguaaugacauugaaacgccaugcuauaguuugcuuuuaugauggcaagugacaagaguauuuuauauuuaauauaaguacagggauuuuaaggcauuuguaaugucuuuaauaaugugauagcuaaaucauuagaggauauaggcccacucagauguguaacuagaagcaauguuguugaguagaggaaaauaaaagcgaaugaaggaaggaggcaacuaggauuaguagugucaucuauuauuauuauuauuguuauuauuuuuugagacagagucucacuuuguugcccaggcuggagugcaguggcacuuucuuggcucacugcagucuccaccucccagguucaagcgauucuccugccucagccucccgaguagcuggauuauaggugcccgccaccacacccggcuguuuuuuuguauuuuuaauagagacgggguuucgccauguuggccaggccggucuugaacuccugaccucaggugauccgcccaccuuggccucccaaagugcugggauuacaggcgugagccacugcgcccggccucauuuauuauuagacucuuauggauggcaaauucuuuacaugaggaaaaugauuuauaggaaagacucaguaaaauagaagcagauuuuugaagcuuucuaucuuuacauauagaacaucaucucuccaugacucuggugauauuuuucagcaaccccugugaacagccucucuccucauauuguuuccuuuuuuaaaaauauuuuuaggccaggccuuggcucacaccuguaaucacagcacuuugggaggccaaggugggcagaucacuugagcucaggaguucaagaccagccuggggaauguggugaaauccugcuucuacaaaaaauacaaaaauuagccaggcguggggugguaugcacauauagucccagcuacuugggaggcuaaagugggagaaucacuuaacacccaggaggucaagacuccauugaaccaugacaaucccacuguacuccagccugagugacagaguaagacccugucucaaaaaaaauuuuuuuuuaauuuacuuuuauuuucuuuagcaauacagacagggucucacugugccaccaggcuggucuugaacucuuggacuuaagcacgauccuuccaccucagccucccaaagugcugggauuacaggugugagccacuaugcucagcauccucauguuauuuccucucucucucugucucucuuucuuucuuuuuuuuuagagggagucucacucuguugccccagcuggagugcaguggugcaauacuggcucacugaaaccucugccucccggguuuaagugauuccccugcguuagcuuccccaguagcuggaauuacagguguccgccaccaugcccagcuaauuuuugcauuuuuaguagagacgggguuucaccauguugggcaggcuggucuugaacgccugaccucaggugauccacucuccuuggccucccuaagugcugggauuacaggcaugagccaccgcacccggccauguuauuucuuauuuaugugucuuugcuuaugcuuuuauuuucgcuuugucugucccuaccacaccuacaacccccuuccuugagggaaauacugauuccuguucauucuuuaagauucagcuuagugucaccucuucauggaagucuugcaucaucucuucuacuucagcacuguggcacuuugagacaaguuuucuuuuaaucccccuuguuuugugcgugugcaugcagaccaaaucuucgucagcacuagauauugucauuuauuaaauuuaauccuucuaauguguagcgauaucucauugugguuuuuaguauuucacugaugccuaauguugugcaucuuuucaugugcuuauuugcuauccguguaucuucuuugaaguaucuguucaaauauuuugguaauuuaaaaaauaagauugcuuuauuauuuuguuuugagaguucuuuauauauucuggaguguuuuuuuuucagauacguguuuugcaaauauuuauucuuaaacccugacaugucuuuuccuucaaauuucaaagagcagaagucuuaacuuuucuugaaauuuaguuuauuaguguuuuuucuuuuauggaucaugcuuuuuauguuauaucuaaguaaucuuugccuaauucaaggccacaaaacuuuucucugauguuuucuucugauguuuuauaguuauugguuuuauauuuaagcucaugguccuuguaaguuuacuuugugaugcaagguauggauugauguuuguuuauuuauuuuuccauauggauauaccauuguucuagcaccauuuguugaaaaaucugugcuuucucuaugguuaccuuuuuguuguaaaucuauugaccauguaugugggucuauuuccagcuucucaguucuguuccauugaacuaugugugucuucuuucauuaauaccaaacucucuggauuacuguaguuuuaguaagucuugaaaucagauagcgugcacaucuauguuuauaccuuuuucagaaguguacuggcuauuuuagauugucuuuccguauaaauuuuagaauuaacuugauuucugcauggggaaauauacagaagaagagguaaaagaugacuuaagccaagaaugaugaaaaggaaguugauacccauuaaaaaagaugaaaauguacguaucagaggagaaagaaaacagaaacuaaaucaaaaaaguggaaagaaggcugggugcaguggcucauaccuguaauuccagcacuuugggaggcugaggugggcagaucacuugggccaggaguucaagaccagccugggcaacauggugaaacccaucucuacaaaaaaauacaaagauuagcuggauggugguggcgugcaccuguaguccucgguacucagacgacugaggugagaggaucacuugaacccaggagguugaggcugcaccacacugcacuccagccugggugauaaagugagaccuagucucaaaaaaaaaaaaaaauagauuauauucaguaucuuuagaugaguaggaggcauuaaaugcaaggcauuaaagcauuguaauuguuagguggagacuaagacuuaauuuggaauucugggaggaaaaucauaagcuuaaguuguccauauugauaaugaaauaaaaugaaacaugucuauaguagcauuauuuuugaaauuuugaagugauugauuuauaaccccaggucuggucucuguuuuuuauuuuaguauuuauguauguuucauguuguugcugcugcuguugucuuguaucucagauaugggaaaaaguuuuaaauaugcagaaaaggaauuguauucgauuucuuucuccuuuauuuccuccugguaguacuguaacugacgauuagacuaugcccucaucgcuuuccagagccagaagcuuccuguaaguuaucucuggauugccguaaaguuaucuucggauuaccuuuggaaagauguauaacaaccaauaacguuuucucauauucaucuagggacuuuauugccacauaugccuaugcauuuuauuugcacagauaacuaguguuugacuugagauauauuuaauauauuaaauauuaauauauuuaauaaauuuaauauauuuaauaaauagagccccaagaauaaacugacuagaaauaaaacauauugaauccaaguauuuccuuguuccuuggguuaucuaauuauuugguuugcuagcaaggauuguagaaaagaauauuaucacugauuuaggaaaccaguugcuaucaucuuaaguuaaauguacuaguauguguuuaacuuauuaucuucagucccauuccccaauauuaggccauuuaaaacuucucauucuuguccugggaacucuguucucuccaccuauucuugaccaugccagagguuaucgguuauucaucacccucauccuuugugauaaggauguuuuauuuucccuuuaguuguucuacuuauuuuagaguagugacaguagagaacaaugcaacuaccugaugagggagaaaaaggaaguaguaacaagaaaugccaaauuccuugcagaauuauugaaaagcaaaauacuguauagcuuuucuuuuucaaguagugcugugaaaacaguauaugcuccaugcggguaaggacaauguccaacuuguucacuauugaagcacccuagugcuugguacaguaaaugucguaaggaauaggcaugcaauaaauauuucuugaauaaauguuaaacuggucagaaacauuagacuucaaaagucugaagguuauuuuuuucaauaaugaugagugacuuugccauuauaaaacauguguuuuuuuuuuuuuuuuuuuugaguggucacagagcuggagaugucaugaacacuuggaauuaagucuuuuuuaaaaaaauguuugcauuauuuuauaaucuauggacuuuaguugaauguauaauuaaagaaagacaaaugccauccacaggccuuugguauggaaauggaaugggguugcuaaugaaauuguucuuuaucccagggcaucauuuaagcucuugugauugccaucaaucuuuaauuuugucaauaugaucuuacuauaugcaguauaguuugcuaggggcaguuuuuguaguaucagcugcuuaucccauucaggugaaguacaaauuuaguaugacaguuguaaugauuaauaguuguguauaguuaaaaauaaauacuauaguugguuguaguggugacaccuguaguccuagcuacuugggaggcugaggcaggaggauugcuugagcccaggaguuugaggccaggcugggcaacauagguagacacugucucuuuaaaaaaaaaaaaaaaaaaaggcuaggcacuguggcucaugccuguaauccuaguagcacugggaggccaaggcaggaggaugucuugagggcaggaguucaagaccagcuugggcaacauagugaaaccuugucucuacuaaaaaaaaaaauaaaauaaaauuagcugggugugauaacaugugccuguagucccagcuacuggggagucugaggagggaggaccacuucauccuaggauuucaagcuugcaaugagcuaugauuguaccacuguccuccagccuaggugacagagugagaccuugucuaaaaacaacaacaacaaaaaagauauugauaaggaaauagaaacuucaaaaauggcacagugcaagaguuauuugcuuuguuaagcaagauaaacacagacacauuuucucaggaagggagcucauaaugguuaagaccagaugggaaggauaguuauuuauuaagaugaguauguaguaagacacaaaaaaacauguuuucccuuccguaacuuuugggaauaaaugccaauauaagacagauuuauaugagaauguguaaaauggaauaaguuauugauauuuacucugaacucuaaauuaagccucauauaggcuuaauuuuguguuuuuucaauuuuaggaacucugccagcaucugugucucugccugugauugauuuugcaaacuauuguugagaugauuagugauuuguauuuugggugagauuucauugaguuagcagucugauucauuaugaagcacucuggugcuuguaggauuuuuagucugaauccuaaaugaaauaacauuaauugugccaaacuacagacugagauaaaaugaccuuacacuuagggugauaagagagaaacuguaauuuaacacuauaggacuuacaucuuuacauacgcuauagaggcaucguuuuuuguaagcuacuuuagaugaccaguauuuacagaagcuuaguucuagcuuuuaccaguuugcccugauuuggccagcuuguuuuuucagggggaguuaugcuacuuuauuuuccuagugcuacauauaaaacuugagauuugggguuaacaauaguauauuuguauguauuucauauguaguuuuaaaauauaccuuucauugaaauagcauguuacguagauuuauuugcaguuuuggaaacucuaaauuuaaauuuuucugugcaaagcagaccuagcguuacauauaauauugcuuauaaauuaaaaaacuaaaauacaaaaacccccuaaaauacauuaaauauuuuuuauuuuuaauguuuuuuaaaauuuuacuuuaaguucugggauacauguacagaacaugcagguuuguuacauagguauguaugucccauagugguuuguugcaccuaucaacccgucaucuagguuuuaaccccugcauccauuagguguguguccuaaugcucucccuccccuugcccccuacccccugacaggcccuggugugugauauuccccucccuguguccauguguucucauuguucaucucccacuuaggagugagaacaugcaguguuugguuuucuguuccuguguuaguuugcugggaaugauggcuuccagcuucauccaugucccugcaaagaacaugaacucacucuuuuuuauggcugcauguuuuuuuauguuuuuuagaggcagggucuugcuguguugcccaggcuagagugcaguggcuauucagaggugugauuauagugcacaauggccuugaacuccuagcugcaagcgaucccuccaccucagccacccaacuaggugggaccacaggaguauacugcugugcccagcuuugaaauacguuuccuaugaagucaguauuuuacagauuuaucugaagcuuuuguuuaauagaaccaaagacaaauuuauuaaagucuucacccugugguaguguuuaaucagccuuuggugauggagauuaaaacuuuuuaauguaaggaguauauaagaaguaggagaaaaucggguuccuuaucuaggacugaugguuacucucagaaauuuuacucagagucucugaggccuuuguaggagacacgcuaagaaauaaagagugaauggauggcagacucaaagcagcuuguguaguauuugggaaacuaaguggaguguuuuucguacuguugaaauggaguuagauggcaaaguuggaaagguguugcuaacaggcuuuguuauguaaucaggauucccaguauaaauuugguugauguaaugggaggaucuuuugagaaucuauguaaguuguuguagaaauuagaaacucuuggaaaaacuaauucaaaaaccugccucuucauuaguuugaaauuaaagauaagaaauuaacugugcuguguuuucccaaauaaaacauuucucuuucuuggaugaaaaauguuaaucacucaguauuuaagucuugaacugagcuguauaugagacuguuugaagccacaugagcagugucacauuuagagauuuaaauuacauuugaauaauuuauuucauaauuuuaaguuauuuugaaauagauuuuugugguaugccuacaagguggaaaguugaugccgagaccugagaggggaaaauaaagcugaauggaaagguuuaauaauguuaauuuccugaaauugaguucucuguuauugauugauugauugagacagggucucacucuguugcccaggcuggagugcagugggguagucucgucucacugcaagcuccgccucccggguucaugccauucuccugccucagccucucaaguagcugggacuacaggcgcccgcgaccacacccggcuaauuuuuuguauuuuuuuugguagagacgggguuucaccauguuagccaggauggucucgaucuccugaccucgugaucugcccgccucggccucccaaagugcugggauuacaaggcgugagccacugcgcccagccuuuggucauuuuuauuggcauccuaaucaaauccaaaagagaccucugaccccuaauauggcaguauugaucuuacuuugguuuuuacauauuauagauauugguaaacauuuuauggagcuuuuuuuuuuaaggaagagauuucauaauuuuaauggacuuacaaagauugaaacaugaagaauuaaaaaauagaaaucuaguucuauauaauaucuguuuuagagauuagaauuggagcaccagaaaagaugguaauuauuaauuuucuauuuagauuuuaaaaauaucugggaaaauugaacauguggauaaauuaccauuucuuuguaucaauuuuuagaaaagcauuggguguuaauuggcugugagaugaguaggaagggaggaagguggcagauuuuaggauuauaaagcauaugaucauugaucauuccacaaauacauguuaugugcuuccuauguggcgggaacuguauggagauauaaaaagaauaugccuccacacagaaacauaguccccuuaaggaacauaccaucuagugggagccgugauuaaaacagauuaaauugccuucuaauccuaugccuguguguuuuuuguguuuuuuuuuuguuuuuuuuuuuuuuuugagacagagucucgcucugucaccuaggcuggaguguaguggcgcgaucucggcccacugcaggcuccgccuuccggguucacgccauucuccuaccucagccucccgaguagcugggacuacaggcgcccgccaccacgccccgcuaauuuuuuguauuuuuuuuaguagagacgggguuucaccguguuagccaggauggucucgaucuccugaccuuguaaucagcccgccucggccucccaaagugcuaggauuacaugcgugagccaccgugcccggccugcccuguguuuuauaaaaaugaucuaaaauugggcugggugccguggcucacgccuguaaucccagcacuuugggaugccuguaaucccagcacuuugggaggccaaggcgggcggaucacaaggucaggaguucgagaccagcuugaccaacguggugaaacccccaucucuacuaaaaauacaaacauuagccaggcguggugacacgcgcccguaaccucagcuacucaggaggcugaggcaggagaaucacuugaaccugggaggcagagguugcagugagucgagaucucgagaucacgccacugcccuccagccugggcgacagagcaaaacuccgucucaaaaaaaaaaagaucuaaaauuagugaaaccuauguuuuugaaaauuuaggguguuuuacccauucucauuguagguaaugaauuauguagugugucuuuggaucuagaucuauuugauuuggcuuugcuuaaucuuguauuuuuuuguagacucuuuuauuauuacccaaaaguacccaaagagacaugugugccuuaugguguccagcagaaauucugaaaaccuuguuaccuaaaaacuuuauuuucagaaguauuauauauaggcugaauaugguagaaaucaaauuuuucuccugcggaaaaugaucauauucuuugugcuauaugaaguucuaagacauuuauggaaaauaaaauacgguuuagcaucgcccaaauuguguaagauuagaguugaagagcuuaaccuggaaaguuggaaacuaauuacuguuaacauaugaacagauauggaaaacuuucucuuugcuccuuuaaguaaguggaaaggaaugacuauuuucccuuuagaaaugugagagaaagugauaguaugggaaacuuugauugcauucuuauaaacuagcuuuuugauuucuuauuacaugauagaauaucucuuuuuucuuuaaucucuauauguuacaaauuucagaugaccugaaagcaacucuucaauuugggauauaaguucuaaacuuuacuuggaaacaguuccagauucagacacuugguuuugggguguguguauauauguuaauauaugagcaaagaacccaauauaaauacuauguggcaauuuauugaaagcaugcaggaguuuaauuuaggcucaggacauugugucauuugcuauucuuguuagauaugaacuggauuuuauuuuuugucuaguaccaagcaguacuucuuauauuggaccccuugaauaagguuaccuuuagagccauuugucaccuacuucauacauagcacauuugaugaguuuuaugucuagcuggucaucauugaugauuguucagugauuauuuuggcaguuauagcaggaagauggcacaguauaguuaugugcugcauaacaacguuuggauugccuaacaaugcauuucucagaacaugucuuuguuaaaccacacaugacugugcuaguuuugauuaggguggccauguaacucauccaaauuggacucuuuugagcaugaaaagggaugauaauaauaauugcuucagaacaacagauauaaaccaagacugacccaggcaaacuaagauauguacucauacuaauuaggacacuuuugauuacuaguaacagaaaacacaauucaaaguagcuuaaacaguaagagaacuauauuggcuuguguaucagaaaaggccaguauuugggugugcuacaggugucauucagugaggacccugccuuuguuuuucuguuuuccagacucugccuuccauggcugacuuuccuuaucguuguugcguggcugccagcagcaauuugggcuguauucuucuuuguuuaugaccagcaggagagagaagccugcuucuccuauaaacauagaaugaguucugcgguuuugugauuauuagauacuccugaacuaaaucucugcaaggggaaugucaugugcugauugucuuaggcaugggauaucugaauaucacugaggaaaggaggauagaauuaccuuauucucuuagacuagucagaguccauucacgaaacugcugugugggaaagcagugcagcuaaaugaagggaaggaguuaggaagcaaccauaauguucauugcaaaguccagugcuguugcuuauuugcauuuucccuuaggcaucugauaaugaguuccugcaagauccuagcauacugcagauaauguguguguuuucuuuuucugcaagugagaauuuguaguauaaaaugacuuacuagacugguaaugggagagaaaaggaguuuaccauccuauuuucucuuuuuuuaaaguaagacuauaauaauuauugaucuccuccuuuuuuuuuuuaaacagacuaauagggaugccaaaggaaaaauaugauccuccagauccucgcagaauuuauaccaucaugucagcagaggagguagccaaugggaaaaaaucucacugggcagaauuagaaaucucgggugaguggaaucugaagcauuuaaucuggaauguaauagugauaauacaaaaguugaguauugcuauauuuuuuguuguacauuuuuaauuagauggacucauugaaaaacuacaagaugguaagauacuaguguuuucuguuuuaugugugacugaauaucuuuguuuccauuuuuugagauuaauuacauugagcaagcaucuggaauugaggauauggggaguuuaguuucuaaguaaaaccaguuucuuugauauaauagauuuuguuuaggcuauuucagaguaauuauuuuugcaaauugaaaucuuugccauccuccuaucucagugucggcaaagaaggaaaccuggaagcuauuuauucuaauaaauauauaauaacuguguuacaggaccuuaauaccuguuuaggauuugguaaaauagaaugugauuccuaaaaacucauaauuccagucuaauaaugagaaaaacaucagacaaacucaagcuaaaggaccuugugcaaaauaccuaacuugauuaauacucaaaauugucauggucauguaaaacaaaggcugaaacugucacagaccagaggagacugaggagagguaacuaaaugcaaaaugguagccugcguugaaucuggaacaaaaagguauaaaaacuggugaaauccaaguaaagucuagaguuuaauuaguaguaaugcaccaguguugguuuccuaguuuugacaaauguaccauggugaugauguagauucuaauguuagggaagcugaaggagggguauauaggaacucucuguguuaucuugguaacuuuucuguaaaucuaaaauuauuacaaaauuuaaaguuauuaaaaauagaauauaaguauuuuucuuuuaugaauugguauaauacagauuauauauaaaaugccauuuuuuccccaguaggcauucauuuggaagaguuaaaccccacauuguaaugucaauagcaagaauuacuugcacauuuagcuaaaagguaacuggguggauggaugauugguagucaaaagaaugaauaugagcagaucuuacuaaguuaaucuaggguuucuuagccuuggcacuacugacacuuugagcuggauaauaguggaggccuguugugugcauuguaggauauuuaguagcauuucuggccucuacucacuagauagcaguaguaccccuucaguuguggcaaccaaaaaugucuccaggcauuccaaaauccuuugaggaaacaaaauugccucugguugagaacuacucaguuaaacuccaaggguuuccacauuuugccacuucucauuuaauacauagaagguucuugagaaagagugguugucaggugaaaguggcaugaacguaaaggagggccagguguguuuggaagcaaucaaauggcauuaaauaaaaaauuaaaaugucagagauacaauauccauguguauuugcagccucucuuaccacuuuucagucguuguaguuuaggugucaucuugggccugggguuuuuuuuuacacuucaguauuuugccuuuuagguagagugcggagccuaaguacaucacuuuggucauugacacacuugacagcgcugcaccuaaaugacaauuaccuuagucgcauuccaccugauauugccaagcuucauaaucugguuuaccuggaucugucauccaauaaacucagaaguuuaccagcagaacuaggaaacauggugucucucaggugaggaaauaaaacagacaugacucacuauauaaaauucuaaauuuaagaaaaugaggggauguuacuuuauuacaguaggauuucuguguguuguaacuaucaaauuauauaaacugucuaagcauagugcuugaguuggccuccguugaacauuucuuuuccuuuaaauuuggagguuccugaauuagagugugcuuguauuaccaguuuccuugacaaacuugaggugggguggggcuaaaauaguaagucucauuauccaauaugauaagacugauuagaaguacuugaaaaaugaagauuugcugaugaauaaaacuuacaagaacauaucucuauuauaugagucaaagaauauuuauauuucauaauacagcuccuuaaggaaaccuuaaaaccugaugaaauggauuuauuucuaauuuuuagggauucuuuaaaaauucccuaaagaaauucuaaaaaaauuuugcaggaaucuuaagaucuuaucuaaauguuuccaaugauuaucuguugaguaauaauuuuuaaaaauugcuaucacguguuuaaacauauuguuuuaaaaucuuguucuucacuauccuuuacuugcuuuuuuuacuuuuggucauccacuaaugaggaugcuauuuuuuuccuauaggcugcucaaaauuucacaaucauaaaguuagaucuuauuuaugcuauccuauucuugucuguacuaucuaugcuuuauuuuaauauuuauguuucaugucagugauuguugaucauaguauauuuuuucaucuuuucacauuuucuuuugucuucuuuaauauacuucaccuguuguuucuuauucuuuuuauuuuuauuaaauuuuugguuuguuuucuuaguauuuugaugugauuagaguaguauucaguuacuuaaaaagagauaccggugauuggcuacuaauuacaguuuauuccugaaguuuguguaaaaauuuguacuuuuuucuauuaauuagacgaguuucaaggauaucuguuguuuagcugcuaaggauaucugucgcauuugcauuugauaggcauuuugggugagaaaaaaggggguagauuuagccugagaaugauaugcaguuccuacaccuccaacuuuaaugugagcuagcaaaugaguaaauccuagaaauagaaccauuguuaauaguuguggcaauugcacauuuuguaguacuuuuauauugugcaauguuuuuggaugagcacauagaaaugugccuugaauauaaacaaucacucauaguauguuagaaggagccuuaagaauggcaaauacagauguuaauaaaacuuaguauauuaaacuaauuuuuuuuuuuuuuuuaaaacagggaauugcuuuuaaauaacaaucuguuacggguuuugccuuaugaacuuggucggcucuuccagcuacaaacucuagguuugaaagguaagugauuuuuaaacaguuuugagguauucugagccuuuuaaagagcauuuuggccuuuaaaaaggucaaguuuuaguaugaguuuuagaaugugacuacguguacuuucucuugaaagaaaaguaguuuuuguuuguuuguuuguuuguuuguuugagacggagucuuggucugucgcccaggcuggagugcaguggcgcaaucuuggcucacugcaagcucugccuccuggcuucaugccauucucuugccucagccuccugaguagcuggggcuacaggcgcucgccaccaugcccggcuaauuuuuuuguauuuuuaguagagacgggguuucaccauguuagccaggauggucucgaucuccugaccucgugauccgccggccucggccucccaaagugcugguauuacagaugugagccaccgugcccugccuaagaaaguaguucuuuaaguaucaaauugaacuugaagauuucaauaugugccaucauauuaacaaacuuguaaggggaaaauuuuuugguuguuuuuguaucuuaccuuuaauuuuucuauaaaacugaacuuucucagaagagauaauuuaaauuaacacuuaaaaaaaaaaagggaauacuaggcugguuugagaccagccugaccaacauggagaaacccugucucuacuaaaaauacaaaauuagccgugugugguggugcaugccuguaaucccagcuacuugggggucuggaaaaucgcuugaacccaggaggcagagguugcggggagccgagaucgcgccacuguguuccagccugggcaacaagagcgaaacuccgucucaagaaaaaaaagggauuacuuuaccuaauaauagucuaaaccucagccagaaugccucauguuuagcuuuugacaugguagauaaaauagcauugaugugauuacaggagagaaaacauuauaauaguaaaauuagcuguaccuauuaaguaaauuauucuagguaacguguuaguccaaaaugcaugcuucucugaccaucuuucucaguuaauuugggaugaaaggcauacucaauucauagaaacacugaaauuuguguaauuuucucuuauggcauagcauacaagaguuuauuuaugaauuaauaggaccaaauacaaauguucuguauuaguuaaacauuuucuucugugcucaugaggaauaaacaucagucaaagccuuguaaaguauacacuuucauagauuuuauuuuccuucuucaaagacuauuuuaguuuccaugauaauguucugccugcauuugcuuuuguuauauaauggaucauuaagaaugaaauuugaauaagaauagaaagaaugcugauuuuauugguugaaauaacacaugauaauuagguuuccuuauucaguuucauaaauuagacaauuauaugaaugguuugaaucuuguguuauaguuucuuuguaggauuuuauugauuuuuuaaaucacauaugaaguagagagggaaaguacuuauaucuaaaauauuuuccuaaggauugaggauuaacccaaggcauuugaaauuguacuguugagacauuucaccucauuuucuuuaugcucagucuuauucuuauguagcugaaauagccauucagcuagaguuggaguaggugcaagucuauuccucacuaacagcuguuuucuucuucccgauauugauagaaagcauaucaaugacaaaugaauaauuuacuuuuuuuuuuugagauggaguuucacuuuuguugcccaggcuggagugcaauggcaugaucuuggcucacugcaaccaccgccucccggcaaccuccgccucccagguucaagugauucuccugccucagccucccaaguagcugggcgugcaccaccacguccggcuaauuuuuuguauuuuuaguagagucggggcuucucuauguuggucaggcugaucuugaacucccgaccucaggugauccgcccaccucagccucucaaagugcugggauuacaggcgugagccacugugcagggcgaauaauuuacuguugaauccaguggacuuacccuuuguauuagaaacauuccugaaaaagcaacuguuaguauuucuuacucuuucauaacuguuucauauuaucucaaguacaagcauguuuccagaaaauuuguacuaaguaucaacugaaugaguaauuuugaauauuaucuccuuaguccuucauucaguuuuucuaguuaaaaugguaguuuuccaaacgauugucuuuggcuggccuucgauucuaguggcauuuugucuacugauuuacguucuuuaaaaucuaucaagucagacgccacugauuuacauucauuaaaaucuaucaagucagacaccagcucugcuucacgaacuguaacuuagcuuuguuuaugccugugguuaaauucuuuuuuauuaaauuucaauuuguuguaaguaccuauauguagcccuuuucuaaacuucuuugagagucuauuuaguuuuuugucagugucacuuuccaaggugauccagaaaaccagaucucuuccuuuuaaaaaaguuuaagaugguaauagcaggaguggcuuuugaagcaauugaagggauacaguguugcuaaugaaugguaguuuuauauucuuaggaagguaaaauuugaaauaauuucaaagucaguuuuauuagccauauuaugguacuuuaugucaaaaaaauggaauggaacauuugaaauagcacugugauauaguuaaacaaugagaaugaacugcuucugagacauuuugucuugaaacuggaagauuuuuuuucucuauauccuuuuccuccuuugaaacucagauacugaaauuuuaguaaugauuugggucaugcuggcucaacaagcuaauuuuuagaaauuuuauuuugagauuugaggagagcguggagaguaaguuauuugaggaauuaggauaagaaggccaauuuuaaaacuauagacacagacaccgccagucuaguaaguuggaaguguucugugaagucacuuagaaaaauaaaaauguauuaauuuuaugaagaaaaggcauaaguagaagcaauucucauacaguuauuuuaaaagaauuuagaauucauguccuaagguguaaggcaauacuuuauccgacauaugggccaacaaguuguccuugagcaauaaaaauugaugucccaggucauaaaaauauguaggaccucacuaauuuugaaaauuucuagcuuucuuccaaggauuacuuggucuguuuauggaccaugucaguggaagacuuucuuuuacuuuguaaauuuguuuuauucuugaaauauaauauaaaagaauaauuaacaugcauuuuaaagaaaauaauuaaaugaauagucauucuccuauuagccaauauuuuaaauaccuguuuuaaaaaaaugcacugggaaauauaauuuucauuuauauaggaggcaaaauacuuauuuuuguguuguaugugagcuucuaaaaaucaauaagaaaaagaacagucuaguagagaacauauuaauaguucguaccagaugauguacaaagaggucuaaaauuggaccugaucagccuuaugcauaauaauaguacaaauugaaauuauauucaauuacauuuuucaccuaucagauugggagaauuuaaaaaauaugacaaaauagcccuguuggugagauuauggggaaauaggcacaaacacaccuugucauuauagauccccuauaccuuuuauguuuccugcguuuucuuucacgauuaugucuuucucccagauguuacuacuacccugaauuuagauauugggguuauguaugcaucuguuaaagguguucuaaccuuuuuaugaauggaauccuacugaauguaauuuuuaugacuugguuuuuauucagccuuauguuuuuaugauucagccauguugaugcauacaucuaaugacaguucuuuguuuuacugcuguauuguauucugauaugugaauaugcuauaauucacucauucugcuguagauauuuagguugguuccauuuuuguuuuuggcuacuauaagcaguacagccaugaacagacucauacaugucuccugauauacuucauaggaguggaauggggauguagaggucuguacauccuuagguuuuuuuuaggcaauaccauaauguuuuacaaagugguuguacuaaaagauucuacucaaaauaauacaguuuucauuuucagucuuuucuccaacacuugauauugucagauuuuuaaguuuugucaguuauugaguaugaguuucuaacuguacucuuaauuuacauuuuccuaauugcugguaagauuuugcaucuuuucaugugucuguuggcuauuauauuuauuugaaauuacuguugauguuuuuagccuauuuucuauuugaugauuucuuauugaauuggaggaguucuuuuuucuauuuugcguuauaagugucuucucccacucuauggcuuuuccuuuuguuuuucuuucugguaucuuuuuaaugaguagaauauauauauauauauauauauauauauauauauauauauauuuauuuauuuuagacagagucucacucuguuacccaggcuggagugcaguggcgcgaucucggccacugcaaccucuaccccacggguucaagugauucuccugccucagcuucccaaguaguugggauuuacaggcgugcaucacuaugccuggcuaauuuuuguauuuuuaauagagacgggguuucaccaugcuggccaggcuagucucgaacuccugaccucaggugauccucccaccucagccucccaaagugcugggauuacaggugugagccaccacgcccugccagauuugauauuuuuaauguaguugaguuuuaaaaucuuuucucuuguaguuaguacauuuguguguuguuaauaacagaaaucuugcccuucccggaucagaaauauauucucuuguaucaucuuaaagguuuugagguuuugcucuucgcaguuaauucuuuaauucauuuguaacugauuuuuuuuuuuuuuuuuuuuuggggacaaagucucgcucugucgcccaugcuggaguacaauggugcaaaucucagcuugcugcaaccucugccuccuggguucaagcaauuuuccugccucagcuuccugaguagcugggauuacaggcucccgccaccaugcccagcuaguuuuuguauuuuuaguagagacggguuuucaccaucuuggucaggcuggucucgaacuccugaccuuaggugaucuaccugccucagccucccaaaguguugggauuacaggugugagccacugcaccuggcccuuguaacugauuuuuaaauauaguaugaggggucuaauuuggugaggaauuuaauuuuguuuuuucccuaugaguaaccaguugucucaacaucauuagugaauaguuuuuccuuuucucagugaucaguaaagucacuucucuuguguauuaaccaugucuaggucuauuuugggaauuucuuuuccuuuccaguaguaaauuugucuaaccuuguaccaauuagcauauugucuuaauuauuauggcuuuauauuaaaacuugauaccugguuuugaaagucuccucacauuuuucuuuagcaguguuuugacaauuugggcaccguggcucuuccucauacauaagaaacagcuuguuaaguuucaugaaaaacucuguuugaacucuggaauuucauugacugucuggaucaauuuaggaagaauugacaucuuaauuguauucaaucauccuauucaugaauuugggcucuuuguccauuuauuuaaugucuucuaauaaaauuuuauagcuuucuacaccaaucaaguacaucuguuagacuuauuucuagguacuuuauacuuuuuuuuuuuuuauuguaaaccacaacugucuuuuuucccuuuuuuuuuuuuuuuuuuuuuuuugagacggaguuucgcucuguugcccaggcuggagugcaguggcgcgaucuuggcucacugcaaccacugccucccggguucaaacgauucuccugccucagcuuccugaguagcugggauuacaggcuccugccacuacaccuagguaauuuuuguguuuuugguagagacaggguuucaccauuuagccaggcuggucucaaauuccugacgucuggugauccacccuccuuugccucucaaagugcugggauuacagguaugagccaccgugccuggccaacuguuuuauuuuuuaagguuuuuucuucuuuuuuuuuuucucuuuucuugguuauuuccuauuugcuauuggauauagaaauacaauugguuuuguuuuuuguuuguuuuaaaauuaaucuuauagugagccuucuuggcuaaacucucauucuucuaaaaacuugucugcaaauuuuuuggaguuuuacaugcaguaaucauuucaucugcugaaaauuauggcuuuuuuuuuucuuuuccaguucuuacauauuuaauuuucuuauuuuaaugcacugacucuaggauaauucauaugauguugaguggaagcauuaauacugggcguacuucuguuguuuccaguuuuaaagggacugcuucuaauaguuuuuauuaagaaugauacuugcuguauguuuuuguuaaaaaaguuuuuuagauuuuagaaguuuccuucaauuccuacuuugcuaguucauuuucagauauuuuaucaaguacuuuucuccuguagagaugauuauauuauuuuucucaucaaaaguuaauaagguaaauguaugguaaaauauauauauacauauacauacacacacuuuuuuuuccaauuuuaaacaaauuugcauugcugagauaaacucaacuuagucauguuguuacauacuuuggauuuaauuugauaaauaucugucuagaacuguaaaggcuuugagauuuuacccuacuuaaaagcucauaaguuaggcaguuacugguucauggaugguggcagaagacauaagauuccugggucagagaaaaagaacauuauuacucaagcuacaaaaugggcccagaugcaggcuguguacacagucaguuuguauugcaugcaauugaguaauccaggucugggguccagcacuuuuuaaguaagcagcaaauauuguagcaaaauagcgaaaagcuacuagucuugcuuccccaggguaacaguuacaugauaguaaugauggguugccuugaccuguuuaguugccuauauaaguaauuauagaaauuacucaguaucaagagacagauaacccuuggaaucagucacacuaaccaagaaugcagagggaggcacaaggcccauaguagacugauucuccuaacaauuuuuuaaaggauuuuucuguguauguucaugaauaaaguagaccugugucuuucaugcauguguaucuaagguuuauaaugaccguagaagcaguggggaaaauucuguauuauucaguucucugaaagaguuuauguaaaauugaauuaauguauuccuugaaaucuugguaaaacaguccuguaaaacugucauugccugguguuuucuguuuucauugagaagauguuaacuacuauuucaauguauuuuaguuaugagaacuuuugagaaauuuuuuuuuuuaagugaaagcaaguuuauuaggaaaguaaaagaauaaaagaauggcuacuccauaggcagagcagcccuuagggcacugguugcccauuuuuaugguuauuucuugauuauaugcuaaacaaggggugauuuuuucaugccuccccuuuuucgaccauauaggguaacugucugacauugccauggccuuuguaaacugucauggagcuggugggaguguagcagugaggacgauuggaggucacucuuacugccauccugauuuugguggguuucagccggcuucuuuaugcaaccuguuuuaccagcgaagucuuuaugaccuguaucuuguccugaccuccugucucauccugugacuuagaaugcuuaaccaucuugaaaugcagcccaguaggucucagucuuauuuuacccagccccuacucaagauagaguugcucugguucagagaacucugacauuucucugcucccuuuuauaagagaaccuuuaauccuaaggguugcagagggacaagagugcaucuucuguaacuucuucaugcugaacaggggcgaugauauuccuuucuaacuuuuagggucucuuguauuugggguagagaggagcucagucagaaagcgucaguauguugagagccauucauaauuccgaguucugacaaaaggugauaccuaaaguuggccgauugcuguugugcgcagaugauuuuccuuugggucaggggucuuuucaguauuacugcuuccaugguuugccagaaagauguuacuggaaaggggucccaauuccaguucuuggaucuccugcaagaaagaguuuggggcaaauccauacgguaaagugaaagcaaguuuauuaggaaaguaaaggaauaaaauaaaaugacuacuccauaggcagagagccaagaaauuucuguuaaugagucaauuuuguuggaucaucucugauauuuucccuuuucucuuuuuaaaugggacauacgauuuauucauauuuagauuuacauguuuuaucuaauuuuauuaucuuuuucuggaauaugacauccaauacaugcaauauauuaguaaagugauucauauauaguuacuauauaauuaucuauauauucauaguccguuuccagcuauuguuuagcugguauuagacugugauacuuaaaauguggagauuauuaugccuuuaauuccauauuaccguggagcuucuucugguucuaacaagacagcagaacucaacuaugcuaaaggcaucaguauauguugguggcaacuaugcauuguuugguucuggaaguugagauaaauguguaccuauacuggauuauagauuuacauacuuucaaauauaagcauuuaaggcuacagcuuugccuguuuggcuacuuuuuuguugcauacacuauuuugauaggaaguauuucauuacuguuucggucuaaguauuuuuaauauggguuauuauaucuuccuugacuugucgguuauuuaaaauauuauuuaaaauuuccaugcaugugauuuuaaauuuauuuuuauuguuagcuuuaaaccuaauugcauuauagacuaaugaaccaguucugugacauuuguugauucuugcccuauggcauaguauaugauugguuuuuguaaauguucaaccuguaucugaaaagaauuucuuuucucuaauuguugggcacaggauuuauauauuuguccauuaguucaauuuguaaguuguauuucucagauuuccuaugucuuuagaaauuuuugacuguuggcuuuuucuguauuuuuguuaaaauuuccauuaaaauggaauuguuuauuuucuuauguaguucagucaguuuuugcucuacauaucuuggguuuauuuuauuagguaguucccacuuaauauuguuauaaucuuaugaugcuagugucuuuuggugaauugaacccaauacuagguacugagcuucuuauuaggauuuuuucuuauagucuguauuucuaauauagcuaugccaauuuucuuuugguuaauguuugucuaguauauauucucucauccauuuacuuucaaccuuuugugugcuuacauuuagguauagcucuuauaaauaguauauagcuggacuuuguuuuuaauccauucuacucuuuguuuuuaauguggguucagaccaguugccuuacauauaauuauugguauuuuuguuauugcuguccuaccuuuugauuccacuguggguaauuuuuuucugcuuccucgcuuuucuaaaaguagguuuuucccauauuuuucauucuauuuacuuucucuucguuugaaauugcucuauucuguuucuagacuccuuguguuuauucuugaaauggugccuugaauauauuuuuuuaaagauuacuuuuaaaguaacuuuaaaaauugaccugcuauuuauacauagugaaauucuuaccucuuugguguauaguucagugaauguugacagacauguaguugcauaaccagcaccacagucaagaaauagaacaguuccaucacucuccaaaauucauuuaugccugcugaagucaauaccuucuucucucagcccuugacaacuacuuuuccagaaugucauauauuggaacauacaguaugucaccuuuugagucuggauucuuugguuuagcauaauguguuugagguucauucauguuguguguauaaaaccuguggcacauccauauaauggaauauuacuuaacaauagaaaugaaggcaaauuuguuuuuuugaaauuuuauaguuuuagauuuuaccuuuagguugaugguuuguuuugaguuaauuuuuauauacggcacaagguuuauuauuuugcauaugcaugucuaguuauucuagcacuauuuguugaaaagauuauacuuucuacaugggauuuuccuugcaacuuugucaaaauucaguugcccaaauauguguggaucuacugcuaaacacacuauucugucccauuguucuaugcuaauaucaaaauguuugauuguuguaguuuuaugaucagcuaugauacagggauuauaaguuuccaaacuuuguucauaguuuuccaaguugcauugacauuucuagauacuuugcauuuucauauacauuuuagaaugaacuuaugauuuaugcaaaauauccugcugaaauuugucaugggauuauguugaauauacagaucaguuuguggauaaucaauaccuuaaucuugagacuuaauacugagucuuucacuccaguauagcucuucauuuacacagaucuucuuugcuuuauuuucaaauaaaguuuuguaguuuucaggguauagaucuuguaaauauuuugcuagauguauaucuacuuacuugauuuuuuaugcuauugcaaaugguacugcuuuuuaaauuuucaguuauucauuguauagaauuaaauacaauugauauuuaauuguauugggcuugucucuugugauguuuguaaauuuacuuuuucuuggagcuuuuuacgaacucuugaucugugaacacaguuucauuucuuccuuucugauauguauuuuuaauuuccuuuuucuugcuuuaucacauuggcuaggaccucuaguacuauauugaauagaagugacaauggugcacauccuuaccuuguucuugauuuuagggggaaagcauuaucuuucaccauuaauguuaacuguagauuucugguagauauccuuucagguuaaauaauuuuuccuucuuccccacauuugcugaaugguuuuugucauuaaugcaaguugaauauggacaaauacucucuggaaguuguugcuauuacuuuuauuuucaggaagaguuuucagaaugcuuuagaacucaaaacguuucuguuacugcuuucuuaaaugauugguagcauuuuccaauaaaaccauaugagcuuggaauuuucuuuauggaaacauuuuuaacuucuacaucaauuucuuuuguagauacaggucauuaagguuauccucccaccuuuuucuuuuuuuccccuauagccaugucagcuuucuccugcagucauuugguugauucuccugcacuaauuugguuaauucucaguguucucaaauaguugauucugacaacuuuuuuguuuuguuuuguuuguuuguuuggauuuuuuggucaucguugcuuguacagagcagcacauuuuuggagguuuuuacucugccauuuuugcugauguuuucuauccauuucauuuugagugagcuuugguaguuucugucuuucaaggaauuuguccauuucuucuaaguuguuaaauuuacacacauauaguuuucuuaauauuuccuuucccuggcugggcagaguggcucaugccuguaaucccagcacuuugggaggccgaggugggcagaugacgaggucaggagaucaagaccauccuggcuaacacagugaaacccugucucuuccuuaaaaaaaaaaaaaaaaaaaaaaaaaaaaaaaaaaagccaggcaugguggugugcaccuguaguccuagcuacucaggaggccgaggcaggagaauggcgugaaccugggaggcggagcuugcaguaaguccagauugcaccacugcacuccagucugaaaaaaaaaaaaauuuccuuuccuuuuacugucuuuuuggcugucccuucauuguugauauuuauaauuugugucuuuucguucuggucaaagagaaauguaucaguuuuauugccucuuuuucaaacugugccacgcuuugaauucgguauuuuuuuuuuuaauuuuauugauuucugcucuuauuucuucugcuugcuuuggguuucauuuguucuuaucgaguuuagaucuuuuuguuucuaauaucagcauuuaaagcuguaaguuucccucuaaaaacugguuuuuccauauccuacaaauuuugauagugucauguuuccauuuuaacucaaagcauuuaauuauacuuuuauuuuuugagacagggucucagucugucacccaggcuagagugcaguggucuuaucauagcucacuguagccucuaacuccagcacccaagcaauccuccuguucagccucgugaguagcugagacuauaggugcacaccaccaugcccaguuaaauaauuuuuuuuguuuguagagaugggggucucaccauguugcccaggcuggucuugaacuccuggccucauggaguucucccacuuuggccucccaaagcacugggauuacaggugugaaccaccaugcccggaccaauuaaaacauuaaaaaaucuccuggugacauccuuuuuggcucauggauuauugggaagugugauguuuaauuucagaauauuugggaacuuucuggguauuugucuguugguaucuaguuuuauuaggccauaacuguauguuuuguaugauuuuauuuccuuuuuaaucuguuacaguuuguuuucuggcccagaauauggucucacuggugaauguucaugugcacuuggaacgaaugcauauuuuuugguuuccgaguggaguauuauguaaauaauaggccaaguugguugauaguguucuguuuuucaaccuuacuaauuuuuugugugcuuuuuucugucaguaaccauaggaguguuugaagucucaauuacaauucguguaacucuuuggggauacuauuuuauuguauucuagcuccuguugucgcugcugacacuugucauucuccuguuuauucuuuugauaugguuguucuuucaacccaucuugguuguuuuuuuuuuucuucuuuuuuggagacggagucacgcugugucgcccaggcuggagugcaguggcgcaaucucggcucacugcaagcucugccucccggguucauaccauucuccugccucagcuucccaaguagcugggacuacaagcgcccgcaaccacgccuggcuaauuuuuuguauuuuuaguagagacgggguuucacuguguuagccaggaugguuucgcucuccugaccucaugauccacccgccucggccucccaaacugcugggauuacaggcgugagccaccgugcccagccacaacccaucucguuuuaaagucuucuguuugucauuuucuaguuugcacuauaaucuguuuuuaaaugaaauccuuucauaaacuucuuuguauauauugugcaucuuguaucaguuuauuuauuuaaaaaacugguuuuugaaaauuugcagccuuuccucuucagauauugccuuuucucacuucucucucuaaucucucuuucuggcuaggaguuaaauauguuuacuguuugcuguagguguugauguagugguaaggugcggagggggaggaagugcccuauaguccuguaauuaggucugccuuagugagccagaguugacuauuucccuacuugaugucaaagucuagagagggcauuuaucuuacucuaggucuguuaagcuuugggaaaacuuagauucugguaaaauaguuuccuuugaagauaguacuuacuaaggagaacauuacuuucucuugcccccuuuuggaagaaugaggagauuuuucuccagucuuuauaguaagacucguggaaguaaaacuuaggaaagugugggaaugcccuaagacuaggcccucuuggaguuuuuaacucucaagcuaaucuacauggagccuccaguaauuugucaguuacacuuuaaaguguucuaguucuaguucuagcuguggacuucugcugccaguaaguugugauucucuguaucugcuuguuuguguuugggacagcaguuuguccuauaaccucaauugugaggacaggagugacagcuuuuaaaaucuuuacauguuggaucagaacuuaagucuuguucuucuuucuagaacuccaauuucauauaguauucuaacuucuguaucuuuuacugucuuauguuuuccaucuuugugacucucagugacgcauuuuggauaauuuucuuugaaucuguuuuucuugaugacugauuuucuuuucagcugugucuaaucugcugccuaacucauucaucaagaguuuuuucccccuaguacuuggaguuauaauuacauucaguaaaauauccaaauauuuaaaauccaguuucacuaauuuugacaaagguauacaccuuaauagccagcaccuaaaucaagauagaauauuuccgucacccuaggaaguuuccucuucucacuugcaagucaauuagaaacuaccaaccagacuuccaaaguauucauaccauuuaccaguaauugaauugaaguagaagaguucaagguauucugcauucuuuguaacauuugguuggucauuaaaaaaauuuguuuaggccaagcagaguggcucaugccuguaaucccagcauuuugggaggccaaggcgggcggaucacuugaggccagaaguucaagagcagccuggccaacaugauaaaaccuugucucuacuaaaaauacaaaaauuagugggcgugguggcgggcacuuguaguccccaucugcuugggaggcugaggcacgagaaucacuugaacccggaagcuggagguuacagugagcccagauugugccagugcacuccagcccaggcaacagagugagacugucucaaaaaaauuuguagcugugcugguggguauguguugcauugaagguuugguugauuuguuauuuaacagaaccuucaauuuuggaaguucuuugguuuuuauuuuuucaaauuuggaugcuagacuguuguugcaugcuugucuuaaugaauaccuccuuuauuucuuaagggacuauauagucuguuaccaauaguguguucuuugauguaugauaaaucuguacucuuaguacucacacauuccuaauuacuguuauaacaaaauucuuuucuucucacauuucacucacauaucuugguaacacauuuucuucuuacuugaaauacguuuguuuucccuauauguaauauaaauauucuacgaagacccuucuuuuuuaagauaucacucauucuuucuccuauauggcuauuugaguuugucuguggucuuaaaagauaaaugcagguuuucaaagauuaauguagaaccuauaggauuacuucaaggugccagguugugauauuacuucagaauugacuaugauuaauauauaugcuuuuauguauauguguauauauguuuuggacaagcccaaauuuuagaguucuuaaagaaaauauuuauuuacacauacauuuuuaaauguauauaauagauuaaauauaguagaauucaauuuaagaaauugaauuuaagaaauuaguauuuuauuuuauaguauacauuucugucuugccuugcaguuauaaguuuuaaagguuuuauuuuugucuucugcuuuaggcaauccuuuaucacaggauauucucaacuuauaccaggacccagauggaacccgaaagcuacugaacuucaugcuugacaaucucgcagguaacuguuagugacaaagcuguaaaauaaauucuacagauauuaugaacuagcuaauauauguuccucaagagcaucugacuguuuuuuauaauugccuauggguuuggaguuccuuccauuguauauccuacguuaguggaacauucuucuuuucauauacugaauguuuucuauuuaccaagcaauauguuaggagauuaguugcauuauuuuguuuaagaaccuaggacauaggaacuuuaacucacaguuuagagaugcaaauucugagauucagagacuaaaguaauuuauuuauacauagcuaaucagugccagagcugugaaucuaagauuaucuugcucuuaaucacaaaaauacacaguuauuaguuguuugcauuugaugcaaaugacuuggaacccacacauuuuacacauuuuuaaugaaugaaaugacuaguuugauucauuacacguuuguggaaauuuugcagcuagguuuuaaauuaagaacaccagauuuauuuaaauacaauuuaaaaucauuguauuccaaauggaaguuuucuucuauaagaauaccaggcuggaugugguggcucacacuuguaauccuagcacuuuguguggccgaggaaggcggaucaccugaggucaggaguucugagaccagccuggccaacauggugaaaccauggugaaacgucucuacuaaacauacaaaaauuagccaggcgugguggugcgugccuguaauccaagcuucucuggaggcugagacaggagaaucccuugaaccugggaagcagaggcugcagucagcugagaucgugccgcugcacuccagccugggugacagagcgugacucugucucaaaaaaauauauauuaaaaacaaaaacaaaaaaagaagacuauuagguauuugauuuaaaacuuuuuuuuuuuuuugccuaagcucugaaaauaugaguaaaaguauggagauacuacugcauacaaauauuuuucuuagcaugaugucuuucugaaauaacagaauucugaaacagcuagaaaaaucauaaguuccagcauaguggccaugaugacauuuuggcuauauucuuuuaaaauucucuuuaucguaagacgcccuucuuccccacuccuucacauaaaguaagguuuauaauaagguaaaacuaaauuaauauuaucugaaaaguuuauggcuaaaaagacuaaaaguugaucaauagaaaucagcaaauuuauuauagaggcguucuuaguaaagaauuaggaauauguggcaauuuaaugaagcuguauacauagcauguguaugcuguuucuaacuuacuuuaaaauuaaauaucucggccgggcaugguggcucacgccuguaaucccagcacuuugggaggccaaguggggagaucacgaggucaagagaucgagacaaucuggcuaacacggugaaaccucaucucuacuaaaaauacaaaaaaucagccaggugugguggcacgugccuguagucccagcuacuugggagguugaggcaggagaaucgcuugaacccgagauugcgccacugcacuccagccugggcgacagagcgagacuccgucucaaaaaaaaaaaaaaaaaaaaaaaaaaaaaaaaaaacucuugucucuauagauguagccagucaauccagccauaugugugugcugugugugugucauuuguaaggaguucuuguauguuuuagauguaagcuuuuuuuugguaauauguugcaaauaugugcucccaugcuauuauuaaauuuuucguucucuuaauuugucuuuugacaaacagaaaaauuuuaauguacuccaguccaauuuguugaucuuuuuuguuaugguaccgcuuuuauccuuuuuaagaauuuuuugauaccacaagaucaugaauauauucuccuaugucauuaucuagaaaccgguuuuuuuuuuuuuuuuuuuuuuuuuacuucuaauguuuagaauuagguuuuaugacuuuuccauauguauuuuauauugacucugagccauuuauugauuagguuguccuuucacuauuguuuuuuaaugucaucuuugucauaaaucaggugucaauguauguguaggucuauuucuggauucuuuauucucuuccaugagucuuuauagcaauguaacaguguuuaauuauggacagcuuuauaaaaagucuugagauccaguagaguaagucuucccccuugaccuauucuaaagaauuuuggcuaguucuggcaucuguguucuuuuaccuuguauuuuuauuaaaauuuuuagaacgagguuuuuaaaucucuccccucucuaaaauguagagauuuuauuugggauuauauugaaucuauagauggcuuuggaaauaauugauauguuuacaacaguggauccuauucuauuuguuacgcuuuuuauaauuucucucaguaguuuuaaguuucuauguagugggcuugcccauauuguauuacauuuauucuaaauacuaacuucuuaauucgcuuaaaaauagucauuuuaaagauuuaucuaacuuaaugguuguuacugauuaauggaauacaauugaguuuuguauauuuuuugguauucagucaucuuccuaaacacuaaaugccuugcuaaagaacauauucaaccacuuugcuaaauaguuuuuaaugcuaaugcauuuuuuauuuuaauguauacaauuaugucaucugcaaguaaugagaguuguauuacuccauuucuaauccuuuuaauuuucuugccaaccugcucuuacugcacuaacuagcuaaaaguggugauaaugggcauccuugucuaauuucauaauuuuugauuaaguaucauauucacuguaguuuuuguauagauaaacuucaucagaugaaggaaguuuuuucuauuccugguuugcuaggcaaguuuuuuuuuuuuuuuuuuaacaugaguagauuuugaaauuuaucagaugcuuuucuuuauuaagaugaguagauuauuuuuauccuuuaauaugguaauuauauugaugguuuuuuuguauguuauaccaccuuugguauuccuagaauaaagccaacaagauuaugauaaauuauuaucuuuuuauacccuagauucaguuugcuaauauuuuauuuaggauuuauuuauuuauuuauuuauuuuuaugagauggaguuaugcucugucacccaggcuggaguacaguggcaugaucucgacucacugcaaccuccacuucccagguucaagcgauucuccugcuucagccuccugaguagcugggauuagaggcacacaccaccacgccuagcuaauuuuuauguuuuuaguagaaacaggguuucgucauguuggccaggcuggucucgaacuccugaccucaagcaaucagcucaccuuggcuucucaaaauguugggauuacagguuugagccagugcgcccagccuauauaggauuuuuugcaucuguguuuaugacugaaauuggccaguacuucuuuuucuucaguguccuugucaaguugugauauuaaaguuacacugguuuuguaaaauuuauuuaaguauuuccuuauuuucuguuguuuggaagaauuuauuuaagguugaauuuuuuuuuucuuucuggguuuuuuuuuuuuuucugguaggaaguuuuaaauuacugauuuaauuucuuuaauaauuauaguacuauucugauuuccauuucucuuucuaugaguuucugaaaguuguguuuucuggaaauuugcccauuuuauguaaaucuucaaauuuacgggccgaaaguuguucagaauauuuuaugaugucuuaauauccauagguuguguagugaugucuuuuuuccauuucagauauuaauuuaugcagaugauaaauuaugcaggcauuuauuaauauuuucuuugaaaagaagaaccaacuuuuagcuucauuggucuucuuuauuguauguuuguuuucaauauuauuaauuucuuuauuucuuccuucugguuucauuugguauucuuuuucuagcuuaaggugaacaugccuuaauuuccagucuugcuuuuuuuuccucaaauauauuuauguauauauuuauguauaaauauuucucuaaaguggcuuuuagcuguaucucacaagcuuuaguuuguauuauuuucauuaucauucaguucagcauauuuucuaauagcccuuauuucuuccuuggccugugagucauuuagaaacuuguuucuuuauuuucagaggaguucuuccaguuuucuuugucauagguuccuagcuuaauuccauggugguuagagaacauaucuugauuaauuuaaauguuaaaaauauuuauuaccucugcagaugauuaauuuuuguaauuaaguaugcacuugagaagaaugucucuucucauuagaugcaguauccuauauguuaguuuguuuguucauuauauuguuugaauguguuagauguacuuaaugauuacuuugguuuuauucauuaccaauaaagcuaugucaaaaugguagguuugucuuucuucuuguaguuauuucagcuuuucaauuacauauacuuaggguguauuuucauguguuuuauauucaugguuauucaaacuuucuaucuugcugcacauuuacuuuacugauuccuuguucuuuccuuuuuugguguuccauuucuguuuuccuugauauuuagagaguuuccuuagcucacugcagccuccaacuccugggcugaagugauccuccuaucuuagccucccaaguggcuagggacuacaggcucccgucaccacgucuggcuaauuuuuuaauauuuuuguagagaugggaucucacuauguuggccaggcuggucuuaaacuccuggccucaagugaucuucccaucucagccuuccaaggugcugggauuauagguguaauccacugcaucuggcccucuuuuagcuauuuuuuaagggcaggucugcuagcaauggaaguguuuuccuuugucuguuaacaucuuuauuuccccuugauuucugaaggauaguuuuucuggauacagaauuuccaguugacaguucuuuucuuucaguccuugaaaaauauuguaccacuuccuuaggcuuucaugguuucuuaaaagaaaucuagugucauuugaguugauguccuauagguaauaugcuauuucugucugauguuuuuaagguucguucuuuaguuuucagaaguuuaguuacgaucugucuuagcauggauuucuuugggcucuugauauuugaaguuuacucaccuucuuaaauuuguuagguguaagucuuucacauaaauuuggaaauguucaccuguucucucauagaauacuuuuuuagcuccacauccuuucuccuguccuucuggaacucugauaauacuaaucuagauauuuuuaaaaaauuauaguuccacagguuuuuucaggcucuguucauuuguuucagucuguuuucuuuuuguuuuucagacuaaguucuccugauucguucucaaguucacugauuuuuaucuuuuggcaucuuuauuauugugccuuuccaaugacuuuuaaaauuuaaguuauuguauuuuucaguuggauaauaucuauuugauacuuuuaaaauaauaauuucucuguauuugcuggauuuuucuauucuuuucagggauauuuguaauuacuuguucaagcaguuuuaugauggcuguucuaaaaucugucagauauuucaacaucugauucagcucaguguuggugucuguuggucuuuuaacacuuaaguugugauuuuccugguucuugguaugaccagugcuuuuuauuuguacccuggacauuuuggauauuauguuaggagacuucugaugcuuuuuaaaucugugauuucagcagacaguuacccuguuuagguuuagcauguagauuugguuugucucuucagguucagcugacaccugcacuguaggcagaucaggccuagugcugccagucaguguuagguguggggaggaagguuggcucucuugagcucuguugaagauugggucaccaauauauuuauuuauuguaugugauaguagcccauauaacucuuuauuucuuuguuuugucauaucauuggugauaucauuuggccauguaguuucaucuuuaaaaaaccugacuuuaggccaggugcaguggcucacgccuguaaucccagcacuuugggaggcugaggcaggcggaucacaagaucaggagaucgagaccauccuggcuaacauggugaaaccacgucucuacugaaaauacaaaaaaaauuagcugggugugguggugggcgccaguagucccagcuacucgggaggcugaggcaggagaauggcgugaacccgggaggcggaacuugcagugagcugagauggcgccacugcacuccagccugggugacagagcaagacugucucaaaaaaaaacaaacugacuuuaaaugcaugucucacaugaauauauuauccuuuuguaaaaaaaguuaaaauuccuguuaugauuaaaauuucuuuuaaucauuacuuuuaaucacagucccuuccaugcagguaaucauacuugugaguuggguguauauccuuuuacuuucugguaggcauuuacauacaaaaauuauaccagcagaaauuuuauacuauaacuuuuaguguaugguuuaaacauuuuuaaauaaaauauaucacauuuuguuauucuauuuuuuucuacuucuuuuuacucaacaguauuccauggauauauuuccacuugaauacauauuuaucuuuuuaaacuauagcauagacuuucuuaaaauggauauuauuuagccauuuacuauugcuuucguuaauauaaacaaugcuguaauggauaucuuuuugaauccugcuuaaagaagauagggcugaucccaggaaauagaauuuuacucagucauagggacauggguguuuuaaauuuuaaaagaugccaguuuguucucaagauagcuguacuaauuuauauuccuaccagcuguacaugcuguuuaucgccaucaccaguccuggauguuauugaacuuaaaaauuuugcgugaacuuggguaacaaauaugccaucucaucuuuuuuaauuuugcugguuaguagugagauagaguauucgcucauauuauguuuuuggcucuuuggauauuguugauugcguuauacuuaaacugcuacauugugauacacuaguuaagauuuggaagcaccaaaauguugauauuauauuaccuguuuuauuuuagaaguuucuggauuucugaauuuuuaagcaagccagcuuagguagauuuugcuaauuaaggaucccaauagcuagaaauuuuuuuguuuacucuuucuguuucuauauuagauuuuucauuuuugagacacuugcugugacucugccauggcacucacauagccagaagauuguuuucugggauucaguauguugaacaagcuggaugauuugucugucaucuuauaaccuucuuuucuuuccuggcaagauauggaauauaugaaauagaguucauucuacucugugaaaaguauggcugcuaaaacagaguaucauauagguagacuuucagaacaccaaaacuguuaauaaagugacaguuuuaaagaucugggcuacuuuggucaaaauuucuguggcuagauaaagauggaguguuguuuuaagggaauacauuucucagccauuaaugccaugggcaaaucugcaaacuugaaucaaguuguacuguaauuucaaagauuuugaaaggaaaagaaaaggggguaguuaaaucuuaacucaucugguaguuagguagcauuuaguuccauaguauugauaaccauaucugagcaauuaaugucuaacaagugccuaccuuuuuucugcauaaugugguucuauccuuaucucuuguuuugugcugacauuauaaaagaguaaaaucagaaaaugaaggccccacuagaaaauucacuaacuuuaauacauccauauguacuuuuuucuguuuuaaagauguuugaguauuuuaauucaucaggguuggaauuucagauggcuuugauuucccacaaggcuaagucaauacaauuuacauauauaauuagaaacuuaagauuuuacauaggguuuuaaauagguacuuuucguaaauaccauguaagugaaaaugccauuaaugaauuuccuaauguuauuuucuuguauuaguucuguguucucugcauagcuuuucugaaauuuccuuuggcuccuuaaucuucauuaaauuucagcauuagauuaagucaguuugcaggccguuacagcagaauagaaaacagaaguguuuuugacauuauaaacacauuucagauuucagaaacacaugaaauuaaccuauauuuacaaaauuuuuuucaguucauccagagcagcuuccuccgaggccauggauuacauuaaaagaacgagaccaaauucugccgucagguaaauaguuuuucuuauucuuccuuuuuuuucagaaauucuuaaaauguuauuugggcuucaugaucuguaauaaauaagacuucauuuuuaccuuucauggguagaugcauuuaaaaauacugauggauagacuuuuaaaaaguccacauuaagauagaccugucaauaggugucuuauaucuuucacaguaaugcagcccuugguuuuaaaauuauuucuguaauacagcuuuccaaauagcaucuucauagagaguauugggugauuuaagauuuaaguaaugcagcccuugguuuuaaaauuauuucuauaauacagcuuuccaaauggcaucuucauagagaguauugggugauuuaagaaaaaugagaacaaugauauuucuugugaaaaauuuuaaacuacugagaaguacuugaucuuucuugagagauagauaacauuuauggaagaauaauguagacuagacauauauuuacuauacuggcaacaaaguauaauaccagcccagggguguagaaguaguacauaguauuugagcaauauaaggauauaaucuagcauuucuagaacugaaguaauguagaaaacauaagccuuuaucuguuugcagggaccaauaaugguuugacauuuauaaagcuucuucauauuugacauuuuaggcuugggaauucuacuuaaaauaaguuaugaauuaccguuuuucgaaaugucuuuuuuuuaaucacaagaguaauaauuuucaugauaucuaauuucauuuuaaaauuaaaugaaaauucuaaguguuuggauaugaagauuaaaccagucacagaauaguacuacauuaauagauuuuggcugggcacuguggcucaugccuguaaucccagcacauugggaggccaaggcgggcagaucuguugaggccaggaguucaagauuagcuuggccagcauggugaaaccccaucucuacuaaaaacacaaaaauuagccaggucgugguagcgcacuccuguaaucccagcuacuuaggaggcugaggcacgagaaucgcuugaaccugggaugcggaguuuacauacagugagccaagauuuugccauugcacuccagccuaggagacagagcaagacccugucucaaaaaaagagauaguuaauuuuuaaaggguaaaucacaauuagacuuuauauauauuuugagcaauauaaaggccuuuuguuugugaguuuugggcuuuuuuuaaguuaagaggauucagaacaagucuuuuuuuuuuuuaguauuuggaaaugugggauauauagccucuucaugguucuauuugcauuuuaauaacacuacaaaauauuauaauaugcaguacauuuuugugucuuucagagguaauaauuuuaaaaccaacccacucuagagcugcaauaucagcuuguuuuaagaggcauugugucaguguuaugaauaacauuuuuacuaucagguugcauguugguguuuaagugaaaggaguaccuaagguuuucuacaaaacuuaaagcuagauagauuuauuuuauacuuggccuuuccuaguguauaauuaauuauucccuucugauguuaaaaacaccauuuucuaauucuucauaguaaucccuuuugaauaugagugaacauaaucuugaagaaaagauuuucuaauauugcacagcuacauuucuauuaagaaaaggaacaauagaaacaaauuuucauuaauugcugaauucucaaaguaaucuguucuuggguuuucuuuauugaaaaacuaguguggacuuuucuugugagguauggugcuucucugaguaggaucugagugcugaaaaaaaguuacuguuaaaaaugcauuuuacuucugaugcauagagggauguguauaauacuuugugguggcuaagggugauuuauugcuuaaaaacaugauaaacuauauggaaaucaagccuagauaaugaaaaaggucccagauagaaacagaguauaagagaugagugguaauaacacuuagguaguuuuuacuucuguuuaaaaauugcugguucauucucaggcacuggcagggauauaaagaguuuuggcuauauuauaaaaauugcaaucucugaucuuuuuaaugaaaucucaguuuacaaagucuuaggaaaaaacugaaugaagcaaauggcagucugccucuuucgccuuacuuccaaaugacauuucaaauacugagaagcauaguaagguaaauucagggugcuuacuucacaguguaguggcuuggaaaugaugcugggucauuuccaagauaaauacucagaaaguacaaaagucaacucaaauugaaauuuagcucccaguguacaaaauggucaccagucagaccccccaggggacugaacugaguuucucuuaauaccuuuuccaucaucugaaacagaaccaacuucaaucaagugucacuucacuuugaauuccucacgucuuauuuaaauaagugauucucaaccaugucuguucauuauaaucaccugggaugcugggauccuuuuuaaaaauacgaauagcuagacucuuaauauuucaacuuaauuagucuggagucagacccuuacuucagcauuuuucuuuauaaggucuacaaagugauucuacuaggcagccaagauggagaauuacugauaaaaaucagggcuuuucagacuuuaacaugcaagugcauaugaaucaccuggagauuuuguuaaauugcacauccuguccaaaagagguguuuauggggccacagauucugcauuucuaaauucccaggugauugauuacugaugcugcuggucuucacagcacaguuuugaguagcaaggaugcaaaccaucuucuacuauuaguuugcucacagucuuuuuauaguuaaaggacauuuaaaaaugagcauuuuauuucagaaaugaacauuugauugacaaaaacgauucucuuacaacuaaauuuuguuaguccauacucuucugcuucaaaguaaugauagcaguaggaggcacaaaaaauacuuagauauuuuguuaauaagagguaaugagauuagaguucuuuaauuaaaaugcaacuacaguuuacuuuuguuccacucauuuaaagaagcuuuucucaaaguuauaagcaaaaaauuagcagauuuaaaauuuaaauuuuuuauuaaaauaaauuuccuuaaaacucucaaauauaagcuguuagucuaauucuagacuuaauaaaauaaauuuuguaugauagacuccaaugauguuuuaguagauuagcaaucuuuaucuugccuaggcauuuuacaaugaugauauguggcguaugugugugugcuugugcagguguacacaugauauugcuuuagaaaaaguugccuaauuuucucccguuugucuguuguuuuuucucccacuucuuagcaucauucacgguuauguguuacaauguguuaugugauaaauacgcuacccggcagcuauauggcuauugcccauccugggcauuaaacugggaauacaggaaaaagggaauuauggaagaaauuguuaacugugacgcagauaucauuagucuucagguaacaccauagaaauuaaacugucuuuaacuuaaaaggugaacuuaaacauaagagaagaucugaccacugggagagauccuguguuuagagccaaagcucaaaaagaauuguuuucucuccucuuaaaaauaauggacaauuuaaauaagcauuuaagacauuuccauagugaaacuauuuugcugacugaauacaaccaccuacuuauauuuauuuacuguuuucuuaaguggaaauaaucuuacccguucauguuaauauucaccucaugaucauugguauugcugaaagagaaaaccacagaagauugccagucuuuuaggaauauaaauuuaccuuguauuggagucuguuuuuuuuuaaaaaaaaaagcuugcccacaguuauuccuuaaacagacauauuuuaauauauuguacuauaaaucaugcauauuugccuuaccuuacuuuauaaaccaucucugaaauuuagauucuucuguuuuauagcacuuuauaaauugaacuuuacugaagaagcagcaucuuuucaugaaauguguucuguugcuucaaaauuuagcuaaugauuagccaaaaagauguuugaauaguuuuuaguaacuuuuuucuuagcaacuuucaaaacauauuaagugcuuaaagguuuaaaaauuuuuaauugacaaauaauuguauauguuuaugggguacauugugauguuuugauacauauauauuuuuuuaaaugaucaaaugaggcuaauuaacauauucaucaacucagaaacuuacuauuucuuaaagguguuuaaaaauguuguguguuacaggccgggcaugguggcucacgccuauagucccaguacucugggaggccgaggcggguggaucccuuggggucaagaguuugagaccagccuggccagcguggugaaaccccauaucuacuaaaaaugcaaaaauuagccaggcaagguggcgugcaccugucaucccaacuacuugggagccugaggcaugagaauugcuugaacccaggaagcagagguugcagugaucagagauugcaccacugcacuccagccuggauggcagagcgagauucugucucaaaaaaaaaaaaaaaaaaaaaaaaaaaaaaaaaguuguguguuacaauuucacacauucuuuucaucauagccugagaggaaaaauuauuaaaaauuuuuuuauguaacagaguagcuugauaauuuauuuuuagguugcuugggaaaaaaguaaaaaucuuuuaaaauuaaaauaaaauuucuucuaaauacugagacuaacagagaauuggggagaggaggcggcaaacaaaaucaggcuauuguaguuucuugucuacuucuugguuuaguauuuguagugauaacagccucacacccuccuaaauauagcaguuugaaggauagaacauaauuuaagaaaauugucuuauuauaaaagcaaugcuauaauacuauacuguauuaaaaagagaucauucuagagaaguugaaaauuuugaaaaaauauaaagcaugauggagggaaauaccuaauuucaugucauaagauaguuguguuaaaacuucuggaguauuuuucuucuauacauuaaguaaaauauauuuacagauacauuuugauucuuauuuauuguacuuaauggauuuuccauguuacuaaaauucuucaaaacucauuaauuauaugaacguauauugauguagcuuuucccauaccauuggacacauuuaguuguuuauggguuuuugcugucauaaacucaugcuguuagaaacaucugcauacauaaauuaucuucauauuuauuucauuuagaaagaccuguuaaaauauuuuaugagucaaagaauaaaauagacuaauaauuauuaaauuaauagaggccauuggaugauugcgauuuagguacuuaaaaauuucuuaaaguagaauuuuuuguggauagauuuuacguuucucacucuuggguaucauuucuuuccaccauaguucagaaggauaugcaaguuuuuaaauuaccuuuuuauauauaaauuacuauucccuaucacagaaucuaucauauacccaacuugcuuuguuuaguugccagucuugaggaaguaaaguauaauggagugaacuguaaauugggaaucaagagaccuugggauguaguccuacuccuguuacuaucugugugagcaugagaaaaucaugucaccuuucugguucuuucauguuuaaaaagcugccauugucaaguagcagcugcuagcaaucagguaagauaguaagauaauauuugcuaugugaauuauuuuuacuaaguuacaucuuacucauaaugcugaacauuuuuauaucuuaaucagcauuuucccucugucauauagaugauaacuuuucuuucaucucaggaaguggaaacagagcaauacuucacucucuuucugccagcauugaaggagcguggauaugauggauuuuuuucuccaaagucacgugccaaaaucaugucugagcaggagagaaagcauguagaugguugugcaauauucuucaaaacagaaaaguaaguuaaggaaacaaagcacaaugguguacuuuuauuuauuuaaaugcuuacacuuuaaaauugucuuugguuuugcccuauaaaaucaacagaaagcuagaaaacaaguauuaugcaacuuaaaacuguuguuaauguuucauuucucaggcuguguauucgaaauaaggauauuuauuguauuauuccuuaugcuuuuauuaccaaauaacacugaacauuuuaagagauacagacuugaauggucucauauuucagaacauauuuucaugaaguaaaguauuaguuuuuguguaaaaaaagaaagugauaccuuuuaagguuggccauaagugaucuggguuucuuuucugugauuuuuuuuuaauaauugauuuuugagaaucauucauuuuaaaaucauuuauucacuaaauguauacugagcauuugcuuugugauaaguccugugcuagacacaacagacacaaagauagucaagacauaguuccuaaucucacugaaagcucaaauccaguaggaaaaacuaggcauauaagacaauugcaauaucauaugguguaauauaagauagaggucugccuggguagauaagagaggcaggcacagagcauauggagguagagaguuaaaaggguugacugagacagggcaauggaaaaugaaacgugacaucugauagagguugaaucccaugguuaauaguuuggauuucauacguuaggaaaucaucuuacaggauaagcauauacaugcuuacagcuguuuuccaguauuuccccauuuuacaucuauuuuaccaaagccaaucuguuuuuauugauccaagcauauuaccagcaugacaugcuauuuuaaguaaacaaauucaaugaauuugaaagauauuugguccacuucccauuuaucuaugccuacuuuccugucuuuuccaugaauuuguaguagagauauucuuauuuugguuaauaauuaguacaaagccuuguaguauuugaggucagaauauacuaaauucuucuaaugguuugguaauuuuuuaugcauuuuagaauaauucuauuaaaacuacguaucucuuaacuacgggaauauguucugagaaaugcaucauuaggugauuuuguuguugugggaacaucaugaagugcacuuacacaaaccuagaugguacagcacuauacaccuaggcuauaagguauagccuguuguucccaggcuagaaaccuguacagcauguuacuguaguaaauagacaauuguaauacaauggcauuugagucuaaacauaucuagacguaaaaaagguaauguauugugcugugauguuaagacaccuacaucaucacugggugauaggaauuuuucagcuccauuauagucuugugggacuaccaucggcauguagucccuuguugacugaaaucuuguuauaugguauaugaccguacuuccagaguguuugccaucugucagccuuuucgaauuguuuauauuaguugucuuguucaaauuuuaaagcaacucuuacaggcagcuauacagcuauuuccuuguuuuuaaagaugaggaaaccaagguacagacaaguucaauaacuaguuccaguuacacagucugauuucauaguccaugcuuuuaacuacuguaauaaacugaaucuuuagccuucuuguuugagcuuuugauaucacuaauaccucuuauaagauuaccucauuuagaaaaauugcccugaauuugacauuuguuuuuguuuuuagacagggucucagagucuuacucugucacccaggcuggagugcaguggcgaucauggcucacugcagccucaaccuccccaggcucaggugauucugucaccucagcacccugaguagcugagacuacacgugcaugccaccacaccuaacuaauuuuuguauuuuuuguagagauggggucuugcuguguugcccuaggcugguuuugaacuccuggguccaagcaauccacccgccucagccucccacagugcugggauuacagacguaagccaccgugccugacgauauuuguuaccuauguucauacacaaauccccuugaaacaccauagcuuaaaaaaaaaaugcaccaguaaacuugagacaucuaacaucaggcucuuuuucuauuugcuauaguuucuuucaagauaauauggaagauuuuuauuauuacucucacaguuuugagaggaaaaaucuaaaauuccuuaacaauuuacuagaaguaguuaaggcuuugaaauaacaguuagaacuguuaucuggguauuugcaaauugauucuugaauuauuaaaaaugcugugaacuaguuaaguaaugagcacauaggaaguacuuagaugugucaccuguuuuucuuuucuuccucaacucuuuuuuccugaauaguaacauggaucuggcaacagauugaaugugauacaucaguauauuguaccucuuuucaacuucuuuccuggaaugacaggacuauauaccuccuauagguagaacaaaaccaccuucugucccaguaccagauauuuauccaugucuuagcugacuauucagugccaacuauuuggaauuuaaaguauuauacccugccuuuauucuuucuucagacuggaaauauagggcaaaaaaagacugugaguuuugaagccaggugcuucuucuauuuauuuagcuauauaauguugaaagacuuagcauuucuggaccuguuucuucauuuguauauucuuaucuuguaagaucauuuuuguagagguuacaaaacuaacaaagauaacuguggaagaguagucaacacuguacuuacucucagucucuuucuucuguaaucagaguaucugauaauuccucaucuucacugaugacuguuuaaucauacaugaaaaacugguacagaauacgcaacaauaaauggaaacuaucauaauugccauuuauagcaaaauacuauaauaaaaaucucuaauccaucaugaugaaaggauagaguauuguuuaguaaaggcuaggacacaaguuaccaauauucagauaauuagaauauaauacacuguucuuuaaaucacauuauucuaguuuaguuuugggggauucagaaucuacuucaggauuuggcagcaccuguuuggucaucauuaugaacaucauuuuuugggaguuagaugcauagagauacuagaaaauagaacuuugagugauaaaauaccagaucucagcuuuugcuuugucuuuuaacaaguauuauuuacguuccaaagcauuuuauaaaauacauucauacauaugcauauguuucuuauauguauauaauguauauguagaaacugaguuguaaauacauuuuuuuuuuuuuuuuuugagacggaguuucacucuuguugcccaggcuggagugcaguggcgugaucuuggcccacugcaaccuccgccucccagguucaagcaauucuccugccuuagccuccugaguagcugggauuacaggcaugcgccaccaugccugacuaauuuuguguuuuuaguagagacaggguuucuccauguuggucaggcuggucucaaacucccgaccucaggugaucugcccuccuuggccgcccaaaaugcugggauuacaggcgugagcaaccgcgccuggccguagauacaugcuuuagacucauaauuuaaauuucuuuuugccauguuuuguccuauagacuuaaccauuaaguagaauugggucuuggagccagauacacaacuuaauagugggggaaaauaugaagaugaaagcagaccuauaugcuagacuugcuguuccugagguuagcaguucugaccuccuuaucaugcuuuauuucaagucaaugagaaagggaaagaugaaaacagcaauuuagaacagugugaucauugcacugugaagaggcaaucucuuaucauaggauugggaacuuagguugucauggcacuuaguucuugcuguacuuccuaaccugcuuccauucucagagguaccagguaaggccaaguccuugcuuuuuuuucuucuauuaucacagguaguuuugugcuuggaaggaggguuuucagaggucauaguaucauuccaaaaugguacaguaucauuacuguugugauacucccaucucacuggucucucaguuauuaauuuccugugucauaggugguuguugcauuuagaauuuguacguaggauuuuuuuugaaaaugagauuuugaucuguacucuucugguaauuucuauucaaccuggaucauaacauuacgacuuuguacuacaguuucuguaccuuucgaauauagauaauaacuguuccacuuuagagguuucuuaugggguuaaaauaaugaauguggaugcacuuucagugguuaaaagagcuguacagucugggcgugguguuucaccccuauaauggcagcacuuugggagucugaggcggguagaucacaaggucaggaguuaaguccagccuggccaagauggugaaaaccugucucuacuaaaaauagaaaaauuagcugggcuugguggugggcgccuguaaucccagcuacucgggaggcugaggcagagaauugcuugaacccgggaggcagagguugcagugagccaagaucgugccguugcacuccagccugggugacagagcaagauuccaucucaaaaaaaaaaaaaaaaaaaaaaaaaaaaaaaaagaacgguacaaauauaggauguuauuuaucuacuuccuuauuuaaccuggucucucagcuuaccuuuuccaauuaguuaccuucuggcacucccaugauuacuuaaagggaccaagaacacauuuuauaucauuuuauacugaauauaguaagaacuucuauuugguuugguuuuaacaguguugggaugugauccagaaagggucagaguuaacuuugugugauuauacuauugucuugacuguguauuacauugccccuuuuuacuuguaaaugaauucagggauggaauauuacuuaaauccuauagauugcuuuaguuucucauaguuggcagucacuguccucucucuagcauuaauuaauuacaucagagcccacaaaguuauuuuuagacuacaaguugguaagaaauugaguuaugucuuuauuugaaggacugcucuggacguguucuuuuugcacaugaaacauccaaccuaauaauaauucucaaaucauauaaggggauuuuuuggucauagcagucuuuauuauauuaauauauguucuuuuauccauuugaccuuucgucuaguuuuuuuuucaaaaaugugaauauacagaagaauucuuagaauaaaauaucaucaggaauaaugcuuuuagcaucuguauaccagucacagaguaugaaugguaaacuaauguaucgaaagagacaaguuuaagauuuuccguauuaccaaggcuguauggcuuggaacaaugauuggaaaguaacuauaaacuaauaugucuaauugagaagaaacaucuaauaauagaaagaauggcagaaaaccucuauauuucaaaauguuaccuguauggaaaucugugaaacaaaguagaugcagaauagagugcauuugguuuguaugggaagggaaugcaagaaguagcauuguuaagguaguagggauagaauauggguaauuauaucuuacuauauuguaaauuuauuacaguuauaaacaaggaaauaagauaaauuguagauuacagccaucagcacuaaugcuagaaaucucauucuuuuaaaaacagaauaucugagaaagucuuaaaguucaagaaacauaucaacacucuuauuuacuagaaagaaggaacuuuauuugguucaacuaguuuucaacucucucuuugguuuuucaacccuuggugaagcugaagugauaaaacuugagugagaaugugugcucuagaguuucucaguggcaguggaagggaguguuaguuauaaugacauaugcauccuguuuaggaagacuaguuuugcuuuucuggacuuuugaaaccaugacaguaaaaagaagguaccuuuaaaagauugagaaguuuuaaaagucaaaaguauggcaguauauaccaaugagaaauaaaguuggaaggauaguugcaagcaucugauaacccagugguugcucaagauuuauguuuaaagaauuguuauuuaaaugaagaaagaucaauaacuaaucauguauuuuuaaaaaaguuuaaugaaccuaugaucauuacuaagaaacuuaagaaaaagaaaaggcugggugaaagugcuaaggcagugaggaggauauuuuaacuaacauuaugcacuguaaauaacaaggaaggaauggacccgcugcagacuguauaaucaguaauugacgaucaacaaaaaacagcucuauacaauuuauguuuugcuuucaugauuucuauugagaagaauuuuccucaaaguagaaacacuaagaccagguaaagaggagaauggcaaaccaagacggugagauugguaagccaagagagucacuaaacugcacuaacuaguuagguuuucagaugaagauaauuauaucuuaugguauuaaagaucuuacggaagugugguuagagaacuggcaaagguaaucuguuauaaauauuggaguagagaaaaaaauucuaggauuugggggauggaugaacuaucaaacuuuucaaaaagacagacuugcccagccucaguuuucuucaucuuuguaauggcaguaguaauaccuccugcugcaauguggguucucagagauaaccgaaagaagacucggagauaguuugguguucaggaguuuauuagaaaucaacaccuguggaaaggggaggaagcagaauuggacauacggagaaaagugaaguguugcaggccugacugccucaggugacucaacagggagcuuuagagcuuauauggccugugagaguuaaaccacaaggggcccacaucccuggacuuuuaacuuuugcuuucgauuucuaauuggaugguggugcuccuagaaguaugugaccaugaguaggcagcuuucugcaacugaagcaaucccugaugaggaaucugagcaguauaucuccaugugcaaauuuuaggacuaacauauaugaaguacuuaacacaaaucuugagacuggauagauccucaauaaugguagcuuucauuuuuuuuuuauuauucuguccuauugagaaauuuaauuauuuugagagaagagaaugcaugcucauaacauuuauaaauguccaaaagcuggcagggauauuuaaucuauuagaaaaauagaauuagauccaauagaaaaauagaauuauauccuguaaauuugugcaucuaucuuacauaucuguaaaaaauuaaaaauuaaauagaaugaaguuucagagcacuuaauauccgaauaggugaacuaaugagcagauguucaugaagugauacuuaacugagguaaagauugccgcucuuagauuauuaauggaaggaauaaaaagagggagggacaagaaucagcugagaccacagaaaaauauauguagcaauguucauuacggcauuaguuaaaauacguaaguaacuuaaauguccaacacagguuaaauaaauuauggugaaucuguagaguggacuauaauccagucaucaaaauugauuuggaagaauauuaaauguuauaggaaaugucccugauagaauaguauuguucuaaaugcguaaaaauauguguguguauguguguagagaaaagucuggggaaauauauuaacuuuuaaauggagguauuggguuauaagugacuuaguuuucuuuguucucauaucucuacaauaaacauauuuaauguaucauuuuuuccacguuuuuguuuugaaguaccuauaaaugcaggacugacaagaccugguuuaagagcaaaaagaucaaaacauuucagauauauguuaguuccuguuuggcuuacaauaugacuuuccccaaagugaaguuuuagucuuuauuaaugaaaauacaguuaaaaaaugaagaaggcuguaguucauuuaugcccaguuauagguacugcaccuuuggguaaacuugaguuguucaaaugaacuuuucaaaaagacagacccaguugucaguucaauuuaaauuuguugagcaaauuuaaacaaauuguucagaugaacaacaucacacaucauguaaguguaacugaucguuucuuuuccggagaagacauggagggugggagagcauugacaucuauugucagauauuuaaaguggugucauuuggaagagaaauuagauuuaauguauauucuugaaaagaucuagaucuaguuuuaauggaaaaaaugggagaagaauacaggaaagcaaauuuuaguuauuucuuuuaauuagaguccuaugcuccccugccccuacgccccaaagaaugaccuagcuuugguagaaguaaaauuauuccaguuauaaaaauauuauaauuaacaggauuuuuaagacuuuuguacagaauccuagguuccuguaaguauaccauagaaguucugugaauauuuagaagauaucucaaaaauuaaaugugaauaauugaacuguaauuugaaaauaacauguucacucacauguuucaaauacaaguuuuaacauuuuggaaaucauuaacguguucauaaaguacugcuuaguuaacuuguuuuuggugcagaccucugaaucaaauuucuucaugucugcuucuuuuuucugaguauagggccaguuauuuaccauuuauagcugugugaaucaggauuuuuaauaauacucuguaaccaaaacaaaauacaaaaauuggacacugagacugauauaaaacuauaucaucucuguccucugauuucaaauuuuuauauucaucaaaauagguugcuuguuuucagugguugauuuauucuaacauaaugcugcuuuuaucuguuuuaucugugggaaucucaccagaaacuguaaaagguauuccacagcuuaaaauuguuugaagaagucugauauggacaauggucaauccugucuauaggacacauuuugaaacugcucacuccucuugauuucucuugccuuuguucaagccaccaucauuucucuuucagauaaccucacaaacuuucuaaucugcuucccaguuaucaguucuuuaauugagcagcuaagugaucuuaaaaaacauaaaucaaaugauaccauguccuggcuuagaacuuuuaucucuccucuucagcaucauuucauacccuuccauucuuuucuaacacauaaacuugcagugcuuuuugcugucucaggaccuuucacauuuucuaccugggaugcucuuaaccccauucuucaccuuaguaacuuucaucugucauauuuaagcuuauagauuaccucuuuagaggguagaaacuauagucacuuuaagcacucuggguuagaaauaggcacauaaacugacccuuuacacuugucaguccagcugacacguucagaauuggaggagggaagggaauauugcuucauuuagugcagcauccuguggcauaguaagucaauauuuuugaagaaacagaaacuagcuucuguuuucaaagcuugaaggaaagugaggaggggaucuguuacaagacuaugucuucucuccacugaacaccuagugcaaguaauguauuuaguagguuuugauuacuuauaaauauuucacaaauuaauaaaauuagacugaaaaagguuaaaugacuucaccaacaucccacugcaauuaaaugucagcacuaaaccaauucuauuaaauccuacaacucuacaaugcuuaauaauuuggcauuaaugaaggaaagaaaaaauuauuagugcagaagcuauaaucacagagagagucauuucuucaucuugcagaaucuguuucucagaauacuuauaccccauugcaacuuucuaguaaaagucagauggaaaaaucaguuacucuuuagcugagauaaaggugugccccuguauuuuguugacaaauaucuugaugugguagaaauaaaacuacaaacaggguagguggauuguauucuuuuuaucuuuuucucauuaacuuaguugagauugugugcaccuuuaaauaccagaaaauucuagcaguagcuuaaacaaaugagggaagggugauuuucucacacaagaaguccagaaauaggcaguccagaacugguucagcugcuuccccauuuuuagaagguuggcuuuugccuuccugcuucuuauuucauggucacaagaugguuauuauuucuccgagcacuagcuguaaggggcaagguauaaaagcaugaagggauauauaugcugucuuuguuagguggggccucugagaaacuuuuuacaauaaucagacuucuugugucuuaguggccagaacuguaucacauggucacuugcagcuagaaaaugacaagggagacaaugcaugucauguuucuuucauuuaauaucuuucagcaugauagucuagguaccuaaaauuauaauaauguaccuuuuagauuuacauuggugcagaagcauacaguggaauuuaaccaaguggcgauggcuaauucagauggauccgaagcuaugcugaacagagugaugacaaaagauaacauuggugucgcugugguauuagagguccacaaagaacuauuuggagcaggugagugcaauguaaaauauucuuacuaaaaauaaacaccaucccaaguuuuuccaucucaaaacaagugaagagaauuuugccguuauuuauugcaaaguuauuuucuuuugaggaaaguuaagggagaugggcaggaaaauagcaccauuguguaaagcaucauauauuuguugggauauuuugugcucucuaucacagucuuuuuuacuuaccagauaaucuauguaaagucuuuuuuaauaugccauuaaucccaaacaguucuuuuaaauagggaauauuuugguuaggcugaauuuagaaauuaugaugacuuggcccucuuuuugaauuauauuuuuagcuugagugugauucuuuugucuuuaagguuaaggacuuggcacauuuccucuaguuucuuuguuauaucucagucauugucaggguaagagcaggaucuuuuaucuacaugguacuuacuuuagcauuuuagauuauuuauagcuuccuucagagucagaaacucauuauguacuucauacacagaccuuuuuuauccuucuuacugccugccuuugagcaucucacuguuuacuaguacauuuuaagcaagaaaggagugagacuacaucagggcuuuuuuuccccuguacuuuuuguagaggaaaagauuauuuuggacuagaguauugauuugaauuauucagaccaugcauaugugucaaaccuucuuuucucaccauacuucaauuuauuccuuaucaaagguaaucuuugauaugaaauuuuggacuuuuuacuuuucuuagccccuccguuuuuauuuaccuuuauguccuuuacaaucuuauucuucccaaaguuugguacuuuuuuuucugauauuguggagaauaucuuuuggaguuuuacuccucuuuuaauuugcggaagaguaauucuaaauaguagagacuuuuacguucugaaauacauaucucuuguacucauagaaggggaauuuaguaauauagugcuuauggcucuuugaaggggaaaauuuuuaauauugugaauacuuaaucuauagcuaaaagugacacuguaaaacugggaaaagaagaucgcuuagaagauuuggcuacagacauuuaugaucaaauugcuuuuaaggugacuaugucagauauaacagauacuucaguuucuuauuuucucaacauugaagauaauuauagcuuggugagacuggaaagaaacuuuaacaaacuaguagacuuagaaaauuaggucuuuucccccaaagcuuauauuccaauagaaaaauuugagacgcuucuauagaaauuauaaaagaaaaauuaaauuuguauguuuacggauaguccaaugguuuaaagguauguaaaguaaaaagugagagaucccucaugucauucauacucuagauuauagcucuuguugauuucucuauagaguuacuaacauacagaaugugaguauauguauuaauaguuuuauaucuugaauauuuuauggacaucugucaguaaauguuaacuauguuuaauuuucaaaaaucuuaauguauuccaucuaccauuuggaaaguacuauguuaauguuuauuuuaacagaauuaaaaaacauagaauuauaggaauaaaaaaaaaaccuuagagauauucuaguugaauauuucacuucccaaaagaaucugguuaaauuacugacccaaaacuacauaaaauaauuaguaagaaagccaagucuaaaacccacguguccagacuuuuauagcacacuacucucuaauucugauuuuaaaaauaauguuauuucgguauauggugugaauuuguucagguagcagaugacuuucuuauuuuaucuuauauagguuaauauaauuuacugccuuuacugcugaccuaucacaguugugcuguguugugcuugggaaaugcaaggugaaugaguacuagacaguaguaagaauuuaaauugagguuuagguaacucaacugaaaaccugccuuacuacauuauugugcuauuuaaaugacagauauuuaaagggcuauaccaaauuugugggccagauuuagcccaugggcuacaguuugccaacuugaucuaggagaguaauucccauaguaggauuaccagaaucucagcccuuuagcuucuaagaauuacuuuaugagauaaaagggaaguuauaaauucauggaaaagaguaaagaaguagcuguggaucauauugagaaaaccugaggaugccacauuucuucaaacauaaagcauaacuuugucuucuuuuuguaauguuuaaauuuagguaugaagccuauucaugcugcagacaaacagcugcuuauaguggcaaaugcccacaugcauugggacccagaguauucugaugugaagcucauccagaccaugauguuugucucagagguuaaaaacauucuggagaaagccucuaguaggccuggaagcccaacugcagauccuaauuccaucccgcuggugcuaugugcagaucuuaacucauugccagauucagguauuuauaauaucauuuccucacugcuuucaauuucacuuuuacucuugguucaaaggccagcuagcuccuaaauuuugaguagauaaauuaaggaauguaucauaagaauuccauggaugggacacaagguaauagaagagaguuuaauaaagaagcuauuaccaaagguguugccugguuuaagggaaacaaagcaauaaaugaugcaguacucugccacuaggggauuuaguaauagaucucuuuaccacuccucuaccuaaaagggaaaguggugggagcugucugucauuagaacuuggaaaaaauacaguuguaggaaagggccacauaauaggagugauggcuuugaauugcaugaagcggucaaucccuggcaaaccaaaaagaagggagccagggaaauauauauucuuaccucacucugcuucuguccuuucaucuccugcuaggcugcccauugaucaaauccaaccaaaagcuagagcggggagggauuugcaguugaugcaauaaagaucagcugccugaggcacagaguguacugcagaagggugaucugaaggggcagccagaaaauauucauuacguguagcucucuaguuuaauaauguuagcaacuuuuaagugaauucauuaaaugauauuuggauaauguuaguaguuacagaagaaugaucaaaauuauccuagggcuucauauuacuucuugagcuccacuaaacuacuuuaugucugaacuuuuaucauuuuacuuuuuauaaaaauaauuucugcauuuuagguaucaaauggaaaacauuagacuauuacucuuuugccaauaccaaagcauaugcuaaauuuuguauauuaucacugcuaggcuauuuuaaguuauuuaaaguaaguaacaauaagguuacuauaagauaaccuaaaugccuacacuuggaauauuaaaaaaaagucacugaacuugaaaacaucuuuuucuucuuagcaaauaaugcugaaaucauuguuuauaaguguuugucuuuaaccccuagccuaauuggcacuuuaaccacaugcuccuuucuuaauccuuucuuaaguugaauuacucucaagugcaaguuuuucucccauuguauuugauuuguuaaaaccaguuaguugucauuuggcaacacaacauagugaaaugacuuugguaccagacugucaugguuggauccugauuuugcuacuuaugaacuaugcaaucugugacuaaguuccucauuuuuccuuuuuuuuuuuuuuuuuuuuuuuuuuuuuuuuugagacagaguugugcucuuguugccaagguuggagugcaguggugcagucuugacugcaaccucugccucccggguucaagcaauucuccugccuuagccucccaguagcuggaauuacaggugcaugccaccacgcccagcuaauuuuuguauuuuuaguagagacaggcuuucaccauguuggccaggcuggucucgaacuccugaccucaggugcuggauccgcccaccucggccucucaaaguguugggaguuuuacaggugugagccaccgcacccagccuaguucuucauuuuuaacaaggggggaaucauguuaucuacuucauagaauugugagauuuacaugaauaaagcacuuagaacagugccuggcauguagcaaauacuagacaaaugauagugccuucugagcuauuuacaauacugauauugugcuuaucacacauucauuauaucuuacuaucaauccuuauuacaaauagaaagaugacucuaacagugcacuaaucaucauaaggguuuugauacuguuuucauguuugcuaauucaguggaagcagugcacuuuucugaaugcuauucuucucuucagccuuguauuuuuagccaagugguauacuucuggcauauaauaugcuuuauagugucagacugagaaaacucacucuagcucaaaauaaagaaugauauugucuagcugacauuagacauugaaauguugaagaugcaaaaucuguuuuuguuguaaacuauuuuuauuaauaugcucuacuuauauauucgcaaaguuguugauugcuuagaauggggaaauacuaaagagauagugguuuggaauaauuuuccaaaaacauuuaggguuaauaccuuccuggugaaugccauccuagguccuggaaaucaucuuuagccugaaaaaccacuaagaaaacuaaggauaucuuugaguguuccugauauauuuuguucugaaauaggcaaacauccuuugauucauuugcuugacucauaugaaauggcugguauuugauuuuuuauuuuuaaacaacaacaaaaggcaguuuuauauggcucaaccuaagaagaccacucugagccugguggauuaaccugguaacaagucuuggcugugaagccuuguguaaggucuaaaugcuaaauggaagugucucuucuuuauucuaccagguguuguggaauacuuaagcaauggaggaguagcugacaaccauaaagacuucaaggaacuaagguacaaugagugucuuaugaacuucagcugcaauggaaagaauggaagcucagaagggagaaucacacauggcuuccaacuuaagagcgccuaugaaaauaacuugaugccuuacaccaauuacaccuuugauuucaaagugaguggcagccuuugggcagguguagaaauuauuucagauacaagcauguaacaaaaaagguguaaauucuuuaugauuaauuguauaaucuucaggaauuuuuagauucuuaaaaugucuaggcuaaguaugcaccuaaauauaaguagguuuauuggguuuuguggcuauuguugucuuaaauucuucuugcucucuugcuuguuuagauuucaaauaauauaauaacaaaaacuucuaaaaugcucacuagguaccaggcacuggucaaagcacuuuguauauaucaauauaguuaacccucaccugcucaaaccaucccuaacuuucagcaguaaccucccuccccuaaccucccgccccccacagaaaagcaccgaauauagcaaaacucacuuugaaugaauuuauauaguauuuucucaagauuuucuuucuacuuuccauugauaucuuaguaucuuuaaguuuuucagguuauuuuuggguaugggguuagagcagguuguacuuugguucuacuuuauaucuguguauuuauacuaauauauuccuaggcagugggacacucuaaaaggaaaagaaagacauuuuuugacaaauaugaaaaaaaauggaaaggcugauuguacaggaccagcuauucuuuagaaagacagauugugguggcuuuauguaaucucuuucccagugcuaguuuucugaucacucuguguaccuguagcucugcuauuauaccucucuuugacuuucuggcauuucaggcaucuauaguagaaucuuauacuaucuggaaaaauccaaguguuagaaagugguuugguauaagaagccuagaggaaauuuaauaaaauaccaaaggaaauuuacaaauggccucccuuauauuuccaauaaccuuuuucuauuuuuguguggguuagcuccuguccaagaaacaaauaggaggaagaaaagaaauucguguguuguuacuaaucagcuuucauaaucaugaagagaaaaaaaauugcuuagaaauugaaucuaauuuaguauuuuugcuauuagaaaagauaauucaauccagcgauaguucauuuuguuccagccacuuguauguagugaugugcugguaaauauuuaauaaugagcuuuuugggaaaaagcucugauuugugguguuugccgauuucugugguuuaaguacuucuguagcagaauccuaucuuccaacaugauaccauugaacauagaguugggaagaggugcuaagaaagcuagcacuagcugacucuagcacaucauugcuuuuauguaagcuuaaaggaauaccuuuuaaugauacaguuuaccacagcuuaaauccuauccuuguaacuauagugauauauaucugccagcguaacccagaaaaccugugauaaaguucccgaaaauaaguguuuaguaauucugcaacuauuauuauuguucagguauguguguagguaaaaagaaaaaauuuuauucuauuucacauagcccuuuuuuuuuuuuuuuuuugagauagggucucaguuugucacccaggcuggagugcaguggcaagauuuuugcucacugcagccugaaacuccugugcucaagacauccuccuaccucugccucccagguagcgaggacuacaggcacacaccaccaugaccagcuaauuuuuuguauuuuuaguacagacaggguuuugccauguugcccaugcuggucucaaacuccuggguucaggccaucugccugccucagccucccaaagugcugggauuacaggugugagccacccuacccagccuagauuuuuuuuuuuuugagacagggucucacucugucaccuagaguggcacaaucaugacucacugcagcuucacccuccugggcucaagcaauccucccaccucagccuguugaguagcugggacuacaggugugugccaccaugccuggcuaauuuuuguauuuuugagggguuuuuuuugguagagacaggguuucaccauguugcgcaggcuggucuugggcuaauuuuuguauauuugaggguuuuuucuuuugguagagacaggguuucaccauguugcccaggcuggucuugaacuccugggcucaagcaauccguccaccucagcuucccaaaguacuaggauuacaggugugagccacuguacccagccuagacuuuuuuaaagcuuacuucuuccuuguccauaaauaaaaaucagagaaacacaauuugggacauuaauccaccuuccucagucaucugaauugguuuaaaauuauuuacugacaguccuucaaaagcucuuacauguguuaguaauugaaucaaaaauccuauugagccauuuacauuguucaaauaaguauggcuaaagaacuagaaaugccuggcucagagaguguuugauguuuggauguauaagauaggaucagagagaaggauaaagguauaaguuggugggagagaguaauauaugggaagauaaauaggcuggcuggauagauagaugggaugagacaauagaauaguauuucaaggaaggauggcuagagacuaagggcacaccugaguagagagaauugagcucuuaguccaaguaacagaaaaugaacuuuucaguuuuauacauauauuuuacauaguuaaugcuaucccaguauugaaagcaaucaguaaaaaaggguagguaacaucaaauauaaaaugccaugugaucagcaucaaaugcagauccaauuguauuagugaggggccauuguaucagugagguguuaaauuuuguuugcuuagcuuaguauuuguuuacuuucuucguccuugaacaagcuagaaauguagaaaagaguuauuuagagcucagauucauuuaauugcaaacugauuuggaaugaacugaaggguaaacaauuagaaggauuacuccuuuuucaacauuacuuucagaccagguaaguuuaauaaacagcuuaauucaaaccuacuacugcugcuccucaccccacguuuauccucuaaucugagggugugcccaaaucauuuaauaaaaaaaaggaagggcagcuuuuauuuuauagcaaauaguaaacuuuucuguuacauuaugaaauuguaauuuucuggcauucuuuuaaaaaagcuuagcauagugguaacagacuauuaauauuuucguuguguuuugacuuuuuguugaaauacaguucuauagacuuauacaauaauagucuuuacuaauauaaagagugcauuuucccacauuauuaauauuaaauauuuuaagaaagaaacugacucaaaaggguuaaaaaucauuagucuauaaccuuuuuugugcauaugaucaaaguuagggauccuccucauagaugcauauguacaaauauguugggugaauucacagacauaaccuggcugagaguuuugauaagaguuuuuacucuggauauuucaaaccaugaaaauaguuacaagugaugcauucaauuaaaagcgucuuacuuccuggaguguuuaacuuuuucuuggggccuacguuugcaaagaacucuagcaguugaugugcaugacggcacucuaauaagguuguaagauauaggaggguuugucgcccaggcuggaguacaguggcguguucuaaguacacugcaaccucugccucccagguuaaagcaauucuugggccuugaccucccuaggagcugggacuacaggugcacgcccccagacccagccauuuuuuuuguauuuuuaguagagaggagguuucaccauguuggccaggcugguaauuaacuccuggccucaagugaucugcccgccuuggccucugaaagugcugggauuacaggcaucaggcaugagccacugugcccagcccuauaggagauucuguucaacauaaguaauugagauuauuucauguguuuuauuuuagaauugaagcaaaaaguugucucauaaggagaaguaaaacuaccgugauccuuguaacucauuuucuaaaauaucacuguaaaacuaggcauuauaaccaaaaugaagggauaauaccuuaugauccuaucauuuuuugacuguuuaaacuuggaguccccuggacucauguaaguuccuuaauuugugguaaaguaagguuggauaagggcuucuuuuuuuuuuucuuuucuuuuauuauuauuuuuuaagagacagagucuugcugucagccaggcuggaaagcagugggacaauuauaaguagcuugaaacuccuggccucaagugagccuccugccucagccuuccgaguagcugggacuaugggugccugcugcuacaccuggcuaauguuuaaauuuuucguaaaauccugggucucauuauguuuaccaggcuggucuugaacuccuggacuuaagccauccucuugcccccacuucccaaagggcugggauuacaagcaugagacacugcaccugaaucuugucucuuagaagaggaacaguuuugguguuuugauauuggucaaaugaaaaucaacaaacugaaaugauuguguccaaaaucucacaauaaaaaaauuuguuuucauuaaaaguuuuuauuuuuuaaguagcccauuucauuguaauaccauuuaaaguauuggcuggaacucauguauaguauuuguaaauagguuuuuacagguguagaaauauuucucccuacuugggcucaggcuaucuugauaugaauaggaacuagauaggaagaaauuugauuuugcugucuugcauacacaaccugggauaauaaaagcccccugguuuuagacuuacugaucagacaaauccagucaucuagcucugacagauaaaacugcuauguauggcuuccugcugaaugauuuuugcugaguugucuuuauguagcaaggaaauccagaauuuacacauauuccaguauuugugaaaaugaguauuuuaaauuaagaauagaauaguuaacuguguaguguuuuguauguauguagcaaaucugggaaagcuagacuaggauuagcaaauccauaaacaugguuuacuauagcuucagucagguguguuuggauaucuugauaugcaaauaauugaaaauaauaccguuaacuauguaugugcucauauaaauauucuuauuuucuacuuauuauagccaauaggauuaguacaggcuccauuauauuuauacugauauguuggauuucacuaaaccaagcaggccaauucuaaagaugacuagacauaauuuaauguguuuagcuucucaaauuaucacuuacacacaaauggaaggauuuauaauuccaauagcaugcuguguuucccuauugagccaccuuuauuucauguaauacccauugaauauuugagccuuauuugacccacuaucaagacaacagguaccagaagaaaggguagucaguuuuuugguuuuuauaaauuauggauuguucuuuauauaucuugaauuuuucuuuuuuuccuauucccaaucucuuuccagggcgugauugacuacauuuucuauuccaagacucauaugaacgugcuugguguccuggggccuuuagauccucaauggcugguugagaacaacaucacuggguguccacacccucacaucccuucagaccacuucucacuguuaacacaacuugaacuccacccuccacuccugccucuugucaaugguguucacuugccuaaucggagguaguggaguacugccccgccaagacggggaucuguugcuauggaccuguacaguuguaaaucaaaguauguaggagugaaguauggccauccuuaagcugcuucuucagguuucuuucauuauguguuugcuguaagacuuuguacauuuuugugcauauugguaucauuuggcaguagggcuggaaccaaaguauuacucucuuuacaaaauuuuaauuuaacauguuuuuaaauuggaccuucuuuauauuguauuaacagccagcauucaaaauugauaaauuaccaauuugaggcccaauaacaguguauuuguuuuuccaaaacaaauacuuucuuuugaaugguuucagugagccaaccauuuuauaaaaggcaauuuuuaaaaacuauaaauacaguauuuuaaacugaaugaugauaugccuuccagggaaaaccuugaauuuuuccuuuauaacugacuuuuggauuccaaagucauuugcacauuaacagaguacuuaaauuuacuuguucaguccauaaacuaugauauagccucuauacaugguaagaaaauuugaaaaauuaaagaugguugcacaguauacuuuuauaauccagcauguaacaccacaugacaauuuguuggccaaaugcugguuuggaguuuuuuugaggaaucacuuugguuuuuuuguccuuuauauauaaccuuauuggaaguauuaauucuaagccugucucucaaguuuauuuauagagaaaaaguaaguaaucuguauugccacauaccuugaaaauagaaugugguauguuuaggaugcccacggaaugaauuuuuccuuauuccaauucaaccuucugucugguugugccaggaaaacagauguuauaugaccuaugucauuuuugccauuauagucaaauguuaaaagaagaaaaaagucugcugaauaaaaaggccuugaucaaaguuucagauggggaaaaucauacagauauuuuauguguuuccaacauagauuauguggcuguugguuucuugagaugacagugcaaaggauuugggagagagaacaaauuuggggcaguaguugaaaacguugggucauuuuccugacucuagcugccaaauggccaucauaugcuuuuaaucuuuguuucaguugucugucaggguugaauuaagaagcuacugguuuauucccaauuguugaugccuuuagguauguuggaaucuuuuuuuugccuaggaggggccaguugaaaaucugugacucaagaggcagugaacagaauacuguuuucuggggaaaaauugguuggcuacuugauguuaauuauggcacaguaacaggaaaagguugugucuguguuuuuaaguuuuucuuuauucugcuuuuuugcugcuauaagaguuuucugaaauuuauauuuuaaacuuuucaugcacuuuacuguuucuagucucaaaaugugauauuuuuaauaaacaagaaauuuuccauuaugugaaugaaauuuuaaaagacaauagccuauauuugugucucacuaauauauaaaguauaggucaaauuuaaauuauuuaauuaguuuuaaauauacacaauuugucuccucuuucaaaccugacaucuucggcuguuuuauuagucuuaaaugaugcauuuacuuuggucauuuuaugcuaauuucuuccauaguaaauuaaucaggcuauauaagguaauauuuccccagaggguaauuuuagugggacgaggguggugggaugaugucauaucauacaugggauugcaucagaaggguucuguaaagccugaacucccuuuuaaaagugccuagugauagaggcguuguuugucaucuauuauaauuggaaugucauuguaguucagugaauuuugauguaaauaaaauaucuuuuaaaaauguuaaaguaccaggauaaacaaacaaaaagaaacaacccuuaagaugacagauuuuccucaacaugcagguuucccuucuuauauaccucaaguauccaacaucuagccaugcaaauugauuaccugaagcauaguacuggaaaguagaauagcaugaaaaacuuaauuuuguggacauuaccuuuuuuuguaaucagcuacuguauguuuuauuuuagaucuuuuguuuuggguggguuuucugcucuggagguauaugcacuaacaaaacauuuuccuccuuucauauacgcauguuaauuagcaaugugagcaauauuuccuaccauacuucacucccaauauuuuuugagauguuuguauaaaauggaauuuaaaguucacuuaugauuguauaugaaccacagaggagcccauuuauuaauaaaaaacuuuuuuaauaguuaaauguagagggaaaaaauaaaaaaaaaugggaaacauuguaaacagcuuaaguuuauuuuguguaugaucgaggcacucuguugcaggaagguguguaauuggguucucucugcuucaaaugcgcucuuucaaaccauucauuauccuguguauuuuuaaugugguuuuaguaaauguugguaguagcucuguugaaguagguaauuguguuauguuuugggugguacacacuuggggcaugguaacccaaauuucaugugcacgguuucccuuuagcccacugcccaaauuucacauacccuucacccuuuguucccuuuguaaaaggagugguaucuguuuugagcugccaauucagaugaucagaaaugcugcuuuccucagcauugucuuguuaaaccgcaugccauuuggaacuuuggcagugagaagccaaaaggaagaggugaaugacauauauauauauauauucaaugaaaguaaaauauauaugcucauauacuuucuaguuaucagaaugaguuaagcuuuaugccauugggcugcugcauauuuuaaucagaagauaaaagaaaaucugggcauuuuuagaaugugauacauguuuuuuuaaaacuguuaaauauuauuucgauauuugucuaagaaccggaauguucuuaaaauuuacuaaaacaguauuguuugaggaagagaaaacuguacuguuugccauuauuacagucauacaagugcaugucaagucacccacucucucaggcaucaguauccaccucauagcuuuacacauuuugauggggaauauugcagcauccucaggccugacaucugggaaaggcucagauccaccuacugcuccuugcucguugauuuuguuuuaaaauauugugccuggugucaacuuuuaagcaacagcacugccuaaaagcaagcagagaacagaaucccagcaccauucuauaggcaacuuuuuagaauucagauauaguaaaucuguuccagauuuaugauguuuuauguaaaaaaaauuuuguauaauaacauagcugaauauuuuuguuucauuucuuugauguaaggcgugugaacauucguuugaauaucacauguugaagucagguauggcacaauggguucugagaccagcuuuuccuccccucccauuugccuuguuccaagcucuuucuuuucaaauuacuuuucugauauucauaggcagguauuuaauuuuacuaauuagcauccugugugaauguauuaaagaagccacuguguuuuaguguaguuggcaaaaauauaaaagcuguuucuuauuugccccuauuuuuuuggugucuuaaaguuauauauuaaaucacagagaagcaagggagaaaguugaaagauaucuaaggcucauaucacuugauucuaugguagauuauauuagaauugaggauguggcacauuaaaacuggaacaugggcaaauauaguguuccauuuuaaaauucuaaguuuauauuguuaaaugggugaaaauuuaaguuuauauuugcauuuccaagcguuucuaaaaaucacuaaugccaucuauacuuuuaguaugaaacagcagacuauagaaagcacagggaagaauaggcuaaauacauucuuugaagaaccagaggcauauaaccacaucauuaugucauuccuaauacauggcuagauuuucuaaugauaaaauugacugugucccaaugcuuauuugauucuaagcuuuuuuauucuguuucugagauauuuuaauagcuuugcaaaauaugcugaccaguuuuuggaaaauaaugguuuuuauagcaagcaaagacuuuauggcacauuuucaaaauagcacucauacauacuuacauuuugacagaaaugugaauucucacauugaugagauauucuuuuucccaccugcccuacccuuuaaaaaaggucacuuuucuaauguguaguagauucauuuacgccuuucccuuugagucauaccauguuuggagaacugugugaauuguagguagagaaauuaacuagggaagccagaagcuugaacuaaaguuuuaaauuuguaggcagaugagaacuuuuauacuaugguugcuuugggcgauucuaauuuuguaauagcaucaugaucaccaaaauuaauucaaacauuuuaguacaucuuuaaucugucuuauuuaccaaaguucuaaucuguuuaagaacaggaugccaagagcaucuuucauuuuauagaaugauaugcucaccuuuauaagugucaccuaaaagcuugaggguaaaaaagaagcagcccauauaucuaaacuacaggaugucuugaacaagauucacagaaagaaagaaaaaaaagcaguucuuuccaggaaggugguaaggaagagcaugcauauuucuuguuuuaaccaaauaccuuuuuuauguaaaugucucuauuaaaccccagguccuacaccaggaaauagggugauaaccaggaaaauaccaagcuuuaacccaguuggcaguuccuuguggcauacauuugguuagacuuggguuuuuccuggaaccaaaggaaaauaagcauguugaguucuucguucaacagacaugacauugaaguaauagaauauuuuuuaaguaaaauaguuuucacuuucaaagccuaugacauaaggacauuugugcuuauuaauuguuaauuuuuuuuuaugguacauuguauaaacugaguagcauugaacugcauuuuagaaguaugucaucagaaacaaaucacauuauggaaaggauauacaaaugccaagugauaugacucuuuuggcauggugguagcaugguccauucagcuuucagaaucuuucggaggcucuaguuuggugccuaguacuaguuauuuuuguuagaacaaucucucaaaauuuagauaauuuuccaguuguaugucugucacuuuuaacucuaaagcguaagaaucaugguaacccucucagaagugguccuuucuugcucauuucaguuucguauuaacuucaaaucacugauguauugucuuucaagcuaucaauuguuauauguaccaauuuaauuuaguuuguaguuaucugaagucacaaaauugguucagcauugaugucaaacaauggcuuugcuucuuaccaaacagacuuaguauccugcugcuuguuucaaucuugaugcaguaagugaugcaguaucugggucuguauuuacuuagaaacuguacuguccuuucucugugcuuaacuugcuaaaaauauauucccuuaccugugaaauuccugagcggugcucugccaacuuuucaaggggagggauuuggauggcuguguuacugcacacuggaucuggaauuguucaggguuaugagugacaaauuucuuaaacaccagcagcacugagaugugcacuaugggcauucguacaguuguuguccaaaugcaaacaacuuuuucaucuuggagaagcugagauacagaguucaauagaacuacuuggaauauuuugagaagguugaauguuucaucuuuggcuuuguugucucuggaguggggaaguauggagggcuuuuuuuuuuuuuuuuuuuuuuuuuuuuuuuuuuuuuaaagagaguguguauguacuuuuucucucuauaagggccaggguguuggucaaauucaccaucgauuaauuuauaucuucuguugugauuuuuuucaacuauauaacaagugccaacuaauuguccaugggacaaucuacuuuuccacucaauuuaucguuuugaguagggaaagguucauuuauuuucauuaccuggcauuaaguuaaagaauucauuauuuugcauacauuugagucauucugugaccuauaaaguguuuuuguaacuaucuaauucuaaugguugcaaagcaaagcacaugacuguaaaaccaagcaagguguuuuaguaacuuuuucccugaauacuugguaguuuccauugauacuauuccaaaacaaauucugcuguuuuagguuguauauuuacuuugcuuuuguucuaagaaaaagccaaggacuaaaucaacuuguuuuuguguuucaguaaucaguuuaaaaucuaagauuuuuuuuuaaauuagacuauuuaaugaagugccauguaauuguagcuugcuaguguuuaauguuuaauagacugguucuguagguguuuuaaccauuuaacacucucugccaucccuggagaaagugguucuacucuuacugaacacauucucucugacaaaaucaccagcugcuuuauuuuucuauuuauuacaguuaaacaguugaugaggucugaaucuugaccaaaacugcucagcugagauguuuuucacaauagacacuguacaaagugugcgugcaaaaggacacgguugguaguauuuuuucauuaaugugaacauugacuaaaaaaaagcaguccugccuuuuaaaucuuguggcagcucagaagggaggugcuuaagaaccuuaacuacuaugucagauaacaaaauauuuuuuuccauuuuggagauugguuacugcucacacaugauguauagggcuaaauauaugcuuguuuccuugcaccuguguacuuccccucucucccucccuuuccuuccccuguaggcaauaaauggccauuuugcaacugca

SEQ ID NO: 191489 - RNA, 40733 nt, Homo sapiens
ucccacacccgacgcucuggcccacacagacgcuacucuguagcaucucagguucccucuggcugcacucuggaggaccacacucguuuucuuuuuggcugccagaggcccccgcauccaccgcugagcugggagaaagauggcggcagccgugcgacaggauuuggcccagcucaugaauucgagcggcucucauaaagaucuggcuggcaagugaguauuucccaggaacgcgggaguacagagguggggaaagaaagccacagccuuaaucuccuuagguuggccacggcucuugggcgugaagcuaggagccggccugacguccaagggggcgggccugaggucggcuggggaggcaaauguugggagaagcagaaagcuggaggggaccuugugcaggggccuucgaggcuauagacuugaaaugauugucagcuuguucaguucuugauagaaucuuucuggucccuuaggauuuuggaacagcggucugagagacgacugcuacccuggccuuaguagccuucccugguaccucuucccaucgcuggccggccucacaccgaaucuggccucucuuuggaccuuccuccucuuuuuuuuugauucagagaaauguauauucuggggccuugaugcugcguuuuucggggagauggcuucuuggggcuggcugagguugaggcgguauggccgcugucaugucguccagaccauucagacugucuucuguggguccuuguguuucggguauuuucucugccaccaacucugauggcacauaggcggaaugugcucauaucgugggucaggaugucuacaguagugauguuugcaggaaucugaauuuugucgaaauuuauauagaaugcuuagguucacuccaaguuaaaaugugugacgugccuguucugcaagcaguugucaacaguauuaagcauagguagguagacguauauuguucauuuucucuuuguagaugucacagcauuucucuuuuguaaugaacaugcuuucuguuuaaaguaugccucucuaggccgggugcaguggcucacgccuguaaucccagcacuuugagaggcugagaucacuugaggccugagagaucugagagggaggaucacuugagggcaggaguucuagaccagccugggcaacauagugagacccccccccccgccgccacccgucuccguaaauaaauaaguaaauaaaguaugccucucaaguugaucuuaauguuuacauccugacagcugaaaucacuuugauguauauuaaugggauacaccuguucuaaccuggucauugaaauucugacuguuuuaaguaggcuaggcugccuuuucucugguggcaaacguaaucuacuuuuaucagugggaaauucagccguauauuuugggcuuaacuacuuugugcugcauuuucccacucaggaaaaugaagauaauaauaggacuuauucuugucugacauuaucugaggacaagaugaguaugugugugcauauauacuuaccacacuuauaucacguagaacaguaccugacauauagaaagugcgguaagauuguuguuguuacuauuaagcugucaguaaauauauauucacuuauuguauggguuggaaauaaguuaaauaugucuucauggcucaauccuuucugcuuguaauuuuuauauggaugaaaguaaaaucagcuuauauuuuuccccaugcuuccuuuacuuuuuauuuuguuaaagaagaauaagugcauuaguuaucaaaagaaauagagcuuugcaaguauuugcagaauucugaaacuuaaguauuuacuucuucaggucugaauuggagauaaacaauaguacuuaaagcgugcuucaguuaucuguugcuuuguaacaaaccaaaaacuuaaccaguguaaaacaacuaugauuucucaggauucuauggguugacuggacugcuuugcuggucuugucugggcucacucaugcagauauagucagcuggcaacacaccuggggcgggacucacaugcauaucuugcucuugccuggaucucucucucucucugcacagucucucauucaguaguuuagcuugggcuuucuuaggugccuaugagaggggaagucgcaagaccucuuaaggauagccuaggaagucucacgucaguucucuaguacuggucaaaguaaaucagaagaccagcccagauucaaggggaggggaaauggagcuuacuacuaccucuuuaguggcaaaguuacauugcaaaggagccuggacagagggagacacgauucauuggaagccguuacuguagcagucuaccacaugguguuauugugaagauuaaaugaaauaaugugcuugauaacugauagccagugcagucuuagccauaacuccuucagagcugcuuucugagaaaagucuuggccuugccugcauuuccuaugugggcaagaauguagcaggauauuuauccuuacaacaacaucaguucuaccagcuauaugcuuuaagagaaauacccuugaaauauaucaguguguuuuuuuuuaauguauuuuuucuuguauguacuuuuaaugaagguuuuuggguguuuuuuuuaggagcugaguaacaaaggauuccauauuaaagaauaauggaauacauuguuucuaaaacaucaauacuguguguuccuagcaauugggauaucuguaacaguaguuguucaauaaacgugguugaauuaaugaauagcuagaaaggggcagugcuuguauuugaauccagguucaucuacucuaaaaagcucauuuuaaaccuaccagacuaugcucguuuucuuguuaaaaacucaguuagaaaugcuuucccauaacugugaauuaacacagcugucuaaaguuuauauaagaaauuagccagaggaaaagcauuuccuccauuuuauaggcugcuuuugugcauauuaugcauuguauuuauuaucucacauaaagcuuuagaauaggagagccacaacggaggauagacuuuauugaggauagccucaaaggccccuucuaacucagauucugauucucucuuuguugucccaaacacaacaguuuuagugguuuucaucucuagagugaaagucaauaacaucuagaguuuacugugcgaagcacaacauuacuuacauuuaaaaauccuuaacaaguaggaguaggugauaguagugauauuauuuacauuauaauaagagaaaaccaaaguacagaguugaaauaccuugcucugaggucacacagcuaguggugaagcuagaagacaguccauaucugcuugccuaugagcccuuaacucuaaacaaacacaucuaccuuuuuggccuuauuuucacaaaaaaaaauugacuacacuucagauagugauuauuuuugccuagaaugccugucuuccuacuguuauuaaauugaaauacuuagaauguuuaaagaucaaccccauccaaugauuucucucuccuaaaaauuauauuagcacuuaccuguuuuuuuuguuuguuuguuuguuuuguuuuguuuugagauggaguuucacucuuguugccuaggcuggagugcaguggcgcgaucucggcucacugcaaccucugccucccggguucaaccgauucuucugccucagccucccaaguagcugggacuacaggugcaugccaccacacccgacuacuuuuuuuuguauuuuuaguagagacaggguuucaccauguuggccaggauggucucgaucuuuugaccuugugauccaccugccuuggccucccaaagugcugggauuacaggcgugagccaccgcgccuggccagcacuuaccuguuuuuaagauuuugucuuuaauuuuguguagcuucauuaugauaugucuguggauuuguuuuuacuuuucuaugucaguuacccuuugcugugaaauaaaccccaaaacuuagggcuuaaaacaacagucacuuauuuagcuuauaauucuguagguugguaguuuggauugggcccagcuguaugguucuuuucugcuccacguggucuugguuccacaugggcucccaugugggucuauaguuagcugccagccaggccagguaggcagcucugcuucuguggauuggcuggcuuguuggcuggggcaauauaguugacugggcuacauaucucauuagccaguauguuagucugagccuguucaugugacagcagcaggguuccaaaagacaaacacauacaaggccucucgaggucugggcucagaacuagcacuucauuucuaccacguuuuauugguuaaccccagauucaagggguagggaaauaaacucuaccuuuugauaugaagagcuacaaaguuguauuguaaagggacauggguacugggagugaaauuauauuguggccguuuuuuguaagcacucugucacauuauccugguuaagcuucacuggguuuccugaaucaauggauuaaaucauuucaucagucuugagaugucuucaguuauaucucuuuauuuuauuuuagagacagggucuugcucuguugcccuggcuugagugcaguagagagaucauggcuuacuacagccuuaacaugcuuggcucaagcaaucuucucgccuuagccuccugaguagcugggacuauaggcacgugacaccaugccuggcuaauuuaaaaacauuuuuuuugguacagauggggucucccuauguugcccaggcaggucucgaacuccugggcucaagggauucuccugccucggccuacaaaaguguugggauuacaggugugggcuacugugcuuggccuguaucucuuuaaauguugccucugccccauucuguuucuccucuaggcuccggugaaaucccugucaggcccacugacuauaaccucuaggccucuuacucugucuuuuccauuucaaugcuuuauucuggauuaguucuucaggccuaccuucuaguuuaucacuucuucaacuguguuuaaucugccguuaaguacuccauugaguuucuaaguuggguuguauuuuuuagcucuguaauuucuggugguucuuuuuuccaaugauacuuuuuauggcuccuggucuguugcugaaacuuuaaagcuugucuuuauccccaugaacauuguaagcauaauuguaucaugcucuuucugauaacuccagucaguauuugacguuuugguuguugcgauugucuguugcuuuuguugauucuagagagaaauuucauuaccugagggugcuaacaguguauaaucaaggcuucagaauuuuuuugguuuaccuggguggucuugggauagaauuuguaaccuuacuuccaaagugugugucuccuccuuuggcagaauauggaacuuccauucccauuugugcagcucuauuagucugccagaaauggcagcuugcuucucagugcuuccagcagauucgcagugagcccaccuucuccucccuacaagaagugccacucuaccucucagccaucuuuccacagucagcaaaugccuuuagacagaauauaugguuuaucuuauuuuccucauuuuaccuuucuuguuaggauuuuaugcaauuacauuuuuuuuuucauuucuuucagcuuuuuauguuggcuuuuuuuuuuuuuuuuuugagggaggguugguccagucguuuaguucaccauuacuguaaguggaagaucuguuaauaccuaccuuuaccacccauugugaucuuaaaugaugacugugguacauuuucaugcuuuauuuaucuccagauuccuuucaagugccaagaaauuaagaaucaacauacugaauuugguucauauacauuaaagaugcucaauucacugaugauaaauggauaggagagauguaugaugccuuaguaauaaaacuuauuuuccuccauaaguuuuuuuuuuuuguuuuuuguuuuuuuuuuuugagauggaaucucacucugucgcccaggcuggagugcaguggcaugaucuuggcuuacugcaaucuccaccucccggguucaagcgauucuucuggcucagccuccugaguagcugggacuacaggcacacgccaccacgcccggcuaauuuuuguguuuuuaguagagacagaguuucaccauguugggcaggcuggucuugaacuccugaccucaggugauccgcccaccucagccucccaaagugcugagauuacaggcgugagccacugcgcccggccaaauuuuuuuaaggaagaaaauauuuggcacuugucacauucuccauaucagucacauuucucuuuguauacugaguacucauauaaaaagcuauuauuaucuacgaagccuuauuugacaaaucuaguccauuuuuguuuuacucucacucugucacaggcuggaguacaguggcucacugcagccuccaccuccuggguucaagugauuuuccugccucagccucccguguagcugggacuuacaguugugcaccaucacacucggcuaauuuuuguauuuuuaguagagaugggguuucuccguguuggccaggcuggucuugaacuccuggccucaagcgaucgucuuccuuggccucccaaagugcugggauugcaggugugagccacuucaccuggccuuacucucuuuugaguuaauauauuaccucuucauuuaucauauugcuuauauuguucaguuuuaucauaacuuuuguuuuuguauuauuguaauuuaauacuuuuuuuuuuuuuugagauagaauuucgcucugucacccaggcugaagugcagcagcgggaucucagcucacugcaaccucugccucccagguucaagugauucucgugccucagccucccgaguagcugagauuacaggcacgugccaccacaccuggcuaauuuuuguauuuuuaguagagaugagguuucaccauguuggccaggcuggucucgaacucuugaccucaagugauuggcccaccucagccucccaaagugcugggauuacaggcgugagccaccgcaccugaccauauuguaauuuaacacuugacauauuaacuuuuuauuuuuaaucuuccccuuugucuucucagccauaugaucuucaaauacaaaggucauuuaaaaacuuuuuaguaucauacacagaaucucauauagcaucuuaaaaugccuaaggacucaauuaacaccuuggggugauuuuauauggcaguauuaaauuucuguuuaaguuccugguuuaaaacagguuuguuagucauuuuauguuauucugaaaaaguaaucucuguuguuagauacuagaauuuacauauuagagaagcaagggagcauguaauguagccacagugcuguaccucacuuuuuuuaauuaauuaauuuuuuuuuuuuuuugagacaaggucuugcucuguccaggcacacgccaccacagcuggcuaauuuuuguaauuuuuuuuuauuuuuaaaauuuuuauuuuugagaugagauaucacucuguugcccagguuggaguugcaguggcaagaucucagcucacugcaaccuccaccuccugggcucaggcaauccuccccccucagccucccaaguagcuggcaccacaggugugugccacaaugccuggcuaauuuuuuuauauuuuugguagagaugagguuuuacuauguugcucagacuggucucgaacuccugagaucaagccaucugacugccuuggccucccaaagugcugggauuacaggcaugagccaccacgcccaaccaauuuuuguauuuuuuuuuuuuuuuuguagagaugagguuucaccacauugcccaggcuggucuugaacuccuggacucaagugaucuacuuucuuuggccucccaaagugguaggauuacaggcaugagccacugcgacuggcccucaauuuauucauuuauaaaauugggaguuuauguacacaauuucuaaggccucuauaaguuauauaauuugaugaguauaaaacuuugaucacuuuuuagguugguuuauuuucauuuuuucuuccuauucccaauacagauuaguugauugauuaugaaacuauguguuaaaacuuagguuaggccaggcacaguggcucaagccuguaaucccagcacuuggggaggcugaguugggaggauugcuugaguccagaaguuggagaccaguuugggcaauguagugagaccccaucucuacaaaaagaaaagaacaguuaaccaggggucguggcacaugccuguaguccuagcuacucaggaggcagaagcaggaggauuguuugagcccaggaauuggagguuacagugagcuaugaucaugucacugcacucuagccugggcgacagagugagacccugucucaaaaaaaaaaaaaaaaaaaaaaaaaaaaccauaacaaccacaaaacaacuuagguuaauuagcaaauuuauauaagugagacacuauuaccuuugaauauaauguuguuaguauaaaauaaucuaagaggauauaaaaguaagagaucuuagcaauaacccuugauuuaauuaaauaugaaaaaaauaaaaaauaacaaaccauugaauguauaacuuaucugaaagcaugcccagggccauaaaguaauuuaucuuuuaaggacccucaaacuuagcaauauugaaaauauaauuuucuaaaaacuuaauauuuccuugcuuucuuagaauaauuuauuucuucuuuuggaauuugcuaucuuuucuauccguauaucugcuuucuuaaagucacuuugauucauugugguuuugagaaaucagauaaccaagguugugagaauuuuguaugaguugagagucaguaaugcugagugguagcuugagggugugcccuacaaaauaaaagucauaaaucugaaugaguucagguucuauuuuuguauauuuauuucguaacucuauucuggaugacuuuccgaauaauugcaaugcuaugagguuuguaaaauguauuuagugcuuuuaaaaaauauuacaauuggcugggcgcgguggcucacgccuguaaucccagcacugugggagcccgaggugggcggaucaccugaggucaggaguucaagaccagccuggccaacaugcggaaaccccaucucuaccaaaaauacaaaaauuagccgcacuugguggugcaugccuguaguccucgcuacucuggaggcugaggcaggagaauugcuugaaccugggaggcggagguugcagugagccgagauugcgccagugcacuccagccugggugacagagcaagacuccaucucaaaaaaaaaaaaaaaaaaaugauuaagacaaaagagauaaagauuaguauaggccgggcacgguggcuaacgccuguaaucccagcacuuugggaggcugaggugggcggaucaugaggucgggaguuugagaccagccugaccacauggugaaaccccaucuuuacuaaaaauacaaaaauuagccaggcgugguggcgcaugccuguaaucccagcuacucaggaggcugaggcaggagaaucgcuugaaccugggagguggagguugcagugagccaagauugcgccacugcacuccagccugggugacagagcgagacuccgucuucaaaaacaacaacaacaacaacaacaaaagaauaguauaacacucauauacuaaccacucguuaagaaauaaaacauuacuaauaccguugaauauuugagugcuuaugaugugccaagaauugagauaauugucuacauagcagagaacaaaacacaagaauuccuguccucguggagcuuguguggucacagauauuagguagaauaguuauuagaucugaaugcaaauaaagaauaaauagguacugucugacagcauaaaugguauucuaucagugcauuuggcuuggcgaaguuuauuuuguacagacuaagacauucagucuuuaauguuugguuucguugccuggucaacauuauccuauugcuggugacccuacauacauuacgucuguaagaggaaaagauucaggucaccucaaauaauguuuuugugugucuauguauugcacaguugaaggaaauauagcuuaucuuuuaaggcauuugaaaggaaauugacuuuguaguuuaaauucaaaaauaaaaccuucaagaaaaagugacaccuuagauucaguaacagaauuauagauucauucuuucuugugaugagcuugaaaacuuaaaaaauucugguauacuauacugaaaacuagaugaagugguaccuuauauaauuauagauuuaauaucucuugugauagacuagaaacuuaaaaaaaaaucugugguauacuauaaagaaaaccacaaacuauaguacuaugaaagaaaccaagguauguagaaaugaauaaauacacaucaaaguuugcauuagaaaauauaguacccucagaacauuauuuucauuugguauuguuguagguaucgucagauccuggaaaaagccauucaguuaucuggagcagaacaacuagaagcuuugaaagcuuuuguggaagcaaguaagugaaauggaaauuucaugcuugccuuguauuacugagcuaggacuuuaaaguucucucaagccuuguuuuguaucaaauuaucaauauuaaauaugcauugagauugauugauuuuagaauuuaaacuguuuacaacuugauuaauuuucagugaauuaucuucagaauuacaauccuaauuaaaguuuuguauguuuauuguuauaauagcugauaagggacaauauagcauaauaguaaagagaauaguuuggauucaaauccugguaugcuauuuuaugagcugugugaucuugggucaauuauuuaaccucucugugccuccuuuuccucuuuaaaauguacucuguaguacaucuaauguaccuaaaauguacucuauaguacauuacuguacuacaggguaguacaguacuguacuuugagaagugucugcuuaugucccuugucaauguuuuaaugggguuguuuucuuaauguucaacaucacuaaucaucagagaaaugcaaaucaaugugggaugccaucuaauauuagucagaauggcuacuauuaaaaaguaaaaaaauaacaaauucugguuagacuucagagaaaaugaaaugcuuauacacuguuggugagaauguaaauuaguucagccacugugaaaagcaguuuggagauuauucaaagaauuuaaagcagaaguaccauucaaccagcaauuccauuacugaguauauauccaaaagaaaauuaaaaauuccacaaaaagaaaccccacaugcacuuguauauucgccauauugcuauucacaauaaggaaggcauggacuuaacuuaugugugaaucaauaaauuggauagaaauaugugccacauauacaccauaaaauacuacgcacacauuaaaaagaauacaaucauguccugugcagcaacaugcauaugucuguaggccauuauccuaaggaauuuuauagugaguucacauggaauuuuauagugaguucacaucauuaaugauaucugauagugcuuuacaguguguucucacacacauuaccugucacauaggcuccuuuuaauaaccugugacuagaacguauagguacagguaucccuguauaauauauuguaagacaagucucaggauugaguaacuuuuuuucaaggacauuuagcuggcagagcccagaucagaaacuagguuuucugauacacugcucuuacuugcuuauauuucccugaguaauaccagcuuguaugguaacuuaaaugccuaaugacacuuguaaugaaacuguuuucucagucacauccuguauuacccaauaaugaauuccaauuaauaugugauuaauuaauuacaacugccuuaaaaaaauacugccuuaaaaaguuacugccuuaaaacuuaaaagguuacugccuuaaaaaaucauggccuccggugugagauaaacuagcaaugguuuccaaaaaacuguuaggagugguuuauuaagaacuuugcacuguaguagcagaagaauaaugcuuuuuauaacuuugaucuuggcugggcacgguggcucaugccuguaaucccaacacuuugcgauuacagguaugagucauggcacccagccaagggaucacuugagcucaggaguucaaaaccagccugggcaauguggagaaaucucgucucuacaaaaaaauacgaaaauuagccuggcguggugaugcaugccuguagucccagcuauugggacgcugaggugggaagacugcuugagccccgguggucgagacugaagugagcugagguugcaucacugcgcuccagccugggcagcaguaagauugucucaaaaaaacaauuaaaaaacauauauauauauauuuuuugaucuuuguauaagcuuugaauccaguaaaccaccaggaaaagcagucuacuguuaaaaucauuuacaucaacugaacaguuuuugaaucacuuauuuucauauuaacugcugcuuuaagacuugaauaauuggccggggccauggcuuacgccuguagucccagcacuuugggagaccgagaugggcggaucacgaggucaggagaucaagaccauuuuggcuaacacggugaaacccuaucucuacuaaaaauacaaaaaaaucagcugggcgugguggcgggugccuguagucccagcuacucaggaggcugaggcaggagaauggcaugaacccgggagguggagcuugcagugagccaagauggugccacugcacuccagccugggcgacagagcgagacucagucucaaaaaaaaaaaauaauaauaauaaaaaagacuugaauaauuuaucuaagcaauaguuuacaagaaugaugcauuuaaaaugauaguuauaauaguaacauuuguugagugcuauguaccagguauuguuuaaagugcuuuguguauauuauugcauuuaagcuucauaacaaccuuaugaaauagauguuacacaugaggaaacagaagcacagagaagcauagagaaguuaaguuucuugucugaagucauauaaucaguagugguagaagcaguguggcuccagagcuuaaucacauaaaauaauaccucguaaauguuuauaaauaaugucaauacaucuagugcucacugaaguucuuauuuauuguuuuuauugggaaaguauaaguggcaauaacuguacuggcagcacuugcuuuauuuaaauuucaugaaaauuauuuuacuguuuucuuuuuuaacuccuuuuuggaacaagguaggauauaagcacauaaauaaaaauauagguguuuuugugccuucacuuuguagaaaaaugagauaaaauuaucaacuuuuaaaacuuuuuucaauuauuucuguuucuuagaaaaguuguguuauuuuuacuguuuuuuaagauuuuuuaauuaauuaaugaauuaauuaauuuugagacagagucuagcucuguugcccaggcuggaguacggugcugugaucucggcucacugcaaccccagccucccagguucaagcgauucucuugccuuagccuccugaguagcugggacuacaggugcccaccaccaugccugacuaauuuuuuuuuuguauuuuuaguagagacagcguuucaccacguuggucaggcuggucucgaacuccugacgucgugaucugccugccucggccucccaaagugcugagauuacaggcgugagccaucgcacuggccuauuuuuacuguuuuuguguggucauuguguaaucaaguauuucagcauaaggaaaacugaugauguaauauaaaaugauagggguauggaaauccuugaauaaugcauugaaggcuguacuaauauagauuguuguuaguauuaauuuuaaguaaagguugauuguuuaaugacaauuuaucagcucauguuuucuuaucuuuuuuuuuuuuuuaaacaagugguaaaugagaaugucagucucgugaucucgcggcaguugcugacugauuuuugcacacaucuuccuaacuugccugauagcacagccaaagaaaucuaucacuucaccuuggaaaagauccagccuagagucauuucauuugaggagcagguaaaaaucuagagaagugguuuuuuaacuugagauagcagcaguuauuuugagaaucugauauuaguaaauucuuaaaggagauaaucauccaauuucauuuuugacaaaacagugugccaaacgacauuuuaugaugcaaaaucaaguaaauauuagguuguuacaacuccaacugacauuugcuuauaaaguaaaauuugauuuugugaaucaaauauugcucucuagacaauuuuuuaaaaucaguaaaauugguauuucagcugaaaacacaggaaaacuccagcaucguguaugcaggaacauacaagcuaaauuuaauguuuaaacuacaguauuguaccauaauccacauugcagaaauguguugcuuccguucacuaguuugauauucuguaaaugcaaaauucguaggaaaacuuggguggucuugauaaacguuuacuguuuacguggcagcuuaguauguugaauugccacuuuagaauaacuuuccuauuuauuuuaauuaguuacuaaugucaguugaaauaauuugacauguauaccuauuauuccagguugcuuccauaagacagcaucuugcaucuauauaugagaaagaagaagauuggagaaaugcagcccaaguguuggugggaauuccuuuggaaacaggacaaaaguauaguaaauaguggauauuggaugacuauauauaggauguauauaauugcucacuuauauuuuuucuuacauucuaguacaggaaacagauaaacaaauaaauacaaaauuguguaguauguuagaaggugauaagugcuguggagaaaaguaauggggcaaagcggggacagguuguauguauauuuaaauagggugauugggguaguaggguggcccugaugucacuuuaucaaagacuugaaggagauaagggaguagcuaagagugaucugaggaaagaauaucaccagauacucuuguuguuguuguuguuguuguuguuuuuugugacggaguuuugcucuguugcccaggcuggagugcaguggcaugaucucggcucacugcaaccucugccuccuggguucaagcaauucuccugccucagccucccaaguagcugggacuacaggcaugcaccaccacaccuggcuauuuuuguauuuuuacuagauuuucaccauguuuacuagguuucaccauguuagccagguuggucucaaacuccugaccucaagugauccaccuacuucagccucucuaagugcugggauuacaggucugugagccacugcaccuggccgaauaucaucacuagauacucuuagaggagauggcuagugcaaaggcccuaagaugggagcaagcuugaaguguuuucuuaauaagagcaaggaggccaguguggauagaguagagugagcaaaggggcaagagaucagggaugagaguagagaguacuggggaccagguuauguggaguuuuauaagccauuguaaggaauuuggcuuuucacuaagugaaaugagggggagccauuggagaauugugaacaaacagugaaaugaucugacuucuguuuuaaauaauuacucucacuacuggguugagaauaaacuguaggcaagcagugauagaaguagggauauugguuaagaggcuuaugagaccagguacaguggcucacaccuaugguccaagcacuuugggaggcugaggugggagaagauugcuugagcccaggaguucgagaaccacuugggcagcauagcuagaccccaucuccaccaaaaaaaaaaaaaaaaaaugcugggcaugauggcacaugccuguaguccuagcuacuugggaggcugaggcgggaggaucgcuugagcccaggaguuugagaccaacuuggacaacauauugagaacaccccccaucccuacaaaaaaauuuuuuuuuguuuuaaauuagcugggccuggugauauaguauggauaugcaucuauacucccagguaguugggaagcugaggcgagaggauugugugaacccaguaauuugaggcugcagugggccaugauugcacugcuguacucccaccuagggcacaaagcaagacccugucuuuuuuaaaaaaggcuuauacaguaccacagauaagguggauguugugagaaguauugaauucuagauauguuuuuuaagguagaguaaggauuuccugauggcuuguauguagagugugcaaaaaagagucaagauaagcccugauuuuuggccugagcaauuggaaaguuggaguggggaagaauagguuuguagggaauaucaagaguuucauuuuggacauaugauauccaaguagaaauauguagugaggaguugaauguauuagucuggagauuagaagagauaucuggacuagauauacauauuugggaguuauugacauauagaugaaauuuaaagccauuagauuggaugagaugcccaaaggagagaauguagauaggcaaaaggacugaguauagugaggccuggagcacuucaacguuaagagguugggaccaggggaagauguagcaaaugagaaggauuauccauugagguaagaaggaaaucagaauaauguggagggugguguccuagaagccaaaugaggaaaauguaucaagggccagguggugagcuauggcauugauaggucaaguaagauaaggaguacagguuaacuguuggcauuaguaguguagaggccacugauaaccuuaaccagcugaguuuugugaaaugauagugaaagccugauugcaugguuuaagagagaaugggaagagaagauguggagauagugaguaugggcuacccugugggggaguuuucaaaaaagguaggaagaaaaacaggguagacgaugacagcagacguuaggcuaagggauuaguuuuucuuuuaugauccaguagaaagcaaaaauuugauauaggggaauuggggagaggauucuugcaggaguagacaagagaggaaggaaucuagcagagggauaggcuuuagauaggaauauggguaguucaucugugucagagauucucagccucagcacuacuggcguuuucggcuagauacuuuguugugggggcuguccuguguauugcaggagguuuuagcagcaccacuccucugauugcuggaugccaauaguacugcuguuccuaguugugacaagaaaaaugucuguagacauauuagugauauagugguggaauuuguguaaguacucuuucauugcauugcuccaguauucuuuuuuuguuggcuuuuugguuuugagagagggucuggcucugucaaccaagcuguagugcaguggugugaucucagcucacuucaguguccgucuccuagcaucccaaguaguugggacuacaggugcacaccacuacgccuggcuaauuuuuguauuuuuaguagaaacgggguuucaccauguugcccaggcuggucucaaacuccagggcucaagcaauccaccugccuuggccucccaaagugcugggauuacaggugugagccaccaugcccagccuugcuucaauauucuuaaggaaguugaaaucagagacaucagcuggaacgguggaugggguugcagugugagguugaggagagacaauaaugugagaaguaauccccuuaggagagugggacaaugaauggacucagcauguaaacuuggcagcauuaaggacuuguugaagaucauaaugauuaaaauuagaucagucauacugggcacaguggcuucaugcuuguaguccuggcuacaagccucagucccagcggaggugggaggaucuugugagcccagaaauuugagcccagacugggcaacacacuaagaccccaucucuaaaaaaaauuugauuuggugcuuuuucccaucacauuucagcuacaugaguacgggaaaggagugagcaaacaauuagguuuaaccacaguugcaauuuuugccuaacaaguaugacagcaagagagggacaagggagaugaguaccuaugcgguucaaugaugauaaguuauuacaaugagugaccauaggaguuaggcuagguaaagagggaagugaggccuuuauggagaaaggcagugacauguaagggauaagugguuuggagggcacaguggguucaaggauuguuggguuugagauacuagagaaaaugagguagaaaaacaauuuuaaaaaauuaagauggcagggcgugguagcucacgccuguaaucccagcacauugggaggcugaggugggcagaucaccugaggucgggagcuugagaucagccuggccaacauggugaaaccuuguuucuacuaaaaauacaaaaauuagccgguguggucucaugugccuguaaucccagcuacuggggaggcugaagcacaagaaucauuugaacccgggauguggagguugcagugagccgagauugcaccacugcacuccagccugggugacagaguaagacucugucucaaaaaaaaaaaaagaugguuuauaacucuuacucaaccaaucuuaccucuugauguauauguuuuuuaaaauuuauaguucuuuaugaaacauuucuccuaaguauauugcacgagaaggaugaaagguaugagacuauugcuuauuguauugaaaacacuuccucuuccaguuggcaaguauaaaacgguaccaacugugaaggacuuaaaaauaucuuuggccaggcgcgguggcucacaccuguaaucccagcacuuugggaggcugaggcaggcggaucacaaggucaggagaucaagaccauccuggcuaacauggugaaaccacgucucuacuaaaaauauaaaaaauuagccaggugugguggcaggcgccuguagucccagcuacuugggaggcugaggcaggagaauggugugaaccugggaggcggagcuugcagugagccaagaucacaccacugcacuccagccagggugacagagcgagacuccaucucaaaaacaaaacaaaacaaaacaaaacaaaaaauaacuucaucugcuuuucuacucguuugccaggugaacgggggauucuuuuuuuguucuucauuaauauuugcaauagugaggcagacacugcuucagacaucuugccuuuuuugugcauuauuuaugaaauuacuuggcaaugaugcuccuugaaaaagcggccaguuuguaaaaaagccuucauauguagauguugaauuuugcauuucaaggucccuugauaauuugguaguuugaaaaagcugggcuuucuugauugcuuuggucuuauucuuuaccuagcauuuuuucccuagcacagggcaauugauuuauuuucagugguagcugaaacaaauauaaaauuagauacuguuuuuugcaguggucauaauuaucauuuuauaguacuauaguguuauccucaucugugaggaaaccaaagagauaaaaaugucauugguuuucuaaacgaguuaaagugacuaaauguagacuuuggauaaaugggaacuuuuucuuucaaaaaaugauucauucugauuaugaaaguaaucgauauaauaguuacacuuggcaaaaaauuggaaaauucaacaguauagugcuaugcauagcaagcaauguaaauuugaauugugaauggaaaaaaguacagaauauuaauauaugcaaggaauaaauuugcauaaauuucuccucccauucuccuuugcccccaaaucaauaaaguauagaauuauuuucaaagcuggggccaagugaauuauaaacucuguguucuugccacaugguggcaccacuuuugcagguaaauaggauuaauuuuucuguuaggauuaaucuuguuucaugugaguuuugaguuaugugaggucuuuaguuaugcacuccuggcauaaaaugugaccacugagaugaagaagaaaaugaaagccaccuauaaucugacuacccacagauaauugcuauuaguauuuugauauauguguauagaaauauauuuuaauaguguuuuacauacuguuuuauccaguuuuuucauuuaggaaaaauacguggugacuagauuauaacuauacaguauucuaccuuuuuuuuuuuuuugagauggagucucacucuguugcccaggcuggagugcaguggcaugaucucggcuuacugcaaccuccaccucccggguucaagcuauucuccugccucagccucccuaguagcugggacugcaggcaugugccucuaugccuggcuaauuuuuuuauuuuaguagagacaggguuucaccauauuggucaggcuggccuugaacuccugaccucgugaucugcccgccucgggcucccaaagugcugggauuacaggugugagccaccgcgcccagucuuguauucuaccauuuuuaugcaccacaacuugaucaccaauaauaucauaaugggugauuuccaauuuuuuuccuagcauagauauuuauaaauaaauaauuuuacaaaugaauauccuuuuagaugaauaugugugcacauaccuggcucucuuuuuaggauuucuuuucuuuucuuuuuuuucuuuuucuuuuuuuuuuuuuugagacgaagucucacucugucacccaggccggagugcaaugucacgaucuuggcucacugcaaccugugccuccuggguucaagcaauucuccugucucagccucccgaguagcugggauuacaaguguggugccaaccaugcccggcuaauuuuuuguauuuuuaguagagacaggguuuuaccauguuggucaggguggucuugaacuccugaccucaggugauccaccugccuaggcaucccaaauugcuggaaauacaggcaugagccaccacgcccggccuuaggauuuauuuucuaaagguaaauguauaguggguuaaggguauaugcauuuuaaaggauucaaaggaugguuggagagcauauuucccaguuauuuucuaggaagguugucccacuagucauauaugauauaccccuaaacugggcaguuguucuuuuaagaucuuuagcuugugagauuaucugaggauuaaaagcagcuaagauauaaugugauuaaugauaauaaaaauucaauaaaacuuuuuaguuuuuguguaaugcaguaaaaaguuugauucccggccgggggcaguggcucacgccuguaaucccagcacuuugggaggccgaggcggguggaucaugaggucaggagaucgaaaccauccuggcuaacacgaugaaaccccgucucuacuaaaaaauacaaaaaauuagcugggcgugguggcugccgccuguagucccagcuacuugggaggcugaggcaggagaauggcgugaacccgggagggggaguuugcagugagccaauauugcaccacugcacuccagccugggcgacagagcaagacuccaucucaaaaaaaaaguuugauucccuuacgguaccagaauauauaucaggaaaaaacaacauaucuucuauuauuccuaaaauuuucuugacaaaauguugagucauuauguguuuuucuguuacauccuagacaguacaauguagauuauaaacuggagacuuacuugaagauugcuaggcuauaucuggaggaugaugauccaguccaggcagaggcuuacauaaaucgagcaucguugcuucagaaugaaucaaccaaugaacaauuacagauacauuauaagguaacagaugaguugauuuggaauuacuuuuguauuggagaauuguaacauacuaagauguuccaggacaucugauagaugcucuuaaauauuagaaauuguuucucuguuuuguuuuguuuuguuuaacucuugcuuuuuaauuuguccccuaauugaaauauuuucccucuguuagguaugcuaugcacguguucuugauuauagaagaaaauucauugaagcugcacaaagguacaaugagcucucuuacaagacaauaguccacgaaagugaaagacuagaggccuuaaaacaugcuuugcacuguacgaucuuagcaucagcagguaaacacguaauaauuuauacuuaaaugaacaguuaucuuugcuuaauaacuuuagguugguuacuguuggaaaauuuagcaaggaacuauucuucaaaaggaugucuucauaauacaguuaugguaaauguaguuuaaguguuuaaaaacagaaauaaaaugauuuguuaaauaauuuaauaugcucauaucagccuauuaugcauaugugguaagaauaguuaaaagagggcugggcgcgguggcucacacuuguaaucccagcacuuugggaggccgaggcggguggaucacgaggucaggagaucgagaccauccuggcuaacaaggugaaaccccaucucuacuaaaaauacaaaaaauuagccgggcgugguggcaggcgccuguagucccagcugugggggaggcugaggcaggagaauggcgugaauccaggagguggagcuuguagugagccgagaucaggccacugcacuccagccagggcgacagagagacucugucucaaaaaaaaaaaaaaaaaaaagaauaguuaaaagagauaauauaaaguucuaaaauuucacuaaagaaguggauaucaacuugagaauuacgcagagugaaacaaaaauuaaaaucuauagauugaugaaaugauaauuaaugcacugcuuuuggguuuuuuuuuuuaaccuucaagccuuaguuuuagaccuggcauuuauccuuuucuucaauacguguaacaaauauuguuuguucuuuuuacugaauuuuagcauguaaaucacuuaugaaguagaauggguauuaagaggaaaugcuaauucuaaaccauagcuuuucuuaaauugcucuaucacccaggcuggagugcaguggcgcagucacugcuuacuacagccucaaucuccugggcucaagugauccucccacuucaaccucccaaguagcugggacuacaggugcacaccaccaugccuggcuaauuuuuuuguauuuuucuagagaugggguuucuccauauugcccagucuggucuugagcuccugggcucaagugauccaucugccuuggccucccaaagugcugagauuacaggugugagccaccacguccauuccauuuuauucuuuauagacuaguuaucuuauuuauuuuauuuuuuguuacugaaaacgcaguacaugaacaugguacugcuucuuuuucuaaagaacuuuuacugguuucuuaccuaucuuucaauacaaaugguagcauauacacacuuuugcaacuuaccuuuuuauuguaacuguauacaucauagugaucuuuacaugucaguacauauaacucauucuuuuugguuuucuauugucuggcuuuaucauaauucauuuagucagucacaacacuauagugauuaugcacauguaugaguauauguauagguuaacuuucuggauccaaagguacauacuuuugaauuuuugauagacguuccacauugcccuauacuauuacacuccaaacaaaaacauucaugagcaccugauuucuuacacagguauuaucacauucuuuuaucuuuucugaucugguagaugaaaaacaguaucucacuuuaguuuuaauuuguauugaugaaugcucuugagcauuuuucguauguuuaaaaaaauuguugaaaaucuguauuucuuuauugagugaauuauacauuuauguugacuggccauuuuuugaguuguuuguccuuucuugguggcuuguggaagcucuuuagauaugaaggaaaauuaaaauuuuuccuaacuugucaucuuuuugguuuuguuuaugacauuuuugccaugcagaaccuuuuaguguuuacuuaauuacauuuauuaaucuuucuuuaauggcuucaagguuuuguugacuugcuuagacaagucuucccuacucugaaauuauauguaguuguaaauccccccauguuuucuuucaguacuuuagguucucaaauuucuuggugucaggaccccuuuacacucugaaaaaguauugagaaccggaaagcuccuguuuauguagauucuaucuacugauuauuagaaauuaaaugaguaauuuaagacaauuuauuaauuuauuuuaaaguagcaauaauagacccauuacauauaaacauaaaugacauacuuuuaugaaaaacaauuauauuuuuccaaagcaaaaaauguuacugggaauggaauuguuuuauguuuaaaauuuuuuuucaauaucuagcuuaauaggaaacagcucaauucuucuuuuuguuuuuuuuuuuguuuguuuguuuuugaaacggagucucacucuguugcccaggcuggagugcaguggcgcgaucucggcucacugcaagcucagccucccagguucaugccauucucccgccucagccucccgagugaguagcugggacugcaggcgccugccaccacaccuggcuaauuuuuuguauuuuuuaguagagacgggguuucaccauguuagccaggauggucucgaucuccugaccuugugauccgcccuccuccgccuuccaaagugcugggauuacaggugugagccaccgcacccggccgaaacagcuccauucuuauagguacuuccgcauucccuccguuuuaauagguuguuuuaguuaaaguauaugaagaaaauucagccucacacagauguguagcuggaaaagacaagcacauuuuaaucgcauuuucagguaauuguggauauucuuugauaguauacuugacagaugguauaguucuuuuuuuuuuuuuuugagauggagucucgcucuuucgcccaggcuggagugcaguggcacuaucucggcucacugcaagcuccgccuccuggguucacgccauucuccugccucagccuccggaguagcugggacuacaggugcccgccaccacgcgcagcuaauuuuuuuuuuuuuuuugagacggaaucuuccucugucgcccaggcuggagugcaguggcacgaucucggcucacugcaagcuccgccucccagguucagccauucuccugacgccaggcuaauuuuuuguauuuuuuaguagagacgggguuucaccgcguuagccaggauggugucgaucuccugaccucgugaucuacccaccucggccucccaaagugcugggauuaaaggcaugagccaccgugcccggccgacagaugguauaguuucuuacagauuaguugcaauguggaaucugaaaccauaucaauaaguuuuuugcauuccaugacacgaaaaauucuguuuucuacuuucuuuaacauaauaaguuagcagccauuaagaauccuugcuugaggccaggcacgguggcucacgccuguaaucccagcacuuuugggaggccgaggugggcggagcacugaggucgggaguuugagaccagccugacuaacauggagaaaccucguuucuacugaaaauacaaaauuagccgggcgucguggcaugugccuguaauccuagcuacuugggaggcugaggcaggagaaucauuugaacccgggaggcagagauugcagcgagcugagaucgcgccauugcacuccagccuggguaacaggagugaaacucugucucaaaaaaaaaauaauaauaauaauaauaauccuugcuugggucauucauuacauucuauguuacaaaauggugauuugcucauucuauucuucugcaugaacuuuuuuuuuccuuuuuuguacuuuuauuuugaacuuuuuacuuuacuuuuuuuucugcauauuuucuguugguaugauauguacacaggaaaaguacacaugaaaaguauacagcuugaugaauuuucacaaacugaacaccuccauguaaccagcauccagaacaagaaacaaaauauugccaacaccccuccuucuuugugcuuucuuccagucacuagccccaacuccuaacccuacaagaauaaugacuaguauauauuagccuucuuauuuuuuuauaaaugaaaucauauaguguauucauucuugucuucuuuugcucaaauuuaugaaauuuaucauuauggcuauguguauuuguacuuucuucauuuuccuuguuauuuaguauuccauuguaugaauauaccacaauucauuuaucuuaauuucuuauuggcugcuaggaauagaacugcuaugaacauucuuguauauuugacacagcuuuuuauuuauucaggguaugacaaucaguuacaauuguuacucuuuuugauguuuaaauuguuccaaucaugacuagauuaugucuuuuuuuuuuuuuuagauggagaugaggucuugcuauguuggccagaguagucuggcuucaagcagucccuccaucuuggucucucaaagagcuaggauuauaggcgugagccacugugccuggccaguuacgucuuuuugacauggccccauuaaucuuugaauacuucccugcgaauuagcagaaaaaggaacuuggauuuaucuuguguuuugccugccucagacuugaaaucagcuauuuuucaaggaucccuaguucuuuuuaauggacuaccaagauauggacaguagauaugcucauugcuucugggugucauuguguuuaggcccuuuugguauaaagagcuagaaauacauuuagaaagaaaaccguuguugauaggaucauuuucaugaguuugauuuuuuuaauguuaucgguugucacuaaaguuccuuaaaaauauaaauugaaacugugaauauuaagucuccuaucagauaaauauuuuuucaucuuuuauaaauuuuuauuaacgaaauaauuaauguuuauuguagaaguacaaauaagaaaaggaaaauagaaaucaccuguucuuccaaccgcuuguaacauuuuggcccgaaauucuucauguaugacuguaugguugcucuucuuuaucuguggauuccauguuucugaauuauccuccuugguaaaauguauucauauccucaaagucaauacuugcagcacuuccacugucauuugcagauaugugcaggguggaaaaacauuugaauguccugacacauguuuccacccgagguugaacauguagauucccugcuuguuuuuuuacuuuuauacuguacacaaauguccuuuucauggucuguuuaagaucauguuuuucacacuuccguucuguuaccagugauuuugcuguuuaaaauggcacccagccauagugcugaagcgcugucugggggguguucuuaagugcccuauggagaaaauauguguguuagauagcuucauuuaaguaugauuuauaguguuggcugugaguucaauguuaaugaaucaacaauauguauuaaauaggaugucucuaaacagaaacacacauaaaacaagguuacagauuaauucauugacaaaaauguugugaccagaugcucacaggaaccuagcuuuguauucccauaggagcagcaguuuaguguuugauaauucagcgucggcagugacugcagaccauaauuaccaugaauaaugaauacuggcuguauauuuaguagacaaaaaugaggucauaagauagguuuuuuuuuccugaagaaacauugugaaaauaacauugugaaauuugaugcucauuuauuucucuuagggcagcagcguucucggaugcuagcuacucuuuuuaaggaugaaaggugccagcaacuugcugccuaugggauccuagagaaaauguaucuagauaggaucaucagaggaaaucaacuucaagaauuugcugccaugcugaugccucaccaaaaagcaacuacagcugaugguaaugauccugucuuauguguauaugguagucaauguuuagguacagacuagugaaaaucauguuaaauuagaaguaucuuuuaauaauaauucuacauaacacuuccucauaaaaaaagaggaauuguuuuuauuuaaaauuuuuuuuuuaauuuauaaaauuuuuuuugagacagagucuugcucugucacccaggcuggagugcaguggcacaauggcgugaucucggcucacugcaaacucuaccuccuggcuucauaccauucuccugccucagccucccgaguagcugggacuacaggcgcccgccaccacgccuggcuaauuuuuuguacuuuuaguagagaugggguuucaccguguuagccaggaugguuucgaucuccugaccucgugauccgccugccucggccucccaaagugcuaggauuacaggcaugagccaccacaccuggccuauuuuuuauuuuauuuuuugagacagaguuuuacucuugucgcccaggcuggagugcaauggugcgaucucgguucaccacaaccucugccucccggguucaagugauucuccuacuucagccucccaaguagcugggauuacaugcaugcgccaccacgcccggcuaauuuuguaauuuuaguagagacggauguugcucaggcugaucucggacuccugaccucaggugauucgccccccucagccucucaaagugaugagauuacaggcgugagccacagugccuggcaauacaauccuuuuaacuggguauacugcuguacuacuuaaaaaauauauauuauggcugggcaugguggcucaugccuguaaucccagcacuuugggaggcuaaggcgggaggaucucuucagccugggaguuucagaccaaccugugcaacauagugaggccucaucucuacaaaauauaaagaaaaacagcuaagcauggugguacauaccugugguucuagcuacucgggaggcugagguaggaggauugcuugagcccagggggucaaggcuacagugagccgugauugccccacugcacugcgguuucagugacaguguaagaccuuguuaaaaaaaaauugugauaaauauauaaaacauaaaaauuaccauuuuaaccauuuuugggugugcaguucuguggcauuacuuucacauuguugugcagccaucaccaacauccaucuccagaacuuuuacauuuucccaaacugaaacucuguaccuauuaaacaauaacuccuuauucuugccuccccucugccugcuguacuacuuuuugacaugggauagauugggagaggaacagacugaggagagaaguuuuucuuuuuucuuuuuuuuuuguuaguuacagucgugcucuguuguccagguuagagugcacuggugcaaucauggcccacugcagccuggaacaaaguaacugggacugcaggugcacaccaccaugccugguuaauauuuuaauuuuuuguagaguuggggucucacuguguugcccaggcuagucuugaacuccuggccucaaagaaucuucccaccucagccuuccagagcacugggauuacagacaugagccacugugccugguuaagcagucccuuuuuuuuuuuuuuuuuuuuuuuuuuuuuuuacuuuuugagacaaggucucacucuuuugcccaggcuggcgcuggcaugaugccauagcucacugcagccuccaccucuuggggauccuucuaccuccaccuccccagaagcuuaggcaugugccaccacacccugcuaauuuuuaaauuuuuuuguagagacaggaucucuccauuuugcccaggcuggucuugaacuccugggcucaagcaguuccucccaucuuggcuucccaaagugcugggaugauagggguaagccacugcaccugccugcuuuuuugaacauauuaaauuugagauauuuauaaaauuacuggauuggauauuuaauuuagguaguuggcuguguaagucugaauucaaaagggagauuuagauuagagauaugugaucauuaucagcauuuugaugguauugagacaauguaggauaaaaagagaugaaggugcaaaauuaaacccucuaauauuucagagaaggaaaagaaggaggaagcagcaagguagacugggagauaggaguuaagugaaaaacuagcagaucguggguggaauucuggaaaaggagaagugaggcauuguaagaaaaagagguucucagaauacuucccuugaagucuccaaguauauuuuguccccugcacucauuauaguaguuaaauguucagcagaaauauguaagcauugggugagcccaguggucuaauacauucaaaguaggacccuggguccagaacauuaugagauacuguaugaccucacuuaaaagaggauucuaugccugaucuuucaggaggguuagccggauccuggaucuggaucuggauauuucucacauuugccuugguuugaugcuccuggaguucccaaaagaauagagaucacuuuaucaagcuugcagaacagguugcaugauuguugugcugcugcuugcuaguaaaaguuuaugcuuguagaaagaaaaguuaaugggcuggugccgcggcucaugccuguaaucgcagcacauugggaggcccaggugggcgcaucacuugaggguaggugagaacugccuggccaacaugacgaaacccugucccuacuaaaaauacaaaaaauuagcucgguguaguggugcacaccuguagucccagcugcucaggauacuuaggcaugagaaucacuugaaccugggaggcggagguugcagugagcagagauugugccacugcauuccagucugggcaacagaaugaaacucugucucaaaaaaaaaaguuaauuugauagccugaagaagcaagauucuaaacccaaagggguuagaucuauaugcuuaauaauuacuugccaaucacucauuugcuaaauguuauuuuuauuuaauuguacauuaaugaaacuacaucauauauuggcuacuuuuaaaauuuugaucagaggaguuaaagaggaugaguuauuacgugccuagacauuuucagaaaaaaugaugcaucuuuuuagaguauaaaacuaguuucaaacuuguaacugucuuauuuauguuuaagguuccagcaucuuggacagagcuguuauugaacacaauuuguugucugcaagcaaauuauauaauaauauuaccuucgaagaacuuggagcucuuuuagagaucccugcagcuaagguaucuucuugauuccaauacauuuaaaaaaaaguuaagagaugaaacuauuaaaauaaugagaaaauaaaauaaauguuggaaacaacauuuauuaucuuccaacaaaauaaauguuggaaacaacaacagaauuacaccuaaaaagccacaaguaaauacauucuuuagaaguuaaaauaggccuaguguuuauuaguggaauugucuuaguguuuuuugguguuuuaaauuguguuuugugauaaagugaccuagaauagaagucuuucaggaguuucagguuaugacacccauuuucugagaaugucuuuguuuggugucuguuuaaauccaacaaaguaccaaugacauucagagaguauugcagguaucauuuacaaaauauucucuuaacuuuaaauaaaauuaagcaaccuuacuuuuagcuaauuuauaaaccuuaaaagucgugcaguuaugggucgcaucccuuuuucucuggcagugaaauuuuuugucuguuuauuuauuuuauuuuuuuuuguuuuuagagacagggucuuguucugucacccaggcuggagugcaguagcgugaucauagcuuacugcugcuucagacucguggguucaagcaaucuuccugucucagacucccaaguagcugguacuacaaguacacaucaccacgccuggcuaauuuuuuuguuuguuuguuuucccccgagacggacuguagcucuguugcccaggcuggagugcagugcugcaaucucgguucacugcaaccucuaccucccagguucaggcgauucuccuaccucagccuacugaguagcugagauuacagcaccacgcccagcuaauuuuuguauuuuuaguagaggaacuguguuggccaggcuggucucaaauuccugaccuuaugauccaccugccucagacucccaaagugcugggauuacaagugugagucaccacgcccagcccuuuuuuuuuuuuuuuuuuuuaaagaaacagggucuugcuauguugcccaggcuagucuugaacuccuggucccaagugauccuccugcuucggccucccaaagugcugggacuacaggcaugagucauugugccuggcauggcaaugaaauuuuaauuagaauuuucuaacaauuccuuuacuuguacacauucaauacacaguaaaggaagaacaauuugggagucaagguuuaaguuaccauuaaaagagacuuucuucuugaggcuuuaagguaugaucucuugcugagacuauuggaggugaauauauuuuuaacaauaaaugcuagucacaaucuguucaggacugauaggauugauugugaagauggucaaaauuaauaaaugaccaggucacaauccaguuugcuuaugcacaguaaacauuaaguaugucuucaggaguuagguaguagaccuuuugcuuucuuuuaauugucuuuuaaacccuuucaauuucuuuuugaauuucaccaucuaccuuucaauuuuuaaagaguuucugggguagcaaauacuguggaaauugaaauaaaauaagaaaaacuaguuuguuuggguuuuuuugagguauggauccuaguaagaagaaaaauugauaguuugcuuuugagcagaggagaaaaugauaguuauauucuuguccaaaaucucacaagaaaaacagaucccaguuaacuuaaaauaauggcuuauguacagcaagaauugggaaauagccagauuuacaagauuuacucuucuaguggcagauuaauguauauguaaaguuuagugaugguaguuaaaccagaagcuuucuguucucuuuucauaugugaauaacuaaaagauaugauaaaguuucugagaguuuuuuuuucccccaauaggcggaaaagauagcaucucaaaugauaaccgaaggacguaugaauggauuuauugaccagauugauggaauaguucauuuugaaaguaagagguuuuguguauuucugucauaaugaaauagcagugaacuguuauauuugugauuaaaacauguuggacaguuuccuuugacucagaaucuuacuacuggaaugagcuuauuucccaaagaaauaauuuaaaauaauuuuuaagaaguuauauucaugaggcugggcauggcggcucaugccuguaaucccagcacuuugggaggccaagaaagguggaucacuugaggucaggaguuugagaucagccuggccaacacggugaaacccugccucuacuaaaaauauaaaaauuagccagguguggugacaggcaccuguagucccagcuacucaggaggcugaggcaggagaaucacuuaaaccuaggaggcagaaguugcagugagccgaaauugcagcacugcacuccaaccugggugacaaagcgagacucugucucaaaaaaaaaaaaaaaaauuauauucaugaaucuacuuacugcaggauuuucuauguuaaggaaaaauuugaaacucaaauuguuguaucaguucauucauuuaugcaucaaauauuuauugaccacauaccauguaucaggcauauggaaaugacaguugcauuuccuauucagcaacucauuaaacuaauggaggcagacagguaaguggaucccuugacuuuuucauugucuaauaccuucccagcuccuuauucccaccucauuuacacccuggaccuugcuguacccagaacuuuuccacuugcaaaauuuuuauuugaaauaucucacucuggccauaaccuuuuucuuguuucucuaguggucuguggucugucuccguuacucucaguucaauucuuccuugaccuuauuggaguuucugguccauugacucuucuguuuucuuccaguuagcauaaucuuuuuugugcuggagaagagucgggcaucagacaggcugauaccucucuaaauucgaggucacagguccucagcacuacauaggauucaugguacauuucuguaguccacucuuuuuccuccuuugcaaugacuauuucagguuugguuuuucuuaaaucucugacuuuucuccccauuuauucucaguagaaaaccuuguuuccuauuucaaaggggaaaaaagccaucaguaugaaauauuuuaauuuccuuuuuuaguuauuuuuuucucucauucaauuugaaauuuuaacuucuuuaucagauguagaaacacuuuaauuuuagauauagaugugaaucuuuuucuuccuucguguuuuacugcagaugguuuucgucacccugucugguuguuccacuugggcuuuggaccuuuucucugauccuuucccuuuccccucccaccaaaaaacacugguuuaggaaccugagguuagcaguuauuuuugucugauuuuauccuuuuuuuccuacuggcuucuuuccaucaauauuuacacauccucaggacuccuccauuuuaaugaaaauccuuuuaucuuccaaaucucaucuugacuuuucaacauaucaaauaguguugaucucucacuacuuuuugaaccuucaccccaccaccacagcuugacuuuugucaucucuuccauccgauucuacuuuuccucuuauaucuccagcuauccuucauagucaucuuuguagaaucuguaguaccuuuaaguuuaaauacuaguuacuuagggcuuaauccuagaccuuuccccacuuaugcuacugaguuuccauggguaaucucaucuauuuccuuugauucaguuacugucucugcauagacaaugccuacauuuaccuuucuagagugauucuaagucccagccccaugguucuaguuuacuacuaagguguuucuaccugauugcuucaugggcaucuuagcaugaacauaucaaaaacugaauuuauuaucuucccuucuugugugucccccacgacuaaccagccagccaucccaaaacuguauuguuagcuuucuccaauacuccuuauccuugggcucaaaccauccucccaccucaaccuccaaaaucccugaagugcugggacuauaggugugagccacuguauuggguccuuuucuucauuucuuacuaucaccaaccuauucugaacccuacuauuauaaccucuucagguguugagaaauaaccucuuucuuuccuucucauaucuacaauugcuccuuucuaguucaguucccuaguacagcuggagugauuauuuucuuuuaaaaaaugcaagcauaaaaaagaaauaaacaaauaguuaaaucauguuauucuuuuguuuacacuguaaugaaugucuuccccauugcuuguagaacaaaguucuacaaagucucccaaaagcugguccugguccuuucuagcuuucucuugcauaagucuucuuuuuauuuuuuucagcauugcaaauucuucccccuaucaaacauucugaaauauuuaccccuuuccagccaucuucucuuugucccaugucucaauuugaauauccuuaaucaguaaugauuuuccugacuuuccagauuagauauggcuuuaaauuauauauucucaugucagccugaauuucuuccuagaauuuauuuuaguuauuuucaguuguguaacuauuugucuaaaugucuguuucuguuuccaaguuaagcuuccuggugauagguauuaagucugucuuauuuuccaugguacauccaacaucuguuccagugucuggcacauuguaaaugagaaauaaguguugaauaaacaaacacagcauaugaugaguaauauagcauuuccccuucugugcauuaauguugcuugucuauuuccucccuucccucacaacucuccuucuggccuuccaguaucaauuugcuguagcuuuuguuauaaugauuuuuuuuucuuaagagacaacucgcuguguugcccaggcugaggugcagugguaugaucauagcucacuguugccucaaacuccugagcucaagcuguccuccugcuucagccucccuaguagcuaggaaggacuacagguguacacaccgcaccuggcuaguuguuuuucuucuugagauggggucuugugguguugccuaggcuggucuugagcuccuggccucaagugauccuccugccucagccuuccaaacugcuaggauuauagguaugagcuauugugccuggcuuuuuuuuuuuugagaugggagucuugcucuguugccagacuggagugcaguggcgcaaucucggcucacugcaaccuccaccucuuggguucaagggauuccccugccucagccuccugaauagcugggacuacaggcacacgccaccauacccagcuaauuuuuuguauuuuaauagagacgggguuucaccauguuggccaggauggucuugaucucaugaccucgugauccgcccgccucggccucccaaagugcugggauuacagacgugagcuaccgcuccuggcugccuggcugauaauuuuaacuuuaucuguaauaugugucacaaauauuuuuuuccauucugucagguuuucuuuuucuuuuucuuuuugagauggaguuucuuucgcucuuguugcccaggcuggagugcgauggcucaaucucgguugaccacaaccuccaccuccuggguccaagcgauucuccugccucagccucccaaguagcugggacuacaggcacgcaccaccacgcucaugcaccaccaugcccggcuaauuuuguauuuuuaguagagacaggguuucucuauauuggucagccuggucuugaacucccaaccucaggugaucagccugccucagccucccaaagugcugggauuacaggcaugagccacugcacugcacccggccgaauucugucagguuuucuucuggaagacaauacauaacauaaacacauuuuuaaauuuuuuugcacucaaauaggucaauguuuuauuuuauggcuuuugaauuuccuguauugauuaggaaagacucuucuaccuuggaauaaaacuaguguuuuccuaaauuuuucuaauauuauuuuacauuuaggaauuuaauccaucuacaguucauuuuuguggauaauuuuagguuauggucuaguuguuuuuuucuaggugaauagccaauuauccaaguaucauuuauuaaauaaaacauccuuucugauuaaauugugaucuuugacauaucugauuagguuccacauauauguuugcaucuauuucuguacucugguuccacugaucugcaauaauaugguaauaaacaaauuuauaauaaauuuuaguauugguaaagcaacuccugcuucccacuccuuuuuuuuuguuaaauugaaauucacaugggcugggcacaguggcuuaugauugugaccccaaugcuuugggagguugagguggaagaauugcuugagcucaagaguucaagucuagccuaggcaacauaacgagaccccauuucuacaggauaaaagaaaaaaagaaggaaauucaccuaacagaacaguagccauuuuaaaguaaacaauucaauggccuguaguauauuuacaauguuguacaaccucuaucucugucuaguuucacgacauuuucaucuuuccaaaggaagcccuugcccuuuaagcaguuacucuccauuccuuccuucccccagcuucuggcaaccaccaauccaucuucugucucuggauuuaccuagucuggauaguucauauaaauggaaucauacaauaugugacaugugaccuuuuggcugauuccacucagcauaguaucuuuaggguucauccaugucauggcagguaaucagugcuucauucauuuuuauagccgaauagcauuucauuggauguauauaccucaauuccaccacugguuuucauuuucagaauuaucuuggccauucucaaacaccaauuuuuuuauguuaacuuuaauaauuuuggccugguuagaaagcaaaauagaaaaaaaaagggggauugucuuugggauuucuuuaaauuuauuuauuaaaggagaaggauugauauuuuuauguuauuguauauuuccaccugggaaugugauuugugucuacucaaguuaucuuuugcccuuuauuaagauuuuauagguugcggcugggcguaguggcucacgccuguaaucccagcacuuugggaggcugaggcgggcggaucacgaggucaagagauugagaccauccuggccaaccaacauggugaaaccccgucucuacuaaaaauacaaaaauuagcugggcguaguggugcaugccuguagucccagcuacuugggaggcugaagcaggagaaucccuugaaccugggagguggagguugcagugagcugauaucgcgccacugcacuccagcccagaugacagagugagacuccgucucaaaaaaaaaaaaagauuuuauagguugcuuuuucacuaaauaugugcccuuuuuuguaaauuuugguacuguuuugaaugggacauuccucucaauuuuuuauuucuaacuauauaguguugguaagagaaaacccugguggauucaagaugacuuuuuuugagggauuuaaaugguaugauauuuauccuucagucaaguacagauuugaauguguaaacagacuugcuuuccccaguagguggcagugucuuaggaaucugcaagccuuggugaugaaaagacagccucagucuuuuuuuguugugguugagguuguuggguuagucgguuuuauuucguuuucacuaguaguaguaauaacaugcaucuguauguauuuguuuuauaccuugugccaguaauuuggguacuuuugaaaugcuagaaauuuaaaaaaagaaaaaacacuuuucuuaacugcuguuuaaauagcuuaguuuuauuagccaagauuuuuuagagguuuuuuuuuuuuuuuuuggagauggaguuucacucuugucgcccaggcuggagugcagugguacgaucuuggcucacugcaaccucuaccuccuggguucaagugauucuccugucucagccucccgaguagcugguauuacaggcgcccgccaccacgcccggcuaauuuuuguauuuuuacuuuucuuuuuuuuuuuuuaauucuuuaaucuuuguauuuuuaguagagacacgguuuugccauguuggccgggcuggucucaaacuccugaccucaggugaucugccugccucggccucccaaaaugcugggguuacaggcgugagccaccaugccuggccugaguuuuagacuuuuaaaagcuaauagaaguauuggcuggacgcgguggcucaugccuguaaucccagcacuuuggcaggccaaggcggguggaucaugaggucaggaguucaagaccagccuggccaagguggugaaaccccaucucuacuagaaauacagaaauuagucacgguggcaggugccuguaaucucagcugcuugggaggcugagucaggagaaucgcuugaacucaggagguggagguugcagugagccgagauccugccacugcagucuagccugagugacagagcaagacuccaucucaaaaaagaaaaguauuuauuguuuuuauuuuuuuugaauagcuuuuuucuguuuuuuagguauuuaaaaggaacaugccucuuccaagaauaggcauguaaaaaguauauaucuuuuaacucacaguugcugugaauacaaaggaauaauuuuaauuuuguacauuuuuuuuccccuuagcacgagaagcccugccaacgugggauaagcagauccaaucacuuuguuuccaagugaauaaccuuuuggagaaaauuagucaaacagcaccagaauggacagcacaagccauggaagcccagauggcucagugaauccuugcagaacuucugugcacaugacaucuuuuuccauguugugcagaucaguuucacuaucuccaaagcauuugcaucaugaccuuauacauuucaaucccuuuuaugcuggauuccguuuaaagaagacauuauuagagcaggaaguacaagcauuuaaaauauguaguucccauauauuucagggucucuguguauuaagcuaacucagauguuuugaaagcuuuuucuuuaaacagaggugaaauaucuguggcuaaaaaguuugagauuugugauaacuuuguagucauguaaaacuuaagugcuucaugccucuccaaaugugguuauucuaauaaauggagaaaugagccaaauaaaaguaguacuuuguuuuuaguua
